US007309815B2

(12) United States Patent
Shukla et al.

(10) Patent No.: US 7,309,815 B2
(45) Date of Patent: Dec. 18, 2007

(54) NUCLEIC ACID COMPOSITIONS CONFERRING DISEASE RESISTANCE

(75) Inventors: Vipula Kiran Shukla, Indianapolis, IN (US); Holly Jean Butler, Indianapolis, IN (US); Aaron Todd Woosley, Fishers, IN (US); Pamela Rene Haygood, Indianapolis, IN (US); Cristie Min Dewes, Indianapolis, IN (US); James Patrick Connell, Indianapolis, IN (US); Ignacio Mario Larrinua, Indianapolis, IN (US); Avutu Sambi Reddy, Carmel, IN (US); Anthony Trieu, Oxnard, CA (US); Zihua Hu, East Amherst, NY (US)

(73) Assignee: Dow AgroSciences LLC, Indianapolis, IN (US)

( * ) Notice: Subject to any disclaimer, the term of this patent is extended or adjusted under 35 U.S.C. 154(b) by 153 days.

(21) Appl. No.: 10/487,902

(22) PCT Filed: Aug. 30, 2002

(86) PCT No.: PCT/US02/27883

§ 371 (c)(1), (2), (4) Date: Aug. 20, 2004

(87) PCT Pub. No.: WO03/020905

PCT Pub. Date: Mar. 13, 2003

(65) Prior Publication Data

US 2005/0019767 A1 Jan. 27, 2005

(51) Int. Cl.
*C12N 15/87* (2006.01)
*C12N 15/82* (2006.01)
*C12N 15/11* (2006.01)
*C12N 15/00* (2006.01)

(52) U.S. Cl. ............. 800/279; 435/320.1; 536/23.74; 800/298

(58) Field of Classification Search .................. None
See application file for complete search history.

(56) References Cited

U.S. PATENT DOCUMENTS

| 5,891,673 | A | * | 4/1999 | Hashimoto et al. | ......... 435/69.1 |
| 5,990,388 | A | | 11/1999 | Roth et al. | ................. 800/301 |
| 6,087,560 | A | | 7/2000 | Cornelissen et al. | ......... 800/301 |
| 6,100,449 | A | | 8/2000 | Fluhr et al. | ................. 800/279 |
| 6,100,453 | A | | 8/2000 | Aldwinckle et al. | ........ 800/301 |

OTHER PUBLICATIONS

Wahl et al, Methods Enzymol. 152: 399 (1987).*

* cited by examiner

*Primary Examiner*—James Martinell
(74) *Attorney, Agent, or Firm*—Kenneth B. Ludwig

(57) ABSTRACT

This invention encompasses the identification and isolation of genes that confer disease control properties in plants, as well as plants comprising such genes. These genes are derived from the following sources: *Nicotiana benthamiana*, *Oryzae sativa* (var. Indica IR7), *Papaver rhoeas*, *Saccharomyces cerevisiae* and *Trichoderma harzianum* (Rifai 1295-22). The control conferred is against the one or more of the following phytopathogens: *Aspergillus flavus*, Cercospora zeae-maydis, *Fusarium monilforme*, *Fusarium graminearum*, Helminthosporium maydis, Phoma lingam, *Phomopsis helianthi*, *Phytopthera infestans*, *Pyricularia oryzae*, *Pythium ultimum*, *Rhizoctonia solani*, *Sclerotinia sclerotiorum*, *Ustilago maydis*, and *Verticillium dahliae*. Further, this invention encompasses other homologous and heterologous sequences with a high degree of functional similarity.

12 Claims, 540 Drawing Sheets

Figure 1

Contig Sequences

This figure describes the sequences of contigs corresponding to genes
identified through functional screening and claimed in this patent.
Contigs were assembled from multiple sequencing runs and are named for the
first sequence run corresponding to that clone. Each entry header contains
the contig identifier in the following format: SEQ ID NO; contig name;
source organism.

> SEQ ID NO:1 103532_300363_1 Nicotiana benthamiana
TGGTATGAACGCAGAGTGGCCATTCGGCCGGGGATATCACCCAATTACAATTACTTGTCGGTGAACTAGCAAATA
TAAAGTGTGACTATATAATTTCACATCCCTTTCATTTACTTCCATTGTTCACATTCAATCAATTGGAGCAAAAAA
GGGTACCTTTGGATCAAACAAGTAAGAAGCAAAGATATGGGTCGTGGAGTCAGCAGTGGAGGAGGTCAGAGCTCA
TTAGGATACTTGTTTGGGAGTGGTGAGGCTCCAAAATCTACCCCAACAAATCCCCAGGCTGTTCAAAGTGAAGCT
CAGCCAATAAATAAAGAGCCATCTCCAAAGCCTGTTGCTGCTGCTCCTCTTGCTGATGCTACTAAGCAGATTCCC
GCAGGTATTCAGAGTATCAGGGCAGATGGTCAAAACACGGGCAACTTTATCACGGACCGACCATCTACCAAAATC
CATGCTGCCCCTGGTGGTGGATCTTCTCTGGGATATCTCTTTGGTGGTGGCAGCAGCTGATAAAGACATCCCAAA
TCACCCATCACGGTTTTATTATTTCTGTACGTTATCTTTCAACTATGTTGTAAGTGTGATTGTGAGTATTGCAGA
ATGTCAGTGTTATTTTATGTTGCTACCTAGTGGGTGAGGGAGTTTTCTGTGTC > SEQ ID NO:2 103578_300363_1 Nicotiana benthamiana
TGGTATCAACGCAGAGTGGCCATACGGCCGGGGACTCAACACTCAAATTACAATCCAAAAGCTTATATTTTTTCT
GTTACTTCTCTGTACTCAAGCTTTGTTAACAGTTCGTTCACAACAATGGAAGCAGCAACCAAGACGACCAAAGGT
GCCGGAGGAAGGAAAGGCGGAGGCCCAAGAAAGAAGGCTGTAACCAAATCTGTCAAGGCTGGTCTTCAGTTCCCA
GTTGGTCGTATTGCTCGTTTCCTGAAGAAGGGTCGTTATGCTCAGCGTGTTGGAAGTGGTGCTCCAATTTACCTC
GCTGCTGTTCTTGAATACCTTGCTGCTGAGGTGTTGGAGTTGGCTGGAAATGCAGCGAGAGATAATAAGAAAAGT
AGGATTGTTCCTAGGCATGTACTTTTGGCAGTAAGGAATGATGAAGAGTTGGGGAAATTGCTGAGTGGAGTTACC
ATTGCAAGTGGAGGTGTTCTTCCAAACATTAACCCAGTCTTGTTGCCAAAGAAATCTGCTGCAGCCGAGGAGAAG
GCATCAACGCCCAGGTCCACCAAGTCGCCAAAGAAGGCGTAGGACTATCAATTACAATTGATCTTTTGGTAAAAT
ATGGCGGGCCACTCTTTTGTCTAGTTTATTGGTATACTTCTTGT > SEQ ID NO:3 104218_300060_1 Nicotiana benthamiana
ATCAAAATGTTTTGGAAAACTAATCTTTTTATTTGTGTTTCTTTGGCTATTTTGCTAATAGTAATACTCCAACTA
GCTGATGCAAGGGAGATGTCTAAGGCGGCTGCTCCAATTACCCAAGGAATGGATTCAAACAACATTAGTGATCAA
GCGGGTTATGCTCGGGTTTTACGTTGTTTGGCTTGCAGATGTTGTGTCGGTTAAATTTTATATATTTTTTACGAT
CAAATATTATACAATGTTTTTGTATGTGCTAAAAGTAATAATACTCCAAAATAAGGCACAACATTGTGGTAGTAT
TAGTTTGTGTTGTTATACATGTCTTGTCCGGTTGTCTTTCAACTTTGTGGTACTGTAATTTTAATTCTGGTCAAT
AAATAGTACTACTAATTAGTGTATAAGAAAAAAGAACAA > SEQ ID NO:4 104251_300060_1 Nicotiana benthamiana
AGAAATGATTGGAAATGTCATGATAGATGCTCGATCAACAGGAAAATACTATCATTTTGTGCGGCTCATGGGGCG
TGCTGCTTCACACATTACTCTAGAGTGTGCTTTGCAAACTCATCCAAACATTACTTTGATTGGAGAAGAGGTATT
TGCAAAGAAACTGACTCTTAAGAATGTTACCGACTACATTGCTGATGTGATCTGCAAGCGTGCAGAGTCAGGTTA
CAATTATGGAGTGATCCTCATTCCTGAAGGACTTATAGATTTCATTCCTGAGATTCAGCAACTCATTGCGGAACT
AAACGAAATATTGGCTCATGATGTCGTGGATGAAGCTGGTGTTTGGAAAAAGAAGCTTACTCCCCAGTGTCTTGA
GCTCTTTGAGTTGCTGCCCCTAGCAATTCAGGAACAACTGCTGCTTGAGAGAGATCCACACGGAAATGTCCAGGT
AGCTAAAATTGAAACTGAGAAAATGCTTATTCAAATGGTTGAAACTGAATTAGGTCAGAGGAAGCAGAAGGGTGG
ATATAATGCTCAATTTAAAGGACAATCCCACTTTTTC > SEQ ID NO:5 104421_300364_1 Nicotiana benthamiana
CCAGCTTGGTTCTCCTTCACAGCATCAGAAGAATGCATTTCATCTTGCTTCTCTGCAGCCTCCTCAGTAGTTTGG
ACTTCATCTTTCTTCTCTACATCTTTCTCCATATCCTTGTTTTCATCTTTTCCCTCATCCTGTTTCTGTTCGACC
TCCTTCTCAGCTTCCATAGACAGAGTATCCTTTTCATGTTTTTCAGCTTCTTGCATGTCAACATCCTTTTCATCC
TTTGCCGCTTCTGTTTCTTCATGGACTTCATTGTCTTTCACAGCCTTCTTAGAAGCTGAAGATTTTCTGCTTCGC
TTTTTTTGGAGTCTCACTTTCCGCTGAAGGTGAAGCTGCCTTTGCCTTTCCACTGAGTCTTGAGGATCTTCTCGG
AGTTTCACCAGCTCCCCAGTCAAACTCCGTGATTGGCGGACTGCCAGGGTGTGACTTCAGGTACTGCTCCAACTG
TCTCTTTGTAGTGATCTCCTCCCCCGTTGGCGCAGTAAATACGATCTCTTTTTTCTTTGGAGTCCCTCCTCCTCC
TTTCTTGGGCAGAAACTTCTCAAATAAATATTTATAAggtcctgctcttagagcccggccgtaatggc

Figure 1 continued

> SEQ ID NO:6 104423_300364_1 *Nicotiana benthamiana*
ggtgggttTTTTAAACACAAACAAAATCGCATTATATTGTCAGGTAACTCACAACAGCTTTACAAGGCCATCAAA
CAATCAGAATTTTGAGAATGTTTTAAGATTCACTTTCCGGGAACAAAGTTTGTGGCGTAGGCCCACGCATTGTTG
TTAACGGGGTCTGCAAGGTGGTCAGCAAGGTTCTCCAATGGACCTTTTCCGGTAACAATGGCCTGAACAAAGAAT
CCGAACATAGAGAACATGGCAAGTCTACCATTCTTGATCTCCTTTACTTTGAGCTCAGCAAATGCCTCTGGGTCA
TCAGCAAGGCCTAATGGGTCAAAGCTGCCACCAGGGTAGAGTGGGTCGACAACTTCACCAAGAGGCCCACCAGCA
ACGCGGTAACCCTCAACGGCTCCCATCAAGATAACTTGGCAAGCCCAGATGGCCAAGATGCTTTGTGCATGGACC
AAGCTTGGGTTGCCCAAGTAGTCAAGTCCACCCTCGCTAAAGATTTGGGATCCAGCCTTGAACCAGACAGCTTCG
CCAAACTTGACACCGTTACGAGCCAAGAGCTCAGGGAAGACACATCCAAGAGCACCAAGCATAGCCCCCCTgcag
tggatcacttcgagttccccggccgtaatggc > SEQ ID NO:7 104431_300364_1 *Nicotiana benthamiana*
acAATAAAGTTGTCTCCATATGacGAATAGGCCACGGATTCgaGCCGTGGAAACAGCCACTAATGTTTACATAAG
GGTAGGTTGTCTATGTCACACCCCCTCGGGATACGGCCCTTTCCTGAATCTTGCATAAACGCGAGATGCCTTGT
CATCGAGCTGTGCCCTTTAACAAAGAGAAATCACTAAGGTATCATCTGATTAACAGTGATGTCTTCTTAGACAAA
CTGGTTCACCTAGATCACTAAACCTAAAGTTAAAgtGTTCCTCATTCATCTAACAATCATCTCTATCAGATGCG
TAAACCATTTCACCTTGccttCTCAAAGTTCTCAAATGTTATCCCGGCCGTAATGGC > SEQ ID NO:8 104874_300366_1 *Nicotiana benthamiana*
CTTGGCAACAGGTGGTCCAAGATTGCTTCTAATTTACCGGGACGAACTGATAATGAAATCAAGAATCACTGGAAT
ACACATATTAAGAAGAAGCTGAAGAAAATGGGGATTGATCCAGTCACACACCAGCCAATTACTGTTAACCAACCA
AACATAGAACAGCCAACAAAAAATCAACCAATTATTCAACAAGAAAAACAAACAACAATGCCAATTTCCCCATCT
CATGTTGTCCCAGAAATAATGGATATTCTTGATCACAACAAGGAGCTGGTTGAAACTCCTATATTATCAACAATC
ACAGATATCAAATTAGACGACGACAACAACAATAACAGCAATATCAACAATAATAAGAATACGGGGACAAGCTTC
TGTACTGACGAAGTCCCCGTAATTAAACCACATGAAATTTTATTCCATTCTGAATCAACCACTTCAACATCATCA
TCTTCTTCACCAACATCCATTATTCTTGAAGATACGCAGTTTGATTTCAATTGGGGAGATGATTTCAGCAGAACA
TTGGATTATTTACTTAATGATGATATTGACATGAATAATGTCATTTCCCAAGATTGGTCAAAGGTGTTGGAAGTT
TGAGCAAATTTTACTTGTGATTAATTTTCAAAGGGGGGCTGAATTAAGCTTTGTTCTTTTGATTGGCAAGTCACT
TTTTTC > SEQ ID NO:9 105059_300046_1 *Nicotiana benthamiana*
AATTTTCATTAATGATGGCAGAAGAAACAGCTAAGGATGTTGCCGATGATAAAGCCATCGTTCCATTTGCTCTTC
CTTCTTCTAAAGAAGAAAAAGACAAATCCAATGACTCAAAACCTCTTGCCATCGTCGAAACTAAAGCATTAGTAC
CTGTTGAGAAAAGAGGATCTATTGATAGAGATGCAACTCTTGCACGATTTACGACAGAGAAGAGGTTGTCCCTAA
TCAAAGCATGGGAAGAAAGCGAGAAATCAAAAGCTGAAAACAAAGCTCAGAGAAAGCAATCTGAAATCCTTGCAT
GGGAGAACAGCAAGAAAGCAAGCTTGGAGGCTGAGCTCAAAAAGATTGAGGAGCAATTGTTGAAAAAGAAGGCAG
AGTACATTGAGAAAATGAAAAACAAGATTGCTCTACTCCACAAGTCAGCAGAAGAAAAGAGAGCGATAATTGAAG
CTAAACGTGGAGAAGATCTTCTTATGGCAGAGGAAACAGCAGCAAAACACCGTGCCACTGAAACTTCTCCAAAGA
AACCTCTCCTTGGATGTTTTTGAAGTGGCAAAATATCATATACTCCTATACAATTATTGGTTACAAACATTGTAT
AGTGAAGTGTGCGGACTGGGAATTTCTTTGCATTAG > SEQ ID NO:10 107031_300262_1 *Nicotiana benthamiana*
AAGTCTACTAAATCCAGGGCTGGTTCTGTGGTAGCAAAGGATGGAGACAAGAGTGTATACTTTGATTTAGAGGAC
TTGGGCAACACCACTGGGCAGTGGGACTTGTATGGTTCAGATGCACCTTCACCATACAATCCCCTTCAGAGCAAG
TTTTTCGAGACTTTTGCTGCTCCTTTCACTAAGAGAGGTCTGTTGCTCAAATTCCTGATATTGGGAGGGGCTCA
ACTCTTGCATACTTCAGTTCAACAGCATCAGCGGATATATTACCAATCAAGAAAGGACCTCAACTTCCACCCAAG
CTTGGGCCACGCGGAAAGATCTAATTTCTTTTCAATCCAACTT > SEQ ID NO:11 107690_300380_1 *Nicotiana benthamiana*
AAATTTCAGAAGGTTCACCTAAATGGCTCATGCTATGGCTTCAGTGGGTGGCCTAATTGGTTCTTCTCAAACTGT
GTTGGATGGTCAGCTCTGTGGTTCAGCCCGTTTGAGCACTGTTAGCACCAGCAGAATTGCCTTGGCTAGACCAGG
TCTCAGCATTAGAGCCCAACAGGGGTCTGCTGACACTGAAACTAGCCGTAGAGCCGTCATCGGTCTTGTTGCTGC
TGGCCTTGCTGGTTCCTTTGCTCAAGCAGCCTTTGCTGCAGCTAAATCAATCAAGATTGGTGGCGCTCCTCCTCC
CTCCGGTGGATTACCTGGAACTTTGAACTCGGATGAGGCAAGGGACTTTGGTCTACCACTTAAGAAGAGGTTTTA
CCTTCAACCATTGACTCCAGCTGAAGCAGCCCAGAGAGTTAAGGATTCAGCCAAGGAGATTGTTAGCGTCAAGAA
TTTCATCGACAAGAAGGCCTGGCCATATGTCCAGAATGACCTTCGTCTCAGAGCAGAATACCTTCGCTATGACCT

Figure 1 continued

TAAAACCGTAATCTCAGCTAAGCCAAAAGAAGAGAAGGGAAAGCTCCAGGACCTGACTGGAAAGCTCTTCAAGAC
CATTAGTGATCTGGACCATGCAGC

> SEQ ID NO:12 109076_300042_1 *Nicotiana benthamiana*
AACCACCCAAAATTTACCCTGCCGATGACGTGGCAAAACCGCTTGTCAACAAACACAAACCAAAACCCACGAAAC
TTAGAGCAAGTATTACACCTGGTACTGTTTTAATTATCCTTGCCGGTAAGTTTAAGGGTAAGAGAGTTGTGTTTT
TGAAACAGCTTAAATCTGGGCTTTTACTTGTTAGTGGACCATTTAAGCTTAATGGTGTTCCTTTGAGGCGTGTGA
ATCAAGCTTATGTTATTGGTACTTCAACTAAAGTGGATATTTCTGGTGTGAGTGTTGAAGAAGTTTGACGATAAGT
ATTTTGCAAAGCAAGCTGAGAAGAAACAGAAGAAGGGTGAGGGAGAGTTCTTTGAAGACAAGAAAGAGGAGAAGA
AGAATGTGCTTCCACAGGAAAAGAAGGATGACCAGAAAGCTGTGGATGAAGCATTGATCAAAGCCGTTGAATGTG
TTCCTGAATTGAAGGCTTATTTGTCAGCTAGGTTCTCCCTCAAGTCGGGCATGAAACCCCATGAGCTTGTCTTTT
AGGCTGTGAGATGTTTAAAATACTCTTTATGAAATTGATTTTGTTAGATTTATTTTGGGTTATGTTCTGTTTTGG
ACCT > SEQ ID NO:13 109576_300051_1 *Nicotiana benthamiana*
TTTAAAGGAAAAAAAAGGAAAAGAGAGAAAGAGAAATCTTTCTGTCTTAAGTGTAATTAACAATGGCTTCCTCAG
TTCTTTCCTCAGCAGCAGTTGCCACCCGCAGCAATGTTGCTCAAGCTAACATGGTTGCACCTTTCACTGGTCTTA
AGTCAGCTGCCTCGTTCCCTGTTTCAAGGAAGCAAAACCTTGACATCACTTCCATTGCCAGCAACGGCGGAAGAG
TGCAATGCATGCAGGTGTGGCCACCAATTAACAAGAAGAAGTACGAGACTCTCTCATACCTTCCTGATCTGAGCG
TGGAGCAATTGCTTAGCGAAATTGAGTACCTCTTGAAAAATGGATGGGTTCCTTGCTTGGAATTCGAGACTGAGC
GCGGATTTGTCTACCGTGAACACCACAAGTCACCGGGATACTATGACGGCAGATACTGGACCATGTGGAAGTTGC
CTATGTTCGGATGCACTGATGCCACCCAAGTGTTGGCCGAGGTGGAAGAGGCGAAGAAGGCATACCCACAGGCCT
GGATCCGTATTATTGGATTCGACAACGTGCGTCAAGTGCAGTGCATCAGTTTCATT > SEQ ID NO:14 113128_300022_1 *Nicotiana benthamiana*
CACAATACTACTTCTTTTTTCTTCTTATTTTTTGCTAAGAATTATAATCATGGCTACTACATGGTTTTCTTTTT
TCTTGAGTTTCCTTTTGCTTTTGCATGGCAATTATGCTCAACAAAGGTCTCACCATCAATATGGCCAGCAGTGTC
AAATTAACAGACTCAATCCACAAGAGCCTTCCTTTATAATGGAAGCACAAGCTGGAGTTACTGAGTTTTTTGACA
GAAATAATCACCAATTTCAATGTGCTGGAGTTTCACTATTTCGCCATGTTATACAATCCAGAGGCCTTCTCTTGC
CTTCTTATACTAATTCTCCACTGCTTGCCTATGTTGCTCAAGGTCGAGGATTTTATGGGATCATGAACTCGGCTT
GCCCCGAGACATTCCAATCATCTCAACAAACTCAACAGACAATTATAGGCAGAACATTTCTAGACCGTCATCCAA
AGATTGAACAATTTATGCAGGCTGATATTATGGCATTTCCTGCATGTGCTGCACATTGACTCTATAATGAACGAA
ATGA > SEQ ID NO:15 113145_300022_1 *Nicotiana benthamiana*
ACAATTTTAAGTATCATACCAATAGCTGTGCCAGTATCTGGGAGAGCTCAATTTTTAGTCAAAGGCTATAATTTG
TCAAAGCCATCCACAAGGTTACTTTGTGCTTTATAAAGTAATTACCTGGTTCCAGAAGCTAATAATGAGGTAGAA
GAAAATATTGATGGCATTGACAAGGATGATAAGCTCCAATCCCTAAGTTTCACATGTTCAGTTCCAGCAGTTACT
GGAAGAGGATTTATTGAGGTTGAAGATCACGGACTTAGCAATAGCTTCTTCCCTTTCATAGTTGCAGAGGAAGAT
GTTCGCTCTGAGATCCGTATGCTTGAGAGTGAATTAGACTTGACTTCAGCTAATTATGTCACGGGACATATAAAT
AATATGGAAGCATGAAATCAAGCCATGGATTTTATTCATGAACTGGGTTGGCTGCTTCATAGAAATAATTTGAAG
GCTAGATTAGAGCACTTTGGTCCTGATGCTGTTCTCTATCCTTTGAAGCGGTTCAAGTGGCTTATTGATTTCTGC
GTAGACCATGAATGGTGTGCAGTAGTTAAAAAACTGTTGAATATTCTTCTTGATGGAACTGTGGGCGCA > SEQ ID NO:16 113718_300005_1 *Nicotiana benthamiana*
ATTTGGTGCAAAGCCAATCTTGGGTATTTTTGTGTGTAGAGGCAGGCATTTGTTGGTTTACAACATGAACCAAGA
AATGAGTGGCGTTATAGTTGCGGATCAGAAGCAGCAGCAAGAAATGAAAGGTGTGAATGGGGGTGTTCATGAGGA
TATTAAGATTGACTACGTGTTTAAGGTTGTGGTAATTGGGGACTCTGCTGTCGGTAAAACTCAGGTGCTGTCCAG
GTTTGCCAAGAATGAGTTCTGTTTTGACTCCAAATCTACCATTGGTGTGGAGTTTCAGACTAGGACTGTCTCCAT
TCAGTCCAAAATCATCAAAGCCCAGATCTGGGACACTGCTGGCCAAGAAAGGTACAGAGCAGTGACAAGTGCATA
TTATAGAGGAGCACTAGGAGCTATGTTAGTTTACGACATAACAAAGAGACAGAGCTTTGATCATGTAGCTAGATG
GGTTGATGAACTCAGGGCTCATGCCGATAGTTCCATTGTGATCACGTTGATCGGTAACAAAGCTGATCTAGTCGA
CTTG > SEQ ID NO:17 114987_300010_1 *Nicotiana benthamiana*
TTTGTTAATTTCATGTTTTTAATTGGTGGTGGATGAAGATAGATGGAGACTCCTCAAGAAGAAGTGGTAGGAGTC
TCTAATGACCTCTCCCACATTGTTAAGGGCAAGCGGACTAAACGTCTTAGGCCTCAATCTCCCATCCCTTTCACC
ATCTCCGTGCATTCATCAACTGGTGATAATGGCGGAGATGGTAGAGAGATCGCCATCATTAACAATAATAATAAT

Figure 1 continued

AGCGACAGTAATATTAGTCAGCCTCTTGCCACTTCAGCTGAAAACTTCCCTTATGAGGATGTCCCCACCGAGGAA
GAAGAAGAAACGGCCAAGTGTCTAATCCTCTTGTCTCAAGGTGGTCATCCTTCTTCACGTCAAAGATTTATAGAA
TCACCACCTAAAAAATTGTTCGATCTTTTCAATGATGACATGGGGTTGTACCCAAGCAAATACAATAGCAAAAGG
TACGTTGAGACGATTAATATTGGAAATGGTGCCAAGGCAGGGACAGATGTGTACGAATGCAAGACATGTAATCGT
ACATTCCCCTCATTCCAAGCCTTAGGTGGACACAGAGCAAGTCATAAAAAACCAAAACCACTAACCATTGAACCA
AAAAAATCATTCTTCTATTTTTC

> SEQ ID NO:18 115121_300012_1 Nicotiana benthamiana
TTTCTGTCAAAACCTAACCAGCACTTCTTCCCCCGGGGCACCGAACCTTCGGCCGTCCGGCAGAGAACGTCACCT
CAAATGGAGTTCGATGAGTACGATTATCTGGAGAAGACTGTAGAAGAGCCCAACGGTGGTCCTTCTACAAAGAGC
AAAGACAACAACAACAACAGCAGCGCTGAGAAGGAGAAGAGCGAGAAAGCCTATCGCCGGAGGGAGAGAGACGGG
AGCGAGGAATACGCTGCCGAAGACGACAATAGAGATCGCCGGAGCAGCAAAAGGTCTCGCGGCGACGGCGAAAAG
GATAAGGATAGAGATAAAGATAGAGATAGGGAAAGGGAAAGATCTTCGAGGCATCGGAGCAGGGAGCGAGAATCG
GAGAGAGACAGAGAGAGAAGCTCAAAGGACCGAGACCGAGAACGTGACAGAGAGAAGAGGGAGAAGGAGAAAGAG
AGGGAGAAGGAGAAGGAACGAGAGAGGGAGAGGAAGAGTAGAGATCGGGATAGGGAGAGAGATAAGGAACGGGAG
AAGGAGAAGGATAGAGAGAGGGAGAGGTCAAGGAGGAGCCGGAGTCGCTCCAGGATTGAACGAGAGCGAGAGCGA
G > SEQ ID NO:19 116525_300078_1 Nicotiana benthamiana
CTCGAATCGAATCCACCACACGGTACCCTCCTCTCTCCTCCTCCGACCACCATGGCCATGGCCACGCAAGCCTCC
GCCGCCAAGTGCCACCTCCTCGCCGCCTGGGCACCGGCGAAGCCGCGCTCATCCACCCTCTCCATGCCCACCTCG
AGGGCACCCACCTCCCTCAGAGCGGCGGCGGAGGATCAGCCCGCCGCGGCGGCGACGGAGGAGAAGAAGCCAGCC
CCCGCGGGGTTCGTGCCGCCGCAGCTGGACCCCAACACGCCGTCCCCGATCTTCGGCGGGAGCACGGGGGGACTC
CTCCGGAAGGCGCAGGTGGAGGAGTTCTACGTCATCACATGGACGTCGCCCAAGGAGCAGGTGTTCGAGATGCCC
ACGGGCGGCGCCGCCATCATGCGCGAGGGCCCCAACCTGCTGAAGCTGGCCAGGAAGGAGCAGTGCCTGGCCCTG
GGCACCAGGCTCCGCTCCAAGTACAAGATCAACTACCAGTTCTACCGCGTCTTCCCCAATGGCGAGGTGCAGTAC
CTCCACCCCAAGGACGGCGTCTACCCGGAGAAGGTCAACGCCGGCAGGCAGGGCGTCG > SEQ ID NO:20 120380_300384_1 Nicotiana benthamiana
CAAGATTGCAACTCCTGTCTTACGGATTCAATACTCGCGTTGTGTTCTGCAGATAGCTGAACAGCAAGTACCTCT
CCTGTTGCCTTGACAAGCCTACCTAGGACTGCTCGAGAGTCACCAAGGTTGGCAATATATAATGTCCCGTTGCAG
ATAACTCCAACAAGACAGCATGATCCAACAGCAGCAATCTGTGGTTTCATCGGCCATTGACTTGATACAACAGAG
AGGAAACCCTCTTCTGTTGCTTGAAATGCCTTTCGAATCACGTCCACAGACATTGATTGCTGCTCAGAACTGAAC
CCTGCAAGATTAGAAGTTAAGTGAATAAGCGACAAAACAGATTCAGCCCCCCTCTGGTCATGAATCACCCAAAAT
AGCTCAATAATGGATACAAAATGGAAAGAAGAAGTTACTCTTGAGATGTTGAAAGAGGTGATTATTGATGAATCT
TGAAGTCTCAGGACCGCCATGGCCATCATAAACTCCAACAAAAGTACCATAAGGACCAGAATCATTTAAGCTCAA
GCAGCCAGATTTAAGTTGGCTCTGGTCTTCCAGTAGATTATTAGCTTGAACTACAGCCATTGAGAACTCTCCATT
AAAATGTTGTCCAATATCCTTATACCATAGGAGCCCATCTTGACGACCGCCGGCATCTGAACTT > SEQ ID NO:21 120445_300385_1 Nicotiana benthamiana
TGAAGGAGAAGAGGATGTTCGGGCCTGGTTCCCTTGCCCTTTGTGTTATGTTGAAATTGAAGTCCAGATGCTTTG
CAACCATTTGCAAGAAGAGCATTGCTTTGACTTTAGAAACGCGGTTTGTCCCATATGTGCTGCAAATTTAGGTAA
AGATCCTTTGGGGCATTTTACGTTGCAGCATGCACAATCAGTAAAGAGGAGGAGAAAATACCAGAAGTCAGGCTT
CTGGAACAATGCTTCAGCAATAAGTGGCAAGGATCCCCATGAAATAACTTCATTCTTGTGCACAAATTTAATGGT
TGGCCGCTGCAATGTACAAGAACCTGCTCCTGATCCCCTTCTGCTGCCATTTCTCTGCAGTACGGCTCATTCTGA
TTCAAAAGATGGTCTACAAGATGAGTCCCTGGTAGTGTTGCTGCTACTCCTGATGCAGAAAGGTACCTGTAATT
TTGTTATGCATGCGTATATATATTAATTCATTTCTCTCAGCTTTCCTGCAAATCTAACAAAAAACAAATTGGAA
TCACTAGTGCTAAATGTGAAATAATATATAAGCAAACTTGCAATTCCTACTAGAAGATGTACCTTTCTGTATAAG
TCGTCACTGGAAT > SEQ ID NO:22 120677_300428_1 Nicotiana benthamiana
GTTATCCACCTGGTGACCCCAGCAAACGTGCATTTGCTTACGTTGTCTTGACAGGAGGCAGGTTTGTCTATGCCT
CATTGGTTCGCCTCCTGATTCTTAAGTTTGTTCTGAGCATGTCTGCCAGTAAAGATGTCCTTGCACTTGCTTCTC
TTGAGGTGGATCTTTCCAGCATTGAACCTGGGACAACTGTTACTGTCAAGTGGCGTGGGAAGCCTGTTTTCATCA
GACGCCGTACTGATGAGGACATCAATTTGGCGAACAGTGTCGATCTTGGCTCCCTTCGCGATCCACAACAAGATG
CTGAGAGGGTCAAAAATCCAGAATGGCTTGTTGTTATCGGGGTATGTACTCATCTAGGGTGCATACCTTTACCAA
ATGCTGGTGATTTTGGTGGTTGGTTTTGCCCATGCCATGGCTCCCACTATGACATCTCTGGTAGGATTCGCAAAG

Figure 1 continued

GACCTGCACCATATAATCTGGAGGTGCCTACCTACAGTTTCATGGAGGAGAACAAGTTACTTATTGGTTGAGAAA
TTTTGTTTAAGTTGCAGGACAACTTGTAGCTGCTGGACCTAAATTGGATCTT

> SEQ ID NO:23 120979_300518_1 Oryza sativa
GGTCATCTCCATGCAGATGGGTGCAGTGCAGGCATGCGAGCCCTACTGCCCCACCCCGACGCCGCCGGTGACGCC
GCCTCCGTCGCCGCCGTCGGGTGGAGGGAATAAGTGCCCGATCGACGCGCTGAAGCTGGGCGTGTGCGCCAACGT
GCTCAACCTGCTCAAGCTCAAGGTGGGGGTGCCGGCGAGCGAGGAGTGCTGCCCGCTGCTGGGGGGGCTCGTCGA
CCTCGACGCCGCCGTCTGCCTCTGCACCGCCATCAAGGCCAACGTCCTCGGCATCAACATCAACGTCCCCGTCGA
CCTCGTCCTCCTCCTCAACTACTGCCACAAGACCTGCCCTTCCGACTTCTCCTGCCCACTCATCTGATTCTTAAT
CTTCATTACCACCACAACCCTAGCTACCTAATTAAGGCTTAAGCTTTGCATGGCTTAGTCTGTGTGTTGCAGTTG
TGTCATACATATATACTTATCTCGATCTATCAGTGTGATTATTGATGATCAGATCGATCATCTAATATATGTATC
TTGTTATTTTAATGCGTACTGTCAAATAAAAGTTTCCTCCAGTGTACGTACGTTCTATCT > SEQ ID NO:24 122157_301608_1 Oryza sativa Contig A
CCCCATTGGGTAGCTCAGCTTTGCTCTCCTTTTATTTTTATTTTTTTTCTGTTTGTTCCAAGGTTTCTTGCAT
CACTTTGCGGCTTATCTTGTTGGTTTTCCTTCTATTTTAAGGTGTAAAGTTTGTCTCCTTGTCTTGGTTGTGCTT
GCTGTTCTTGTTTGTTTCAACCAACTTGTGCAGTTATACTTGATGCTTCTTTTTTTTTCTTTTTCTATGTGGTTT
ATGCAGGTTGTGAATTTCTTGGGGGGACACAAGAATCGTGGGATGGATGGCAATGCGAGATCGGCGGCGAATCAG
ACGAAGCAAATCGTCACGGACAACGAGCTGGTGGAGCTGCTATGGCACAACGGCGGCGTCGTGGCGCAGCCGCAG
GCGGCGCAGGCGAGGGTCGTCTCCTCCTCCGGCCGCGGCCAGAGCGCCAGCGTGCTCACCGGCGACGACACGGAG
ACCGCCGCGTGGTTCCCGGACACCCTCGACGACGCGCTGGAGAAGGACCTCTACACGCAGCTCTGGCGCAGCGTC
ACCGGCGACGCGTTCCC > SEQ ID NO:25 122157_300016_1 Oryza sativa Contig B
CCCCCCCTTAATAGCATCAGCAAGAATGCGAGGGAGACGGCGGAGAGCTCGGGAAGCTGACCCTGTGCCTGAGCC
ATTCACCATTGACGATGAGGTCTCCCATCTCACCAGGATTAGATCAGAGCCAAGTCAAAAGACTCTTGGTGCTTT
TTACGCCGGTCGCAAGAGGGGCATCTCAACGTTCGGGCTGTTGTCCGGGAGGGAGTCTGGCCGTTCGGGTGCTGG
TGGATTCTCTAGAGCCGATTGCGCTTACGCTGCCCGGAAACACCTGCCAACAAAAGGACCATGGTGTGTGGATGA
CATGACTAGTGAGGCGTATGTGTCGCAGTTCTCTAGTGATGGTTCACTGCTTGTTGCTGGGTTTCGGGGAAGCCG
CATCAGAATTTACGATGCCGATAACGGGTGGAAGGTTCATAAGGATATAAGCTGCCGAAGCCTGCAGTGGACGGT
TTCAGATATTGCTCTATCACCTGATCAGCAATTACTTGCATATTCCAGTTTGTCGCCTACTGTTCACATAGTGAA
TGTGCAGAGTTCTGCAAAGG > SEQ ID NO:26 127296_300469_1 Nicotiana benthamiana
CCCCCATTGGCTGGAAATGCAGCGAGGGACAACAAGAAGACTAGGATAATACCGAGGCATGTTTTGTTAGCTGTA
AGGAATGACGAAGAGCTTGGAAAACTTCTAGCTGGTGTAACCATTGCTCATGGAGGTGTTCTTCCTAACATCAAT
CCAGTTCTTCTGCCTAATAAATCCGACAAAGCTGGAAAAGAACCTACTAAATCGCCAACGAAGGCTACCAAGTCA
CCCAAGAAGGCCTAATTTGTGACGATGCAGGCTCGTGTGATGGCACAGTGTTCTACTTGAATCCATGTTGTATGG
ACATTGTATTGTAGCTTTGCAATTAGGAGCTTTAATGGTGGTCGTGAAATAATCTGTACTTGTATGTAGTTTTGG
TATCTATGGGTTTCATGTAGGCAACGTCTGTTGAAACTAGGGATGTTTGATTTCTGTTATGATGTAAAACTAATG
AAATTGGTTCTGTTTTTTC > SEQ ID NO:27 127573_300470_1 Nicotiana benthamiana
CCGCTCTTTTTCTTTCCTTTCACTCTTCTCGGGTCCCGTTGGAGATATTCCCCTTCATCATTTTTTCCTGAGAAA
ATTCAAATGGCCGTTCCACCCGCTAGAGCTCGAGCCGATTATGATTACCTAATCAAGCTCCTCTTGATCGGCGAC
AGCGGTGTGGGTAAGAGTTGCCTTCTTTTACGTTTCTCAGATGGCTCCTTCACGACCAGTTTTATTACAACTATT
GGCATTGACTTCAAGATAAGGACCATAGAGCTTGATAGCAAACGAATCAAACTACAAATCTGGGATACTGCTGGT
CAGGAGCGGTTCCGAACAATTACAACTGCTTACTACCGTGGAGCCATGGGTATATTGCTGGTGTATGACGTGACT
GATGAGTCATCTTTTAACAACATCAGGAACTGGATAAGAAACATTGAGCAGCATGCTTCCGACAATGTCAACAAA
ATTCTGGTCGGCAACAAGGCTGACATGGACGAAAGCAAAAGGGCTGTTCCTACATCAAAAGGTCAAGCACTAGCC
GACGAATATGGCATTAAATTCTTTGAGACAAGTGCCAAGACAAATATGAATGTGGAAGAGGTTTTCTTTTCCATA
GCTCGGGATATAAAACAAAGACTTGCTGAATCTGATTCAAAGGCTGAGCCACAGACTATCAGGATAAATCAAC > SEQ ID NO:28 130439_300487_1 Poppy
GAATTCAAAAAATAGTAATGGCTTCTTCAGTGATGGCCTCTGCTGCAGTCGCCTCCGTGAGGAGCTCTGCTCGCG
CTCAAGCTAGCATGGTTGCACCATTCAGCGGCTTGAAATCCGTTGCTGCATTCCCAGTTACCCGCAAATCAAACG
ACATCACCTCCGTTGCCAGCAACGGTGGAAGAGTTAACTGCATGCAGGTGTGGCCACCAAGTGGTTTGAAGAAGT
TTGAGACCCTCTCATACCTTCCCCCATTGACCGTCGAGCAACTATCCAAGGAAGTCGACTACCTTCTCCGTAATG

Figure 1 continued

GATGGGTTCCCTGTTTGGAATTCGGTGCCAGAGGATTCGTCTACAGAGAACACGGTAACACCCCTGGATACTACG
ATGGTCGTTACTGGACAATGTGGAAGCTACCCATGTTCGGTTGTACCGATGCTTCCCAGGTTATCAAGGAACTAG
AAGAGGCCAAGGCTGCATACCCTGACTCTTTCATCAGAATCATTGGATTCGACAACGTTCGTCAAGTACAATGTG
TTAGTTTCATCGCATACAAGCCCGAGAGCACCAGCTACGAACAGTAAAGGATGAATCTTAATCAAGGAGCATAAT
CCAATTCATTTCTGTATC

> SEQ ID NO:29 130630_300489_1 Poppy
GAATTCAAGGGGTAGATTTTCCATATTTTATTCTGAATGCACCAAGCAACATCTCTATGTTTTTTCCTTCAAACT
GTTTCCCGTTATCTGATACCAATTGTGCTGGGATTCCAAATCTGCAAATTATATTTTCAAAGATGAAAGTGAAAA
CATCCTTATCGCGGATGTGCTGAACAGCTTTCACTTCTGCCCATTTGGTGAAATGGTCTGTCGCAACTATCAAGT
ATCTCTTTTGTCTTGTACATGATAAGAAAGGTCCACAATATCTAGCCCCCACTTTCCAAAGGGCCAACAACTTGC
TGATGAGGTTAAGGACGCTCCTGGGGCATGTATTCTTTTGCCATGGCGTTGACAATCTTTACATCTTTGCGACAG
CTTTTTTGGATCATCATGCATATATGGCCAAAATACCCTTGCGTCTTAGCTCTGTGGGATAATGATCTCCCTGC
ACTGTGATTGCCGGCTTCTCCGCTATGCATCATCTGTAATATATTTTGTCTTTCTTCTTTTGATAAACATCTAAT
AGATGGTCCACTAAAGGTTTTTCGATATAATATTCCTTCTCTTAATTCTTAGTTAGTAGCTTTACCTCTTAACTT
ATGGGC > SEQ ID NO:30 130744_300490_1 Poppy
GAATTCAAAATTAGGGTAAACCTAATTTACAGTGGGAGAACTCAATCATGGCGAGGGGATTGAAGAAGCATTTGA
AGAGGCTTAATGCCCCCAAACATTGGATGCTTGATAAACTTGGAGGCGCTTTTGCTCCCAAGCCATCATCAGGTC
CACACAAATCTAGGGAGTGTCTTCCCTTGATTCTTATCCTGCGAAACAGATTGAAGTATGCCCTTACATACCGTG
AGGTTATTGCTATTTTGATGCAAAGGCACATTCTTGTTGATGGAAAAGTGCGAACTGACCAGAAGTATCCATCTG
GATTTATGGATGTTGTGTCAATCCCCAAGACGAACGAGAACTACCGTCTTTTGTATGATACCAAGGGTCGTTTCC
GTCTCCACTCAATCAAGGATGAGGAAGCTAAGTTCAAGCTTTGCAAGGTCAGAAATGTACACTTTGGATCTAAGG
GTATCCCATACATTAACACCTTCGATGGTCGCACCATCCGTTACCCTGACCCTCTTATCAAGGCCAATGACACCA
TTAAGCTAGATATGGAGAGCAATAAGATCGTTGATTTTATCAAGTTTGATATTGGTAATGTCGTCATGGTTACTG
GAGGTAGAAACAGAGGCCGTGTTGGTGTAACCAAGAACAGAGAGAAGCATAAGGGAAGTTTCGACACCCTTCACA
TCCAGGATTCTACTGGCCATGAGTTCGCCACCCGTTTGGCCAATGTGTTCACCAT > SEQ ID NO:31 131003_300510_1 Poppy
GAATTCAACTCTCCTGCTATCTTTTACAGAAAGTAGGGCTCAGATTGCAGAAGTCTGATCAGACATGGCTGCTGC
TTTCTCAACCGTTGGAGCAGTTAACAGAGCACCTTTGAGCTTGCCAAGCTCTGGCCAAAGCTCTGCCTTCTTGGG
AAGCAGCTTGAATAAGGTCAATTCTTCTGTTGCACCAAAACCATCATCAAGAAGCTTCAAAGTTGTTGCTGCACA
AGAGGTTGATCCAAAAAAGAATGAGGACAAATGGGCCGGTCTTTACTACGACCAGTCTGATGATCAACAAGACAT
CACCAGAGGAAAGGGAATGGTTGACTCCCTTTTCCAAGCTCCTATGGATACCGGAACTCACAATGCTATCATGAG
TTCTTATGAATACGCCAGCAAGGGGCAAAGAACATACGACTTTGACAACACCATGAGTGGATTCTACATTGCTCC
AGCTTTCATGGACAAGCTTGTTGTTCACATTACCAAGAACTTCATGACCTTGCCCAACATCAAGGTTCCTCTAAT
TTTGGGAGTCTGGGGAGGAAAGGGACAAGGAAAATCATTCCAGTGTGAGCTTGTCATGGCCAAAATGGGAATCAA
CCCAATCATGATGAGTGCT > SEQ ID NO:32 131272_300512_1 Poppy
GAATTCAAAACACAGAGCAACAAAGTCATCGTACTTTAAAAAAAAAAAATGCCTGCACGAAGAAGAACCCTTTTA
AAGGTCATAATCCTCGGCGACAGTGGGGTTGGGAAGACTTCTCTGATGAACCAGTATGTGAATAAGAAGTTTACT
AATCAGTATAAAGCAACCATTGGAGCTGATTTCCTGACTAAGGAAGTTCAATTTGAAGATAGGCTTTTTACTCTA
CAGATATGGGACACGGCTGGGCAGGAAAGGTTCCAAAGTCTAGGCGTTGCCTTTTACCGTGGTGCAGACTGCTGT
GATCTTGTATATGATGGTAATGTTGCCAAGTCATTTGAAAATTTGAACAACTGGAGGGAAGAATTTCTTATTCAG
GCTAGCCCATCAGACCCAGACAATTTTCCCTTTGTTGTTGTGGGTAACAAGGTTGACGTGGAC > SEQ ID NO:33 135281_300412_1 Poppy
GCTAGCCACGCCGTCCGCTCGGGCCGAGGCGCATCGCGCGGGGGAGAAGGGGAGGAGAAGATGTCGAGCGACGG
AGGGCCGGTGCTTGGCGGCCTCGAGCCGGTGGGAACGAGAACGACCTCCACCTCGTCGACCTCGCCCGCTTCGC
CGTCACCGAGCACAACAAGAAGGCCAATTCTCTGCTGGAGTTCGAGAAGCTTGTGAGTGTGAAGCAGCAAGTTGT
CGCTGGCACTTTGTACTATTTCACAATTGAGGTGAAGGAAGGGGATGCCAAGAAGCTCTATGAAGCTAAGGTCTG
GGAGAAACCATGGATGGACTTCAAGGAGCTCCAGGAGTTCAAGCCTGTCGATGCCAGTGCAAATGCCTAAGGCCC
ATCTCGTATCCTATGTGTATCAAGTTATCAAGAAGATGGGGAATAATATGGTGTGGATATAGCTATTGGACATGT
TAATTATCCACATGATAATATGGCTTGGATATAAGGATCTCACACGATAATATGGCTTGGATATATAGCTATTAA
AGATTTTACCTATGGCATATTTCAATGTGTATTAGTACTAAGTAAGAATGATTGCAAGGTGTATT

Figure 1 continued

> SEQ ID NO:34 135357_300413_1 Oryza sativa
GCTCTCCCCCTCCCCTTCCTCCCGCTCCGGCGAAGGCGAGCGCGCGGATCGGCGTGATGGCGGCGGCGGCGCCCT
CTCCCCCACCCGTCGCGGCGCTGGAGCAGATGAGCAGGACCAAAATGTTCGGCGGCCACAACCTCCGCTTCCGCC
ACCACAGCGCCACGCTCGGCTGCCCCATGACCTTCTCCGTCTTCCTCCCGCCGTCGCCGGCATCCGACCTCCCCG
TGCTGTACTGGCTCTCCGGCCTCACGTGCAACGACGAGAACTTCGTCACCAAGGCCGGCGCGCAGCGCGCCGCCG
CCGCCCACGGCATCGCCCTCGTCGCCCCCGACACCTCCCCACGTGGGCTTAATATAGAGGGAGAGGCAGACAGTT
GGGATTTTGGTGTTGGTGCTGGATTCTATTTGAATGCAACAAATGAAAAGTGGAAAAATTGGCGCATGTATGACT
ATGTTGTGAAGGAGCTTCCAAAAGTTTTAAGTGACAACTTTGAACAGCTGAACACTT > SEQ ID NO:35 136729_300438_1 Oryza sativa
CCGAACCTTCCAGAAGCTCCAGATTCCAAACGCAGCAGGAGTCGCCTCGCCTCCTCCTTCATCCTCCTCGTCGTC
GCCGCGGGGTCGCCTGAGATCACATTAACAATGGTGAAGGCTGTTGTTGTGCTTGGTAGCAGTGAGATTGTTAA
GGGCACTATCCACTTTGTCCAAGAGGGAGATGGTCCCACCACTGTGACTGGAAGTGTCTCTGGCCTCAAGCCTGG
TCTCCATGGGTTCCATATTCATGCACTTGGTGACACCACCAATGGTTGCATGTCAACTGGGCCACACTACAATCC
TGCCGGAAAGGAGCATGGAGCACCAGAAGATGAGACCCGCCATGCTGGTGATCTTGGAAATGTCACCGCTGGAGA
AGATGGTGTTGCTAATATCCATGTTGTTGACAGTCAGATTCCACTTACTGGACCAAATTCAATCATTGGCAGAGC
CGTCGTTGTGCATGCCGATCCTGATGATCTTGGAAAGGGTGGGCACGAGCTGAGCAAGACCACCGGAAACGCTGG
TGGCCGTGTTGCTTGCGGGATCATCGGACTTCAAGGCTGAAACCTGGAGGTGTGAACTCACCTTCCATCTCCCAG
CACCAGAAGCCTGAAACTCTACGAGCTC > SEQ ID NO:36 137131_300502_1 Oryza sativa
CCCCCGAACTTTCTGCTTGCAAAGTTTCAATGCACTGGAGTGAGTCAGTGAGGTTGGTGAAGCAGAGTGAGGAAA
GGAGGATGGGAAGGGTGGCGCCTAGCGTCGAGGAGGTCGGGGGCGAGCAGCCGCCGCCCGCGCTTGGGCCCGGCG
AGACCGTGAGCGGGACGGTGGCCGAGCTGAGGGCGGCGTACGAGAGCGGCAGGACGCGGAGCCTGGAGTGGAGGC
AGTCGCAGCTCCGGGGGCTCCTCCGGCTCTTGGCGGAGGAGGAGGCCGCCGCGTTCCGGGCGCTCCGCGAGGACC
TCGGCAAGCACCAAGCCGAGGCCTACAGAGACGAGATCGGCGTGCTTGTCAAGTCGGCGAACGCCGCGCTGCGTG
AGGTCGGGAAATGGATGGCGCCGGAGAAGGTCTGGGTGCCGCTAATCGCGTTCCCGGCAAGGGCGCAGCTGGAGC
CGCAGCCGCTCGGGGTCATCCTCGTCTTCTCTTGCTGGAATGTCCCGTTGGGCCTCTCTCTGGAGCCTCTCGTTG
GAGCATTGGCGGCCGGCAATGCGGTCGCGCTGAAGCCATCGGAGCTGGCGCCGGCCACCGCTAAGTTCCTCGGCG
ACAACGTCGGCA > SEQ ID NO:37 139377_300409_1 Oryza sativa
CGACACACACACTCCTCATCCCAGAGCAAGAAGCTCAGCTCCTCCTCCTCTCGCATGGCAGCCATGGCCACCACC
GCGTCCAGCCTCCTCAAGACCTCCTTCGCCGGCGGCGGCGGCGCACCCGGAGCTGATCCTGGCGTCGAAGGACGA
CGGCGAGATCGTGGACGCCTGAGCGAATAGAACAGGGTAAAAAAAAAATCCGCAAGACGTGGTGGTGACACGGAGG
CGTTGGGGACGAGAAGAAGATGTGGACTTTCCCCTGTGTTTTTTTTTCGGGATTTGCTTTGATCCCCTTGTTTG
TTTTAGCTCTGGATGTTGATTAGCGTCTTGTTCATAGCAATTCCACTGCCACCGTGTGTGTGCTCTGCTTGCC
TGATGAGGGCAAGAAAACTTCCATGGATCCGTCTCTCTGGGAGGAATGAATAAAAAGGATGAGGAAATAAAAATG
ATTCAGTGCCN > SEQ ID NO:38 167904_300552_1 Poppy
GAATTCACCTCATCTCTCCCTCCATGGCTTGGTTACTGGCTAATGGTAGTTCAAGATTTACTCCACAATCACCCA
TAGAAACATCAAAAACCCTAAAAGCTTTTCCTCCAAGAATCGAAACCCCAAAATTTCTAATCCCCAATGTAAGGT
TTCCCAGAATACGTGCAGAATCGCAAACAGTTGACCAAGCAGCTCCATTAACAGGTAATAAACCTTCTTCCTCTA
ACGATGCAATCGATAAATTTCTTAAAAGAGATTATAAATGGGGATTTGTATCGGATATTGAATCTTTTTCAATAC
CTAAAGGATTATCAGAAGAAACAGTTAGATTTATATCTGCGAAAAAACAAGAGCCTGAATGGATGCTTGAATTTA
GGTTAAAATCTTATGAAAAGTTTTTGAAGATGAAAGAACCTAATTGGTCTGATAATAGGTATCCAAAAATTGATT
TTCAGAATATGTGTTATTATTCAGAACCAAAGAAGAAACCCACTTTGAAAAGTTTAGAAGAAGCTGATCCTGAGC
TTCTTAAATATTTCGAAAGGTTAGGGGTTCCATTAACTGAGCAGAATAGGTTAGCTAATGTTGCTGTTGATGCAG
TATTTGATAGT > SEQ ID NO:39 168371_300555_1 Poppy
GAATTCAAGATTGAATTCTGTGAACTGAGTAGGGAGAGTAAGAAGAATTAGCTGAACGTTCTTGATTAATTCTAT
CAGAAATGGAGAGAGTTTTGATGAGATTGAGTAAGTTAAGATCATCATCATCAGTATCATCAAGATTTTGTTATG
GGAGAAAAGCAGGATTTTCAAGTGATGCGAAGATAGATTTGTCGTCATCGAAATCGTTTGTTCAGAAGATTAGAG
ATCTACCCATGGATCTTCCTGGAATCAATGTCAAGAAAGATGTTTCTCAGTTGATTGGGAGAACTCCATTGGTAT
ATCTCAACAAAGTTTCCGCAGGATGTGGTGCTTACATCGCCTGCAAGCAGGAGATGATGCAGCCTACTGCAAGCA
TCAAAGACAGACCTGCACTTGCTATGATTGAAGATGCAGAAAGGAGAAACCTTATCTCTCCTGAGAAAACCCTGT

Figure 1 continued

TGATTGAGCCAACATCAGGAAACATGGGAATAAGTATGGCATTCATGGCAGCACTGAAAGGTTACAAGATTGCTT
TAACAATGCCATCTTACACAAGTTTGGAAAGAAGGGTTACCATGAGAGCATTTGGAGCTGAACTAATCTTAACTG
ACCCCGCCAAAGGAATGGGAGGAACTGTTAAGCATGCTTATGATCTTTTGGAATCTAGAGAGAATGCCTACATGC
TCCAACAATTTTCAAATCCAGCTAATACTC

> SEQ ID NO:40 171278_300535_1 Oryza sativa
CTTAGATCACCATCTTGGGGGAGACGGTTGAAGTCACCTATCATTTCTAGGCTCCTGGTTACCACACTTTGAGCT
TTGGGATTACTGCTTTCTTTGGCGTGATGGCGGAGCAGAGAGGAAATATGTTGATGAAAAAGTATGAGATGGGGA
AATTACTCGGGCAAGGAACCTTTGCCAAGGTTTACCATGCCCGTAACACCGAGACTTCTGAGAGTGTTGCTATCA
AGATGATTGATAAAGAGAAGGTTTTGAAAGGCGGGCTCATGGATCAGATCAAACGTGAGATTTCTGTGATGAAGT
TGGTGAGGCATCCAAACATTGTGCAGTTATATGAGGTCATGGCTACCAAGACTAAGATATATTTTGTGCTGGAGC
ACGTCAAAGGTGGAGAGTTGTTCAACAAAGTTCAGAGAGGAAGACTAAAGGAAGATGCAGCAAGGAAGTACTTCC
AACAACTGATTTGCGCTGTTGACTTTTGCCACAGCAGGGGTGTTTATCACCGTGATTTGAAGCCAGAAAATCTTC
TTCTTGATGAGAACAGCAATCTGAAGGTTTCAGATTTTGGCCTAAGTGCTCTTGCTGATTGCAAAAGACAGGATG
GGCTGCTCCACACAACCTGTGGCACACCTGCTTATGTTGCTCCAGAAGTGATCAA > SEQ ID NO:41 174874_300527_1 Oryza sativa
ATCCATTAATTACTcGCTTCGTGGTCGGAATCCATGGCCGCCGCCGCAGCCGCTGTCGGGAACCCTAACGCGGCT
GCCGCCGCTGCGTCGGTCTCGGCGTCGAGGGTCGGTGCGGGGGCGCTGCGCGCGGGGGGTTTGAGGGTGGCGGCG
GGGGGAAGTGTGGCGAGGAGGGGAGGGGCTGTGGTGGCGGCGGCAATGCGGCCGGCGAAGGCGGTGGCGTCGCCG
GCGAAGGAGGCGGCCGGGGAGGTGAACGGGGCGGCGCCGGGGGGGTTCGCGAGGCCCGACGCGTTCGGGAGGTTC
GGGAAGTTCGGGGGCAAGTACGTGCCCGAGACGCTGATGCACGCGCTCACCGAGCTCGAGGCCGCGTTCCACGCC
CTCGCCGGCGACGAGGATTTCCAGAAAGAACTTGATGGTATCCTCAAGGATTACGTCGGCCGTGAGACCCCGCTG
TACTTTGCGGAGCGATTGACTGAGCACTACAAGCGCGCTGATGGCACAGGCCCCAAGATTTACCTCAAGAGGGAG
GATCTTAACCACACTGGCGCCCACAAGATCAACAATGCTGTCGCGcaagtcTTGCTTG > SEQ ID NO:42 175126_300530_1 Oryza sativa
GGGCAGTGCAGGTGTCGCTGGCCATGGCGAGGAGGAGCAGCAGCAGAGCGTGCGCGGCCATGGCGACGGCCGCCG
TCTTTGCGCTGCTGGCCGCGACGGCGACGGCGTCGGGGCTCGTACGGGTGGAGCACCCGGCCAAGAGCGACGGGT
CGCTGAGCCTGCTCGTCGTCGGCGACTGGGGCCGGAAGGGCACGTACAACCAATCCAGGGTCGCCGAGCAGATGG
GGAAGGTTGGGGAGAAGCTAAATATAGACTTCGTCATATCCACCGGTGACAATTTCTACGAGGATGGACTCACTG
GCGTCGATGACCAGGCGTTTGAGGAATCGTTTACCGATATCTACACGGCAAAGAGCTTGCAGAAGCCATGGTACC
TGGTGCTGGGAAATCATGACTACAGGGGTGATGTGCTAGCACAGCTTAGCCCAGTCTTGCGAAAGATCGACCAGC
GATTCATTTGCATGAGGTCGTTCATTGTTAATGCAGAGATTGTGGATTTCTTCTTTATCGACACAACTCCATTTC
AGCTGAAATATTGGACTCGCCCTAAAGACCATCATTATGACTGGAGAGGAGTGGCACCTCGACAAAAATACATAA
CTAATCTACTTAAGGATATGGATGAGGCAATGAAGAAATCAACAGCGAAGTGGAAGATTGCTGTTGGGCATCATA
CCATTA > SEQ ID NO:43 175159_300530_1 Oryza sativa
CCCACGCGTCCGCTCCAAGCGCGCCTTCGTCCACTGGTACGTCGGCGAGGGCATGGAGGAGGGGGAGTTCTCCGA
GGCCCGCGAGGACCTCGCCGCGCTGGAGAAGGACTACGAGGAGGTCGGCTCCGAGTTCGACGATGGTGACGAGGG
TGATGAGGGTGACGAGTACTAGAGAGGTTCAGGGTTCTTGCCTGGTGCCTTGGCAATGCTTGATTACTGCTGCTA
TCCTATGATCTGTCTATCAGTTTGTGTGTCTGGTTTTGAAAAACATTTGCTTTTGGATTATGCAGGGTTTGCTTG
TAGCTTTCGCTGCTGTGACCTGTGTTGTTTATGTGAACCTTCTTTGTGGCATCTTTAATATCCAAATGAGTGGTT
TGTCGT > SEQ ID NO:44 175378_300541_1 Oryza sativa
CCCCCGGTGGACACCCTGCGCTGCAGCCGAACGACCGAGCTACCGAGCCAATCCAGCCATGGCCTCCACCGCGCT
CTCCACCGCCTCCAACCCTACTCAGCTGTGCAGGTCTCGCGCCTCGCTGGGCAAGCCCGTCAAGGGCCTGGGCTT
CGGCCGGGAGCGCGTGCCGAGGACGGCGACGACCATCACATGCCAGGCCGCGAGCAGCATCCCGGCCGACCGCGT
CCCGGACATGGGCAAGCGCCAGCTGATGAACCTCCTCCTGCTCGGCGCCATCTCGCTCCCCACCGTCGGCATGCT
CGTCCCCTACGGCGCCTTCTTCATCCCCGCCGGGTCCGGGAACGCCGGCGGCGGGCAGGTCGCCAAGGACAAGCT
CGGCAACGACGTGCTCGCCGAGGAGTGGCTCAAGACACACGGCCCCAACGACCGCACCCTCACCCAGGGGCTCAA
GGGTGACCCGACGTAC > SEQ ID NO:45 175535_300545_1 Oryza sativa
CCCCCCGATGAGAATGGCCGCGCCGCAGCGGGTGCATGTGCGTGCCGCCCCGCTCGCGCGCGCGCTCCGAACTCG
CGTCGCCGCCGCCGCCGCGTCTGCGAGCTCTCCCCGAACGCGCGCTCCTCGGCCTCTCCGAACCAGATCTCCGGCA

Figure 1 continued

```
GCTCGCCGTCGACCTCGGCCAGCAAAGTTACAGGGGGAAGCAGCTTCACGACCTCCTCTACAAGTCCAGGGCCAA
GCAAATCCAAGAATTTAGCCACGTACCAAAGGTGTTCCGTGAGGCCTTGGTCGGCGCTGGCTGGAAGGTTGGCCG
CTCGCCAGTGCACCATGCTGTGACGGCCTCCGATGGCACTACCAAGATACTTCTCAAGTTGGAGGATAACAGATT
GATCGAAACAGTAGGGATCCCTGTCGATGATGACAAAGGCCCGTCAAGACTCACTGCCTGCGTTTCATCACAGGT
TGGCTGCCCCTTGCGTTGCTCATTTTGTGCCACTGGCAAGGGAGGGTTTGCAAGAAACCTTCATGCACATGAGAT
TGTTGAGCAGGTTTTGGCCATAGAGGAGACGTTCCAACACAGGGTGACAAATGTAGTGTTCATGGGGATGGGTGA
GCCTATGTTGAACCTGAAATCAGTTTTAGAGGCACATCGATGCTTGAACAAGGAACTAAAAATTGG

> SEQ ID NO:46 175706_300544_1 Oryza sativa
CCCCACAGCATAGTAACCAACCGAACCAGGCATCAGCCATGGCGCGAAGGCTCTCGCTGCTGGCCGTCGTGCTGG
CGATGGTGGCGGCCGTGTCGGCGAGCACGGCGGCGGCGCAGAGCTGCGGGTGCGCGTCGGACCAGTGCTGCAGCA
AGTGGGGGTTCTGCGGCACCGGCAGCGACTACTGCGGCACGGGGTGCCAGGCGGGCCCCTGCGACGTGCCGGCCA
CCAACGACGTGTCCGTGGCGAGCATCGTCACGCCGGAGTTCTTCGCGGCGCTCGTCGCCCAGGCCGACGACGGCT
GCGCCGCCAAGGGCTTCTACACCCGCGACGCCTTCCTCACCGCCGCCGGTGGCTACCCTTCCTTCGGCCGCACCG
GCTCCGTCGACGACTCCAAGCGCGAGATCGCCGCCTTCTTCGCCCACGCCAACCACGAGACCATAAAGTTCTGCT
ACATCGAGGAGATCGACGGACCGAGCAAGAACTACTGCGACGAGACGAGCACGCAGTGGCCGTGCATGGCGGGGA
AGGGGTACTACGGGCGCGGGCCGCTGCAGATCTCGTGGAACTTCAACTACGGGCCGGCGGGGCAGAGCATCGGGT
TCGACGGGCTGGGCGA > SEQ ID NO:47 175904_300523_1 Oryza sativa
CCCCCCCCCCCGGAAGAGCTCGGCGGTGGAACAGCTCGCTCGATCATGGCCGCCGCCGCCGCCGCCTCAAGGGCG
CTCTGGGCTTGCCGCACCGCCTCCTACCTTCGGATCTCCTCCTTCCCCAGGGCTTTCTCCACCGTCCTTAAAGAT
CTAAAATATGCTGATACTCATGAGTGGGTGAAGGTTGAGGGTGATTCAGCAACCATAGGGGTCACAGACCATGCT
CAGGACCATTTGGGTGATGTTGTGTATGTTGAGCTTCCACAAGTTGGTTCCACAGTATCACAAGGAACGAACTTT
GGTGCGGTTGAAAGTGTGAAAGCAACCAGTGATATCAATGCACCAGTATCTGGAGAGATTATTCAAGTAAATGAT
GAACTAAGTGAAAAACCAGGATTTATAAATGGAAGTCCATATGAGAAGGGATGGATCATCAAGGTTAAGATAAGT
GATCCAAGTGAGTTAAACTCGCTGATGGATGATGAGAAGTACAAGAAGTTTGTGAGGAAGAAGATGGCAAACAC
TGATCAATCCCCTAACTGCTGGATTTCAAGAAACTATGCAGCAACTCACCATCATGACAATGAGCCATCTCGC > SEQ ID NO:48 176385_300521_1 Oryza sativa
CCCCCCCCCCCCGACCGGGATGCTGTACATCGTGGGGCTCGGCCTCGGCGACGAGCGCGACATCACCGTGCGGGG
GCTCGACGCCGTCCGCCGCTGCGCCAAGGTCTACATGGAGGCCTACACCTCCCTCCTTTCCCTCGGCCTCGACCC
CTCCGCGCTCTCCAACCTCGAGAAGATGTATGGGAAGGAGATCACGGTGGCGGACCGCGAGATGGTGGAGGAGCG
CGCCGACCAGATGCTCCGCGAGGCCGCCGACGCGGACGTCGCCTTCCTCGTCGTCGGCGACCCCTTCGGCGCAAC
TACACACACTGATCTGGTGGTTCGCGCCAAGAACATGGGGGTGGAAGTGAAGGTGATCCACAATGCGTCCGTCAT
GAATGCAGTTGGAGTTTGCGGATTGCAACTTTACCGCTACGGGGAGACCATCTCTATACCTTTCTTCACGGAGAC
ATGGAGGCCGGACAGTTTCTATGAGAAGATTCAGAACAATCGACGGCTTGGACTGCACACACTTTGCTTACTAGA
TATTCGTGTTAAGGAACCAACGCTTGAGTCTTTA > SEQ ID NO:49 180809_300625_1 Oryza sativa
GAATTCCAGAAAACAAAAACAACAATGGCTTCAACAGCTTCAGGGACTACTCTATCTCTACTCAGAACAACAGCA
TCATCTTCATCTGCTCGCAACAACCGTGTATCATCAACATTACAAGTTGCAGCAGCATCTCGATTGAGAAACATC
GGATTACAAGTTAGAAACCCAAAAAGTCTTGGGTTTTCTGGTGTTGCAGTAGATCCTCTTCTTTCATCACACGTT
TCTTCACAAATTGGAGCTGTTAATGGTAAAGGGGTGAGAGGTGTTGTTTCAATGGCTAACAAAAGTGTTGGGGAT
TTGAGTGCATCTGAATTGAAAGGTAAAAGGGTTTTTGTTAGGGCTGATTTGAATGTCCCGTTGGATGACAATCAG
AACATTACTGATGATACTAGAATCCGTGCTGCTATTCCAACTATCAAACATTTGATGGCCAATGGTGCTAAAGTC
ATTCTTACCAGTCAT > SEQ ID NO:50 183214_300592_1 Oryza sativa
CGAGACTTCTCTACGCTTCTCCTCGCCGCCGAAACGAAGCAACCCGTCGCCTCGCCGCCGCCGCCATGTCGGTGA
CGCTGCACACGAATCTCGGGGACATCAAGTGCGAGGTGTTCTGCGACCAGGCGCCGCGGACGGCGGAGAACTTCC
TGGCGCTGTGCGCGAGCGGCTACTACGACGGCACCATCTTCCACCGCAACATCAAGGGGTTCATGATCCAGGGCG
GCGACCCGACGGGCACGGGGAAGGGGGGCACCTCGATCTGGGGGAAGAAGTTCGCCGACGAGTTCAGGGAGTCGC
TCAAGCACAACGCCCGCGGGTGATGTCGATGGCGAACAGCGGGCCCAACACCAACGGGAGCCAGTTCTTCATCA
CCTACGCCAAGCAGCCTCACCTCAACGGCCACTACACCGTGTTCGCCAAGGTCATCCATGGATTCGAGGTGCTCG
ACCTCATGGAGAAGGCGCAGACGGGGCCCGGCGACCGCCCCCTCGCCGAGATCAGGCTCAACCGCGTCACCATCC
ACGCCAACCCTCTCGCCAACTAATCCTATCTACTCCATCTAGTTTAAAATCTTTGGAAttcTgAtTgctTTtttc
tgTGTGGATGTGTTGTGTtcTGCTGCTATCTgAatct
```

Figure 1 continued

> SEQ ID NO:51 183295_300592_1 *Oryza sativa*
CGCGCTTCCGCCGCTGCAGCCGATACGGGAGATTGGATCGGAAGCTTCTAGAAGTTTCCGTGGGCGATGGCGATC
CGCGCGAGGTCCTCCTCCTACGCCGCCGCGGCGGTCGCGCTGGCGCTCGCGCTGGCGTCCGTCGCCGCTGTCGCC
GGCGAGGTCTTCTTCCAGGAGAAGTTCGAAGATGGATGGGAAAGTCGGTGGGTCAAGTCAGAATGGAAGAAGGAT
GAGAACATGGCTGGTGAATGGAACCACACACATCTGGGAAGTGGAATGGAGATCCTGAGGACAAAGGTATCCAAACC
TCTGAGGACTACAGGTTCTACGCTATTTCAGCGGAGTACCCAGAATTCAGCAACAAGGATAAAACCCTGGTGCTG
CAGTTCTCTGTAAAGCATGAGCAAAAGCTTGACTGTGGTGGTGGATATGTCAAGTTGCTTGGTGGTGATGTTGAC
CAGAAGAAATTTggTGGGGACACACCGTACAGCATTATGTTTGGAccanaCaTCTGTGGGTACAGCACCAAgaag
GTCCATACTATCTTTACTAAGAaTGacaagaacCATTTGATCaAGAaggatGtcccCTgcgagactgatcagCTg
tcccaTGTGTACACTttgATCATCcATcctgatgctACataCa > SEQ ID NO:52 183350_300593_1 *Oryza sativa*
CCCACGCGTCCGCACTTCACCAACCCTCTGCCTCCCTTCCGCCGCCCTCCGCCGCCGCATGCAAGCCATCCTCGC
CGCTGCCATGGCCGCCCAGACCCTCTTGTTCTCCGCCACCGCCCCTCCCGCCTCCCTTTTCCAGTCCCCTTCCTC
TGCCCGCCCTTTCCACTCGCTCCGCCTCGCCGCCGGCCCCGCGGGCGCCGCCGCTGCCAGGGCGCTCGTCGTCGC
CGACGCCACCAAGAAGGCCGTCGCCGTGCTCAAGGGCACCTCCCAGGTTGAGGGAGTCGTCACCCTCACCCAGGA
TGACCAAGGTCCTACAACAGTGAATGTCCGTGTGACGGGACTTACTCCTGGACTTCACGGCTTCCACCTCCACGA
GTTTGGCGATACTACGAATGGGTGCATATCAACAGGACCACATTTTAACCCAAACAATTTGACGCACGGTGCACC
AGAAGATGAAGTCCGTCATGCGGGTGACCTGGGAAACATTGTTGCCAATGCTGAAGGTGTAGCTGAGGCAACcAT
TGTTGATAAGCAGATTCCTCTGAGtggccCAAAttCTGTTGTTGGGAGAGCattcGTtgttcaTGAGCTTgaaga
TGATTTGGGGAAgggTGgccATGagcttagtCTCAGTACTGGAAATGCTggTgggCGaCttgcAtgcggTGTtG > SEQ ID NO:53 188835_300610_1 *Oryza sativa*
GGCTTCCATGTCTACCATTCTTCCATTGTGCCTTGGCCTCCTTCTCTTCTTCCAAGTGTCCATGGCACAATTTTC
ATTTGGGGGAAGCCCACTTCAGAGCCCACGTGGATTTAGGGGAGACCAAGATAGTCGTCATCAATGTCGTTTTGA
GCACCTCACCGCCCTTGAGGCAACACACCAGCAGAGATCTGAAGCTGGATTCACTGAGTACTACAACATTGAGGC
AAGAAATGAGTTCCGTTGTGCCGGAGTGAGCGTGAGGCGCTTAGTCGTCGAGAGCAAGGGCTTAGTTTTACCAAT
GTATGCTAATGCTCACAAGCTTGTCTACATCGTCCAAGGTCGGGGAGTGTTTGGGATGGCACTGCCTGGTTGTCC
AGAGACGTTCCAGTCAGTTAGGTCTCCCTTTGAGCAAGAGGTGGCAACAGCTGGTGAGGCTCAATCATCAATCCA
AAAAATGAGAGACGAGCACCAGCAACTTCACCAATTCCACCAAGGTGATGTAATCGCAGTGCCAGCTGGAGTAGC
CCACTGGCTATATAACAATGGTGATTCTCCTGTGGTTGCTTTCACTGTCATCGACACCAGCAACAATGCCAACCA
GCTCGA > SEQ ID NO:54 188836_300610_1 *Oryza sativa*
CTGGAATCTTGTTTAACACTAGTATTGTAGAATCAGCAATGGCAGCATACACCAGCAAGATCTTTGCCCTGTTTG
CCTTAATTGCTCTTTCTGCAAGTGCCACTACTGCAATCACCACTATGCAGTATTTCCCACCAACATTAGCCATGG
GCACCATGGATCCGTGTAGGCAGTACATGATGCAAACGTTGGGCATGGGTAGCTCCACAGCCATGTTCATGTCGC
AGCCAATGGCGCTCCTGCAGCAGCAATGTTGCATGCAGCTACAAGGCATGATGCCTCAGTGCCACTGTGGCACCA
GTTGCCAGATGATGCAGAGCATGCAACAAGTTATTTGTGCTGGACTCGGGCAGCAGCAGATGATGAAGATGGCGA
TGCAGATGCCATACATGTGCAACATGGCCCCTGTCAACTTCCAACTCTCTTCCTGTGGTTGTTGTTGATCAAACG
TTGGTTACATGTACTCTAGTAATAAGGTGTTGCATACTATCGTGTGCAAACACTAGAAATAAGAACCATTGAATA
AAATATCAATCATTTTCAGAAAAACAAAAACAAACAACCC > SEQ ID NO:55 188877_300610_1 *Oryza sativa* Contig A
cAAAAAAAAAAGGAAAAAAAAACAAAACACACCAAGCCAAATAAAAGCGACAATGGGATCGCTCACCACCAACAT
CGTCCTCGCCGTCGCCGTGGTGGCAGCGCTGGTCGGCGGCGGGTCGTGCGGCCCGCCCAAGGTGCCACCCGGCCC
GAACATCACGACCAACTACAACGCCCCGTGGCTCCCCGCCAGGGCCACCTGGTACGGCCAGCCCTACGGCTCCGG
CTCCACCGACAATGGTGGCGCGTGCGGGATCAAGAACGTCAACCTGCCTCCCTACAACGGCATGATCTCCTGCGG
CAACGTCCCAATCTTCAAGGACGGCAGGGGATGCGGCTCATGCTACGAGGTGAAGTGTGAGCAGCCGGCGGCGTG
CTCGAAGCAGCCGGTGACGGTGTTCATCACGGACATGAACTACGAGCCCATCTCGGCGTACCACTTCGACTTCTC
CGGCAAGGCGTTCGGCGCCATGGCTTGCCCGGGAAGGAGACCGAGCTCCGCAAGGCCGGCATCATCGACATGCA
GTTCAGGAGGGTGCGCTGCAAGTACCCCGGCGGCCAGAAGGTCACCTTCCACGTCGAGAAGGGCTCCAACCCCAA
CTACCTCGCCGTGCTCGTCAAGTTCGTCGCCGACGACGgTGACGTCATCcAGATGGAc > SEQ ID NO:56 188877_301703_1 *Oryza sativa* Contig B
GATCCGGCGTTACCATACGCTTCGTCATCGGCGATGACCTCAACATTATCAACAACCAACAACAAAACCCCATTT
CTGGGTTTCACATTTGCCTCTGCAAAACCTTCTTTTTTAGTTAAAACCTTAAATAACAATAATTCTAAGCAGCAA

Figure 1 continued

TCTCTTTCGATTCGTTGTCAAAACCTAACCGCTGTACCTAAAGATGAACGATGGATGTTTGAAGATTCTGAAATC
GGCGGACCAGACATTTGGAACAAGACCTGGTATCCTAAAGCTGCTGATCACATAAACACAGAGAAGAAATGGTAT
GTGGTTGATGCGACTGACTTAATTTTGGGCAGAATGGCATCAACCATCGCCATTCACATTCGTGGGAAGAATCTC
GCAACCTATACTCCCAGTGTTGACATGGGGGCTTTTGTAATTGTGGTTAATGCAGAAAAAGTTGCTGTATCTGGG
AAGAAAAGATTGCAAAAGCTATATAGGAGACATTCTGGAACACCAGGTGGTATGAACGTACAGACTTTTGATCAG
CTCCAACAGAGAATTCCTGAAAGAATAATCGAGCATGCTGTCCGCGGAAT

> SEQ ID NO:57 188877_301704_1 Oryza sativa Contig C
GAATAATCGAGCATGCTGTCCCCGGAATGCTTCCGAAAGGAAGACTGGGTAGAGCGTTATTCAACCATCTCAAGG
TATACAAGGGTGGGGAGCATCCACATGAGGCCCAAATGCCTGTTGATCTTCCAATAAGAGACAAAAGGATACGGA
TTCAGAAATAGGCATACCACATGAAGTATGGAGTTAGTTGGGGTTTTAACACTTCTGAAGATTGTGGTCATGAGC
CTAGGCTTTCTTGAATATGTACAACTTATTATTGTGTATGATTTTGTATGAATCTAGTGGATATCAAGTAAATTT
CATTTTGAGTTTTGTAGAATCTATATCCGACTTTGAGTTCTCATGTAATGCAAGGAATTTCATAAAAAAAGAAAA
AAGAAGAAAAACTCAA > SEQ ID NO:58 188959_300611_1 Oryza sativa
GGAGGAGATCGAGGAGGGGATGGGGATCCGGTTCGTGGTGATGGTGAACAAGCAGGGGCAGACGCGGGTGGCGCA
ATACTACGAGCACCTCTCCGTCGACGAGCGCCGCGCCCTCGAGGGCGAGATCGTCCGCAAGTGCCTCGCCCGCAC
CGACCACCAGTGTTCTTTCGTGGAGCACCGCAACTACAAGGTGGTGTACCGGCGCTACGCCTCCCTCTTCTTCCT
AGTCGGCGTCGACAACGATGAGAATGAGTTAGCTATCCTTGAATTCATTCATCTTTTGGTTGAAACTATGGACCG
TCACTTTGGCAATGTGTGTGAGCTCGACATTATGTTCCATCTGGAGAAGGTGCACTTCATGCTGGAAGAGATGGT
GATGAATGGTTGCATTGTTGAAACCAGTAAACAGAACATCTTGGCACCAATCCACCTGATGGAGAAAACTTCTTA
GAAAAATGCTATCCAATAGGGGAGTGCCTCATACTCTTCTGCTTATGGCCACCGCCTCTGTGATTCTATTGATTT
TTCATCTCAATGTGTAACCATCAACGATTTCCATGTGCATAGACTATTAAACTTGACCTGATAGGAAATAATGAG
AATATGGCAGATGCCATCTATGTTCCTT > SEQ ID NO:59 189013_300612_1 Oryza sativa
CACTTCCATCTCATTCTCCTAATTGTCATCACTAGCTTCTAGCTAGCTTAATTAATTAATTAGCCATGGCGGAGG
AGAAGCACCACCACCACCTGTTCCACCACAAGAAGGACGACGAGCCGGCCACCGGAGTAGACTCCTACGGCGAGG
GCGTCTACACGTCGGAGACGGTGACCACCGAGGTGGTCGCCGGCGGCCAGGACGAGTACGAGAGGTACAAGAAGG
AGGAGAAGCAGCACAAGCACAAGCAGCACCTCGGCGAGGCCGGCGCCCTCGCCGCCGGCGCCTTCGCCCTGTATG
AGAAGCACGAGGCGAAGAAGGACCCGGAGAACGCGCACAGGCACAAGATCACGGAGGAGATCGCGGCCACGGCGG
CGGTCGGCGCCGGCGGCTACGCCTTCCACGAGCACCACGAGAAGAAGAAGGACCACAAGAGCGCCGAGGAGTCCA
CCGGCGAGAAGAAGCACCACCTCTTCGGCTGATCGACCTCATCACAACGTCGCCGGCGGCGGCGACGACCTCGCC
GTACGTCGCCGGCCGCCGTGTCGTCGATTTGTGTGTGTA > SEQ ID NO:60 189037_300612_1 Oryza sativa
CTCAACTCAAACATTACAGCGAAAGCATAACAACTAGAATCCCACCACAATGAAGATCATTTTCTTCTTTGCTCT
CCTTGCTATTGCTGCATGTAGCGCCTCTGCGCAGTTTGATGCTGTTACTCAAGTTTACAGGCAATATCAGCTGCA
GCCGCATCTCATGCTGCAGCAACAGATGCTTAGCCCATGCGGTGAGTTCGTAAGGCAGCAGTGCAGCACAGTGGC
AACCCCCTTCTTCCAATCACCCGTGTTTCAACTGAGAAACTGCCAAGTCATGCAGCAGCAGTGCTGCCAACAGCT
CAGGATGATCGCGCAACAGTCTCACTGCCAGGACATTAGCAGTGTTCAGGCGATTGTGCAGCAGCTACAGCTACA
ACAGTTTGCTGGCGTCTACTTCGATCAGGCTCAAGCTCAAGCCCAAGCTATGTTGGCCCTAAACTTGCCGTCAAT
ATGCGGTATCTACCCAAGCTACAACACTGCTCCCTGTAGCATTCCTACCGTCGGTGGTATCTGGTATTG > SEQ ID NO:61 200614_300746_1 Saccharomyces cereviseae
GAATTCCAGCTGACCACCATGTCTACCACACTACTTTGGTTTTCAAGTGTGATAGGCTACGTGATTCAAACAAAA
TGTTTGTCTAACATACAATCTAAAAAGGAAATCTCCGTGGGGCCCAATGGTACAATTGCAACGCCTGAAACTAAC
GGCGACAACGGAAACTCAAGTTCATTAGCCTTCTATCTGACCTTTATGTATTTTGCTTCGTGGCTGCTCTTGGTG
CCTGCATCTCGACTTTGGGAGAAGATGAGACCGATGTTTGTCTCTGACTCAGACTCGAACAGGAATTCTCAGTTT
GACAACAACAACAGCGGGTCTGTGACAAACGAAGATGTCGATACGTTCTCGCACGTGTTGGATGATCCTCAACCA
CGGATTCCAGCCCAACAGCAGAAGCAAAAAATCATATCCGTGGCTACCTTCAAATATGTGGCTAAGCTAACAGTG
CTGGCTCTCATAATGATTGTCGCTGATTTGACTTATAACATGGCTTTGTCATTGTCACCGGCATTTGATGTTGCT
TTGATGCAAAATACTGCCATTTTCGAAATTGTCACTTTACTATATGGTGTTTGTGGAATCTCCAGGAAGAACTAC
GTTTTCCGTAATTTCCTCATCATGATGAACG > SEQ ID NO:62 200629_300746_1 Saccharomyces cereviseae

Figure 1 continued

```
GAATTCCAGCTGACCACCATGCACCAAGATTTTCAAGAAGACGAGCATGAGTATCCAGACATCAGACGCAATCCG
CTGCATGAGGTGACCATGACTTCCTACATACTGGGGATTCTTTTAGGTATATTTGTTGGTCTTTTTCCACAAATT
AGATTCAAGAATTTTAACCTCTTTATTATTGCCCTGTCCTTATTCCATTTTTTGGAGTATAATATTACAGCTAGA
TACAATCCTCTTAAGGTACATTCAGAGTCCTTTCTTCTGAACAACGGCAAAAGTTACATGGCGGCACATTCCTTT
GCTATTCTGGAATGCCTCGTAGAAAGCTTTCTTTTTCCTGATCTGAAAATTTTTAGCTACTCTCTAGCTACCAAG
CTTTGTACAGTACTTGGATGTCTTCTAGTTATTCTGGGACAATATACCAGAACTATTGCTATGCATACTGCGGGA
CATTCCTTTTCTCATATTGTGAAGACCAAGAAGGAGTCCGATCATGTTTTAGTGAAAACTGGCGTTTACTCCTGG
TCAAGACATCCAAGTTATCTTGGGTTCTTTTGGTGGGCAATTGGCACTCAGCTACTGCTTCTAAATCCCCTATCA
```

> SEQ ID NO:63   200665_300746_1   *Saccharomyces cereviseae*
```
GAATTCCAGCTGACCACCATGCATTATTTGCCTGTTGCGATAGTAACAGGTGCCACTAGGGGTATAGGCAAGGCA
ATATGTCAAAAGTTATTTCAAAAGGGTTTAAGTTGCATTATACTTGGGTCTACTAAAGAAAGTATAGAGCGCACC
GCGATAGATAGAGGCCAATTACAATCGGGATTATCATATCAGCGGCAATGTGCTATAGCAATTGATTTTAAGAAA
TGGCCTCACTGGCTTGACTATGAGTCATATGACGGTATCGAATATTTCAAAGATAGACCGCCCTTGAAACAGAAA
TATTCCACATTGTTCGACCCATGTAACAAATGGTCAAATAATGAACGCCGCTACTACGTAAACTTATTGATTAAC
TGCGCAGGCTTGACTCAAGAATCATTAAGTGTAAGAACCACTGCATCTCAAATTCAGGACATAATGAATGTTAAC
TTTATGAGCCCTGCGACGATGACAAACATCTGTATTAAGTATATGATGAAGTCGCAAAGGAGATGGCCGGAACTC
AGTGGTCAATCTGCTCGACCCACCATCGTAAATATTTCCTCCATTCTACACTCCGGAAAAGTGAAGGTTCCAGGT
ACATCTGTTTACTCCGCCTCTAAAGCCGCACTGTCCAGATTTACAGAAGTTTTAGCTGCAGAAATGGAACCAAGA
AACATTAGGTGTTTTACGATATCTCCAGGTTTAGTCAAAGGGACCGATATGATCCAAAATTTGCCAGTGGAGGCT
AAAGAAATGCTGGAGAGAACCATTGGGGCAAGCGGTACAAGCGCACCCGCTGAAATAGCGGAAGAAGTCTGGTCT
CTATACAGTAGAACTGCTTTGGAGACGTAACATGGCAATTCCCGGGGATC
```

> SEQ ID NO:64   200671_300746_1   *Saccharomyces cereviseae*
```
GAATTCCAGCTGACCACCATGAACGTAACATCGAATGCAACTGCAGCCGGTTCCTTTCCACTAGCATTTGGTCTC
AAGACCTCATTTGGGTTTATGCACTATGCCAAGGCCCCTGCCATTAATTTACGCCCCAAGGAATCCTTGCTGCCG
GAAATGAGTGATGGTGTGCTGGCCTTGGTTGCGCCGGTTGTTGCCTACTGGGCGTTGTCTGGTATATTCCATGTA
ATAGACACTTTCCATCTGGCTGAGAAGTACAGAATTCATCCGAGCGAAGAGGTTGCCAAGAGGAACAAGGCGTCG
AGAATGCATGCTTTCCTTGAAGTGATTCTACAACATATCATACAGACCATTGTTGGCCTTATCTTTATGCACTTC
GAGCCGATCTACATGACTGGGTTTGAAGAAAATGCCATGTGGAAGCTTCGTGCAGACCTTCCTCGGATTATTCCA
GATGCCGCTATTTATTACGGCTATATGTACGGAATGTCCGCTTTGAAGATCTTTGCAGGCTTTTTATTCGTTGAT
ACATGGCAATACTTTTTGCATAGATTGATGCATATGAATAAGACCTTATACAAATGGTTCCACTCTGTTCATCAT
GAACTATACGTGCCATATGCTTACGGTGCTC
```

> SEQ ID NO:65   212333_300848_1   *Trichoderma harzianum*
```
ACGCGTCGAGCTGGAGAATCGGAACCGCATGGCTCTCAGGTAACACTCGGGTGGTCCAGTGCATCAACTACTAAG
ATATCGAAAATGTGGTGGCCCTTGCATCTAGCCATATCTAGAGAGGTTCGGCAGGCCCAGTGCAGCTTAGAAGGG
AATGCAGTTACCTACGTAAATTACATTCATCCAGTGTTCGGTATTACTTGCGATGCGGGATGCTGAATCGGCATT
TCCCTGACTAAGGGACTCTCGCTGGACAGTACAATGAATGATCAAGCTACAAAGGCATATATTTTAGACGGGCA
AAGTCTTACATTCAGAGACATGTAGCCGTTGTTCCCCTACATAGGTTTCAGCTGTAAGGGCTTGTGTTATGAAGC
CGGCATCCCGAGTTCTCCTCCTTACATCTCGTGCTTTTTCATATAGTGGCATAGTAATCAGGTACTTGCACACCA
TCTTAATTAACGATAGTGATTTCT
```

> SEQ ID NO:66   212363_300848
```
CCCACGCGTCCGCCCACGCGTCCGAAACAACCTTCTTCATCAATTCTACTACAACGACCTTCCTACTTAAACAAT
CTCTCGATACCAACTCCCCAAGATGAAGTTCACTCTCGTCCTTGCTACCTTTGCCGCCGTCGTCTACGGTCAAAC
CATCGATGACATTCCCGCATGTGCTCGTACTTGCATTGAGAACGCCGTTCTAGCCGCTGGTTGCTCGTCTGGAAC
TGACGTCGCATGCGCTTGCGCACATTTCACTGCTGTTCAGAATGGCTCTACTAGCTGTGTCATTGCTGCTTGTGG
CGTTTCTGTCGCCATTAACCAAGTTCTGCCTGCCACCCAGGCTCTTTGTGCCAACCAGTGAACTCATCCATCG
```

> SEQ ID NO:67   212375_300848_1   *Trichoderma harzianum*
```
GAAGAGGGACTGTACTGTACAGTAACTGTACCTTATGCAATTGTGCAGGATTATGTCTCTGCTGTAATGTATCTG
CGGACGTATCTGCGGATGCCGGGGATGGACTCCGGTGTACTTGGCACGGCTCGCTTCCGTTTGACATAAAAATGC
AGTGTAACAGGTAGATGGACGTACATGTAGATGTAAATGCGGTACT
```

> SEQ ID NO:68   212426_300849_1   *Trichoderma harzianum*

Figure 1 continued

TCGACCGAGACTCGGGCCACGATCTGCCAATTGGCGGAGCTAGACGGAGTATGGCATAGCGCCAATTGCTCAGAG
CAGCTGAGCTTGCGCAATTGGCCCTCATCACAAGGATTCAGCCCTCCCTCTGGAGGTTCAGCTTCATTGATATTG
CGAGGTGGTGTCTACTGTACATACTATACAATATTCAGCACAGGAGCTTTCGGTACCAAAACCCTTCAACACCG

> SEQ ID NO:69 212454_300849_1 *Trichoderma harzianum*
CCCACGCGTCCGATTTGGCAATTCCTCAAGCTCACCCATTTGTTGACTCTGGCAGTGTAGCACACAGTCTGCTCA
ACAAACCACATCACCATGTCCGCCGCAGAGAAGACCACGGTGGCGACCGACGTCGCAAATCCCCCCAGTCGC > SEQ ID NO:70 212492_300849_1 *Trichoderma harzianum*
GGTTTCGGAGAGCTAGATTGAATCGGAGGGGCTGCCTATATTGCGGCAGAGGAATAGTGACGTCATGACTATCAA
GGACCCTGGGAGGTTACCTAAAAGAAAAGCATCTGGACGAGGTGACGTAGCCATCAATGCGATCGATTGTTTGCT
CTATCTCCTCGGGTCGGCTGTTGATTTAGTATTAAACTAATGGATAT > SEQ ID NO:71 212511_300850_1 *Trichoderma harzianum*
GTGATATCTGATATATATCAAACAGCCCAGCACACCATTCCAAAAACTTCAAGACCCTCGAGTCTACATCAACAA
CTCTTACATCTTAAACAAACTGCTTCAAAAGCACATACACAAACCGGTTTCCCCCAGTTTCACCCCCAAATACCT
TCTGAGTGGCAATGTCCCCTTCTGCTATCAGCAACTCCCCAGAGCAGCGACCTGCAAACAACGGCACCACCCCG
ACAACTTCGCTATCCAGCCTCCCGCCGACTTCACCGGCTATGACCACGTAACGTGGTGGGTTGGCAACGCCAAGC
A > SEQ ID NO:72 212639_300842_1 *Trichoderma harzianum*
TCTCATCCACCTCGTCCATCTCATCCTTTGGCTTCCAGCAGCTATCAAGACTTGACTTAAAAAAACCAGTCCTCA
TAAAGACATCTACAATCAGTCACCATGCAGATCACCAAGAGCCTCATCGCTACCCTCTTTGCCGCTTCGACCGCC
TTTGCGGCTCCCACTCCTGCGGACAAGTCCATGATGGCCGCTGTCCCTGAGTGGACAATCACCAACCTGAAGAGA
GTGTGCAACTCCGGCAATACCTCCTGCACATGGACCTTTGGCGTCGATACACATCTCGCCACTGCCACCTCATGC
ACATACACCGTCAAGGCTACCGCCAACGCTTCTCAGGCCACCGGCGGCCCCGTTACTTGCGGCCCTTACACTATC
ACATCCAGCTGGAGCGGCCAGTTTGGCCCTAACAACGGCTTCACTACCTTTGCTGTTACCGACTTTTCGAAGAAG
CTCATCACCTGGCCTGCCTATACCGATGTTCAAGTTCAGGGCGGCAAGGTTGTTTCGCCCAACCAGAGCTACGCC
CCGACCAACCTGCCATAGATGGAATGAATTTGCTTGGAATTACTATACGCAAGGTCAATTTACTCCCAAAGGAAC
AGCTGGTGATAATTGGAAACGACAATGAATCAGGCGAGGGGGGATACGTACCACAAAA > SEQ ID NO:73 212708_300843_1 *Trichoderma harzianum*
CGAATCCAAAGTCGTACAAATCTCAATGAATGGAAAGCTTCCGGCCTACAGCTTGCCAGGGTCCCGCTGGAACCA
CTAGAATTATTTAGGTTCTGATGGCCACTCCAGGGGGGGGGGCACCACTCCGATCCACTACGCAGAAGCAAAAAT
AGCCGCATGACGCAACTCATGATGTGTGGAGTGGCCTGACTTTTTTGAGCAGCTGAATGCAAAAGCAAAAACCCT
TGTGATCAAAAACCGCATAATGCAGGTTTGCGGGCGAGACACGCGCGTGCAACGCATCAAGACATTTGTCGTTTG
TGTCGAGGTGAGGGCGAAAATGGCTCGGATGAGGTGCACACGTGCCTCACAGACTGCGCGTTAAAGCGAATACGA
AGGAGTCCAGCGACACTTCATATTGCCTGGTTGGGGGCCCCTTGCATATGCAGAGATGCGTGCGATTCCCACTTT
GGGCCTATTTCTCGGGATCTATCTCGTAGTAATCGTATAGTCTATGGAGTCTTATTCCAGAAAACCAAATAGTAG
TAGTAATTTCACTGC > SEQ ID NO:74 212785_300843_1 *Trichoderma harzianum*
CGCCCGACAGGTTACCCGCAACGCCCCGCGGTGTGCTGCGCAGCTGCGCACTCCCATGCAGGGCCGCTTCGCCAG
CACCGCCGAGAACGAGTTCATCGCTGAGCGCCAGCACATCAAGGAACACGCCAAGGGCACCACTGAGCTTTGGAA
GAAGATTTCCATCTACGCCGTTGTTCCTGCGCTGGCTATCGCCGGTGCCAATGCCTACTGGCTGTGGACTGAGCA
CTGGGAGCACTGGAGCCATCTTCCTCCTCTGCCCGAGCGCACCGAGTACCCCTACCAGAACATCCGGACCAAGAA
CTACCAGTGGGGTGATGGTGACAAGACTATCTTCTGGAACGACAACGTCAACTACCACAACAAGGACAAGACCAA
ATAAGCTGGAACAATGGCTCCCGGAGGAAAACTGCTGGTATTTGTAGATTACCCTTTTTGGGACCCCTCTGTATA
TTTCCCTTGGAGCTTCAATCGATTACACTGTGG > SEQ ID NO:75 212945_300845_1 *Trichoderma harzianum*
CGACACGCTCTGAAAGGCTGCGCTCTAAAGTGGCCACATTGATTCTCGGTTTTTTATTATCATTTTTTTACATGG
ATCTATGGCTTCTCGCATGGCCTCTCCTCTCCGCGGCACAGTATCGTTGCAATCGCAGCCCTTGTACACCCACCC
CCTTCCACCCGAATGCTTCCCTCCCCCTGCCAAAAGTCGGGACTCGTCCGCAGAACATGCCGAGCAAAGTGCTCT
GCTCTACTGTACGAGCATCTTCGTCCTTGCTCTCTATTTGTCTTGCTCGAGTTTGTCCCCCCAGTGCAAAAAAA
AACTTTACTTTTTCTTCATTTTATCCGGTCAGCTGATTTCCTTTTAACATACTGTACCTTGTGCATCGGCCCTCA
CTCGCTCCGGGCAAGGGGTGCACTACGCACCGCCATCACCTCGATTCGGTGAGATTTCTGAATATGACAGGCTGC

Figure 1 continued

CTGATAAATACTAGTCGTATCCCTACCCAAAATGCCGTAATTCTCTGTTTAATATCCATATGCATATACAGTATG
CAGTACCCCGTAAATGGGCCAATGAAAGGATACATCATGTCGTAAAA

> SEQ ID NO:76 212954_300845_1 *Trichoderma harzianum*
CCCACGCGTCCGATCGAACCGATGTTCGGTGGCCTCGGTTCGGTTTGAGTCGGAGATGCTGCGTTGCTCGTTTGG
GATGTTGATCTACAGGCTGTGCCGCCGTGGCTGAAAGCTGGAGAAGGAAATGGAGTTTAGTTGTGAATATAGAAC
GGACTAGTTCGTGGAAATGCATGTGAAATCTTGAGGGGCTTCGTATAAAAATCGACTTTTGATCACGGTAGGAGG
ATTTAGCCAGCCCCGCATTCCTATGATATAAGGCACAATACATCTCATGTTCACAGAGCAAAAAAAAAAG > SEQ ID NO:77 212959_300845_1 *Trichoderma harzianum*
AATCATCTTACAAAAGCTTCCCAAAATGGCCCCGGTATTAAAGATTGCACTTATTCAGTTTCAGGCCAAGCCTCT
TTGTGTGCAAGAAAACTTTGACAAAGCGGTTTCAGAAATCCGATCCGCTGCCTCTCAAGGAAGCCATTTAGTTGT
ATTGCCAGAATATCACCTCACATCATGGGTTCCAGAGGACCCTTCCTTTGCTACAGCCTGTGCAGCTTCCACGCA
ATATCTTTCACAGTATCAAAAGCTAGCTAGGGAGTTAAATGTTCACATCGTTCCAGGTACCATTGTTGAACCTGT
TACTATCCAACCATCAAATGTCGTTGCTACTTCTCATGCAGAGCAAGACGTACTTGCAGGTGATCTCATAGTGGA
GCTACACAACAAGACATACTTCATCGCTGCAACTTCTGGAGATATCCTAGGAACATACCAAAAGAAAAACTTGTG
GCACGTCGAGCGCGGCGTTTTGACCGCTGATAGGCGAACGCCGCACAAGGCGTTTGATGTTCCACTCCCCGGTGG
CCATATCGTGCGAGTCGGTCTGCTTATATGCTGGGATCTCGCC > SEQ ID NO:78 213011_300846_1 *Trichoderma harzianum*
CTTTACTCCGCGATCTTCTTGATCTTCACCAAAACAACATCATTGCGCCCTTGAAGCCCTCTTAGCAAATATTCG
ATATACCCAAAAGGCATTGAGCCCTTGAGCCTTACGAGAAACACATATATCCAACATGCCTTTCACCGCTAGCGA
TATCTGCAAGATTATTCTTGCCATCATTCTGCCACCCGTCGGTGTCTTCCTCGAGCGAGGCTGCGGTGCAGACCT
CTTGATCAACATCCTCCTCACAATCCTGGGTTACTTCCCTGGTATCATCCACGCTCTGTACATCATATTGAAATA
CTAAGCCCGCCTTCCGCTCCCGTATCCCGCCGGATTCAAAGCGTCATGTCGTCGCACCGCATCATGTTGTGCAGA
CACCAATTACTCCCACGTTTGACCGGCAATTGTCGTTTTAGAATGGATGCGTCAGTGGAGGAGTGAAGGTTACGG
TCGCCGGCTCACCACGTGGCCGGTCATAGACGCCATAATGACAGTGGGCTTTCCTTTATGGCTTTTCTTTTGTTT
TTTCTTTTCCTCTCTTGTTGGCTGGAGGCAGATGCACCCTATTTGAAAGGGGGCGTCAGGTTT > SEQ ID NO:79 213059_300846_1 *Trichoderma harzianum*
AACGGGCCTCCATCGACTCCAGACCATCCAGGACCTACACGGAAGTGGCAAGAGATCGAAATCGTCTGCAGCTTA
CCCCTGCAACGGCCTTAACAAGCTCCCGACTCGGCGGGAAGCTATAGCGATCCAAGCCGCTCTTGTCTCGTATAT
AACCAAGAGCTAGACTTCGCATTAGATAGTTCTTCGTCCTTGTGTCTGAGGACAACTCCCTTCTTCATTACATAC
AATTGATTCAACCTGACCACAATGGCT > SEQ ID NO:80 213072_300846_1 *Trichoderma harzianum*
CACAATGAATCGAAAACATTCCGAGACTGGGATCACCGACGAGGCGGCTATTGAAGGCCATGACCTCATTCACAA
CGCCGAGATTGAGGAGCAGAGGGTATATGTCAACCACTAATGTCGTATCTTGGGTTACACGATTCTAATAATGTT
TTAGAGGCTCATGGCGAGCAGGCATTGACGCAGCCAGACGAGGGAGATGCGCCGCTCAACGCAACGAAGCAGTCC
GAGCCCGCCATGGCGGGACAAACCGGACGCCGCCATTCAGCGATGGACAAGATAAAGGAGACACTGCATCTCAAG
AAATAAATGAGAGATGAAAAGATGAGGTCGGAAATAATTACAAAAAAATGGTCAAACTGATGATACCTGGCGGA
TGGGCAGTCTGGATGGTGGGACGAAAACAAAAGAAAACCACAAATAAAGAGGAAGGGCACGTGTGTGTCACGTTT
CGTCAAAGTGTATTATATGAATTCCCCACATCCGCC > SEQ ID NO:81 213120_300847_1 *Trichoderma harzianum*
GTTTGGCTTGCAGTAAGACCGGCTTATGAGAAAGACCATTGTGAGAGATGTAAGGCTGATCCGGAGCTCTACGTC
ATCTGAGACATGACATTGGCATGATGAGGGTCCAGTAACTACCTGATGATTGGGGTAATCGAAAGAGATGCAGAG
AGAAACACGCAACTCTGAGAAAGCGTCCCGTTACACACGGAACACACTGCCTCCGGACAGCGGCTTGTGGCTCAT
TGCTTGAGTCCCTTAATCAGCAATCCCCAGGTTCTCTTGACAGCTCAGCGGTGCAGTTTTGCGGGCACAGCTGAT
CCACCCGTCAACGGGGCGGGACGCCGGGAAGCCGGGACTCCGGGGCTAAAATGACATCGCCATGACATCCGCACC
GTCCGACCAGAACTGCTACTACTCAAGACGGTAAGCAAGTGCTAGCAAAAGTGAGTTTTACGAGGTAAGCAAGTA
GGAACGTGGCTTATAAAGCCACAGCTAGCTTGAGGCGAAGGCTGCTAGTAGGAACTAAAGTCAGCTTATACTATT
GATAAGCTCACTGCATGGGCTAGTAATAATAGCT > SEQ ID NO:82 213364_300852_1 *Trichoderma harzianum* Contig A
GTCTTGTCATTATTTTTCGACAGCGTCGAGTAACGACACCGCACACCGTCGTCAAAATGGTCAACATTCCCAAGA
CCCGTAACACCTACTGCAAGGGCAAGGAGTGCCGCAAGCACACCCAGCACAAGGTCACTCAGTACAAGGCCGGCA
AGGCTTCCCTGTTCGCCCAGGGTAAGAGACGTTATGACCGGAAGCAGAGCGGTTATGGTGGTCAGACCAAGCCCG

Figure 1 continued

TCTTCCACAAGAAGGCCAAGACCACCAAGAAGGTCGTCCTGCGGTTGGAGTGCGTCAAGTGCAAGACCAAGTTGC
AGCTGGCCCTGAAGCGATGCAAGCACTTCGAGCTGGGTGGTGACAAGAAGACAAAGGGTGCTGCTCTGGTGTTCT
AAATGCGTTGTTCTCCGGTATTATCAATTCTTATGCTTCTCCTGGCGGCATACGGGCATCATGGAACTTGGCGAA
GGGGGTACTGGTCCTTGTTTAGAGGACAGCGGCTCATAGGAAACGAANTAAAAGATTTCTTCATGGACC

> SEQ ID NO:83 213364_300924_1 Trichoderma harzianum Contig B
AGTAACGACACCGCACACCGTCGTCAAAATGGTCAACATTCCCAAGACCCGTAACACCTACTGCAAGGGCAAGGA
GTGCCGCAAGCACACCCAGCACAAGGTCACTCAGTACAAGGCCGGCAAGGCTTCCCTGTTCGCCCAGGGTAAAAG
ACGTTATGACCGGAACCAAAGCGGTTTTGGTGGTCAAACCAAGCCCGTTTTCCACAAAAAGGCCAAAACCACCAA
AAAGGTCTTCCGGCGGTGGGATTGCGTCAAGTGCAAAACCAAGTTGCAGCTGGCCCTGAACCGATGCAAGCACTT
CAACCTGGGTGGTGACAAAAAAACAAAGGGTGCTGCTCTGGTGTCCTAAATGCTTGGTCCTCCGGTATAATCAAT
CCTAATGCTCCTCCTGCCGGATTACGGGCTTCATGGAACTGGGCAAAGGGGGTACGGGTCCTTGTTTAAAGGACA
CCGGTTCTTAGGAAACGATTAAAAAGATTTCTTCATGGACC > SEQ ID NO:84 213718_300860_1 Trichoderma harzianum
ATGCTCCATAAGGAACGATATGTTTGTAAGATTGGAGAAAAGGGGGCAATTTACTTGCCTCTAGCCGCTGAGGGA
GGGCTCGATGATTGGAGGTCCATGGGCAATCTATCTGGAGCAGGCAGAGCGTGGGGTCAATTGCAAGTCGTCAAT
GGCACTAGGGGTTTGGTTTGGGGACTGCTGAAGGCGGGAGGCGTGTGTGTACAAGACTCCCCGATGAGTCGAATG
CCAATGGACGGATATATGGATGGATGGATATCATGTAAGGGGAACGAAGCCAAAAGGGCAGCGTGCTCATCATTT
GTCATTACTCACAGCAATGAACGAATGCTCTGCAGCAGTGCTAGCATCAATCCTTACAAGGCAAGTAATCAAACA
AAAAAACACAAAAACAC > SEQ ID NO:85 213733_300860_1 Trichoderma harzianum
CGTCGCACACTCTCAGGAGCTGAAGTGGCGAAGGAACCAGCCGGCTGGCAGCTGGGACTCGGCAACGGCATGCCG
AAACGCTCACGACGGAGAAGACTCCGAAGATGAGGCAGAAGAACCTCCCACACGGAGCTGGCAAGAAGAAGAAGA
AGAGAAAGCCCAAGAAGAAGAA > SEQ ID NO:86 213792_300860_1 Trichoderma harzianum
TCTAAGGTAATGGGGGAGCGAAGCCGTTGTAAATTCACGTTGGCAAAGCCGAACGGTATGTAATAAAATTTTAAG
CAGCGCTTCAACTCTGTCTAGCGAATTGATTCGAGTATTGAG > SEQ ID NO:87 213793_300860_1 Trichoderma harzianum
CGTTCGGGCCCTGCGTCCTTTTCTCCGAGTCACGCACAGAGACACCAGCTAGCCACGATGTCTACGCAAGCCGCG
CACCCGGCCCTGCTCATCCCAGGGCCCATTGAGTTTGACGATGCTGTGCTCCAGTCCATGAGCCACTTCAGCGAG
TCTCATGTTGGCCCTGGCTTCGTGGCCACCTTTGGCGAGACTCTGAGCATGCTCCGCCAGCTCTTCCAGACCACC
GATCCTGCCTCTCAGCCCTTCATCCTCAGCGGTTCCGGCACCTTGGGTTGGGATTTGGTGTCTGCTAACTTGATT
GAGCCCGGCGAGGACGCTTTGGTTCTAAGCACCGGCTACTTTGGCGACAGCT > SEQ ID NO:88 213827_300861_1 Trichoderma harzianum
GCGGTCGAATAAACACCGACTGCATCTCCATCAGATTGCGCTTGGCGGCCGGGTCTACTGTTGCAGTTGATGCCG
CCCAACTCTGGCAAAACCTGGCGCTGCGGCTGCGGCTGGAGACCGGGGGAGCGATTCTGGCTGCCCAAACGAGAA
CCGGGGGGGATGTCAATGCACAGTTGCATCGAAATTTGGCGATTAATTTTTTTACGAGGGAGGATTAGGATTAGG
ACTTTGCACGGTAGTATTACTAGGACCCCTAGGCAGAAAGTTGGATATAGATTGCATTGGATGTTTTGATTGAGT
TGCCTTGCTGGGATGTTGAGAGTCTATCAAGCAAGCAAGGCAGACGAGGATGCCTTGTGCAGAGACGGCATTTCA
ATTCACTAATTGGATAAAATAGATATCAACGTATTATACAGAAATACTGCATGCAAAGTAATAACG > SEQ ID NO:89 213830_300861_1 Trichoderma harzianum
AGGACATGCACACGCGCAAGAAGCTCATGGCCGAGGAGGTCTTCAACGGCGGGCCGGGAAGCGGCTTCATCGCCC
TCAGCGGCGGCTACGGCACCGTCGAGGAGCTCTTCGAGGTCGTCACCTGGAACCAGCTCGGCATCCACAAGCGCG
GCATCTGCATGCTCAACATCAACGGCTACTGGGACGGCATCATCCAGTGGGTCGACAAGGCCGTCGAGCAGGGCT
TCGTCAAGCTGCCCAACAAGGACATCCTCGTCACCGCAAACACCGCCGAGGACGCCATCCTGGGTCTGATGAACT
ACCAGNGTTCTGAGGGTACTTTTAAGCTGGAATGGGGAACACAATAGACTTTGGGTTAGGTTAGGTTAGGGATAT
AGAGGATAAACCGTACAAAGGGAATGCTTGGACTGTTCAGGACTGCAAACAAGCAAGCCCTGCATCTGCTTAATT
ACTATTTGTTTATTTTGTTGAAAAAACAAACAAAAA > SEQ ID NO:90 213835_300861_1 Trichoderma harzianum
GAGGGAGCTTTGCTGCTCTCCAGGCCGTCATACTGCTCAGACCTCTGTCATATTTGGAGCCGTTTCCTCGACTCC
CCGAATCTAGCCATGCGGATAAGACTGCCCTTTGCAGGTGTTTTCCTGCTTCTCCTGCTCCTGGCGGGCTATGCT

Figure 1 continued

GGTCTATCGACTATACAGCTCGGCGCTTATGTCAACGACAAGGTCCTTCACTTCGTAACGTTCTTCCTACTGACG
GTCGTATTCTACTGGGTCGTTGATACCAATCGTCGGCGAACCCTACACATGACCCTAGTGGTCTGCACTCTCATA
CTTGGTGTCGGATCCGAATTCGTACAGAGTTTCCTCCCCAACGATCGAGATTTCGACATCTACGATATAGTAGCA
AACATCGTTGGTAGTTTACTTGGACTTGGCATCTGCGCCTGGTATCACAAAGCGAATGCTTGAAAGAAAACGACA
GCGCAAACACTATGACGCCGTTCCAGGTGAGGACACTGAAGATGTAGAGCTGGGGCAAGGTCAGGAGTCTGGAAT
AACAGACGCTTCAAGTCGAAGCAGGACTCTCGAAGAAGAAGTCGATAACTGGGATGAAAACGCCGAAGACAACTG
GGATGATGACAACGCATCG

> SEQ ID NO:91 213836_300861_1 *Trichoderma harzianum*
GAGGTAACCACCAGCACACGCAAACGATACGAAAAACCGAGAACAAGTATACCTTCAGCTCCGCGGACAACAATC
ATCACCGCGGACAACAATCGTCACTGCACGTCTGCCTAGTTGAGAGTTCCAAGTGTAAAAACATCAGCAGTTGCC
TTGCTGCGTGGTTCCCAAGTCCAGATAGTCAACAGATCAAACACAAGACAAACCTGCCTGTTCGATTACTTTGCC
TCCTTGTAGTACAATTCGCAATAGTTCACCAAATCACCAGTCATCATGCCTGTCACTGAGTTTGCCATTATCAAG
CTGAGGCCCAATTTCGACCCCCTCGAGTTTCTCGAGACACTCATGGAGTGTCAAGAGATTCAGGACAATTGGATT
CGCCGCAATCAGCCATGCAATCTGGCGCCTGGCATGAACCTGAGCAGCATGTACACGGATGCCACAGACCAATCA
ACACTTCTCATCACGGCGCCGTGGGATTCGCCCGAGGGGCATGGGGAATGGATCCAGAGTCTTGAGAACAGGACG
GCCAATGGCAACTTAACCGAGTTCAGCGCTCCGGGTTGCGACTCCGTCTTGCTCTTCCACATGGACCCGGCGGGA
GCGAGGCCACAGATGCGGGAAGCCTTTCAGCACAAGGATACCAACGACGTATTCGACGTCTGTCG > SEQ ID NO:92 213837_300861_1 *Trichoderma harzianum*
GTCCAAGACAGAGCAAAAGGCCTGCCTCAGTACGTCTCCTTCTCCTACTCCTACGCCTCATCCTCACTCCCAACA
ATTGCCCCGCCATGCCTCTCCCACCCTTCAACCAATTCCGCGCCCAAACCTGCGTCGCGTCAAATCAGCGCCGGC
CGCGGTTCAGATTGAATCGCCGCCTAAGAGGCCGGATTATGTCCTTGCCTGCTGCTTTGTTCTGGTGTATCTTGA
GCTTGGGTGGCTAATTCTACTGCTGTTGCGCTCTTACAGTCGTCATTGATGGCTGGGGCATCCCCTCCGACGAGA
GCCCCAAGGATGGCGATGCCATT > SEQ ID NO:93 213849_300861_1 *Trichoderma harzianum*
TGTCTGACAGGGATGATAATGATATAACGAAAAGAAGAAGATAAGGAATTAATCCCAGATGTCGTGTGTTGGGAA
AAGGGAGAGAGGTAGTATGGGCGATAGGGCTCCCGTTTGCAGAACCGGTAGAGCGGTTTGAGGTATCACGGCAGA
AGCACAGAGACAATGGGCGGCACGAGACCACTTATGCACCCTTTTTATGACGGATGGCGGAGCGGCTATCTGGGA
AAAGAAAAAAAAGAAGACGGAGAAAGGGGGAGAGGACGAGATGAGAGGCGTCTGAGAGAAAGGACGGTGCTCTCA
GCTATATTTCACTATGTACAGCACAAGTACCTCCTTGTCCTGATGAGTCCGGCACA > SEQ ID NO:94 213850_300861_1 *Trichoderma harzianum*
GCGGGTGACTCAAGAGCGCCGGCCGGGCTCGGGGCGGTCGCTTGTGGGCAGATTGGCAATCCAGCATCAAAGGTG
ACGCCAAGTTGGTGGGCTGTTTTTCGCCCCTCGGGCAGGCATGGAGTTCGAGATGCTGGAGGGGGGAAATTTTTC
GATTATCGTGTTGCATTGAAGCCCGGCAATGGGTGACGGAGATGGTTGTCTTGTGTCACAAGGACCAAGCTGTGT
GCAGAGCATCGATGTACTGTACGCGGTTTTTACGTCGAGGCGACATGACCTCAAAGCCGCGATGTGCTCAATTCA
ATCAATTCATTGCTGCAATGAAAAAAA > SEQ ID NO:95 213862_300861_1 *Trichoderma harzianum*
CCACGCGCGCGTGAAACATTGTTGGACAACGCCATTCAGCTACGGCTGAGCGAGGTGGCGCCCTTGGCTTGGATG
AGATGTCGGTACTTGCATTTATTCGGTATGTTGGACTGTGCCGCTATCTCTTATCTACGGCACTGTTTGATATAT
ATATGTTCCTTGCGAAATGCTGGTAGATTCTGTGGCTTTAAGATGCTTTGAGATTCTGAATGTTGGATTCAAGTA
CTTGTAAATGTAACTAGGTTGCGTGAAGAAACCAATATTGTATCATA > SEQ ID NO:96 213865_300861_1 *Trichoderma harzianum*
CTCGACCACGCGTCGAGAGGCTTTTCGTAGAAAGCCGGAAGTAGTAGTGAGAAAGAAAGAGCCCTTTGTTTGCGC
CAGCGCATGACCCGCAGAGTAAGTTGTAGATGTTTTTTACTCCGGAAATGGGAGTCATGGAGACAAGCTTGGACT
TGGGGCTCTTCTTGGCGCTGGAAGCAGAGCGGCTCTTCTTCTTTGAGGCCTGCTTGCGGCGCTCCTTCTCAAGCA
TGATCTGGCGCATGCACTCGCGCTGCAGAGCAAGCTTCTCGCTGCATCTCCAGGACCTCGGCGTCAGTCAAGC
GAGGAGGGGACTGCATCATCATGATGGGAGAGGACGAGGCGCTGGAGCTGGCAATGCTGTGGCTGTCACTGTCGA
AGGGGTCCGACAGGA > SEQ ID NO:97 213882_300861_1 *Trichoderma harzianum*
CATGTGGCCACGGGAATGACGCAAAAGGCGCCGAGAGCGGAAATGGAGAGAAAAAAAACCCAATTGCACCTCGTG
ATGATGCCACTCAAATGTCTGTGGTCGAGCCACTGGCTTCTACCTACGCTTACATTACCTAACAAGGAACGAAAC
ATTTTGCGGCAAGGAGAATTGGATCATTGACTTGGCGAATGGCCTAATGAATGTCGTCAATTGCAGGCCTCGTGG

Figure 1 continued

TTTGGCGGTTGGATGAGAGGGGGAATTGGAGTGAGTGGGATGGGGAGTTGGAGTCATTGGATTCATTTGACAATT
GGTTATTACGAGCGGTTTAGGTAAGAATGTAACAATGGAACAGCAAAACGTGCACGC

> SEQ ID NO:98 213892_300861_1 Trichoderma harzianum
TGCCCACGCGTCTGCCCACGCGTCTGCCCACGCGTCTGCCCACGCGTCCGCCCACGCGTCTGCGGCTGGGGGGAA
AAAC > SEQ ID NO:99 213894_300861_1 Trichoderma harzianum
GCCCACGCGTCCGGCGTGAAGATAGGAGAGAATAGAGATAGAGAGGCAATTGCACGGAATGTTTAGCCAACAAGT
TGCTCGTGGCGGGCGCCGCATCGGCCAGATGGCTCGAGGCGGCCAATATCCGTCACTCGCTGCGCTCAGAGGAGC
TGCTCAACGACGATGTTATGCTGAGGCTGCACAGGCAGCCCCAAGGGACGTATCGGTCGAGGCCTCGGGCTGCT
CCTGTATGGCGTTGCATTTAGCGGCCTCGGAGCAGCAGCAACATTCTATTCGATGGTACAAAAGGGTTTCGCCTC
GTTCACCGACGCCGAGTCAGCCAAACTGTTTGTCCCAGATAGCGACGAGCTGCAACAAATCGAAGAGACAATCAA
CAAACACCCGCTCGTCCAAGAGCTTCGATCACGACCAGAGTTCAAGGAGTCACGACCACACCTAAAGATGTCAAG
CGAAGTCCGCAGCCGCACCCTCACCGGCGGCGCTCTACAAGGCGACGGCATGATCATGGTCCCCCCCGTCGCCTT
CATCGAGGACGGCGGCAAGTCCATCGTCAGCGTCACGTACATTGGCGACAAACTATG > SEQ ID NO:100 213908_300862_1 Trichoderma harzianum
GAAGCGAGAGCTGGGGTATGTTGAAATCAGCCCATGAGAGATTGAGCTGAAAGCATGTGGTCATATGGTTCCCTT
TACGCGAGGAACTAGAAGATCACAAATGCCTCACGTCTCGAGTGCGGGCCTTTACGATCTAACAGTGTCTAGATG
TTCATAGTGTTCATAGTCCAGCTTATGCTCTCGGCCAGTACCTTAGCGAGTCACGCAATCCGGACGGGGCAGATA
TACACCTCCAGGGCTGTATAATCTCTTCGATACTGGTTTCCACCGAGATACTAACCTCTTTTGCGTCAGCTTCTG
GTCGGTGCTGTTACACATCAGTCCGAGTCTTCATATTGAGCTGCTGAGCTGCACCTGCTTTAGTCCCGAAACCCG
GCATGTCCCGACCAGTCGTCGCCTTGTTCCGGAGAACATAACGTTAGATGTGGAGATGCAGATAACAATTTGTTT
GATCATATGATTTATCCTAAGCGGNCATATCACGCCAATTGCTAGACAGACGTTTATCCCTTG > SEQ ID NO:101 213911_300862_1 Trichoderma harzianum
NGAATAGAGGGAAAACAAGAAGCGCTGCTTAGCCCCGATCATGCGTACAATCTTCACACACTTGTGTCAGCTCAT
ACCAAATCGAGCTGGGATTGGTTGCCT > SEQ ID NO:102 213923_300862_1 Trichoderma harzianum
GCAAAGAATCCGCGGCCGACGTGCCCACCAACGGGCACTATGTTTCCAATGGCATGGGCTCTGGACAGCAATTCC
AGCCCCAGCAGTATCAGCAG > SEQ ID NO:103 213929_300862_1 Trichoderma harzianum
GACGGACTTGAGCTTCTGCTCATCCCTTTCCTCTTACATTGCTTTACCTTTATATTCTCTTTTCTTCTTATCTAC
TCGAATCCACCTATAGTAACTTCATCTACCTTAACCTTTTGTCCTCGGCGTATCTACCTCTTACATCTCAAACTC
TCTTCCTCTCTCTTCTCTCTCATACTTTTGCGTCACCATTCTACATCACATTTACCTCTTGTTAAATACAATCAA
TCCCACTATACCTTTCTACTCAGCTTGAAGCTATTCCTCTATC > SEQ ID NO:104 213937_300862_1 Trichoderma harzianum
GTCCAAGTACGAGTGTAAATGGCACAGACAGGTTAGATGAGCTGGTTGTTTGATTGTTGAATGTTGGTTAAGAGA
GTGGCCACAACGGAACCGGAAACAGTGGTAAGGTGATGCAAAAGCAGCAACATTTGGCGATGTCTACGGACTTCT
GCCAGGATAAAGCGATCCTGGCCGGCATCGAATTGACATACTCGCAGACCTCCTTCCTACCTAGTAGTCCATGGC
ATTGGGCCAGTCTGATGGTATCCAGCATTCATGTGTCAGATACAATCCATCCTGTATTAGGTAGTAGATATCCGG
ACAGACATCAAGCAGCATCAGCATCAGGTACGAGTAGGTATGGGGTACTGCGTACACTTAGCCAGGCACAGGCGC
CGGGCCAGGGTCCTGTACCAGTGACCGGCTGCGCGGATTGCTCAATCAGGAAAGGGGGGTCAACAGGACACAAAG
AATGGCACCAAAATGCGATCAATTAGCAGTTGGTTGCGCCGAGGAGGATCCATTCATGTACCAACAACAGCTGGT
GTAACTCTCCGGATGTGAGAAATGATGGTAATAACAGCAAAAGCTGGTAATACTCGTACTGGTAGTGAGCGTACT
GT > SEQ ID NO:105 213946_300862_1 Trichoderma harzianum
ACAGTTGACGTTGCACTGGGAGCATTCGGGGGCAAGTTGGAGAGCGGACGAGAATTAGGAGTAGGGGTGGCCCTG
GTAGTCGCCGCTTGTTTCTCTGCCGGTTTGTCTTCTTTCGCTGGGGGAACGGCAGCGGCATTGGCATTGGCAGTA
GCAGTGGTGGTGGGAGTGGGGGTAGAGGCTTTGCTTTCCACAGGCTTGAGGTTTGACGATTGATTCTCAATAGGC
TTTTGAGTTTCGTTCTTGGCCTGGGCTCCGTTCTTGAGGGCATCAGCAGCCGTAGCCTTTGATGGCTCAGACGCT
TGCGCAGGCTGCTTCTTCGGCACAGCCTTAATCTGCGAAGAGATGATTGCTGGATCGACAGGAGCACCCTTGACA
GTGGCCTGTCCAGTTGGAGCTCGTTTAGCTGGAGGCATGTACCGATTCTCCCGTCCAGATGCCAGAGGGGGAAG

Figure 1 continued

TCTTGACGGCGGACACCGCTGTACCTATTTTGATAGTTTAGTACAACAGTACGCAGGGTGAACAAGTTCGATGGA
TGCAAAAAAA

> SEQ ID NO:106 213956_300862_1 *Trichoderma harzianum*
GTCGCCCACGCGTCCGGTCTGGCTTTCGATCTATTTGTAGACCGCATCTGCGGTTTCGTTGGGAGCTACTACGTC
TCGCTTAAAGGCGATGTGGACGCAATCGTGTTTGCCGGTGGAATTGGAGAGAGGAGTGCTCGTCTTCGCAGCGCT
GTGGTTGAGCAGGCCGGGTGCTTGGGTTTCGCTATTGACGAGGCGCTTAACGATGCCGAGGCAGCTGGAGATGCA
ACTGTTCGGGAGCTGAGCAGCAAGGATTCTAAACATAAGGTCCTCGTGTGTCAGACGGATGAACAGTTTGAGATG
GCTAGAGCATGTACAGAGATGGAAGCACTTTGGACGTAAAAGGGAGGGGGGAGATAAAGCGCGGTTATTTAGATA
GTAGATGTGTGTATGTAGAATATATATATTGC > SEQ ID NO:107 213967_300862_1 *Trichoderma harzianum*
AGCAAATACCGCAAAGATGTCTGACGACGGGCTCTCAATATACGATGAGATCGAAATCGAAGATATGACCTTCGA
CGAGGTTCTTCAAACATACTTCTACCCGTGTCCCTGCGGCGATCGTTTCCAGATCGCTATCGATGACCTGCGCGA
CGAGCAGGATATTGCTGTGTGCCCCAGCTGTAGCTTGATGATTAGAGTTATTTTCGACCTTGACGACTTACCCAA
ACCTCCTCCTACTGGCAATACTGGTGGCCAGATACCAGTCGCTGCTTAAAGCCATCGCTATATTTGAGCTTCCCT
GGGCGAATACTTGATCTATTCGGCAGACACATCGAGATACTACACTAATTAGGCCCGCATAGCGTACACAGTGCC
TCAACGGCCGTTCTGAAGAGGCTTCTCAGATTGATCCGTCTAACATCGGATGTATTGATAGACGCGGACGAGAAG
ACGACGATGTACCAGCGACAGACCAAAGTCATCCCAAGCATCCAAGCTACTGATGCAAAAATATGCGTGCCTTGG
GAGTACCACTCTCCGAGGCAAAAATTCAGTCACTTAAAGAGACAGGCTTCGGGAATGCCATGAAGAATTCAGGCT
CACGTGGGGACATTTGATGAAAGAA > SEQ ID NO:108 213980_300862_1 *Trichoderma harzianum*
TCCGCAAAACGGTTCCAATGGCGAAATGTTTGCAAGACTGAACAGAAGCCCACCGACTAGAAAAACGTGGCGGCA
CGATCGAACAAGAAGTGACGGTGGGCAAAAGGGGGGGGGGAAGCATTTACCTAGGATCCGAGAACCTGCGGGGGT
TTGGGTCGTCGAGATGCATGTAACGCTGGCCCTGTGAGGCGAGCCGTCGGGAAAAGGAAACTTTTTTTTTTTCTGG
GGGAGGCCCTTTTCTTTAGATATTACCATTCATCTCGAAGCTAACACGGACGTGTTTCTTCAACTACCCGTTGAT
GTTATCAAAGGACTATCTTACAAGCTGTTGATTGTCAAAT > SEQ ID NO:109 213991_300862_1 *Trichoderma harzianum*
GCAAGGCTGAAAACGCCCTGCACGCCTTTGCCAACGGTGCTTGGCTCGGAATCAAGATTGGTGGCACCATCATTG
CATCGCTGCTCTGCATTCTCGCTGCCGTCGGTCTCATCAACGGCCTCCTTACCTGGTGGGGTCACTACATCAACA
TCAATCACCCTACCCTGACTCTCCAGACCATTCTGTCCTACGTCTTCTACCCGGTTGCTTTCTTGCTTGGTGTTC
CTCGAGACGGCGATCTCCTCAAGGTTGCCAAGCTCATTGCTGAGAAGGTCATCACCAACGAGTACAATGCCTTCA
ACGCCATGGCCACCGACCCATACTACGCCGACATGTCTCCTCGCTCCCAGCTCATCGCCACCTACGCTCTCTGCG
GCTTCGGCAACATTGGCTCCCTGGGTATCCAGATTGGTATTCTGAGCCAGCTGGCCCCGTCCCGTGGTGGTGACG
TCTCCCGACTTGCCCTTTCTGCCCTCATCTCTGGTGTTTTCTCGACCTTGACCTCAGCCTCCGTCGCTGGTCTTG
TCGTTACCACCCAGCTCTCCCACTTTACCCGACCTCCGGCGTCTGGTTAAGTGGAGTTTTGTGCGTGTTTTTTCA
TGTGAAAGATTTGTGCCATG > SEQ ID NO:110 214011_300854_1 *Trichoderma harzianum*
GGAACAACAGGAGTTGTCCAAGTATTCAATCAAGTACATCAAACACAATCCAGGAGACGAGTACGACCTGGACCA
TGTCGTTCGCACCATCACGGATCCCGAGTACCGCGCCGAGATTAAAGAGTATCTCAAGAACTCCCCAGAGGGTGG
CATGTTTTACTTTTTCCGCAAGAACTTTCCCGCCGCCGTATGGCCAAAACATTGACACTTCGGGCATGCACTA
CAAGATGCCCTGTGTGGTGATCTGGGGATGCAAGAGCCGTACTTTTCGGACAAGATGCTGGATGGATTCTACAA
ATGGTTTGATCAATCGGTTCGAGTTGTTACGCTGCCCCAGGCTGGACACTGGCCTTGGAGGGAAGATGCGCCAAA
AGTGAACCGAGAGCTGCGGTCGTGGCTTGATGCGCTGGAAAGCGGGCAACTTTGATGGAATGTATGAGAAAATG
ATAATGCATGGCGTAAAATAATTGGGATCTTTATGAGGAACATGACAAGAAAGTTTGAGGCAACACAGGGGAACA
GGGGAACAGTTTGGGAGAAAAGCATCGATTTAACGAAGAATAATATATGACAAAATTATTTA > SEQ ID NO:111 214019_300854_1 *Trichoderma harzianum*
CCCACGCGTCCGACACAACTCAACCACACTTTCAACTCTCAACTACACCACAACTTACAATCTCATCTCGCGACC
AACCAACTTTCACAATGGAGACTGTCAAGCAAGCCGTCAACTACGTCGCTGAGTCCGTCCAGGGCGCTGCCTCTG
GTATCAGCAAGGAGACCAACAAGGAGATTGCCAAGGACAGCAACGTCGACGTTTCCACTCGTTTGTCCGCTGGCA
AGGACGCCCTTGGTGACAAGATCGACGAGACTGGCCACAACAACAAGGCCGAGGCTCACAAGCAGCTGGCTGAGC
ACAACTAGATTGGCATAAGGAGCTTCGATTGCTTCACAGGCGTTGAACCGGATCAGAGCGAAGGGAATATATAGC
CTCACTAGGCAGGAATTGATGATTTGAATTCG

Figure 1 continued

> SEQ ID NO:112 214026_300854_1 *Trichoderma harzianum*
AGAACGGAAAGCAAGAGACAGAAAAAAAATCGACAATGACGCCCTTCGTTGCGACCGAGGAGCCCGCCTCGGCTG
CCCCGCCAAACCACAGTCTCAATCACCAGCTGCAGCGACAGCGGCATAATGAGCACGAGGCCGACGACGACGAGC
AGAAGCGCATAGCCAA > SEQ ID NO:113 214084_300854_1 *Trichoderma harzianum*
TCTTCTTCAACCAGTCTTGCAGCTCACATCAGCCATGTCTGTAACATTCACCGTCTTCAAAGGGTCTCCTTCCAA
GAAGATCACTGAGAGCCAGACCACGATCCCGGCCTTGCTCAGTGACCAGGTTTTAATTAAGAATACACATTCTGG
GGTGTGTGGTACTGATGCGCACTATCTTCACGCAGACATGGTCTTGGGCCATGAAGGTGTTGGAATAGTTCAAGC
CGTGGGCGACGGTGTTAGTCTTGTGAAAGTCGGCGACCGAGTTGGATTCGGATACGTCAAGGATGGATGCAAAAA
GTGTCAGTACTGCTTGGAAGGCTACAACTGGCACTGTGTTGAGGGCATCCGCGGATTCGGTTTCACCAACTTTGA
TCAGGGATCGTTCGCGACCCATAGTGTGTGGCCACAGACACGGCTGGCAATAATTCCTGATGAGATCCCCAGCGT
CAACGCAGGCCCATTCATGTGCGCCGGGCAGACCGTTTTCATCCCATTTTTGCGACAAGGCATAAAGCCCTCAGA
TTGTGTTGGCATTGTTGGCATTGGCGGCTTGGGCCATCTTGCCATTCAATTTGCAGCAGCCTGGGGCTGCACCGT
TGTTGTCTTCTCCAGTTCTGACAACAAAAAACAAG > SEQ ID NO:114 214086_300854_1 *Trichoderma harzianum*
CCCACGCGTCCGGTCATCTTCGGCAGACAGGCAACGAGCACCGAATCTCCCCGCGGATAAGGCTTCTTTTTTTCC
GTCTACAAAACGTCACCTGTGCAACAACTGAAAGCTCTCTGGCTTCTCCGATTCGGCGGTCCAGGCCTCTCTTTC
CACCTCTTCCAACGTTTCTTTCAACCCTCTCCCTTTGATCAGGCATTTCAGGATACCGCTTCTCGTCCTCACCGG
CGATCTCCGACGAGCCAAGATGTTGAACATATGGTCTATGGTATTTGGAAAATGCGCCAGCTTCTATGCCCCGCC
ACAGAGAGTTCCTAACACAAATTGCAGAAAAAAAGCAAAAGGAGGCTGAAAATGCCGAAGGTCAGGCTGCTGGA
GGGAAGAGGAAGAAGGTGACGGCGGCACAGCTACGAGTACAAAAAGATTTGTCAGAACTATCTCTCGGCGCAACG
ATGAAGACTGACTTCCCTGACCCCGACAATATCCTCAACTTTATCCTGTCGATCGAGCCGGACGAGGGCATGTAC
CGAGGCGGAAAATTCACATTCGACTTTGCCATCAACCAGAACTTCACGCACGAGCCTCCTAAGGTGCTGTGCAGG
GAGAAGATATATCATCCCAACATTGATCTCGAGGGCAAGGTCTG > SEQ ID NO:115 214087_300854_1 *Trichoderma harzianum*
AAACAACGAAACAACCGCCCAATCGCCAAGTCGCCGCCTCGACATGGTGCTCGGCGACTACGAGGAAGCACAATA
GGCGGGACGCGAAGCAAACAAGCGCTGGGCGTCTGAGAAGTAGCCCGAGAGTCACAGCTACAGCTACAG
TGAACACGCGATAGAGTGATTCAGGACATCCAGAGACGAGACGAGGCGCCTGAACGAGATACGAAGCAAACAGAC
ACGGGAAAGCAGATGCAATGTCGGCAAACGTAACAAAGCCGGCGCCCAATCGGCCGCAGCGGCGCGTAACGGCCG
GCCAGATCCTGTCGATGCCGCCGAAATGGCTCGGCATGTACGACGAATTCATCACCAAGAACGCCGGCCAGGTGT
CGCAGATTGAGAGCGCGCTGAGGAGCTTGACGTATATCATTCCAGGCCGCTTTCGCGATGCTGAAATCGCCTCCG
AGTCGATTCACTCGGGCGTCCAGCTGGTGTCGCTCTACCACGACGGCATCCTCTCGCAGGCA > SEQ ID NO:116 214107_300855_1 *Trichoderma harzianum*
TCTCCATATGGTTAATGGAGATATTTACGGTCTTCCTCCCATGCTGGGAAGTCTTGTGCCATCAAAGCCTCTGCC
AAGAGACACTAAACACAATTGAACAGTGGGAGAACAACAAGACAGGCCTCGGCAAGGCCATCAGATCATTCAAGT
CCAAATCGACAATCATCGACTCCATCAAGACCGGATGGAGGTCGACCAACAGCTCGATCCAAACATCTTCCGTCG
AGTCGATTCTGACGCTGAGTGCTCTCGAATACGTCCTGGAGAGGAATCCCGAGCCTCTACAACAATTCTCAGCCC
TGCGGGATTTTTCCGGCGAGAACATTGCGTTTTTAACAAGCGTAGGAGAGTGGAAGTCATCGTTTCCCGCTTCGG
TCCGCAGCCGCAGCGGCATTATGTCTGACGATACGAAGCGGGAGCTGGTGCGAGAGCGATTCAACCGCGCGCTTC
GGATCTATACTGAGTACATCAGCGCTAGCGATGCGGCATTTCCCATCAATATCTCATCAGTACAG > SEQ ID NO:117 214109_300855_1 *Trichoderma harzianum*
TCGAGTCTTGGCAGCCTTGCTCATCACGATACTCCCGCTTGGAGCTTCATTTTGCATTTCCATACTTGGTGTTTG
ATCGTCTGTTTAATTGTTTATCCATTCGCTCATCATGCCGGGAAACGTCACCACTCACCACGATGACTCCACGCC
CGAGTCGAGCGACAGTGGCCATCATGAACATGAACATCACCATGAAGAACACGAAGAACACGAACACAAAGGCCC
TCCCGGTGGCTTTGACAAGACTCCACTTCCTGATGCGCCGCAAGGATACACTGTTCGCTTCGTTTTTCATGGCGC
GACTAACATCCCGATTGCGGATTTTCACACCGGATCTTCAGATCCTTTCTTGGTAGCAACTCTCAAGGGAACGCA
GCCGAAGCGTCACAAGGAGGATCCCGACTTAAAGTACAGGACACGAACTCTGCACACAACCACGGAGCCGAAATG
GGAAGAGGAATGGGTTGTCTCCAATGTGCCCCCTACCGGCTTCACCCTC > SEQ ID NO:118 214111_300855_1 *Trichoderma harzianum*
ACTTTCCCGGCCTCATCACTTTGCCGATACGAAGATCGTCCCCTTTCAATCCAATTATAACGATCCGTTCGAGTC
GTGAAGCCGTTCAAAATGTCTTACCAGAAGAACGACAAGGATGTTCAGGAGCCGGCTAAGAGCCACAAGATCCGC
ATCACCCTTTCTTCTCGCAAGGTCCAGGTCCTCGAGAAGGTCTGCTCCGAGATCATCGACCGTGCCAAGAACAAG

Figure 1 continued

```
GACCTCCGCGCCAAGGGCCCTGTCCGTCTGCCTACCAAGTGCCTGACCGTCACTCCCCGCAAGACCCCTTGCGGT
GAGGGTTCCAAGACCTGGGACCGCTTCGAGATGCGCATTCACAAGCGTCTCATCGACCTCCACGCCCCACTGAG
GTCGTCAAGCAGATCATTGTCAACATCGACGCTGGTGTCGAGGTTGAGGTCACCATCGCTGCTTAAGCGAATCTC
CAATTTCGTAAAGATGTTGGAGTGGCCGAGACCCTGACGTCGAGGGAGATGAAAACAGCCCTCGCAGCAGATAAG
CACAAAATAAACT
```

> SEQ ID NO:119 214134_300855_1 *Trichoderma harzianum*
```
ATCGTTCCTCGGACAGCAATTTAACCATCCTCCCACAATCGCAGTAGAGACGGAAACAGTGGCGGAAATTACTGC
GATGATTATTGCGGCGACGTTAATCATTTTCCAGAGCGTTCGAACTCTCCAGACCTTGAACTGGGACAGACAGA
GAGATCGTTCTTTCGAAGGGCCATTGCTTTAATTGTGCGATGTTTAGGACTGCACCATGCTGATGTGGCCAAAAA
TGATCCGTGCTTCGGTCATGCGATGCTCATCAGAGCTTTGCATCAATGTGGCTTCGAAATGCGATGAGCTCTCTT
CTGTTGCTTCGTATCCCTTTATATCATGGCTACGTACGGCTAGAAAAGAACCGTGTTGGGCAGTCCCGACCCCAA
ACAGGCTGCTGGGCTGAGACCTCGACACGAATTACGCCATGCTTGGATGTTATGCTCACGCCGCTCATGCAAAC
AAACAAATAAACAAACAATCCAGTGAACTCATCTGATTTTTGCTTCAGTTGCATACCGGTAAACTGATCTGATTT
TTGCTTTCGCTGCATTATAGTGTAAATGTACTGTAAATATTACTACTGTATGTGTAAAGTATTGGGAGTCAAAAG
CTCAAACAAAGCTGTTATAA
```

> SEQ ID NO:120 214148_300855_1 *Trichoderma harzianum*
```
TCTTGCCCGCCACAGCAAAGGGCTGGGCGGATGTGCTGGTAGACGATCGAGCATGGGTAGCTTTGCCGGCGAAGA
TGAGCTGGATGGCGGCATTGACGGGGACGAAGCTGTCATGACGGGCATTGCGTACGAGAACCCCGAAGAACAAGA
ACTGAGGCGACAAAGCTTGCCCAGCATGACTGCCCAGCACATATCAGGCGGTCAGCCGGATCAGTACGGCGGTCA
TTCACGGACGTACCCTCCGGCTGGAGTAAGAACTGCCGCAACCGCCGGCCTATATGCACCCAGTAGTGGTCAGGG
TCAGGCCGTTGGTAACGGCAGCTCGAGCGTGTCAACCAGTATTGGGGGCAGCCACACACCCAACACCAGCATCTC
TTCGGTGGCAGTTGGCGGGCCAAATGCAGGTCTCTATGCGCAGGCTGGTGTGCCGGAAACCGGGAAGCCCCTGAG
CCCTGGTGGTGTCCAAGGCCACGACGGCTCTGGTGTCG
```

> SEQ ID NO:121 214150_300855_1 *Trichoderma harzianum*
```
TGTGAACTCTGCTCGGAATCGTCAATCGAGCCATCCAATTCTGTATGTTCTCACAATTTCTAATTATTGTATTTG
CCAACATGCACTCAACTTCATCTGCATTTCCGTTTCCTCGACCGTGTATCCTCGATAGTGACGAGCCCAGTACAT
TTCTGAGGGGAGCGAGGATTGGCCTTGTCTGTATGAGCAATGGTATCTATTGTGCTCTCACTCGTGGCTTGGGGA
GATGTTCACTTTACTAAACGGGTGGTATTGGAAGGAATCATGTTGAATTGGTGCTTTTAACAGGTATATGATGTT
TTGAAGAAACAAAGCTGCCTGTGAAAGCATCAGCTCCATGTTCCACTACAAATTGCATACAACAGCAAAAAATAC
CCGCCAATGATGGAAGGCCCATCGACGGAAGCGCCTGTCGTGGTCTTCTTGTTCAGAAGCGATATTCCGATCACC
ACTCCGGCGACATACTTCCGCCGCTAATCTCCAACGATGCTGACGAGTATAACTAGCTGAAAGCTTTCTTTCTTG
CTTAAAAG
```

> SEQ ID NO:122 214165_300855_1 *Trichoderma harzianum*
```
AAAAGAATGGATTATAGTTCCAGCTGGTGGGGACGAGACAGTCGTGGGAGCTGTGGAAGGATGGAGCACGCGCTG
GAGCGTGAGTGAAACATGCAGATGGTCGCTGTATTTGGGCGTAGGCTGGGCTGCGTGTAATTCAGAACATTATGT
GCCCACGCCATGCTGGTGGGAAACCTGTACCACGGCACCGTTGACATCGAATCGTCTCTGGGTGGAATTACCCCG
AGAAGCAAGATGTCGTACAAGGAGAACTATAGAAATTGGAGTCTGGACTCAGTGTGTCTTGTCCTAGGTAGTTGC
ACGTGCTCGTAAGGATTGACCATTTCTGGTAGATGAACA
```

> SEQ ID NO:123 214166_300855_1 *Trichoderma harzianum*
```
CGGACGCGTGGGTGCCACCAATTCGACAAGCAAGGTAGCCAGAAATGGCCCCGACCAACGACAATGAACGGCCTA
ATGCGAACGAAAAAGTGCTGCACGTGTGGTCGAAGCCGATAGCAGAGGGCGATCAGGTTCCCGGTCTCCAAGGGC
CGGACAAGAATCCAGATGGGACTCCGAGAGGTTCAAGGTCTGCCTTTGCAGAGGCAGTCTCAATGATCAAGAAGG
ATGATTTTACGAACGTGGCAAACACGCCCTGCGCACGGCAAGGACTGCTGACGGGAATTGGGCGGGAGCTGGCT
TGGGCGGCTTGAAATTTGTGATTCAAGGTAATGCTGTCAAATCTGCCAACTGGGCGGTTGGCTTCTTCCTCTTGG
GTAGTATAGCATCGTACGAGTACTGCCAGTATCAACGGCGGGCCGAGAAGATTCAGATGAAGAGGCACATCGAAG
TGGTCACGCAGAACAGAAAAGAGCACGCAAAGAAAC
```

> SEQ ID NO:124 214187_300855_1 *Trichoderma harzianum*
```
GATTTTGTTGGCAGATGGCCTTTTTTTTCACCCTGCCTTGACGGCGGTTGGCGTGATACTTTCTCGAGGCGGGTG
TCAATACGGATACAAAAGGGACGGCCGAGGGATTGTTCCTTTACAAAAAGGTACATCCAACAACGCACAACGGGG
GCTGGATGCGGCAGGTGATGGCCGCGGTGCAGCAAGTACCAGGCAGGTTGCTTAATTGATCATCCGGTGGCGGGA
GGTACCTTGCCCGACTAATCACAAAAAAGAGACGACACAAAAAAGGGTGCGTGCGAGCGAGCGACTAGCCCCGTG
CGCGGGTTTAGCACGAGCATGTGCTGAGAAGCGCTCGGAGCAAGCGAGGGAACGAGGAATGGAAAGTTTGGGCAA
```

Figure 1 continued

AAAGAAGGTGAGAGAAGCCGCTCTGCCAGTTTTTATGTGTGTATTCTGTTCGGGACGTTGAGATGCTGTAATGTG
GCTTGTCAGAAGTCAACATGCAACACCACTAGTGCCGCTGAGGCCATTGAATGGTGGGTGCCAAACAATGTGGTG
TGGCAAGTGATGTGCGCAATAAAAGGCAGAAAAAGAAAACAAAATTCTCCTT

> SEQ ID NO:125 214188_300855_1 *Trichoderma harzianum*
AAGTTGTGAAAGGGGTTGCAGATCCAATAATGCCACGCCGATCCATATCGAGCAATGTATTTATACCCAAATCGT
CCCTTTACCGAAAATTCCGAGCCTCTCTAGCGCTCGAATTTATCAATTTTTGACGAGTATCCATGAGCTCCGTGA
AAATCAACAAGAGATTTCAGGACATATAGAAGGGAGGGCTTAACATATATGGATATAAATTTTTCTATTGCTTCA
TCCAGCAACAAACCCTTACTGGAGCTCCTGTCAGCCACCGTCGAGATATTCCTGGAGGCGTCACAAAACTCTATG
TCGATCTCATAAGATCAATCGTCGTTGGCGCCCATACTGTACTCTGAGCTACAAGTTTGAGAAAAATACTTGGGT
CAACATACATTTACTACGTATCTTGAATTCTCACCAGCATGATTGATGGAATACAGCACCACGTTGAGACATAAT
AGCTTGGTAGTACTGTACGGGGCCGCCTCAACTATGGAGACGTCTAACCGATCGCGAGTTTAGCTCTCCCGGTAC
GAGTAGCCGTCTTCCGGGCCGGTATTTGGTGCTCGGACCTG > SEQ ID NO:126 214194_300855_1 *Trichoderma harzianum*
GGCAGAGCTACAACGGCCCTAGCACACAATTGGCCACAATTCACGCCTCACAATCGCCAAGATTGCTCTAATTCT
CGGGCAGTCAAGTCTTGTCAAGTCTTGTCAAGTCTCGAACTCGTATCCTTGAGCATATGCAGGTGGCGTCTGTGT
CTCGAGACAAGAGAGGGTGAACATGTGCACAGAACAAGGCACCGAAGCCGAAAGGGACAAACCGAAGCCGAGGTG
GGAAAAAGGCGCCACGAACCAGTATCCAAGAGTTTAGCCACTGTGTCCTAATAGAATCCCCCCTTCTTTTTTTTC
CTTC > SEQ ID NO:127 214213_300856_1 *Trichoderma harzianum*
GTTGGGATTTACGGTGTATAATTGAGCTGAACGGCGACAATTTGCTGGGCTTGTGCGTAGAGCTTCCGATGGGTC
CGGCTGCTTAGCAGTATAGAGAATGGAAGCTGTCATTAAAGGCGCTGTTGTCCGTTGTTCCGTGGTTGACAGCTG
GATATGATTGAACATAAAGAGTTGGGCCGTTGGACCGGGCGATATCATCAGTCGATTTGAAGCAGGTTCGCAGAT
ACTTC > SEQ ID NO:128 214214_300856_1 *Trichoderma harzianum*
ATCGTGTGTCAAATCGTGCAGCAATCTGGGGCAAAAAATTGGGGAGCAGGGCGTGTCTGACTTTAGACTTTGAAG
CTGTTTCCTTGGGGTCTAAAAGACTTGGCTTCGACAGCAATCGTTGCGCTTGAGCAAAGTATCCAGATACCCGAA
GCGGCGAGGGGTGGGGAGAGAGAAGATTACGCTGAGCGGCGCTGGAAAGCAGCAAGTACCTGTACTGCTGCCTGT
TCGCTTGTTTTTGGTGATGTGAGCTGGGCTTGTTTAAGGTAGTGGAGTTGCTGAGGGTAGCTCCATCTTAGACAA
AGTTTTCCCCTAGGCGTTGGGATTTTCGTGTCCCGTGAGTGGTTGTGAGATGACTGAGAGGAATGGGGAGCGGCC
TCAGAAAAAGCGATATCGGAAAATCGATGTGGCAGTTGGTGATTTCGCTTGAGGTGTTTGATAGAAATGCCATTC
TTTTTCCAATATCTAATAGAGACGCAGGCACGGCTGCCAATGTAGTTGAATTCATTGGTAGACATG > SEQ ID NO:129 214221_300856_1 *Trichoderma harzianum*
CGCCAATCTCGAACGCCTGTCAAAATGCTCTCCCGCGCCGCCACTCGCACCACCTCCGTGGTCGCCCGCCGAGGC
TTCCACACCACCCGCCCTCGCATGTCCTCTCCTTACCACTACCCCGAGGGTCCTTACTCCAACTTGCCCTTCAAC
CCTCGCAGCAAGTGGTTCGGCGCCGGCTACTGGGCCTTCATGGCCACCGGCTTCTTCGCTCCCTTTGGCATTGCC
GTCTACCAAACCTACAAGACCCAGTAAACGGATGCTTCGATTACAAAAGGCTTATATGGGCTGGACGCTTGGTGC
TATGAATGGGTGGTGGACTGTTGCGACAGAGTAAATAGCTCGAATTAGACGTGGGACCAATTCACAAGTCACATA
CATCANAG > SEQ ID NO:130 214222_300856_1 *Trichoderma harzianum*
GCAGCACAACGTATCATCATGCCGTCAGCTTCTGAAAAGGCGAGAGCAAAGCTCGATGCGGTGTTGAACGACCCG
GGACGATTTGACTGTACCCAACGGTCGAATCGCATAGCGACGACACGATATGCTACAGGCTGTGGCGTAGTCAAC
TCTGTTCCGCGTCGCCCCAGCCAGAGTAGCATAGAAAGCGATTCAGGCGGCGTCAGGAACAGACTGAAACGCCTC
ATGTCCTTACCCGCGTACTAAAGCGAAAAAAAAAAGTGACTGGAGAAATATTCTTGATATGGATAACAACCTCGA
TGGTTGTGAACAGTTTCATATGTCCTAGTGTCCCATCGAGCAAAGGTTGCCTGTCTATTGGCACGCTCGTACTTT
ATCTCGTGCCTCCTTGGCAAGATTGGAAGATGTACACATCTCTTAACCTGAATTTCTCTCCGAAGAGCATTGAGG
ATCTGTTGTAGTCCATCTCTGTAGCAGACATGTTAGATGCAATGAATTTTTATCC > SEQ ID NO:131 214236_300856_1 *Trichoderma harzianum*
GCAGGAGATCTTCGGCCCCGTGCTGGTGTGCCTCAACGTCGAGACCATCGACGACGCCATTGAGCTCATCAACAA
GAACGAGTACGGCAACGGCGTTGCCATCTTCACAAAGTCGGGCGCCACCGCCGAGACGTTCCGCAAGAACATCGA
GGCCGGCCAGGTGGGCATCAACGTGCCCATCCCCGTGCCGCTGCCCATGTTCTCCTTCACCGGCAACAAGAAGTC
GATTGCCGGAGGCGGTGCCAACACCTTCTACGGCCGACCTGGTATCAACTTTTACACGCAGCTCAAGACGGTGAC

Figure 1 continued

GGCGTTATGGCAGAGCGCCGATGCCGTGGCCAAAAAGGCCGCGGTGCACATGCCCACGCTGCAGTAGAAGATGAA
ATTGGGTTGAGCGGTTTAGGATTGTTTGTGTGCGGAATATGACGGAATGGTGGGAAAAATTGATGATGCCTTGAT
GAAATGAAGGGTGGTTGTCTCACAGAACATGCATGTACTGTACATAATATAGCCACGAGCAGATGGGCTGGACAG
CATGGGAATTGCTTTTTTTAAGCAGAATGAAATAAATCTACGTTAAATC

> SEQ ID NO:132  214237_300856_1  *Trichoderma harzianum*
AAAGCACAAAGCACGGCGTATCGGAGGTAGATCAATGTTTCGCAACCACGACAATGCAGTAATGGCCACCTTGAC
CTTGGCTCGCTGTCAACAAACCAACAGGCAATGCTCGACAGGAGTTCGGGTCCGCAAGGATGAAATACGCTTGTT
GTGAGCCAATCAAGACAAACAGCGATACGCCTGGCGAGGGCTTGATTGAGCCAACGAGATTCTCTTGTGAAACAC
TGCCACCGCCAATCTCCATCTGCTGCTTGCAAGCGAGAGCGAGAGCAGCATCACGTGATGAGAAAGATGGGTGAC
TCAGCAGCTCGGAGACCGAGGAGCCCATCCATCCATCAGGATTGAAGCTCTGATGCTTTGGAGAAGATGGAATGG
TGTGCACAGCCACCACTTGTGGGGAGATGGTCTCGCGAGCAGTTGGAGGGACTTGGATGGTACATGAACTAGTGG
GAGAGTTACGTGGGCATGTTGAGGCGAATGGGAGTACCGGTCAAGTAGCGTCTCTGGAGGAATGATTACGAACCG
TCGGGCTCTTGAGCAACCCGAAGGAGCGGAACGAATCTTGTTCGCTGATGATCAGGGCCTAAAAGCCAAACTAT > SEQ ID NO:133  214244_300856_1  *Trichoderma harzianum*
CGAACTGAAGCACAACGGGGTGAAGTTATACCTGAATGATACTGCAAGAAGAATCGAAGACTCTCATGTCGTCTT
GGCTAGTAATGGAAGAGAGATCCCTGCCGAATTGGTCATTCTAGCTGTGGGAGTAAGGGCAAGAACATCACTGGC
AAAGATGGCGGGCCTCGAAGTGGGAACACAGGGAGTCAAGGTTGAATCACACATGGAAACATCCGACGAAGACAT
CTACGCTGTAGGTGATATGGTTGAGACGAAGCATGTCATTCAACAACAGCCAAGGGTAGTTGCTTTAGGGGCCC
AGCAAATCGACAGGGTCGACTCGCCGCAGATGATATAGCCGGCAGACCAGTGCACTATCGCGGCAACATCGGCAC
AATCATCTGTCAGGTCTTCGATTTAACCGTCGGTTTAGCTGGCCTGTCCGTCTCGGCGCTGCGTGACTTGGGACA
GGAGCCGCTCTGGGTTACAGTGCATCCTCCACACCATGCGAGGTATTATCCTAACGCTCGTCCAATCACGATCAA
GACCGCGTTCGAAAAGGGCACAGGCCGTATTCTGGGGGTGCAGGCAGTGGGAATGGCTGGCGTGGACA > SEQ ID NO:134  214253_300856_1  *Trichoderma harzianum*
CACGCATGTGATTGATTGATTGATGCAAGTGCTATCACAAGCAGCCGGCCGGTCGCACTTTGTCGGAACGAGGAC
CATCAAACCAGTTCTGTTGCGCCCCAACTCCTTCATGTTCCATCATATTACTACCCATTAATACCCAAACAAAAC
AAGGGGAAAATCTTGGAAGTCGCAATCCAATTTAGCTACCCCATCGTGTGTCCTTTTTGCTCCATCCAAAACCAC
CAAAAACAAGCTCCGAAATATCTCCACAATCTAAGCCATCCATCTACGAGTAGGTCGAACAATCCCCCCCGTCGG
CTGTCGGCGAACCTTCCAATCTCTCTCTCACATCTTTCCGGCCTGTCAACTCCAGAGCCCCCGTCGGCGTCTTGA
TCAAATGTCCGGTAACAACTTCCTCCCACACCCTTCCTCACCGGAACTCGTACCCTCCGTAAACGGCACCTCAAA
CGGGGTAATCATAACACCAAGTTCGACG > SEQ ID NO:135  214259_300856_1  *Trichoderma harzianum*
AAAGACCAAGATCAGGACAAGACAATTCGAGAGTGCCAAAAACAGCAAAAGGGCAGAGAGACGTCATCATGGCTC
AGGCCAAGTTCGCCGTTTATCCCAGCCTCGTCGACCGCACCGTCGTCATCACAGGTGGTGCGCAGGGTATCGCCG
CCGACATGGTCGAGCAGTTTTCCCTGCAGGGTTCTCAAGTCATATTTTTCGACGTCGAGGACGAGCTTGCCGCTG
ATTTAGTCCGAAAAGTGTCTGATCAGGGCGTCAAACACAAGCCCATATACTACCACTGCGATGTCATCAAGATCG
ACGAGGAGCTCAAACCCACAGCGGCCAAGATCCTGAAAGACCATCCCAAGATCGACGGACTCATAAACAGTGCCG
CGAGGGCAATGGTGAAGCCCTCGCAGGATATCACGACTGAGTGGTGGGATGAGAGCGTCCCCGTGAACCTGCGGC
ATCAGTTCTTCCTGACCCAGGCCTTGCTGCCGGGGCTTCTCCTTGCTGCTGGAAACGCTTCGGTGATTAACATGG
GGAGCA > SEQ ID NO:136  214262_300856_1  *Trichoderma harzianum*
GTTCGATGCACTGCCACCATCCTCGGAGAAAGGTGTGTGTAGTGGACAATGTATGTGTGTCATTGAAGAAAGTAG
GAGTAGGTGGCGGCTCCTTGGCAAAGTGGCAATGTTGCTTGGTATTATGGATCGGTGGGTTGTGCCCAGCTGGAA
TGGCTTGTCTTGGCGATAGGGGGAATATGGAGTCGTTTTGATGGGAACGGCCTTTTTGGTTTACCGAGGAGGGT
CAACATGTGCGAGCATGTATGTTCAAAGATGGGAGAGGGAGAGAAGAAGAGAGAAAAATCAAGAATCAGTCGTGC
CT > SEQ ID NO:137  214267_300856_1  *Trichoderma harzianum*
AGAGCATCTTCCTGACATGCCGGGGTTGATGCAACGCTTTGACTGTATGGAAACATCCGTATTGCTGACATACAT
GTCTTCCATGTTGTCTTACACTGCACTCAGGAGGAGCAGTCATCCACCGAGTTGATTCACATGGCAGCAAAATTG
TGCTGGATCTACTGCAGCGCAGATCCTCTATTTGGGCATTTCTTCTCGGAGACAGACACAGATCGGCTCGGCGAA
CCCGAGAGCAAGTGATAGCAAGACAAGCACAGATATGCTTGGCGAGGCTGTCCTCACCAGGAAACGAAAGAGGAG
GTTTCACCAGCAACTCCATTCCCAGCAGAGGTCAGCCTGTCCTACCTGTCACATTAG

Figure 1 continued

> SEQ ID NO:138 214278_300856_1 *Trichoderma harzianum*
gacaaaatggtatgccaccaccaccgacgccaccgaccatgatgaaatggacgtcgctatgcagatgctgatctt
ttaaaATTCACAGGCGCCTGCAGCTGGAGCAAAGAAGCAAAAGAAGAAGTGGTCCAAGGGCAAGGTCAAGGACAA
GGCCCAGCACGCCGTCCTGCTCGACAAGACCATCTCCGAGAAGCTCTACAAGGATGTCCAGTCTTACCGCCTCGT
CACCGTCGCCGTCCTGGTCGACCGAATGAAGATCAACGGCTCCCTCGCCCGCCAGTGCATCCGCGACCTCGAGGA
GAAGGGCATGATCAAGCCGGTCATCACTCATAGCAAGATGAAGATCTACAGTACGACTCACCAACCCGTTCCCCT
TGTGTGCGCGTTTTGAAAGAGAATAAGAGACACTGACAATTGCGCAGCCCGTGCCATCGGCGAGTAAATTTACCA
CCATGTtTGAAAGTTAAAGCATTGAGATTTGGCGCCTGGTTGgtcTGAAAGgAaGaAAATGGGACCATGAGTGAa
GaggATGAtACGAggTATATAAAGCCTTAGTTGGGACGCTTTTCATGCTCGGTgt > SEQ ID NO:139 214280_300856_1 *Trichoderma harzianum*
CCTGTAACAAGCGAGGGGCGCATTCGCCATTCCGTGATGTGTAACCCGAATTATATCGATACTTTACTCAGCATG
GCCTCTTCCATCACGGACGCGAGTAACGGACTAACTCATTTCAAGCAAATCATCGGAATAACAAGTCAATCGACT
AACTTGTTTCAAGATTATCCATCGGAATGCAACTATGTAACACCACTGCTAATCACCGCATCATACGATAACGAG
GTCCAAGGTTTTGATAGGCCGACCCCGCCTTTTTTTTTGTTCTCCTCGGGTAACGGTGGTGGCGATATTTTATT
AGTTGTGACGGATCTTGGGAAAGCTCGATTTTGAGGGGTTGCATTGGGGGTTATATATTCCGGGTCGATCCAATC
TTGTTTATTTTTGTTTTTTTTTAAAATCACATCTCAACAAAAAAAACCTTGATTTACCCTAG > SEQ ID NO:140 214286_300856_1 *Trichoderma harzianum*
ACTCGAGAGGAGCCAGATGCTACGCCTGCCCCTGTTGCTGCTCCGAACCCCTCAGCACCAACTCCGCCTTCGGGA
TCAAACACAGGATCAGGTGGTCGCCTTTCACTCTCTGGACTTCTCAACATTCTGGATGGAGTCGCCTCACAGGAG
GGCCGTCTTCTTGTCATGACTACCAACCACATTGAGAAATTGGACAAGGCGCTGATCCGACCCGGCCGTGTGGAC
ATGATTGTCCCCTTCAGCCTTGCCGATAAGACTATGACTGAGTCCATCTTCCGTGCCATCTATGCTCCCTTTGAG
AGCGAGATCTCCTCAAACGAGCTGGCACTCGGCTCCAAGAGCGGTACCAGCACGCCCAAGCGCATTGAACCGGAT
GAGGAGGCCAAGCAACGGTGGGCCAGACAGCATGCTGAGATTTCTGAGCGCATTGAGGTTCTCTCTCTACAGTTT
GCTACCAAGATCCCCGAGTTTGAATTCAGCCCCGCGGAGATCCAGGGACTGCTCCTCAAGTATAAGCGATCTCCC
GAGGATGCCATTGAGGCTGCGGACGCTTGGGTGATTCAGACTCGCAAGGATAAGAAGGAGAAGGAGC > SEQ ID NO:141 214288_300856_1 *Trichoderma harzianum*
CCCACGCGTCCGCATCCATCGTCTTTGATTCATCAAACAGCTCTTGGATCCGTTCTGATCCAGCCAACCAACCAT
CGCCATGTCTGAACCTCTCACCAAGGTCGACTCCGCCGTTCAAGGCCTGTCATCATCACCGCCCAAAGAGAAGGG
CCATAGGAGAACAAGCTCTAGCGCGGCTGGTGTTATGACCATTGCGGAAATCAATGAAAGCCATGCTCCTCTAGA
ACTCGCAATAGAGACACAGCAGACAGCGTGGAAAATAAATCAGCGGCCCAAGGATCTCGACAATGATCAGCTGCT
ACAGGTTCCCCTCACCAAGCCTCCCATCAAGAGCATAACATTGAGGTTCCCTCATGGCAAAGAAGTCGTGGCTCG
CAACCTGAAGGGCCTGACAATAGGTGACGCCCTGTCGGCCATTCACAAGGCAAACAAGAACCGAGCTGATGATGA
GCTTGATAATCCATACCTCAAGGGCTTCGCATGGGATCAGGGCGAGAACTACTTTGAAGTACATCTC > SEQ ID NO:142 214296_300856_1 *Trichoderma harzianum*
GATGATATGGGTGTTTATTGTGAGACATGCATAGGGGCTGAGAAGGCTATAAGCCGGCTTCTCCTTGGAACCATG
GCGGTATTCGGCGATGATGCGCCAGTCTATACGGATATTACAACGTAACACGAGCTATTACAGTGAATTCCTCCG
GGTAAAAGGCGAGAGAGAGAGAGAGAGGCTGCAGACATGTGAATGTGGTTGTGGTGGATGGACCGGGGATGCCCG
ACCAAGAGGATGCAAGAATAGCGATAGCGATACCTAGGGACTGGCTTGTGAAAGAAAAGGTTGACCGAGGAGAAG
ACTACAAAGTGAGACATCGGGGCATTGATGGGCGACGAATAGGAAGCGC > SEQ ID NO:143 214307_300857_1 *Trichoderma harzianum*
TGATGATGAATAGAATGATGGACCAAGGGAATGGTTGGTAAGATGTTCTGGGAGGAATCTGTGTTTTTCTCAGGG
TGAGAGTGTATAAATGTGTAGCGTGTACATGTGTTGAGGCTCGTCGATACCCGGCAACATGATGACTGTGCGCCA
CCCGGCCATTGATTTGTGCTGATCTCTGCTTGATGAACACTGCCCTGTTTACACTGTCGTGTACTGTTAGTATGTC
CATCGTGAAATGGTGGTGTGCGATGTTTGTCGCGGGCTATGAAGATAAAGCAATGAG > SEQ ID NO:144 214309_300857_1 *Trichoderma harzianum*
AGGTGCTTGTTGTCTGTTTCTGTCTAGAGGTATTGGATGTAAATAAGATCAGCACGAGATGAGATGAGATGAGCA
GACAGACGATCAGATGGCGAGATTGAGAGGCAAATTGCAAGTGAATTTAAATTGCTTCGCTGGCGCCTAAATTGG
AAGCATCCATGGCTCGCCTTTTGCCTCCCCACGTGTGGAAAGTAGAGCCGAGAGCGATCCCTAGCGGCTATTCTA
TTCTGGCGGTTTGGAGTCAATCTGGCCCCCCGGAGATTGAGATGGTGGCTGTCGAGGTGCCGGATGGGATGGGAT
GGGCTTGTCTTTGGATACTTCATCTTTTCATC > SEQ ID NO:145 214318_300857_1 *Trichoderma harzianum*

Figure 1 continued

TCTCCTCTTGTCAGAGGCTTTGGGTTGATTGCCTTGCACCCTTTCCAACCTCTTGCGTGTTTTCTCCTTTTTCTT
TTCCTTGTTACGATTGAACCTCCCTTCGCCTGTTGCTCGGAACATGCGGATTGCCGGCTGAGCAGTTCAAGCGAC
CAAGCCAGAGCCGAGCCTCTGAATTTCATGCATCAATCTGACGTCTTTGACCGCTGAGCCTCTGGATTTCCGCAA
ACCGCAGCAGCAATATAACAATCCTTCTTCTTCTTGTTCAATTACGACTGTACCAATATTCACAATGGTTCTCAC
GCACTCCACCAATCACACCTACTCCCACCCTTTCCCGACCGTCACCCTCGCCTACTTCCTGCGATACTCTTCGCC
TCAGCTCAATCCCTTCGCCGCCCATGTCCTCAGCACCGACACCATCTCTAGCCATGTCGACCCGGAAACCCAGCG
CCTCTACACCACCCGCATCCACCTGAAGAAGAGCCGCATGCCTAGCGCAGTCTACAAACTGCTGCCCGCAAGCGT
TTCAGGTGGCAACTCTGGCGA

> SEQ ID NO:146 214319_300857_1 *Trichoderma harzianum*
GGGAATTTGAATGCCCATAACTTGCCGGAGGCAACAACACGCCAAGTCACCAGCATACAATGTCTTTAGTCCGCA
CCTTACGGGGTGACTTACCGCAGCAGGCGCGATCACTGTATCGACAGCTACTGAGGCAAAGCAACGAATTCGGCT
CTTACAATTTCCGCGAGTATGCGAAGCGACGGACCCGAGATGCTTTCCGAGAAAACGCTGCGGTAGAAGACTCGC
GCAAGATCCAGGAGCTGATTCAGAAGGGACTGAAGGAGCTTCAGACGATGAAGCGGCAAACGGTTATTGGACAGT
TTTACAAGATGGATCGATTAGTGGTCGAGGGAGGACAGTCGGGCAAAGAAACAAAATCAGGAGAGATAGTACGGC
AAAGGGAGCAAGGCTACGACTGAGTTAATGAAAAGCATGCGAAAACGACAATGATAAACACGGAGGGATTGATGA
CTGTATAGTAGGGTGGCAATGGGGCTTGTACATCATACATATATCACAGGAGCATCGAGAGACCGGCTTTTCGGC
TCGGCTTGGGAGTAATGCGGGATCGTTACGGGACAAACTTTAGACTACACAATCTCAACACCGATTGCGAA > SEQ ID NO:147 214326_300857_1 *Trichoderma harzianum*
GGGCGATACGTCGAGATGATTCGTCCGCAGCTTCAGTCCGTGAGATGCTGGTGCTATCAGATGCTAGCAGATGTT
ATCCCAAGTTACCCGATGCTACAGACCATCCACGCTGCAGATCAACGGCCGCTTCGTGATGCAAGTCTCACGCAA
ACTTTACCCTCTTTCAGTTCTTACGAGATGCAAGGGATTGATCCACTGGAGTCAGAGAATCTGAACCGCGACCGC
GACCGCGACGGCTACGCGCAAAGTTTGGGCCAGTGACTGACGCGGCCGTTGTTTGTCATCAAGAGTCACAGAGTT
CAATGGCCCTCAGGACAGCGGCATTTGCTGAATACGAAGCGCTGTGCTCATGGCATGGGCAATGTTCCTGCAGT
AGCGCGTGATATGCAAAACCTCTGTGCGTGCAGCTTGCATGATGCTAGGATGCAAGAGCCACTGCGGTTCACTGG
GCTGAGCCCCCAGACTCCTGACATGGCTTACAATACAATATGGATGCTGTGCTCGTAAGCAAAAGGCTTCTCCAG
TAGGTACCTTGCTGCCCGTTTGGAAAAGCGCCGAGAGCCCATGAGATATCGCAACACCGGGCGATTAGTCGTT > SEQ ID NO:148 214329_300857_1 *Trichoderma harzianum*
GGGATCATCGTACATGATACTATTGGCGACTTGGATTTCTAAGAGGGTGTCCAGGCAGGGCTCATTTGTAAGCCG
AGCCGATTTGGGATGACATGTTGCAGTGCATATGCATTTGACAGCGAGGTTAGTAAGTTTCTGTTCAAGTTTAGG
GCGTGTACTATTTGATGTTGTGAGATGTGAATTTGATTTCCAAGCACTGCGACCTGGGCCTCCTGCGCGATCAGA
GGTCTCTATGAGGAGATGAGCTATTGATTGCACTCAGCGCTAGATGTTTGATGAACCCTCAGGACACAGCATTGG
AAGTATTATTGATCAGAGAAAGGCTCTGGGCTATTCACTCCAGAGTTGCGAGAACTATGATTCACGTTGACATAC
GTGTCGGGCCTGCAAGACCGCTGGAGCAGCCAACGTAAACTGCAGCATTTCATCCAACGAAGAAGAGTCATATTT
TGTAGTAAGAGTAGCCAATGATGGCCCATCTATCAAGTACTTGCNANAAAAAAAAAAAA > SEQ ID NO:149 214332_300857_1 *Trichoderma harzianum*
AGCACATGTCAGATATGAGTGTGTAACCTGACGCTAGACGCCATGATAATTACGGAGCTGCCAACCTGCCCACCT
GCTTCTTGGACCACCAGAAATACGCATGAATCTATTCTTGTACACACGGTTATATCTTTTCCCCTTAAACTGCTT
CGTCAGGTCTTTGTGAGGACTCGCAAAGCGGTACGTTTAGGTACTGACCCTCTTGTACACCGTATTTGTACTCA
GCTGGCAATCTAGGTAGTTCCACACATAATGTAACATTCAAGGCTCCGTCACTTGAGACAACCAACAACCACTCC
TGATGGAAATTTCCAGCGGCAGATCCTCATTGCAAATACGACATAATTTTGCCGCAATGCTGCTTCACTGGATGG
GGATGCCATAACGTCTGTGTCAGTCCTAGTAATACAGATTGTGTATATTTCAATCAAGGGAAACAAATAGGTC
CC > SEQ ID NO:150 214333_300857_1 *Trichoderma harzianum*
AAAGAAAATAGAGAAGGGGGAGAAAAGAAGAGAGCCTCTTAGAGGATGATGCTGAATGACGCTGTGGATGGTGAA
ATGTGAGATGAGCAAGGTTTGTGTTACATGTATATTAAGAGGATTTTTTCTTTTTGTGGACGGTTTTTTATATGT
GATATTATGGAGAAACTAGCAAGGATGGAGAAAAGGGGGAGAAAAGGAACGATAAGTTTATCTCTGTTTGGGCAT
GTATGGGTGTTAATATGATTGACTTGTCAT > SEQ ID NO:151 214336_300857_1 *Trichoderma harzianum*
GCCTACTACCACCTTCGCTGCTCAGATGGGCACTGGTGAGTACATTGAGAAGGCTGTCGTTGAGGTCTAAGCGTT
TCCTGCGTCGATTTGGATAAAGGAGGTGTTCTTTTTTCTTTTTTCTTCCCTTTTTACTATTTCCTTTATAACGTG
GTGGGGTGGATAGCTGCAGGTAATGGTCTACCTCTGCAGTTTTGTGATGAAATCATACCCGGGGCACGGCGGATG

Figure 1 continued

TGTCCTAAGAGATGTGTTTGACGACGGAGATGCTTTTGTAATGCGGTAGATGTGGATATAACTATTACTACTAGT
TAAAAAATGTTATCCCAAGATCC

> SEQ ID NO:152 214340_300857_1 Trichoderma harzianum
GCCGCTAGCATGCACTCCGCACGCGGCTGATTTGCTGCTTGTGGTTGCTCCGTTACCCCGTACGAGAGTCCGGAG
GAGATTCTATCCAGCTGCATCGCAACCCGCTCCTCCAGCACGGCTACAGCTCGAAGCTTAAACACTTGGTATAGG
TCGTGACTTTGCACAAGCGTCTCAAGCTCATCAGCCCGGTCCGTAACATCTTCGTCTTGCCAAAATAGCACCAAT
TGGCGCTCCCCTGACATGTCTTGCGCTATGCGGAAAGCAAGACCATCTTCCTCATTGAGAACTAGCAAATACAGA
AAAGGGCTGTTCCACTGGACACCTTGCTCTGTCAAAGATAGCCGAACCGTGGGAGGTCCATTGTAAACGCGGAGT
TTAGCTGCTCCTAGAGGGTCGTCGGGTAGCGGAGCGACGTGTAGTGCTAGCTCTTTGACAGAGGAGTCATGGTCG
ATGAAGCCGTAGCTAAACAGCATCTCGGCTGGTGACTTTGCCTGTCCGTATGAGATAGTAATCTCTCCACCTGAT
GATACC > SEQ ID NO:153 214348_300857_1 Trichoderma harzianum
ATCGACCTCGGCTCCGGCTCGTCTCCACCACGCGACGAGATTGATTGATTGCCCGCAAGCGGCTCAGCTTCCTGG
GGGCGGAACAGACAGTCGCCTGCAACCCGTACTTCAGCTCTGCCGGCCGTTATCTTGAGTGCGGGAAGCAAGAAG
CACGAAAGAGCATCGATTTGGATCCCATCTTTCCCCTCGGGTGCCGGGCGCTGAGAGGTCACGTGTGGCGCGGCT
TTATGCTTGGTGCAGGAGCGTGCCACAAAGTCCGAACGGCCTCTCTATACCTTTTTTTTCCTTCTTCTACTCGTA
CTCCCCTTGTGGCCCTCACATGAAGTGAAGGGAAAAGGGCGACATGGAGCAGATTGAGACGCAGGCATCGGACCT
GCGCTACCTGACGGCGCCAGTCGCCGCTTTGAGCGACTCGGCCAGTGTCTCGTACGAGACGCCGCAGCCACGGAC
ACACATGAGCCCAGGTTCCGCCATGTACGGAGACAATTCCGCGCTGCACGACGACGCTTCGCCTG > SEQ ID NO:154 214350_300857_1 Trichoderma harzianum
TCGACCCACGCGTCCGCAAGGAAAAGGGCGGGATGGAGGGTACCGTGACAGGCGCTGGATGCCGGTCCAGAATAG
CCTCATCGGCAAGCACCGTGTGATTGGATCCGTGGTCCCGTCCAACCAGCTGGGACACGCGTTCATTCGCCCAAG
GGACGGACAGGAAGCCCGCAGGCCCTTGCGAACACGGGACAGCGATGGGGCCCGTGGTGATGATGATGAGATGAT
GATATCGCCCGGGAGAAGACGAAGGGAGGAAGCAGATGGACGGCGAGGGGGGAAAGAGGGTGTGAGCAGAGCAGA
GCAGAGGCACAGCAGAAGCACAGATCACTTACATCGGAGTCAAGCCACGCTCGGGGACAGAGCAAGCAAGAAGAA
TCCAATCACACGGCCAAACTGTCTCGTTCACGACAAGCCCATTCTTCCTCACGCCCCTCCTCTTTGTAAGGTCCT
CGTAAGTGTTGAATGACACCATGTTACCGGAACCACACAAAGAGGGCCCTTTGGAGGAGAAGC > SEQ ID NO:155 214358_300857_1 Trichoderma harzianum
GGATATCGCGATGGAGGGGTGGCACTATGGACATACTCTGCAGCCCAGAGAGTGAAGGTTGGCGAGCGATTGATT
TTTTAAGAATGATGGAATTCCAGCATTCTGTATATATGTATAAGTATATACTTGTGAG > SEQ ID NO:156 214367_300857_1 Trichoderma harzianum
CGACCTGTAACTGGGTACGTGCCTACATGTATATCCGGCATGCCCTCATGTAGGTGACATCTAAACCATGTTCAT
GCGGAGCATCTCGACGGCGCCTATCTGCTCCTATGAACGGCCAACCCTATACACATCGTACTCTGTACACAGTAC
ATGTACGCAACTACAGTAAAACGACATGGTAGTATCCCGTGGTGGCCATCCATGGGCTACTCTCTGTATGCTTTA
TAGGCCCGGAATAGGATCCCGCGGAGCCGGAAACCGTGGGGATGGAAGGCTGTGCAAAGACTACATGTATAGTTT
ACGGCTCAGAATTGTTGGCCGGAAGCTTGTTGTCGTTACGGGAGAGAGACCGATGTGACAAGCTCCCCTCGAGTC
AAGACCTCTTCATTTCATATTCACCAACGCTGGATAAGGTACTGTAAATGAACTCAGGTGTGCTCTCAGGTTCAC
ATTTACAGGAATCATGCCCTCCACACTCTCGGGGCATTTACACGGCCCGAAGAGAATGAAGAAGGAGTGTGTGCT
CTCCTATCTGGATAACGGGGTTTCATTGTGGGCATCTTATGCCCGCATGGATAGCA > SEQ ID NO:157 214368_300857_1 Trichoderma harzianum
GCAGAGGCCAATTCATTCGTAGGTGCGAGATGGTGTGGGAGAAGCCCGTCATCCATTGCTGGATTGGGATAGGAT
GGGAAAGGAACGCGGCCAAAAAAGATTTTGATTGAGGCATCCATGATGATTGTTACTAGTAGCTGTAGAATCACG
ATGCTGCTTTGCTTTGGCCTCCACTGACTCGACCAAAAAAAAAAAAACA > SEQ ID NO:158 214371_300857_1 Trichoderma harzianum
GCAATAGGCTCGTCCGGACCGACTTGCGCTGAGGCGCAGGTTCACACGCTGCAATATGACATCAACCTTGTCTG
GTACATGACAAAGTCCTCCGTATCCGTATAAGCTACTGCTATTATAACCGTAGAAGCCGTAGCGAGACTCGCGGG
ACTCCCGACCCCCGCAACCCCGGGGCGGAACGGGTGGATGTCAGGATCGGGAGTGGGAGGATTCAAAGGGGGGTT
CCGGCACACCCGGCTACCGAAGTCTGGGAGGATTCCGTAGTGCCGAGAGTATTCCCACCCAAGTATTGCTGCTCC
ATCTTGTAATTTGTGCCTGTAAACG > SEQ ID NO:159 214379_300857_1 Trichoderma harzianum

Figure 1 continued

ACTGGGGAGGTGATATGACGTCCTTGTGCAGGTGGGCGTAAGAATTACAAACTCTCTGATTGCCACATAATCCGG
ACATCA

> SEQ ID NO:160 214380_300857_1 Trichoderma harzianum
GGAGGGGAGAGAAACCTAACATTAATAAAGCGGACACTTATTTCGGCCGCTACTGTACTCTACGGATAATCAATA
CCTATCGCATGAGAAACCGTAAAGAGATAGGACATTAACAGAGGAGAGCCGGAACTAGATCGTGGCAATATATGG
GCTACTATGAGGAAAAGTCATAACTTGAGGGCCATTTATGTAACACAGATGGCAAGTCCAACCGAAATAAGAAAT
C > SEQ ID NO:161 214406_300858_1 Trichoderma harzianum
AGACTGTGACCAATGTTTAAGTAGTCAAAAGTGGGCGCTTTGTGCATAGGGTCAACATTATCCTGCAATTCTCAT
AGAGGCAGGTGTGAGCCACAAGCGGTTTGTAATAGTACAGGAACCGCAAAATGTATTTAAGGTCATGTGGTTATG
TGCAGATTGTCTGTTTCTGTTGCTGGTCATTTCTTGATCTCTCTCTTCTTTAAGCCCCTTGGCCGCATGAGCTGT
ACTATGCAGACTTGACATTGATGCAAAAGTCCAAAGGAACTCATAACCCCCCTCAGTACGAGGCTGTGTTGGGTG
CTATCGCGTCTATTAGCATGTAAACTTAGGACAGGTAGCTTTTAAGCAGTATCATTGGTTGATAGGTGTTTATTA
ATAATGTGACCTCAACTACCTGACGGCTGGTCTTCATATCCCC > SEQ ID NO:162 214409_300858_1 Trichoderma harzianum
ATCGAAGGGTCGATGGACGTTGTTGGGACAATGGGTTGCATTTTCTGACTGCGCTGCGCTCGACCTGCATCCCCC
GTCAGGCCCCGTACATCGGCCAGCCCTCAACTGGACGGACGGCCTATGTGGGTAATGCGAGTACGGCGGTCGGGC
TAAAATGTCGCGATGCTGGGTTAGGGTTCAAATTTCTTCAGCCAGCGAGCCTCACGTTGCGGTGATTGCACAGGG
AATGTTCTCCCATCTGCCGGAGCAGCCAGTCGCTAGCATCGTTCCCGTACAAGTACTAGAAGGCAAACCCTTGGT
GAGCTAGCACACACAGGTACTCCGTGCCAGCAAATGGACATGGTCATGGATTAGTAGATCAACATTGGAACAGAG
TCATAAG > SEQ ID NO:163 214411_300858_1 Trichoderma harzianum
GGATGGATACTTGCAGTAATATGGGGTAAGTGAGTGAGTGAGTGAGTGATATGGATACAGCGGGATGATGATGAT
GGTGGTGGTGGTGGTGTTGTCACTGATGTTGTCGAGTGAGTTGTTTGTTTTGTTTACCTTTGGAATTGATTGAAA
TGAAATGAAATGAAACAGCCCAATGCACAGCCTAAGTCCAAAGAAAACAAACC > SEQ ID NO:164 214416_300858_1 Trichoderma harzianum
GGGGGCGGTGATTCGACTGATACGTGTTGAATCGTGAATTACTTCGTAGTAACCAATCGATGCCATCCAAAGGGA
AATGAGATGATTAGTACTAATGAAGCAATGCCCTCCTCACTTCACTCCAAGGGTACGGTAGCATTTGTGCTACAG
CATAGCCTTTTGGATGCTAGACTTGATTGGATCAGGTGTGTATGATGTTGTGTGTGTGAGTGATTGGGTGGTGAC
TCAACTCAGGGCCAGGCTGCAGGCAGACACACCGCACTTCCAATATGCCAGGAACTTAGTTCATCACCATACACC
ATCAATACAATCACCCAGGTATGACTCT > SEQ ID NO:165 214417_300858_1 Trichoderma harzianum
GTTTGTTAGCCTTTGTGATGCAATAGCATGTTGTAAGATTGTTTGTGTAAGTGAAGTCTATAGCAATGCCTGGAA
TGTGATGAACATAGGAATACAGGATGGATGACAGAGTTGGTGATGGATATGTACACTTACCCTCGCTGATACGG
CACGTCGTCAACGGTCTGGTATTCTTGTGGCTGGACGATAGACATTGTTGCGGTTTTCGAACGGTTTGTTATGTG
CTTCAATGGTTTCTTGGCTTTGTAAGTTGTCACACGATCCAAATAACCCAAAATCACC > SEQ ID NO:166 214421_300858_1 Trichoderma harzianum
ATTGAGTCCCTAGGCCAGAACCGCGCGAGTATACATCTATCTGCAACATCTCTTACCTCCATCTTCGCAATGGCT
TCTGATAAGATGGACCGCGGCCTCGACGAAATCATTGCAGACGAGCCAGCAATGGATCTCGAACCCGACGCGGT
GGCGACCGCCGTCGTGACCGTCAAGACTATCCCCGTGATGGGGTGAAAAAGTCTCTCCGCAACGAACCTCGAAAC
TTGGATAGCGAATGGGTACATGATCGATACGAAGAGAACACGTATCGCAATAGAGGCCCTGCACCGCGTCGCAGG
CGCGAGTCTCCCAGCGGGGAGATGCCCGCGGCGCACGACTCCGAGTCGAAAATATCCACTACGATCTCACCGAG
GAGGATCTCGATGAACTTTTCCGAAGAATTGGCCCCATCACAAAATTGCAACTGCGTTATGATCGGTCTGGACGG
TCCGAAGGTGTAGCTTTCGTAACGTATGAGAGCAAAGACGATGCCGCAGAGGCTGTGAGACAATTCGATGGTGCC
AATGCGAACGGCCAGCCAATTCGTTTGTCCGTCATGTCAAGTGGGCCTTCTCGAAACCCGTTTGATACTGCTGTG
ATGCCAGGCAAGCCTTTGTCCGAACGCATTTCTGCTCCTGGTGGCAGATCTCGATCACTCTCCCCTCG > SEQ ID NO:167 214433_300858_1 Trichoderma harzianum
AGAAGGAGTATATCCGCGCTGCCGACATCATCTACTGCTGCACTCCGTCTCAGGAGGATCTTTTCGAAGCCTCCA
TCCTCACAAGCCATGAAGGGAGAAAAAAGGGCAGGCTCATTGTCGCCGTAGGAAGCTATACGCCTGAGATGAGAG
AGCTGCCCGAGGGTCTTCTCCAGCTCGTCACGAAGCCCCGTGAAAAGGGCCATAGGCATTTTCACAAGCATGCCG

Figure 1 continued

ACGAAGGCGGTGTCATCGTGGTAGACACATTGGATGGGGCGTTAACGGAAGCCGGAGAGATTATCCATGCAAAGA
TCCCACCCACCCAACTCGTTGAGCTTGGCGAGCTTGTGATGCTTCACCGGATGGCCGTGGACGAGTCAGAGTCTG
AAGCCTCCGATGTCATGTCCCAGACTTCCTCCTTCTCAGAGCTGGACCTCTCGGAGAGAACCCAATCTATGAGCA
CAGTCTACAGCGATCTGCCACCTAGCCCTTCAAGCACCACATCTTCGGGCCATAGATCGCCCTTTTCAAAGCACT
TCCGGAAAACCTCGAGCAATTTGTCCGACAAGGACAAGGAGAAGCAAAAGGACGATGCCCCTGT

> SEQ ID NO:168 214437_300858_1 Trichoderma harzianum
AACGAGCAGCACGGCAACGTCCCATACAGTTGCCCAGCATGTCGCTCGTCACGGGAGAGAAGACGAACTTTCAGT
TCATTCTCCGTCTTCTGAACACCAACGTCGATGGAAAGCAGAAGGTTATGTACGCCTTGACCAAGATCAAGGGTG
TCGGTCGCCGATACTCCAACTTGGTCTGCAAGAAGGCCGATGTCGACCTGAACAAGCGCGCCGGTGAGCTTACCT
CCGAAGAGCTCGAGCGTATCGTCACCATCATCCAAAACCCTACCCAGTACAAGATCCCCGCCTGGTTCTTGAACA
GACAACGCGATATTGTTGACGGCAAGGACTCTCACATCCTGGCCAACGGTGTCGACTCCAAGCTCCGTGAGGATC
TGGAGCGCCTCAAGAAGATCCGTGCCCACCGTGGTCTCCGACACTACTGGGGTCTCCGTGTCCGTGGTCAGCACA
CCAAGACTACCGGTCGTCGTGGCCGAACTGTCGGTGTCTCCAAGAAGAAGGGTGGCTAATGGTTTTACTGTTTTC
GGTCTGGGGTGGACAGGCGTGACGGCTGGGTTTTTCATCACTGTGATGAGCATTTCCATGGGACTGCTTTCTGGC
ATACGCAGCTGGAGCTGTACTCTAGATCAGAGTCAAATG > SEQ ID NO:169 214438_300858_1 Trichoderma harzianum
TGGATGGGGTCCGGACTGGTCTCACTGGATTTTCTTCTTCTTCTTTGGCTGTCCTCCGGTTCTTTCGGGCTCGGG
CTCTGGCGGTCTTCGCGGCAAAGGGAGATAAGAGCCCACGTGCGAATTTACGAAAGCCCTAGCGCTGATCGGGTT
TAAAGCAAGTGACGTGATGAATCCGAGTTCATTTGCATAAAAAAAAAACATAAAAAATAATAGAGCCAGAGATTTG
CCGACCAGGGCAGGGGGCGCAACCATCTTCATCGTCCATCTTCGAGTGTGTGCCACCCGGAGCAGCAAAGACGGT
GCCTCGGCCAAGAGTCAAATGTCAAAAGATGGAGATGCAATATCACGGAAGCCGAGCTCCACTTGATGCTCGGGC
GGCAAGTATTACACAATGGCAAGAGATCCGGGGTAAACACCGCAGTCCGGCCGATCCTCGAGGCCTATTGGATG
AGCGTTCCGGCACCCAAAGGGATTTTTCGGAACCGATGGTCGGGGATTCCCACCCCCAGCTTGCTTTCTCCCATG
TGTCTGTGGGCCAGAACCAGAATGCGGGGAGTAGATACATAGATCTAGAATTGCCTTGAGATCTCCTGATATTTG
AAGAATAGGAAATTTTTTAACCTTT > SEQ ID NO:170 214439_300858_1 Trichoderma harzianum
GAAGCATATCGGGCTGAAACCCCCACAACGGGAAGACGGGACGATACGAGGCAATGAGGCAATTCAGCGGCCGGT
AGCTGTCGGGATGTTTTTTCCCCGGGGAATTTCGCGGTGGCTGACACTTGGCGTCTCGGGAAATGATTTGACGGA
TGGATGCCTAAGAAATGATCCGACTGATCAGGTACGGCTTATCGGCTGTTAATGACGCAGCATAAACAAGTTGCA
TGTGTATCCTAAGAGCATGCTCGCCAGATGTAGATGGACAGAGGGCACAAGGATTGGAAGAATACATTGCCAATA
GTGGTTCATATAGGGAGTAACTACATGTATCTTACGCTTGAGCGCCTGCTTTTAAGTAGCTATGTAGTACAGATG
GAGGAAGCACC > SEQ ID NO:171 214441_300858_1 Trichoderma harzianum
AAACCGGCAAAGAAATACCCTGCAGTCCTCGAGACTCGCGATAGAGCAGAAGTACATCAGTCTTATTTACTAGCG
AGCAAGACAGTCAAAATGTCGTGGGCGGGTACGGAGCTTGCGGATGCCCCGCTGAGAGAGAGGGAGAGGGGCTGA
CGGGATTCTAGGATTCAAGAAGAATGTGAACCGCGCGACGACGCAGGTGATGATGAAGACGGGTGAGCAGCGTTG
GTATTCATTCGGTTGGGATAGCATTCTGATCTTGTGGTTGCAGGGCATGTGGAAAAGACAAACGATCG > SEQ ID NO:172 214443_300858_1 Trichoderma harzianum
GACGCTATCGAGGGCTGACCTGCATCGTCGTCAGTCGGCAGACGAGCGGATTAACAACATTCTCGAGACGGCTCT
GCAACGAGCAGAAACGATGGATCCCGCCTCTCTAAGCCTTCTCCAGAAAGGCTCTTCCCACAATTCCTCTCCCAA
CTATGGAGCCTCCGGAACGGTGACAAGAGGGATATTGCAAGACTATCAGGCGGTACCGACCAGCGATGAAAGCGA
TGCCACCCGTCCGAGAAAGGTTTCATACAGCGATGCGGCGAAGAAGCCGGGAACCATGCGAAGAGCCAGAGCTC
TCTGCGGCAACGAAACGGAGTCTCCGGCTCGGAGGATACAAGATCGCCAACAAAAGCAAAGTCATCATGGACGAA
GGAAACATTTCGAAAATTTCAGTCCCTTCAGTTGGAAAACAAGGGAAGCGTGGCTAGAGATCACCTGGCTCTCGA
ACGCACATTTCTAGCATGGCTTCGAACCTCTCTCGCTTTTGCATCGATTGGCGTCGCCGTGACGCAGCTATTCCG
CCTCAACACTGATAACGCTTCCGCCTCCGATTTCGACCACACAAGGCTACAAAAGATGGGCCGCCCGTTGGGTGC
GACATTCCTCGCCATTAGTATTGTGACCTTGCTCCTCGGTTGCAGACGATATTTCCATGCCCAGGAATGGATCCT
TCAG > SEQ ID NO:173 214444_300858_1 Trichoderma harzianum
TGAAGAACTGATGCTGCTTTGCTGTAGTCGAAAGGAACAGCTTGGTACGAGCCTGCTTGCGGTTGCTGATTCTTC
CGCTGCTCTTTACGGGCATGCTTTTCTCCTTGTCGCTTCGTACGAAGTTCCAAGCGTTGCCGCTCCTCGGCCATC
TTGGCTTCGTCTCTCTTTCTCTTCTTCTCTAGTTTCTTCGCCCTCTTGGCGGCCCCGGGGGGTACGTCTTCATCC

Figure 1 continued

TCTATCTCAATGACGGCGTTGTCATCCATAACATCATCTTGCATCTCCTCGCCTTCACTAGATGACGGCTCGTCG
TTTTCAATGGCGTCGGATTTTCTCTTTCTTCCTCTGCGCAGGGTGAATTCTTCGTCCTTCTCATCTTCAGCGGCG
CGAACGGCTGCTGGTTTTGTAGGCGCTTCAGTTGCCGCTGGGGTTTCTTGGACAGGCTGGGCTCCGACAACGAAG
TCTGTAGCATCTTCAACAAACCGTTGCCAAGGAAAAGGGAAGTAGTCTTCTTGCACAGCAGCTGCTCCTTTTGTT
TCATCCCATCTTGAGCTGACAGCAACATCTCCAAATAACTGCGAGCGTTGCAGCTTTGTGGCCGTGGCAGCTCCT
TCCAATTTTGCGGTTTGGCTTTGGGTCTTTGTTACC

> SEQ ID NO:174 214445_300858_1 *Trichoderma harzianum*
GAACCAACAACCAGCCAGCAAGCCAGCAGCAAGCCAGCCCGCCGAGACACGGACCAGCGCGAGAGGCGCCTCGTC
AGATTGGATTGGCTTCCAGCCTGCGTGAATCTGAATCATCCCCAGGACAATCCCATCCAATGCTCAGCGGCGCCG
ACTCGGCCCAGGGCCGTCCCCGCAAGTTCACCATCCAGAGCCAGTTCGGCCGGGCTCGACTGCCGCGGAGCCGCA
AGAACCGGCCCTGCGACGCCTGCCGGAGGCGAAAGACGGCGTGTGTGATCCCTTCGGAGCCTCCTTGTCTCTTCT
GCAAGAGCAGGGGACTGACGTGCAAGTCTTCGCCTACTCCTGATGAGATATCATCTCAACAAGAGAGTGCCGCCG
ACAGTACCACTGAGAATGGAGCCTCCGACGCTGAGCTTGTCACACCTCCAGCCATAGACTCTTCGCCGAGTCTAG
CACGGCGTAGCGTCTCGCACTCCAGTCCGGCAGACACGATCCAGTCGTCTGCAGGCTTGAGCGCCGCTGGAGATT
TGAGTCTGGAACAGCAGTCCTCTGGTTCCGCCGCCGTGGTACATCAAGGCCTGGTTCGCCAGAATTCAGATGGCT
TGGACCAACCCTCATATGGTGTATCTCCTCCGGTACCTATTCTATCAAACGGTCCTCTCCACACTCTA > SEQ ID NO:175 214447_300858_1 *Trichoderma harzianum*
CCCACGCGTCCGCCCACGCGTCCGGAAACACAAACAAGCAAATCAATTCCCGAGCAAGAAAAAAAGAAGAAGCCC
ATCATGAAGATGCTTTCGTTTGCCGCCCTCTCGGTGCTCGTGTTGGGCGCTTCGGCCCTGGCTGCGCCGCCGGCC
CACCCCCCGGCCGACAATGGGTGCTGCTGCTGCGACATCAACAAGAAGAGAATCGACTGCGACAGGTCGATCCCG
GCGTCGGAGTGCATCTGCCCCCAGGTCATCTGCCCCGCCGACTTACAAGCAGTGCTGCTGCTGCAATCCCAACAT
TAACAAGATTGTGTGCTCGCTGAGGCTCGTGGAGGACTGTATCTGCTTGGCCGTGATGTGTCCGACGGATGCAAA
GACCATCTTTGTCAGGCCAACTGGCGTTCCGACTGTCGCTTAAGAGTATTCGTTGGCGAGCCGACTTGCCTGAAT
CCTGGACCGGGGACATGACATGGGGGGAGGGAAAATACAGGGCAAGGCATTGCTGATGGTGAATGCACAACACGC
GTGGCAGACTGGCCGAAAATTGATGATTTACTGATGGGCGACTTTGGACTTGAAATGGGGCATGCCGGATGGGTT
ACTTGACAGTATTTACACCATTTCTATTCAACAATAAATG > SEQ ID NO:176 214448_300858_1 *Trichoderma harzianum*
TGTTTCATAATTTGACATTCACCGTAGAGGTGAAGGGTTTAACAAAGTAAAACCTATAAGTTGGCTGCCGTCAAG
CATTCTCGAGCCAAGCCGAAACGAACATGTAATCGATTCTCACCAACGAGTGCGGGCGCTCCGGTCGAGGGAAAC
AACCACAAAGTCAAGATGCGTTCGCCCATGACGGCTATCAAACACTCGCCGACGCTGCAGAGCCTGCGGAGCGAC
AGCTGGCGTAGCGAGAAACGCGGCGACGTCTTCTCCGCCGAGCACTTTAAGCGCAAGAACCAGTTCAAGCGGCTG
TTTCTCGCGTGCCTCGTGCGATGGGTGATGACGGTGCTGCTGGTTGTCGGGACGTATCTCGTGCTGTGGAGATAT
TCGGTGAAGGAGGCCATGTTGAGCAAAAAGAAGAAGGAGTTTAACACGTTGATTATTGCCATTTCGATTGCGTTG
GGTCTGAACATTGCGAGTTCGATGAAGCACATGGTGAGGGAGTTGAGATGGTGGGTTTTGAGCTGGTACGAGTGG
ACGCCGAGAGAGGTAAACAAAGGCTTCAATTTATGCGAGACAATTCGTAATGGCTAATGTGTTGGTGATGATACA
GGCCGATTGTATTCTACAGAGCGAAAACTTTAGCAGTCTCT > SEQ ID NO:177 214450_300858_1 *Trichoderma harzianum*
GCCCGCCGAATCCCAGACGCGGAGCCCCGGAGGCCCCAGGCAGCTGGATCCTGATGGAAAGCTTCGGTCGGGATC
CGGGCTTTTTGGTGCTGAGGAGATGGGCCGATGTTTTTATGGAGGTACTTTGATATTAGTGGCGTAGTTGGTGGG
AAGGGGATGTATTTTGGGGTTTCGTGAGATGACCTGATGGAAGCATAATTTGATGCTGAATCGGATGAGGGGATT
GGGGTTGTAGATATGGATGGCTACATATCTGAGATGCTGGGGGAATCAATCAAGATAAGCAAGGACTAATGTGAA
TTAGTCGTAGTGAGTTGCGAGCTTGTCAGTTCTTAGTAACTTTGCCTCTCTTGTGATTTCATC > SEQ ID NO:178 214452_300858_1 *Trichoderma harzianum*
ATAGAAGCATTTGAAGCCTCCTCCTCCAGGTTGCAGCAAAAGCACAGGAAGCAGCGAGATGGAAGGCAAGAGCCG
GCGACCGGAGATAACCGTCGTGCCGGCGGCAGGCGGCGGCGCCGCCGCCGCCGTTGATGCGGTGAAGGCGGCGAA
CAAGGAGCCCATCAGCCCGGGCTCGCCGTCCCTGGCGAGCGGCGCCGGCAAGGAGAGCCTGAGCCGCCATGAGGC
CGCCGTCGTGTCCCTGCCCGCGTGGAAGCTCGACGCGCTCTGCCAGGAGTCCGGCTCGTCGCCGGCGGTGATGAG
GGCGCGCTTCCCCTACTTCTGAATTTCTGAATTTCTGATGAAGCCATGAGCTTTTTGCCATCTTCGTACGTGTGT
GTGTGTGTGTGTGATTGTAACTGTGTTGTTCATGGCTGAGTAAAGAATTATACTTCCTAC > SEQ ID NO:179 214456_300858_1 *Trichoderma harzianum*
AAGACTCCCCCTCAAGGCCCAGAAAAGACGAATTCAAATCTACGCCGACTGTCTCTCTGCAATCGAAAGCTATT
CGTGCAACCATTACACGTCAACAAGCCATCGATCTCTTAACAAACCTTTATAGAACTTGCGACAACTTTCTACCG

Figure 1 continued

CCATCATGGGTGTCTGTGCCGCAGTACTAATTGTCATCGTCACCATCTTCTTCCCTCCGCTCGGCGCGTGGGCTG
TGGCAGGATGTGGAATGGACCTACTCATCAACGTATGCTTGACGATACTTGGGTATTTCCCGGGTCACATACATG
CGTTCTATCTCGAATACGTGTATTACGACCGTCGGCAACAAGCCCGCGAGGGCCATTATCCGCCGCGTCGTGCTC
CCGGCATCTACTCTGACAAGGTGCAAACGGGTGGACAAGGCCGTCGACAAGGCTATGGAACGATGGCACCGCCGC
CTGCTGGGCAGCCTGCTGGTGCTGGTGCGCCTGTCGCTGGCCCTCCCTATGATAGCCAAGGTTATAACAACAACC
AAGGCTATGTAAATCAGGGCTATGTCAACCAAGGTTATAGCAACCAAGGTCAAAACCAGGGATACGCCTAAGTGC
CGTTGTTTCAGCATAGGGCATTGAGTGGTCATGCACCTACAAGGAAGAGAAAAGATGAT

> SEQ ID NO:180 214457_300858_1 *Trichoderma harzianum*
AACAGGCCAATACCCAGAGGCAAATATGTGCCCATGATCCAGAATTGCGTATCTCCAGGATATAGCGGCCCCAGG
ACATATCCCAGTTGCACGGATATCCAAAAGAGGTGGAGCAGAGAGATGGCAGAGAGCGACAATCCGATTCCCCTT
ATCCTCAGCATCGGCATATGGCGCTGGTAGATGAGAAAGCCCATGCCCCAGAGCAGCAGCAACGTCCATCCTATA
GTCCAGCAAACCCACCATATGCCGATCCCGTTGAGCCTAGCCGCGGGCTTGGAGTCAGCCGTGAGGCCCAGTTCA
GAGCCCATGGCGGCGAGAACCCTTTGAGAAGGACTTGAAGAGCTCGCGACGAGAAGAGAGCACAAACGATGCTCT
GCCTGTCGATTGTGGGCCGCGGGTATTTGTGGGCGAAATGAGAGAAGGAAAAGCCCAGGGCAGCAACTGGTCAAG
ATCAAAGAAAAGAGCAGGACGGGAGGAAGATTTTTAATCTCGGTCGATGCCGTGGGGTGACGATGTGCTCTTCCG
CTTTTCT > SEQ ID NO:181 214459_300858_1 *Trichoderma harzianum*
AAAAAAGGTACCGAAAACCTCGGATGGAGGCGTTGCAAACCCAACAGCATTCGTATCAAGGCACGGAGATGATGC
CGTTGAGGTATCCATTTTGCGCCATCACCGGAAGTTGGCCTTGCTGGACAAAACTTTGCAACACGAGGGGGAAAC
CCCCTCACGTACAAAGCGACGCTGATTGTCGGTCGTCCAGATAATTTCATGTGAATCGAGATGTGAGCCGTCTTG
GACTTCTAGTATTCTGACATCATGTATTTGGTTTGGCG > SEQ ID NO:182 214460_300858_1 *Trichoderma harzianum*
TAATTCTATTTCACTCTTCTGCAGACGAGGACGGACCCGATTGACCATGTTGCGACAATCCTTCAGAGCCTTTGC
CCGCACGGCTGTTGCGAGACCGGCCGCGGCGAGAAGCTACGCTACCTTCAACTGGGAGGATCCCCTCAATGCGAA
CAACCTCTTTACCGAGGAAGAGCAGGCCATTGCAGAAACCGCAGAGCGATACTGCCAGGAACGACTACAGCCTAG
GGTCTTGCAGGCCTACCGAGACGAACACTATGACCCCAAGATCCTCGAAGAGATGGGCGAGCTGGGCCTGCTTGG
CTCCAGCATCAAGGGCTACGGATGCGCTGGCGTTTCTTCGGTGGCCGGCGGCCTGATTACACGAGCGGTCGAGCG
AGTCGATAGCGGCTACCGGTCTGGCATGTCGGTGCAGTCGTCCCTCGTCATGGGCGGCATCCACGAGTTCGGCAC
CGAGGAGCAGAAGGAGAGATTCCTCCCCGAGATGGCCAGGGGCAAGCTCATTGGCGCCTTTGGTCTGACGGAGCC
CAATCACGGCAGCGACCCGGGCAGCATGGAGAGCGTCGCGAAGCCGCATCCGACCAAGAAGGGATACTACTCACT
GAGCGGAGCCAAGACGTGGATCACCAACAGCCCAATTGCCGACGTGCTGT > SEQ ID NO:183 214461_300858_1 *Trichoderma harzianum*
TGTATTCTGTGTTAGGGAGAGTTGATTGAATTTCGCAACGATTTGTTAATAGTTTTCAAGGGAAAGAGAAGAGAG
AAAAGACATAGTCAGTTTGAATCTCGTGCAAATAAACACAACCCCCACCATGCCGCGAGTTCTCACTTTACAACA
AATCGAAGGCGGTAAGCCTGGAGAAGTCTACTATCCCATCCAAATCAAAGAGGTTCCCAAGCCTACTCCAGGGCC
TGGTCAGCTCCTCGTCCACATCTCCGCCGCGGCCCTCAACCACAGAGACCTCTTCATCCGCCGCCACCAATACCC
TGCCATCTCCTTCACCTCACCACTATTTGCCGACGGCTATGGAACCGTCGTCGAGGCCGGCCCCAACGTCACTCG
CAAGGAATTGCTCCACAAGCCTGTGCTGTTGACGCCCATGCGAGGATGGGAATCCAGCCCTGCAGGACCCGAAGA
CCCCCGCAAGTTTGCCGTCATTGGCAGCAGCAAGATCACAGAAGCTGGAACCGGGCAGGACTACATCGTCGTGCC
CGAAGACGAGGTTGAGCCGGCTCCGGAGCACCTTTCGCCGGGCGAAGGTGCCGCGTTGCCGTTGGTAGGACTGAC
GGGATGGAGAGCACTGGTGA > SEQ ID NO:184 214465_300858_1 *Trichoderma harzianum*
GCCCTGAATTGGTTGAGCAGGGCGGCTTGGTGAGCACTCACCGCTACTTGCATGCCCAGTAGCATTGTTCGCTGG
TGCTACAGAATTTTCGCTGTTCGCCACAAGATGTCGAGGATGCAGCTCAATGACCTGCATACCTGACTGTTCATC
CCTTCACTATTTCTACTTCTTTCGCTCTCTTTTCATTTTCTTTGTAGGGTTTCTCATCATGTTTGGAGTTGGAGT
ACAGAGAAAGAAAGCCTTCCATCGTGGGGTTATAAACAGGACGGCTATGGGAACGGCGCAATTTGCAATTTTGCC
ATGTTTTGGAACATCCTCTCTTGATGGATCGAGAATCCTCTCTCTTGATAGATTGAGATCTTCTCTCTTGATAGA
TTGACAATCTTCTCTCTTGATAGATCGAGAATCTTCTCTTCTGGCCTTTGCCTTGATTGCTCAATACCCTTGGTG
GCCACTCAGTCCCGATCAACAACATT > SEQ ID NO:185 214468_300858_1 *Trichoderma harzianum*
AGAAACCCAAACCAAAGGCAAAGGTCAGACCCATCTTCTCCGTTGTCCTCAGCTGAAGCTTCCAGATCTGGGGGA
TGGGCAGAAACAGGATGGCGAGATCGGTAAAGATGGTTGACGAGGCGTTGGCGATCCAAGTGCCGACCTGGTTGA

Figure 1 continued

TGCAGTGACCAGGGAGATCAGGGTACCACAGCTTCTGAACGGGCACGCAGATGAAGATGAAAAGGAACGTGATGC
AAACGACCCAAGCCATGACGAATCCACCAACCGCCCAGGCCATCTTCTTGAAATACGGCACATGGAAAATACGGT
AGTACATGAGTAACAGACTGATCTTGGTCCAGCCAAGGTTCCAGGCGTAGAGGATTTCGGCCACCAGCAGCCATT
TTGCCATCATGACAATCCTCGCAGGCTCAACCTTGTCAGCATGGAGGCCCATGCCATTGTCGTACATGGCAAAGA
TGAAGCCAACGACAACGAGATACCATCCCTATCAAAGTTTTGCAACTTTAGCTATTTTGGCCGTGTGTGGAGGCA
AAGCTTGTCTGGTCAAACAAGCTTCCTCGTTTGAGTAAACCTACCAGATAACACAAACCACCGCCAGAACAGTCA
TGGACGCTGTTACTTGCACGGTCCATGGCTGAAGGTTGTCGGCG

> SEQ ID NO:186    214471_300858_1 Trichoderma harzianum
TCTCGCCTCAAAATTCATGCGCCTCAAAGAATGGAAGAAAACACAGGCGAATGACGTGAAACGAAAGATAAAAAG
ACAGGCGCCTTCATGCGAGGGTTTCGCCAGTCGCCTCTAGCGTGTTTCGAAGCGCAGGGTTGAAACGCGGCTGCA
TGATGCCCGGCCGCCCATCTGAGGCATGGCGGCTACCGGAACAGGACGACATCCGAAGACTTGAGGAGGCTCCGT
GTTTGTTCGTTTCGTTTCGTCTTTCGAGTGAAGGGTTGGTTCTTGTTTTCGGCTGTTGTGTGTTTTGGTTGACTT
GTGTTTACGGGTTGGGGGTGAGTTGAATTGAGTGCGAGACT > SEQ ID NO:187    214473_300858_1 Trichoderma harzianum
GCGAGGGAGAAACGGGTATGGGCTGGGGGGGCCGCACTAGATTCTTTGACGTGTCTTGTACGGAATTCCAGCGCG
GTGGAAGGGTGTGGCTGCTGCACGTTTTCGGGGGCCAGGTTCTTTACACTATTCCCACGGACAAGGTTCCCAAGT
GAGGCTGATGGAGGGTCCGCGGGCCTTTTGGGGGGGGAGGGTCCAATCGAGTGTTGTTTGTGTGTTCACCAAGTT
CAAGTACATGGGTATGCGTATATTTCGGCCATGTATGCGCGATGGATTCCTGCTGTTCGGCAGCGAGCATGAGAA
AAAAGGGAAAATAGACTGCGAGAGAGAGAGCGACAAAAAGAAGGAAATGCTCCGATCACGATTAGGGGCGGAATT
GGAAATCCG > SEQ ID NO:188    214475_300858_1 Trichoderma harzianum
GCCGCATGAGCCAGGCTCCTCTGCCCGACCCCGTTCACATGGCTGCTACCATGGGCACCAAGTCCAATGGAACCA
CCACTGGTGCCAAGACCAACGGTGCCACCGCCCGATCCCGCAAGGCTTAAGCTGCCTGCGCGCGATGTCATGGGG
ATGTCTGATTGACATGTCAATGGCTACAAAGCTCCGACGCCCGAATGGGTGACGAGCATTCTTTTTTATACATAT
TACGAATCCAAAGGGCCAGTTACCACGAGGCCAATTACAATTTTC > SEQ ID NO:189    214480_300858_1 Trichoderma harzianum
ACAATCAACCCAATCATGGAACCAGATCAAGACGGAAACACCCCAACCACAGAGCCTATCCGCTTCCGCGCCGGG
AAAAAAAGAAAAGCATATCGCCAACGACCTACCGAAGAAGAAGAGGGCCATGATGTAGCGACCGTGATTCCAGCT
CCATCCGTCTTGCCAGGCGCGTCAAAGGTTGAGGATGGCGAGCATGGACGAGATGCAAACGACGACGCCAACGCC
AACGCCAACGCAGAAAGACTACTAAGAGAACTCGAAGGGGAGGAAGGCAATGTCGATGATGGAGACGATCGAATG
GATGGGGAATCAGCAGTGGCAGCTGCGTTGCGCCTTCGCAATGCGCGCCGGGCAGGTCGTCGAGGAGGCGTGGGC
TTCCGCTCAGAGGGACGGAACCAAGACGACGAAGACGCAGACACAGAGCAGCACGCGCTGGTTCTCCGAGACGCA
GACAAAGACGCCGCGCACGATCGCATCGTCGGCGGCATCACCAACCGCTTCATGCACCAGACCGGCCTCCTTACC
ATCCTCGACGACAAACACATGAATGAATACATAGAATCCCGCCTCGCTAGCCGCTCCGCCGACCCCCACGGCGCT
TCTCCCTCATCACAGCCCGCATCCCACTCCGCGACGACGAAC > SEQ ID NO:190    214481_300858_1 Trichoderma harzianum
AAAACACCAAAGAACCCAAAGAGCGTCCACGCTTCTTTCTGCCTTTGTCCGGCGTCTGCTCCACTCGCTCCCCAT
CCTCGAACCCTTTGCAAGTCGAACAGGTGACAACGATTCCATTGACCGACTGTGGCTATTTGCATCACAACGCAT
CACAATATCTTCGGCTTTGTGGGGGGATCATATACATCCACCGCGACGTAACACCAAAGTACTCTGGAGTTGAA
AAGCTACCCCGCACCCGGTCGCATGCCTACAGCGCTTCCTTCTGCTCTAGCCCTCCAAACCTCTTTTCTACCTCT
TTTCCCGCTTCGGCAGACACAAACCACACAAACTCTTCAACAACCGCAGACATGGCCGACAACCACGGAGTATTC
GTGGAAGCCCACGACATTGACACTTTCCAGACTCCTCAGAAGATGTACGCAAGTATGTTGGCCGCTAGTCGCTCC
TCGAAATCTCCGATAGACAGCCACCCCTACCCTTTTTAGTCGCGTTTGGCACCAGATCCAGCTGACATCCTT > SEQ ID NO:191    214485_300858_1 Trichoderma harzianum
TTGGAGAGCATGTCAACTGGAGGGCCCCTGCCCAAGGACTTCAATGCCGACGATGCGGGCAACATGGAGGATATG
GAGAAGCAATTTGCCGTCAAAGTTGTGCAACACATGGCAACCTACTGGGCCATTCTCGAAAAGGTCAAGGGCTCC
GGCCTGCGACTGACGAAGATCGACGACGAGATCTACGACCACCTCAAGGAGGCCTTTCCCGAGTTTGACCCCGCC
GCCACGATCGACGAGGACCAGATGAAGAGCAAGACCGGCAAGGAGAGGTGGCGCGCCTTCATGATGAAGTACGAG
AAGAAGGTGGACGACTACAACTTTGGCACCATGGTGCGGAACAACGCCAAGGCCGAGTACGAGCAGGACACAACC
ATTTTCGTCCCCAGGATGCAGTTTTATGCCATTGAGATCGCCCGAAACCGAAGCGGCCTCAACGACTGGATATAC
GAAAAGGCTCAGGAAGAGAAGAATAGCTCCAAATAAATACCCCAATACACAAGCCAATTCAAGGA

Figure 1 continued

> SEQ ID NO:192 214491_300858_1 *Trichoderma harzianum*
GCACCCAGACACCGAACTAACTCAAGAAAAGGGAAAAGGACAAAGGGAACGTTCGGCCTTCTTCCCCGGCCTTGG
CTTAAGCCCCAGAGAAGAGCCGCACGTGGTGCGACGTTGACGCCATCAGATCTCACATCACCATCTAGCAGATAG
TATGTGCGGATGCAGCCTATACAATGCCAAGATTCCCACGCATGCCTTTGGCAATGGAATTGCTGGTGTTTTACC
AGTGTGCCTGTGATATGAGTCGGGCGACTCCGATGCTTTCGGGGTGCGTCATCGCTGGGCTCGGTGGAGGGAGGC
AGCCGAGTTACGAACAAGAATGATGCTGTATATAATCACCCTGTTGTAAGATGCTTCATGATAAAAAAACAACCA
CAAAGAAACC > SEQ ID NO:193 214493_300858_1 *Trichoderma harzianum*
GAGTTCCTGCGCAGCTTCCTGCAGAACCTGGGCAGCGAAATCGCGCCCGTCACGGCCATCCTCGGCGGCCAGCTG
GCGCAAGACGTCATCAACGTGCTGGGCCAGAAGCAGCAGCCCATCCAAAACATGGTCATCTTCGACGGCACCACC
ATGGAGGCCCTCATGTACCCCCTGCACCCGGAGGGCATCCTCGGCGCAAACCTGCTCTCCCTCGGCGGCCCCGTC
GACCCCATGGCTCCCAACGGCGGCATGATGATGCCTCCCGACATGCCCCTCGGCCTCGACGCCAGCATGGTCATG
CCACCGCTGGATGCCACCGCCCTAGCCCACTCGCACGGCATGCCCATGGGCATTCTTCCCGCCGTTACAGGCGCC
GATCTAGCCGGTCACGTGGCCATTCCTCAGCCTGATGCCGGGCAAGTACCTGTATCAGCAGTGGGAACC > SEQ ID NO:194 214494_300858_1 *Trichoderma harzianum*
GACTCTCAGAAGGCTAAAATGGCACCGAATGTACAAGACAAGGAAGGGAAGCCGATTAAACAAGGCGACGAAGTC
TGGACTCCAATTCCAGGCGGAAAACGACAAGGAGAGGTGGAAAATATTGTTAACACGGAA > SEQ ID NO:195 214495_300858_1 *Trichoderma harzianum*
ACTTAATTAAATTGGACCAGGGGGGGGGGCAGGCTTGGTACAGGATTCGTTGGCCGACTGGTGGAATACTACCAA
GTGCCGGGCGAGGTGATGAATCGAACTATTCTTGTCACATGTGAGAAAAACACATTTTGCGATACATAGTATTCG
GATTGGAACTCTGATTTATAACGCATTTGATACCCG > SEQ ID NO:196 214496_300858_1 *Trichoderma harzianum*
ATGAAATCATGAACATCCGTACACCACATCATAAGGTATCCTTTAGATACTAATGTATAAGTACCCAGCAGGGAC
AGAGTGATTGAAAGTCGCAGTGGTAACCACGCCACCAATGGCGCTAACGGGACTCTAGACCTGAGTACAGGTACC
CGCATCTATGCGCAATCACAGACTACAGGTGCCTATACAGAAAACCCAACTACCATGAGAGCAGTAGTGGACCAA
CCCCCTAAAAAGTAGACGTCTTGGAGATACCCATCATGGGCCTGGCAAGGCTGTCTGGGAACTGCAGCCAAGAAG
GAAGATATTGTTACTCTGCTGTATGGATCTCAACTTTCTCCTGCATTGTAGGGAACGAGACCGCCAACACGGAC
ATAGAAGGGATGCTCAATAGAGTGAAAGCTGCTGCATAAGGCCTACCTGTGAGGATAAGCAGGCAGATATTAAAC
CAGTGAAGAACGATTGATCGGCTGTGCAGTCTGACTCATGGCGTGGGCTGGAATATGATGCATTGTAGGAGACAG
CCATACGATGAATACGGGGTTAT > SEQ ID NO:197 214504_300859_1 *Trichoderma harzianum*
AACCGCAACCATGTCGACCCTCCCCAGGACTCTGGGCAACCTGCGCAAGATTGGCATCAAGGAATACTTCCGCCA
GATGCTGTACATCGGTGACACCAAGTACGGTACTCTCATCGGCCAGGATCGCTTCGGCAACAAATACTACGAGAA
CCTCGAGGAACTGCCCCTCCGAACCCGCTGGGTCGACTACGCCAAGCACGACTACGATGCCTCCCACATCGAGCC
CGGCTGGCACGCCTGGATCAGCTACTCCGTCGACAAGCCCCCGACCCAGGACAGCCTCATCGCCACGGGCACCAG
ACACTTTGAGCCCGCCCCTTCCCAAGCCCAACTTTACCGGAACGCGAGGCGCTTACAAGCCGTATAACACAGTGAA
ATCGAAGCTTAATGCTTGGGAGCCGGTGGCCAAGGATCGGGTATGAGTGGTTTTTACGTTTTCTTTTTTAAACCG
TGGGAAAATATGGTGTACATATTGAAATCGCGCAACAAACGCAAACAAATCAAACAATAGA > SEQ ID NO:198 214505_300859_1 *Trichoderma harzianum*
ATCTCCAATCTCCCGCCTAAAGCTGGCCTTTGCTTCTCAGGCCCCTTTACTCTCACAACAATTTGTTACTGCCTG
TGTATCTCTGCTGCGATATCAACTTGACCAAACTCACCACTTTTCTCTCTCTTCTTCCTGGCACCCGGCAGACCT
TCCTTTGCCCGTGCTCTTCATCGGCAAATATATTCCATCGCTACCAGCATCTAGTCTTGCTCGATCGAGATTCCC
TTGAGCCTCATATTCTTGCATGATCATTCTGCAGATTGACATCGCTGCACACTACTTTTGATACAGCTCTGCGAG
CCCAAGAGAATTTCTTGCTTTCGCATCATCCAACTTCATCAGCATTTGTTCGTCGACTCAAACACACAATACATA
CCCAGTCAAATACCGACAACATGTCAAGCGGTCAAATTGCTGCGCCTTTTGCTATTAAGCCTTCCCAGCGGGCTA
ACATCCGGCTGGCAACGGCTCAGGACCTTTACTCCACGCTGAGCAGTTGTCTCAGCCCGCTAAAAGGACATCAGC
AACCAGCTATTCCTTTTGATACCAAGCAAGGCGACGGCTCCTCAACTCCTGCTCATCGCATCCTTGAGGATGACT
ACACCGTT > SEQ ID NO:199 214506_300859_1 *Trichoderma harzianum*
GCCAAACAACGCATCTTACGGCTTCACAACAGCTTGGAAAGCTCTCTATTCGCAATGGCTATCGCACCGATCACT
GGAATGCTGCGGCGACAGCTCATCCTTGACCTCGGCGTTGGTCTTGGATCCGGATTCATCATGGCCAACTGGTAC

Figure 1 continued

TGGTACGGCTACCACATGCCCCGAACCAACGGCCGAGACGCCTACTACGCCAAGAAGGAGGCCGACCGTGCCGCC
GCGGCATCACAGTAAGGGGGGCACTTGTATACTCGATGGACCGAGAGGGAATGCGGCATGAACAACTGCTGGTCG
AATAGAAGGGGAATGACTGGGCCAACGGGCTGTTCATGCCTGCAGGAGCATAGTTGCTGGACAGATGTCGAATAT
CACTGAAGAAAGGCAACCGGGCGAACCTCTACTTAGACCAATAAGTCGCGGGGCAATACGATTCAATTATCTCGA
TTGGCTTATTATATGTTTTTGCCATGCCGACTCCCCTTTGTTTATTGCTGAAAATAGTGCTGGTGGTTTCTTTCC
AATTATGTACAAATTATGTGCTA

> SEQ ID NO:200 214511_300859_1 *Trichoderma harzianum*
CCCACGCGTCCGAAGGTAGTGCCGATGATGGACGGGCCGCCGCCGCGAAAGGGCCACAAGAAGGGCTACACGACT
GGCTCGCATCCGTTGGCGCGCGAGGTCATCCAGCCAGACGAGCTTCCCAGTGCCAACTACAAGAGGTACACGGTC
TGGCGCAAACAGCCGATGCGGATTGTGGGAATGAGCGAAAGGGTGCTGGTGATTGATGGCGAGTACATTCACATT
GTGCCGGCCTCTGGGGGCAAAGCCGTTCAAGAAGGCGGAGGCAAGACGACGACGGTGCATTTCAGCAACGTAATA
GGATGCAAGGTGCCTCGGAAGCATCCCACCAACGTCAAACTCGTCGTCTACAAAGCCACAGAGAGCAAACGCTAC
GATTTCGAGGCTCGAGGAGCTGATGAGGCTGCCGAGATTGTGGCAGAGCTGAAAAAGGGCATCTCGCCTTATCGG
GAGGTTTGATTGATTGCGTGTTGCTTGGGGGCGTTTGGAGACTGGAGTTATGTTTGGATTATGAGGGGACGTACG
AGTTATTACGCGGCCAATGGCTTACTTACTACGGGTAGCGGCAGCGTCTTATTTCCTCCATCTTGTTGTTGCTGC
ACACAATGTGTATATGGGGGTTGAAATTTTT > SEQ ID NO:201 214513_300859_1 *Trichoderma harzianum*
GAATCAAACAAAGCATTACTACCTACCAACAACTATATATCAACTACTGCTACTGCTACTACTCTTCTCTATCCT
CTCTTGACTATCATTGTTATACCAAAACTCACTCTTAGAGTTCCACCTCTCCATCAATCATCAACAACACCAACCA
ACCAACCAACCAGCAAGCAAACAAACAGACCAACAACTGTGACAATGTCCAGCCAACGCAGCGTCTATGTTCACC
AAACCAGCTCTGGCCCTTCTACCGCCAGCTCTTCCAGCCGCTCCTCCAGCTCATCTGCCCATTATGCGGCATCCA
ACTCCCGCTCTGTCTCCAATGCCCGCGAGTATGATGCCGCAGGCCGTTCTGCTCAAGTGGTCCGAGGCAGTGCCT
CTGTCGTCATCAACCACCACAGACGAGACTACGAGACGGACTCTCCTTCTCCTCGCTACCGTGGTGGCTACCAGT
GATGCGACATCCGTCACGCAGCTTGCAACTACTTACACAACTTCACAACCACATATTGGGACACAACCCGCTTCT
GGGGAGCCAGCCGGGGGCTAGCGGGGATACCCTCTGCTACCGTGGCTCCTCTACACACCCACTCAT > SEQ ID NO:202 214515_300859_1 *Trichoderma harzianum*
GCAAAAGAAGAAGTGGTCCAAGGGCAAGGTCAAGGACAAGGCCCAGCACGCCGTCCTGCTCGACAAGACCATCTC
CGAGAAGCTCTACAAGGATGTCCAGTCTTACCGCCTCGTCACCGTCGCCGTCCTGGTCGACCGAATGAAGATCAA
CGGCTCCCTCGCCCGCCAGTGCATCCGCGACCTCGAGGAGAAGGGCATGATCAAGCCGGTCATCACTCATAGCAA
GATGAAGATCTACACCCGTGCCATCGGCGAGTAAATTTACCACCATGTTTGAAAGTTAAAGCATTGAGATTTGGC
GCCTGGTTGGTCTGAAAGGAAGAAAATGGGACCATGAGTGAAGAGGATGATACGAGGTATATAAAGCCTTAGTTG
GGACGCTTTTCATGCTCGGTGTAGCATTTCATGGGAACCGGAAACGCTTTAGCAAATGGCAACGGAATGAAGAAC
TTCAAAAAATGACCTanaaaaaaaaaaaca > SEQ ID NO:203 214519_300859_1 *Trichoderma harzianum*
GGAGGATCAGGTGCGATGTGAGGCTGATTTGGGGTGTATGATTCGTGAGCGTGTAAGAGGAGGCAGCCCACGACT
TTCTCTCTGTGTCTGTGCTTGCTCACTTGCTCGCCTCCTTGGATTCGGCCTGTTGATCCGAATCAGAAGTAAATG
TGTTTGAGACTGAGACTTGGTCTGGTCGAGACGATATGAGATGTGGCATGGAATTAGAAACACGTGTTTGGTATG
GCGATTGCGATGCGATGATCCGCAGAAAGCAAGATCTCAGGGCGACTAACACGGATATACGGAGGTTCGACCAAG
ACACGAGGAATGATGGGGAAAGTCTCAGTATGTCACTACGGAATTTATGATTACGTAGCAATGTAT > SEQ ID NO:204 214526_300859_1 *Trichoderma harzianum*
ACATCTTCGGCCTTCTCTCTAGCGAAGGCGAAGCTCTGGATGACGGCACCATGGACGTCGTTTTATCCCGTCTTG
GCACTCAGCTGCTCACGCCCAATACAGACGAGCTGCTGTTTCGGGAACCTCCCGCCTTTCTAAGTCGCCTCGGCA
TCGATACCTCTGAGACTGAATGGATAGGCCGCGTCTCTGAGTTTGCTCGGTCTGAACTCCGTGCCAACTACCAGG
TCCAAGGCATCGTCGATCAAATGGCCATACGAAATTGTGTCGCAAGCCGCCCGCATCGCTTCGCTGGTCTTTTTG
ACAGTGGCCCTGATCAAGGGGAGAGTGCATCTGCTCAACGTTGTTGCCATTGCCTACGCTTTTGTCCTCGGCTTG
ATACGACCCATTAGCCATGACCTCGCCTGGCGTCATCTGGTTCTTCATCAAATCAACTATGTCCTGACTGCCACG
TTTTTCGTTCTAGCAGCCGCACAGCTGCTGCCTTGTATTGAGATTGGCACGGATCAATGTGTTGGGGATGTTGGC
ATCGTTGGCTGCCTGTCGTCGTTGGGTGCGGCAGTTATTGTCGCATTGATTACTCCACGAGAATGGGTCCCGCCT
ACCATCAAGCATGATATTC > SEQ ID NO:205 214533_300859_1 *Trichoderma harzianum*
AGAAGATGAAGCCGGCCGTTACTGCAACGGCAGTTTGGTAAGATCAAGTATGCTAATACGGTGTTTAGGGTGTGAT
AGTAGAGGCATCCGGCGAGGCGGCTGAGACATATGAGGGCGAAACAGGAGTAGAGGAGACAGTGGCAGCAGCAGC

Figure 1 continued

AGCGTTAATGGCAATAACAATAGATGGCAGAGAACGGCCGGGCCCTCGGATTCCCTCTTGAGAGCGAAGGCGAAG
GTGAAGGTTCAGCTGATGGATAAAACCGGGAGACAGCCGAGCGACGCAGAGGATGTCAGGCGTAGGTTGCGTGAG
GGTGGCTGCAGAGGCCGAGAGCAGGTTCAATCAATGGGCGAGAGACGGCTAATCGAGCAGAGCGTGACGAGGAGC
GCGGCAATGGCGAGTGCGTGAAGGGGTGTTGATTCAAGACTGCGCGCGTGAGGGTGTGGGAGAGATGAGGCAGAG
GCCAGAGGCAGCTCAAAAGGGTTCAAAGTT

> SEQ ID NO:206  214534_300859_1  Trichoderma harzianum
TTCTTCTCTCTCTTTCTCCAAGATTCTCCCTCTTCACCTCTTGTCCTCTTGGAGCTCCCAAACTTCTCCTCGTTC
ATCACCACCGTTCTCAAGCACAAAATAAACGTCAAGCTCTCCTGGTCGCCTCGCCATCGCCAATCGTTGTTTGCG
TCGTCTCTCGTTGCATTTCTGTATCTCCCAGAACTCAAGTCGACTTTTTGACAACGTCACCGCCAAGATGAAGT
CCGTCGTTATCGCCCTTTGCACCCTGGTTGCGGTTACTGCCGCTCAAGGCTCTGCCAACCTTGCAGCCTGCGGCC
AAACCTGCGCCACCAACATGTTGAGCGCCGACAAGGCTGAGGAGCTCGGTTGCAAACAGAATGACTTGAGGTGTC
TCTGTGCCAACAAGAACTTCCTTTATGGCCTCCGAGACTGCTCCGCGGCTATTTGCCCGGCTGAGGATGCCAGAA
AGGTTGTTGACTATGGTATCAGTATCTGTGCTGGAGCTGGTGTTTCGATCCAAACATCTGGAGGTAGCAGCGGTG
GTGCTAGTCACACTGGAAGTTCTCCCGGAAGTGCCACTGGCAGTGCTACTGACGGCGAGTCGACGGCTGCCACTG
CTTCTGCTTCTAACCCTGCCACTGGAACT > SEQ ID NO:207  214544_300859_1  Trichoderma harzianum
GCCGGATATGGAGATAGCTACGACGACTAACACTGCCGATTCACGTTAGTACCAGCTGGCCATTGCCCTGGTAAT
GAGGGCATCCGGGTACTTGTATCGCTAACAGCACGGCAACAGCACTTTGTTCTTCTGTTGCTGTGCTCGTACTTG
TAGCGGGTACTTTCGTCATGTATTATTCATGGTTTGGTTTGCCGGGCAGCCCAGCG > SEQ ID NO:208  214545_300859_1  Trichoderma harzianum
GATTCCTCCTTTCTTCCCCTCCATACTATTTATCCTGCCTCTTCCTCGTCTTCCATCTGTTGCCGGTGTGACTCT
TGCAATTCATTCCCTGCCCGGCTTCCTCGCTTGATTGAATAGCCGTTGCTACTTCCAACTGCAAATCATTATAGC
TATACCTCCCTAGCTTCATATAAGCTCGGCTCTTCTAGGAACGCGCAAGCAAACATCCTCGGCAGTGACCCACGA
GCCTTGTCTGGAGATTTTAAATAGGAAAGCTCATCAACGGCACCTGAGCAGCGTCCAATTGCTCTGTTCAGCTCA
ATTAAGCTTTCAAGATGCCTAGAGACGGCAGTAAACAACCGCCCTCAGCGGCGACAAACCTCATCGCTGGTGGTG
GCGCCGGTATGATGGAAGCCCTCGCCTGCCACCCTCTAGACACAATCAAAGTGCGAATGCAGCTCTCTCGCCGTG
CACGAATGCCCGGCGCCCCCGCCGCGGCTTCATCAAGACTGGTGTAGAGGTTGTGAAAAAGGAAACTCCTCTCG
CTCTATACAAGGGCCTCGGCGCCGTCTTGACGGGCATTGTCCCTAAAATG > SEQ ID.NO:209  214547_300859_1  Trichoderma harzianum
AAGTTTCAGCATTAGCATTACACCAGTAACCCTCCAGGGCAGCTAGCGAAGAGAGCAGGCCCAGTTCCGGGTGAC
AGGTCGGGCAACGCCGCGACGGCTGCGATTCCGAGCGAACGGCGCTGGCGTTCCAGACGGCACAGCAGCAAGCAC
AGCAACAGCACAGCACAGCTACGAACATCGAGGATCCCGCTCCAGGAACCGGTGCTATCCAGAACAAGGCCCCGG
CGCTAGGACCCGCGGTTGGCAGTGGTGGATCGCAAGGCTCCAGTCATGCCATGCAAGCGAGGGAAAAACGCTTGC
ATGCTCATGCTTTGCTCTGGCTCTAGATGAGTCTGAATCTCATCCATCCTCGACCTGCTGCTGTGTCTCCCCGTC
CCGCACGAGGCTTCGGTCGGCGAGAGCCGGGATCGAGGCGTTGGGGGATGGCGTCTGTGAGCCAGACATGACCTG
TCACTGCCGTGGGTATCAGCAAGGCGCAATGGCGAATTGCAGGTGGGCAGCGAGAAAAATTCGAAGGGATAGCCT
TTTACCAGCGCTGCGTCGATGATGAAAATGGGCTGATTTCTT > SEQ ID NO:210  214548_300859_1  Trichoderma harzianum
ACCGAACCGCCAGCGAATCGACGAGGGCATCTGTGTCGGTACCGGATGCTGCCTTTGCGGATGGAGCGTCTTCAT
CGAGACGGCAGGTAGAAGGAAAGACATGGCCTTGTTTGTGGCGCCGCGGGCACTGGCAACGTTGGTCCCTCGGCG
GTATCCCCTGGAGAAGCAGTGGCGAGAGAAGTTGATATTCGCAGCGAGCACGGCAGTCGTGTTTACTTGCGCCCT
TGAGAATCCAAAGAGAGTTAGAGGCGTACTAGGGGGGATTTTGGGCATGGTGTTGAAGAAATAAACCGGGCATAT
GGGCAAATATGATCTCTTTTAGGGAGTTCTGAGACGTGACATGACTAATTTCTTCTTCTTCTTTGGATGTCTTTG
GAATAAGCTACGGTTTTTAGATGATATACACAAACAACCCTGATGCTATAATTGGTAATAAATACCA > SEQ ID NO:211  214549_300859_1  Trichoderma harzianum
GCAGCTGCTTGCAGTGAGAAAAAATGGTTCGCTTTTTATGCGAGCATAGCATGATGTGAGCGAGAGGGATGGGAC
GCCATGGCTGGATTGGGTTACCCCGAGGCCGGGATTCCGAGGCATTGGGAGATGGCAAGCATGCTGAGCTGCGAG
GGATGGGGATCTGGAACCCCCTGTGCATTGGGAGCTGTCTACAGTACCTAACCTTGTGAATGCATGTACGAGTAT
GTGTATGTATGTGAGATGGAGGGCTGTATGTTATGTGTGAGAGCACGTCTGTGTGCTGCAGGGGGTTTCAATGCG
GACGAGGGGAACAGAGTCAAAAGTGAAGAGTGACGAGATAAGCGGGGTATT > SEQ ID NO:212  214558_300859_1  Trichoderma harzianum

Figure 1 continued

```
GGAACGTCAAGTGCGAAACGCACTGGTGTCGCCTGACGAAGCAGGACAAGAGTCAATCAATTCCAAACCAGCCGA
TAGATCTCGAACTCTGTTCAAGACCAATACCAAGATGGAAACGAAAATAGGAGAAGAGCCTATACGACATACCGA
TTTTGCCATGACAGATGCTCAGGGAGGGCGAGGCCCGCTGCAGCAACCAGCCACCACGGCACGCACCGGCTTGGC
GATGGGACGCAGGTTACAAAAATTAGCTCGCCCAAAACGCTCGGCAAGTCATGAACAGCAGTACATAGGTGACGA
GCTCCGTGGCCAAACTACTAGGCCCAGATCATCTTACGACCCGTTGGTCTCAACAGAATATAGTCTAAGACGTCC
AAAGCAACATGCGACACACAACTCGACTGCAGAACCTACGGTAAATACTGTCATTAAGCCTACTTTACGGCGACG
AGGATCCGACTCTAGTGAGAGCAGTTTCGTACGTAGTAGGTCCATCGGCAGTCCTCGAAGTGGATTTAGGTCATC
GATGCGAAGCAGCTCTTTCGATCCGAGGCCATCATCATCTGGTAATAAGGGTAGAAACAGGTTGACTCTACGCTC
GTTATCACCCACAACGTCACATCAGAGGCACCATTCT
```

> SEQ ID NO:213 214576_300859_1 *Trichoderma harzianum*
```
GGCATTCGTATTAGAGTCTCGGAATAAGCGTTCAATGCTTGTTCAGGTCCTATGAGGATCTCTTGCGTGCTCAAC
GATCGCCTAGAAAAATCGCTCCTCATTAAGTTGCCTGAAATTCTCTACACTGGTTGACACACCATACGATGAGCG
TACATATCTTCCTCTCGCCTCTCCTGCCTTTTATATGGTACATGGTACATTTCTATCTAGGTATCTTGTAAGATG
TTACGCGTGTCTAAATGCGTCGTAGAAGCAGTCTGTTGTCGCGAAGCCTGCGAGTTTTGCCCTGCTGTGTCCTCA
TTTGCCTCCCTTCTGCT
```

> SEQ ID NO:214 214577_300859_1 *Trichoderma harzianum*
```
GAATAAAGCTGTGCTGTGCTGTGATTTTTGAACGGATATTACAAGGCTGGTCCGAGTTCTTGGAGTTTGAAGCGC
TGGCGTTGTTTCTTCAAGATCGCGACGTCGATCAACTAAAGCCAGAGCTTATACGTCCGGGTGCATATGCATATG
CGGACATGAGCCTGTAAGCTTCAACTGCTTCGCTGCCAAGCCAAAGCGCGCATCCGAACTTCAATTTCTCAACGC
CCTGCATACGGATTCGATTTCGCG
```

> SEQ ID NO:215 214578_300859_1 *Trichoderma harzianum*
```
GCTCGCTTGGCTGGCTCGAGACTCCTAGGTGCAGCGCTCAGGATGGATTTTGCTGGCGGAAGCACAAAGGCGGAC
CACCTCTGCGTCCTGGTTCACGGACTATGGGGTAATCCGAACCACATGAACAATATCGCAAAGACGCTACGAGCC
CAACATTCCCCTGACGACCTCTACCTCCTGCTGGCCAAGCGAAACAGCGGCAGCTTCACCTACGACGGCATCGAG
CTTGGCGGCGAGCGAGTCTGCGCCGAGATTATAGAGGAGCTCAAGACGATAGAACAGAATGGCGGCAAGATTAGA
AAGCTGAGCGTTGTGGGATACTCTCTCGGCGGCCTGGTATCGCGGTATGCCGTTGGTCTGCTGTATGCAAAGGGC
ATCCTGGACTCGGTTGAATGCATGAACTTTGCGACCTTTGCCTCGCCGCATCTGGGCGTACGGACCCCCCTCAAA
GGATGGCACAACCATATGTGGAACGTGTTGGGCGCGAGGACGTTGTCCATGTCCGGGAGCCAATTGTTCACGATT
GATAATTTCCGAGATACCGGCCGGCCCCTCCTATCTGTCATGGCCGATCCCCAGTCGATTTTCATGCTGGGACTG
```

> SEQ ID NO:216 214579_300859_1 *Trichoderma harzianum*
```
GGCTGACAGATGCTCTATGACGGAGAGGCGAAGCTGGGTCGAAGCAGACGGGCAAAGCGATTTGAAATGGTGAAC
AGGGGAGAATTTGCTCGCTGGCCAAGGGGGAAGAAATGATG
```

> SEQ ID NO:217 214583_300859_1 *Trichoderma harzianum*
```
AGCTATATCGTTCTTCACCAGTAGCAGTATCACCCCACTGTCGCTATCATGGCCCGCGGAAATCAGCGTGATTTG
GCGCGCGCAAAAAATCAGAAGAATGCGTCCAAACATAAAGGCGGCAATACCGAGAACGGATATGAGCAAGCAAAA
TCCAAGTTGAGTAACGCCGAGATTATGAGGCAGAAGCAAGCCAAAGCCAATGCCGAGAGAGACCTAGCGGCAGCA
AAGGCATTACAAGAGAAAAGGGACGCAAAGGCGAAGAAACCGACTGAATTGGGCGCTTCAGCTGTGGAGGTTACT
GGACATGCAAATAACCCAAGAGGATAGCAAGAGATGGGAGAAAACACGGCACGGCGAAATCAGGCGCTCCTTGAG
ACTTTCACAATACGGCGCAAATTTGGGACAATCTAGGTGAAGAGGGGGAAGCGTTTTTTGGCTTAATACCAGGTA
TAGCCATGGATAATAGCGAAATGGATATTTTGTTGCGGTATTGCTATTATTATTCTACCAAAAAAAGTTCGACCT
TTGTGAAAAAAAA
```

> SEQ ID NO:218 214584_300859_1 *Trichoderma harzianum*
```
GATACTATTCGCCGCGCTACCAAGAGGGGTTTGCGCTCGAGTGTCGAGCCATCAAGCGTTTGCGCGAGGAGATTG
GCCTCTCTAACGCGATAGTCATGATTCCCTTCTGTCGTACAGTTAAAGAGGCACGAAAGGTTCTGGATGTCATGG
CTCGCCACGGGCTTAGACGAGGAGAGAATGGCCTACAGGTATATGTCATGTGTGAAATCCCCTCGAATGTGATTT
TGGCGGCAGATTTCACCGAGTACTTTGATGGGTTTTCCATCGGCTCCAACGACCTGACACAATTGACACTTGGGG
TCGACCGCGACTCCGGCGAGCTGGGTGACTTGTTTGACGAGCAAGATGAGGCAGTCAAGTGGATGATTTCGCGAG
TCATTTCCATAGCGCGCGCGAGAGGCTGTAAGATTGGCATCTGTGGACAGGCTCCAAGCGACCACCCAGAGTTTG
CCAGATTTCTCGTTGACGCAGGCATTGATTCCATCTCCGTCAGCCCTGACAGCTTTTTAGCTGCAAAGAAGCAAG
TTGTGGCCGCCGAAAAGGCATTGGGAAAATCGCGCGGCTAATCTAATCAAATCTGGTCTATATTTGTAGTTGACT
TTCACGAAAATCAGGCTGAAATCTTTGAACAGAG
```

Figure 1 continued

> SEQ ID NO:219 214585_300859_1 *Trichoderma harzianum*
ACCTGGCATCGCTATGCTACCATGTGCCCAAGGCGTTGATCTTGTTGGACTCGGAACATCCGTGATGCGTGGACT
TGCATGGAACGTGCTTGGGCTACAAGCGCTCTGGAATGTTTGGTCTGGAACGTTGCATGCAACCTATTGAGTTTT
GCTGAAGCTTGATCTGCGCTCTCAACTGATGCTCCACATATATCGGCAGTCAGTATCCATGGACAATAAGGGCGG
ATGATCTGAAGATAAGCTCTTCATGCAGCTTTGACATTCCTGCGGACAAAGTTGTCTCTTAAGCATCGTGCAACT
TAAAAATACATTGCATTGGCTTTCCACTCAATTTTTGCCTCAACTTTTTAGAGAAATGACCAACCTTAACACAC > SEQ ID NO:220 214592_300859_1 *Trichoderma harzianum*
AGCTTGTCGCGGATGTTGTCGACCTGTTTGCTTCTGACTGGTCTTGGTACACACCATGCTATTTATACCCGAGGG
ATTATCGGGTATCACCCCTAGGGTATTGAGTATCACCCTAACCGGGGCCCTGTGGCTGTATACCCTACAAC > SEQ ID NO:221 214595_300859_1 *Trichoderma harzianum*
TCAATCTGCAAGCAACCTCTCCGCAGAGGAGCGCCTCAAGGCCCGCAAGCCCGTCCCGAAGCCTGTCCCGGCCTA
TCTCCCAACTGCCGGCTCCCCCCTGAGCGTCGACAAGAACCTCTACGAGGCCATCCAGCAGGCCCCAAGGGTCCT
CATTGAGGAATTCACCATTCCTATCCGATCAGGCAGGGCTTGGGAGGCACCAGCAGGATCAATTGTGAGCATCAG
CACGCCCGAGGGGCCTCAAGTCGGCGACCTCAACATCTGGAACCGCCACAACCCCGCGAGCGCTTCTGGGCCTC
CCGCACCCGCCAGCTTCACTCCACCCACGTGTCCACCCATGACCGCCTCTGGTCCAACCTCCCCTACATGCGGCC
CCTCGTCACCATCATCTCCGACAGCCTCGCGTGGTACGGCCAGGACGAAAACGGGGGGCGCGTCCACGACCTGCT
GGGCACCCGCTGCGACCCGTACATCAACACCGTGCTGTCCGACTCGCAGTACGATTTTCACTGCCACTCGAACCT
GAGCCGCGCCGTGGGCAA > SEQ ID NO:222 214596_300859_1 *Trichoderma harzianum*
AGGTTGCTGTGCTGGGGTAGGGGAGAATAAAAGAAGCAGGGCGGAAGGCGGGAATATGGGGAACCAAGCGCCAGG
GGGGACCATTGAGAAGAGCAAGGATGAACCAGGGTCAAACTCTCATCCGCAAAAGTAAACATATATCGTACTACT
CCTCCCTTCTCTCCTCCACCCAGACACCCAAGCCATTTGTACTCTTTCGTAGAAGAAAAGAAACGGAAAAAAGAA
CAAGTATCTATACATAAAAAACAACCCAGCACATCATATCCAAGAAAGCAAAAAAAGACACACAAGACAGCAAGCA
ACCATGGGCTCTCTCGTTTCCACAATGGGTTCC > SEQ ID NO:223 214601_300863_1 *Trichoderma harzianum*
GTTTCGGGCTCGGAGACTCATGCACAAGTACAACACCTATTTCCCCGACGACGCCACGAATGACACCCTAGTGGC
CGAGAGGGAGAGGCTCCTCAACGAGATGCTGGGCAAGATCGGCACGAACCCCTTCATCGAGACGCCCTTCAACGT
CGACTATGGGTGTAACACGTCGATTGGAGACAACTTTTATGCCAATTTCAATCTGGTGATTCTTGACTGCGGAAT
GGTCACAATCGGTAACCGCGTTCTGTTCGGCCCCAATGTGTCAATATTCGGTGCAACACACGAGACCGGAATCCA
ATCGCGCCGCAGCGGAATCGAGTACGGCGGCAGCGTCACCATTGGGGATGATTGTTGGATCGGAGGCAACACCAC
GATCATGCCGGGCTTGACGATTGGAAAGGGATGCACAATAGGAGCAGGCAGTGTCGTCACCAGATCGATCCCCGA
CTTTTCTATTGCGATTGGTT > SEQ ID NO:224 214602_300863_1 *Trichoderma harzianum*
ACGCGTCGGGCGGATAGTTGTGCTATCGTTGTCTTCATGTTTTCATGTTTGCACATAGATACGAGAAGAGTTGTG
GGAGTTGGTTGCGTCATGACATAAGTTGTAATTATAGTATTTGCTGATTATAGCTGATTACGCAGGGTGTGTTTC
CTAGTTGTGTGGATGGATGTGTGTTGATCTGGCCCCCTGCATATTTCGGAGTAAATCATCCTCCCGATGGCTATA
GTCGAGAGGTTAATGGGCTCTACTCGAGTTCTGTCGTGTAACAGCATCCATAAAGACAGTCATAAAGAAGTTCTT
GAGTCATTTCTGATTCTCCCTGTCAACATCATGATTCATCCAACTGAGGAACCATAATGAGCTTGTATAAACACT
CACTAACCTCATTCTAGAGCATCCTTAAGAGGGTCTCTAAG > SEQ ID NO:225 214603_300863_1 *Trichoderma harzianum*
GCGCAAACAAGCACGCCAGAGGCGGGATTACTGGTACCGACGAGCGGTTCTGCTGCGGGATGCCGAAATCAGCGA
GAAAAGAGCTAAGCTGAGAGCCTCTCTGGCATCGGGAAAGCCATTGGACCCGACAATCGCCAACGACAAGTCACT
GAGGAAAGATTACCAATATGATGAATCACGAGACCTTACTACGAACGAGCAGTTGGACTTGGACGACGAGTATGC
GCAGCTGTCCGGTATCGTCGACCCTCGAGTTCTCGTAACGACCTCTCGCGACCCCTCGGCCAGATTATCTGCTTT
TGCAAAGGAAATCAGGCTTCTTCTACCAACTTCAATCCGAATGAACCGTGGTAACCTTATCTTGCCCGATCTCGT
CAAGTCTCTGCACAGTCTGCAGGCCTATCCGACATGCTTCTGCTTCACGAGCATCGTGGTACACCAACGGCTTTAAC
AATCTCCCACTTCCCCCACGGACCGACAGTTTCATTCTCTGCACAACGTTGTGCTCCGCCACGATATCCCTGG
TAGCGTTCGAGGAACCGTGTCAGAGTCATACCCTCANCTCATCTTCGATGGCTTCACTACTCGCTTGGGA > SEQ ID NO:226 214604_300863_1 *Trichoderma harzianum*
CGTGTCTTGTCATTATTACTCGACACGCGTCGCACTCACACGGCAGACTATTGTCTCAGCTGTTACTCCTCCTGC
AGCCTCAATCGTTACCATCGCCAAAACCTGCCATTTTCGCGGCTATGGGCTGGGGGGCCGCCTCGTTGGCCTCTG

Figure 1 continued

CATGGCAACAGGCTTTTCCGAGTGTGACCTTCCCACCCTTGGAATGGCGCTGATAGCATTGCCGCATGCTGTCTG
CTACTTCACAAATATACATGACATATCTATTGAACTGCATGGACTCCAAGTTATCCATTATCCATCACACAAACG
ATTTGTTTACAGTATTGATGCTGTACATTAGCTCGTACAAGCCGAGCCAACAGCATAGACATACTGCAATATGAC
TCTGCATGCAGAAGGTTTGACGAGTACCTGATCACATACAGGAGATATACTTTGTACATCCTCCGAGACAGGGCA
CCGGGCTTACACCAAACTTGCAGTGCCTTAATTACGGAAACTCCGTTGTTACATGCAGCCTTGCACATCCCACGC
AGATACTCAATCCCACGACTCAAAAACTGGAATACTGATACCCGTGGCCTGCTTGTACGCACAGATACAGAAGAT
GTCGACCCCTGGTCAAGAGTCTGATTCCACATCTGCGTACGATTACTTTGGCAAAGATGGCATTCTTTCTCTCTC
TTCCATTTCCTAATTTC

> SEQ ID NO:227 214606_300863_1 *Trichoderma harzianum*
GAAAGAAAAAAAAAAAACCATCACCAACTCGTCCTATCTCGGCATTTTCCAACTCCTCATAAAATTTCCTCGAAT
CCCCTCCAGAAATCTCCGACTAAACCTCTCCATTTCCAAAACCGCAATCATGTCCAACCGCCAACTCGCCCGCGA
CATGCAAGTCGAATTCCAGGCGCGCTTCCAGGCGAAACAGGCCCGGCGCGAGGCCCAAAAGGCCGCCAAGCAGGA
CCCGATCCTCAAGAAGCAGATCCAGGACCTGCTCAAGAAGGGCGAGACGCAAAAGGCCTACCAAAAGGCAAAGAT
GCTGCTCTCCAAGCAGGCGCTCGCCGCCCAGATGGACCAGATGGCCGACATGGCCGAGCTGTCGAGCGCCCAGAT
CCAGGCCAACAACGCCATGAACAGGATGACGCACATGATGGCCTCGTCGTCGCGCACCATGAACCTGGCCCAGAA
GAACACCAATCCCGAAAAGACCCTCGTTACCCTGGAACAGTTCAAGCAGCAAAACGAAGAATACGCCATGACAAA
CGGCATCTATCAGGACGCCATCACACAATCCACCTCGGTCCAAGTCGGCGAGGACGCCGTCCACGAACTGCTCGG
AAAGCTCGCCGACGACGCCGGCCTGGAACTCAGCTTCGAGCTCAACAAGGCGAAGCCCCAGACCGGCGAGCC > SEQ ID NO:228 214607_300863_1 *Trichoderma harzianum*
GCCGGGGCGAGAAGTAAAGGGCCGGAGCCAAGCGAAAGAAAGAGGTCATCAACAGATGCTCATCTTACACCATGT
CTTCTACCGATAATACTGAGCTGATTCTTGCCATTGTGGCACTTATCATTTCTATTCTAGCCTTTGTTATCGCCA
TCTTACAGGCTCTCCAGCAGTATTTCGCGTCGGCTACAGGATATTCTTCTTGCAGCGAAGCTGTAATAGGGAAAT
GGTCGCGATTCTCCAGGCGCAGTATGCTTTGGCTGAGTTCCGCATCGAAGTACATTTCGAAACACCCGTCTTAT
TTGTCGCAAGGCCCGAGAACACGAGAGGGCCTCTCGGAAATGATGAGGATTTCCGTACAGAGGATAGGAAAATTA
TACGCCTTGACGGCAGCCCCTCAAATCTCAAATACACATCAAGCACTGAAGAGTTCAACGCGCAGCAAAAGAAGA
ACAAGCAAGAAGCAATCCGCACAGCAGACAACGAAAACGCAACATGGTGTCACTTGCTGATGACCATCTATCAAA
TGGAGAATGAGTCGCGTTCTTGGCAGCAGGAATCGCTAGGCTACCAGCCTCCCTTAGATCCATCGCCTCCTCACT
CGTTGGTCGTCTGCATGCAGAGAAAGCAGCGAGTCTGGGATAGCATTCCCC > SEQ ID NO:229 214608_300863_1 *Trichoderma harzianum*
TTCGACCCACGTCCGGGTGCATCCAAAGCAAAGCAAAACACGTCAAGTTCGGGCGCCAGGAAAGCTCCGTCCGAT
CTTGGGACACAAAGGAAAAAGCAAATCGAGGCTTTGTCGCGATCGGGGTTAGCTGTCCGAGATCCTGTCACGACG
CTTCTTTGAGGTCGCGATACTGCTGGTAGAGAATCTAAAGGACAACCTTGTAAACATACCCAAATGGAGAAGGGT
GAAACGGCGGATTAGAAGCAAAAC > SEQ ID NO:230 214609_300863_1 *Trichoderma harzianum*
AATGGCGACAATTGCAAGCGGCTTGCGGCATGCGAGATGCGCAAGCTCGATTGCTGCAGCTCAATGGCGGCCGGC
AATCTTCCCGCGGTCGAACTTTCAACTCGCCATCCGGTCTATAACCAGCGACTCTCAAAAGCCTCCCAGTCTTGA
ACTTGAAGCCGCCGAGTCCGTCC > SEQ ID NO:231 214611_300863_1 *Trichoderma harzianum*
GCCATTTCCACCATGAATGAGCATTGCAAACTTTACAGCGGCTACATGTATGCTTGACGTAGCCATGAGTTGTCT
GTCTGCAAACATGTCCTCTATTCTGCACATCCATTTACCCTTCACACTGAAGGCTTGGCTCTCTCCCTTTCTTTT
GATAGACCCCTTCTTTTACCCATCTCTTTCTCCATTAAATCGCGCTCATTGTTCTTTGCTCCATTATACATCGAG
TGACCCCGCCGCAAGCCTCGCCAAACTCATGCAGCTGGAGTGAGATTTCGCTGAAACTAGCTTCACTCGGTTACC
GCGTTAATCTGAGCATTCTCTAATATAAGCCTTAGGCTGATTGGCACAGGAGTAATTGCGCCGTGTATGACACAA
GGCAATAGAAATCACACCTGATTCCCGTCATGACAGATTCAAGATATCGGAACCCCCACCACCGTCTTCGGATGA
AGGAATCATGCATGATTGCGGAGTGCATTCATAGCCTGGAATATTGGCTCCTTCGTATTACTAAACCAACAAACG
GCGGACTGAACCCCGAAGTGCAGTATAACTCAAAGTAGAAATAGGTGCACATTAGCATTGCCTACTATCTGTGAC
TGTGACTCGCGAAAAGTTGCCCGACATTTCCAATAGAACCGACAGATGGTGGACT > SEQ ID NO:232 214612_300863_1 *Trichoderma harzianum*
GTCTGTCATTATTATCGACCCACGCGTCGCGAATGTCGCCAATCCGATTAGACGCCCATGTAAACCCAGACCAGC
ATACGACACGGAGCAATACACCGCGAATCAAATATCCCATGTCGAAGCTACGCGACTTCTCGCCATACCAATGCC
TATCTGTATAGAGTGCCGGTATCCTGTCAAAACT

Figure 1 continued

> SEQ ID NO:233 214613_300863_1 *Trichoderma harzianum*
GAGAGACTTGCGCTTCGGCCCGGCATTTGCACATTTTGAGAACCGAAACGAAGAAGAAAAAGGATAAAAAAAACA
TGGCTTCTAATCAGTTTGATTCCCAGGCCTCGACCAACTACAAGGAGGCTTTTGCCCTGTTCGACAAGCGCGGCA
ACGGTCGCTGTGCCGTCGACTCGCTGGGCGACCTGCTGCGAGCATGCGGCCAGAACCCCACGCTGGCTGAGATCC
AGGAACTGGAGAAGGGCCTTGGAGGCGAATTTGATTTCGAGGCCTTCCAGCCCATCCTGAACCGACCCGGCGGAT
TCCGCGACCCTGGCGAGCCCGAAGAATACTGCCGTGGCTTCCAAGTGTTTGATAAAGACATGACGGGCTTTATCG
GCGTCGGCCAGCTCAAGTACATCTTGACCAACCTGGGCGAGAAGATGACGGAGGAGGAGGTCGACGAGCTGCTCA
AGGCCGTGGACACCAGCTCTGGCCAGATCAACTACACAGATCTTGTCCGAACTATCCTCGCCAACTAAGATTCCC
CTTGTACGAAGAACCTAACCCCCGGTGGTATCTAAGTGCATCTGCGAACGGGATGGCGTTGCTATGTGTTTGTTT
TGATTATGGCAGTGAAATTGGGCACGCTTGGGATTGATGAATTTTTCTTTTGTACGGGA > SEQ ID NO:234 214623_300863_1 *Trichoderma harzianum*
GTGTGAATTCGCGAGCGAATGAAACTCGTCGCATGCTTTGGATCCTGCTTCCGACAAGCTCCCACGACTTGGCTT
GGATAAACCTCTAACCTCCATTTTGGAATCGAGTGTCCTCCATGGCTCGAGAATAAGTCACATATTCAATCAACA
GTATACATAGTTGTAATCGATACACCAATTTCTACTGG > SEQ ID NO:235 214624_300863_1 *Trichoderma harzianum*
ACCGGAATCGGCGGAAATTGGGCACATGCTAGTGACTCGGGATACGTAATTGAATGAAATTATCGAGCTTAGGAT
GTAAAGTTTGGACTGATGAGTGCATAGATGTGAGGGAGGTTAGTCTCAACTATGCAAAATACGGTGTCATGATAC
AACTTCTTCTCGCTATAAAGTGCCACAGATTTAGCACCTTACTACGTGTACATGCATGAGAAAAAAGTGGACGGC
GATTGTGTGTGAATAAAATAAATAGCTTGAGAATTTAGACTGTAAGAACCCATGATACCAGATCTTGTCATGGTA
TTC > SEQ ID NO:236 214626_300863_1 *Trichoderma harzianum*
ATCGCTGATTGCTCTCTGTCATCTGCCAAGATGTTCAAGAGCGGCGTTTCGTCCCTCGCAAGGGCTGCCCGCCCA
TCAATTGCCGCTCGACGAGCTATCCGACCAGCCTTCCCCCGATCCCCCATCGTCAGGCTTGCAAGCACTCAGAGC
GTTGGAGATGGCAAGATCCACCAGGTCATTGGTGCCGTCGTCGACGTCAAGTTCGACACTGCCAAGCTGCCTCCT
ATCCTGAACGCCCTGGAGACCACCAACAACAACCAGAAGCTGGTCCTTGAGGTCGCTCAACACTTGGGCGAGAAT
GTCGTTCGCTGCATTGCCATGGACGGTACTGAGGGTCTTGTTCGTGGTGCCAAGGCTTCCGACACTGGTGCTCCC
ATCACCATTCCCGTCGGCCCCGCCACTCTCGGTCGTATCCTGAACGTCACTGGTGACCCCATTGATGAGCGTGGA
CCTGTCAAGACCGACAAGTTCCTGCCTATCCACGCTGATCCCCCCTCTTTCACTGACCAGTCCACCTCTGCCGAG
ATTCTGGTTACTGGTATCAAGGTCGTCGATCTGCTCGCTCCCTACGCTCGTGGTGGAAAGATTGGTCTCTTCGGT
GGTGCTGGTGTCGGCAAGACCGTCTTCATTCAGGAGCTGATCAACAACA > SEQ ID NO:237 214629_300863_1 *Trichoderma harzianum*
GACTATGATACCCTTGCCAAGTGTATGGTCCCTCTCGGAGCCCAGGCAGATCTCACCATGGAGGGACGAGTTGAG
TTCCTGAAGCGTTTGACACGCAAGTTTTCCGAAGAAGATATCCGGAAGAAGTTTACGAAGCAGGCGTAAAATTTG
ACTCCTGTTTTGACGGAGACAGCACGGCAGAGTCTAGTTCAATCTTCGCTGCCCTAACTACACCTGGTTCTTCTC
GCTCCCGGCAGCATAATGATTGTTTGACGGAGGATGCTCGATGACGAAGACTATTAACATGGAGGAGGGTTCTCC
ACAGAGCTGGCATATCTGGTTTCGGTATTTTTGGTTGAAGCATTGGTTGTTCATGGCATATGATTGCATGTGATT
GCAGACGTTGATGGCGTTTTGGAATAAGGGCGGGTGGAAAATTGACCTTGGGTCGAATCAGCACATAGAATTCTC
ATGGCTAGAAGAATTATGGGAATAGGATCAATAAGAAATGCAT > SEQ ID NO:238 214632_300863_1 *Trichoderma harzianum*
GCTCGGCGATTCAATATCTTTCTCTCGACGTGGTTCGATTTCGATTCGACGTATCGGTGGGGGGGCATGAATAAG
GTAATGGTTGTGTTTAGTTGGGCTCGAAACTAATGTTACCCATCAGTAGTATCACCTATTGCTGACGTCGGCTTG
AGGAAGTGGGTTCAATCGTGATACATTCGGCTCGTACAGTGCAATACAGATAAGATGATGCGATCAGAGAGGCAA
TTGTTAGGTCATGATTGACGGAGGATTCGAGCCGATGATGACAAGGCGACAAGAGCTGGGCAATCGACCCCAATT
GGATGATTCTGGCACCCCAAGCTGTGAATTCGGCTTGACCTTTGAACATCAACTTGCTGTAGGGTAGTGCAACCT
TGGACGTAAAGAGAAGGCAGCGTCAGCATTTGTTAGCGCACAGTACCTACCTGTATGTAT > SEQ ID NO:239 214633_300863_1 *Trichoderma harzianum*
GCCCTCATATATTGAAGGCATCGCCAACCCGATCACAAACCTTCTTGTCCAGACTTGCAAACCACTCAATCGATT
CCTTGATACCCCTTGGGACAACTCTACTTGTTCTCTCCAAACTTACCCCTCCAAATACCATCATCACCATCACCA
TGACCAACGACGTCTCTACCAACGGCTCTTCTGCCGCTCCTGCGACCACCTTTGCCCTCAAGGCTGGTCTCGCCC
AGATGCTCAAGGGCGGCGTCATCATGGACGTCACCAACGCCGAGCAGGCCCGCATCGCCGAAGAAGCTGGTGCCT
GCGCCGTCATGGCCCTCGAGCGAGTTCCCGCCGATATCCGCAAGGACGGCGGCGTCGCCCGCATGTCCGACCCGG

Figure 1 continued

CTATGATCAAGGAGATCCAGGACGCCGTCACCATCCCCGTCATGGCAAAGGCCCGTATCGGCCACTTCGTCGAGT
GCCAGATCCTCGAGGCTCTTGGTGTCGACTACATTGACGAGTCCGAGGTCCTGACGCCCGCCGACGACGA

> SEQ ID NO:240 214634_300863_1 *Trichoderma harzianum*
AGCAATTCACCATGTTGAGCTTCCTCGGAAAATCGGTAGCCTTGCTGGCTGCGCTGCAGGCTACTCTCAGCTCTG
CAAGCCCCCTAGCCACAGAAGAGCGCTCTGTTGAGAAGAGAGCCAACGGATACGCAAACTCCGTCTATTTCACCA
ACTGGGGCATTTACGACCGCAACTTCCAGCCTGCCGATTTGGTGGCATCAGATGTCACTCATGTCATCTACTCAT
TCATGAACCTCCAGGCAGACGGCACAGTTGTCTCTGGCGATACCTACGCTGATTTCGAGAAGCACTATGCCGATG
ATTCTTGGAATGATGTCGGCACCAATGCCTACGGCTGTGTCAAGCAGCTGTTCAAGGTCAAAAAGGCCAACCGAG
GCCTCAAGGTTCTGCTCTCCATCGGTGGCTGGACCTGGTCCACCAACTTCCCCTCTGCAGCAAGCACGGATGCCA
ACCGAAAGAACTTTGCGAAGACTGCCATTACCTTCATGAAGGATTGGGGTTTCGATGGCATTGACGTCGATTGGG
AGTACCCTGCAGACGCCACCCAGGCCTCCAACATGG > SEQ ID NO:241 214637_300863_1 *Trichoderma harzianum*
ACGAGAAAAAGGAACAAGCCGCGGGTTCTCAAAGTCTTCCGGTGCCGCCGGCCGTTTGGCTGCGGACCGAAAGTG
TGGACAGGAATCAACTCGTGATGAGATCCGGGAAATG > SEQ ID NO:242 214639_300863_1 *Trichoderma harzianum*
GATGCTCCACCATTGCTTGCCTTATCGCATTCAAGGCCAGGTAACGACACTTGCTGCTGAGTCGAACGCAACACC
GCCTTCAACAGCTCCTCTGCAAGTCTCCCGCAAAAGGACAGGCTCAGTCTTGTGTGGGCAGCATGCGCGTCATTG
CCCTTTTCTCGGCCCTGTGTGCCGCAGCTCTGGTCCAGGCCGATTTCCACACGGCGCAAATCTATGTGCAGCCCG
TCGAAAACTCCGAGTCGCCCAGCCTCCTCGCCGAAGTGGCATACGATCCTAGCATCAGCGGGTCGTCCTCTATCA
TCTCCTACGAAGCTCCTGAAATCCCGGAGTCTACACAGCTGGTCCGCGTCGGGTTGTACGACGTCAAGTCTGCGC
GATGGATATCTGGCACAACTGTTGCCTCGGTGGACAACTTTGGCAACGGCTACTCGCCCAATTTGATACTCTCAG
TCGATGAAAAGGGAGAGCTTCTCAGTG > SEQ ID NO:243 214644_300863_1 *Trichoderma harzianum*
GAGCCCTGTTGCGATGGAGACGAGAGATATGAGTGTATCATCTCCAGGTGGACCAGACAAACCAAAGCAGGCTTT
TCCGTCTTCTCTTTTGATACCACGGCGCCGCACTTGGTGGGCCTGGACCATGCCTGCCCGGTGCAGTGATTTACA
CATCACACGCCGTAATGTACTCGTACTCGGTGATATTGACCTACCAGCTATTTAGTACGAGATATGATG > SEQ ID NO:244 214656_300863_1 *Trichoderma harzianum*
GATAGCATCCGCAACGGCCGTGGTCAGCGACCCGACAAGTCGTAGCTTGCTGTACATGGTTGGAATGCGCACATC
ACCCTCTCCATCGTTGGCGACTTTCCTGACATCTCCATCTCCATCGCGTCTGAAGCTCTTCGCTGACCCGCTATG
GCGGGGTCGGTGTCAGCGAAGCCTCGCCTCTGTAGCCTCGCAACAATCGCAATCACCATCGCAGTATGGGAAACC
GCCCTTTCGCTTTGAGACGGGCATTGGGCTGTTTGCAAAGCGGTCGCCTCGGCCGTTCCCGCCGCCCTTCTTGTC
CCCTCCATCTGTATCCTTCTCAGATCCCCTAAGCACCCATCACCAGAGTCGGGACCGTCGAGCTCGCGCCTTTGT
GAATGGAGAACTCATTAAAGGACTTACGAATGGTGACGATGCCGTGTATGCTAGCGACTATTTCATATGTGCAAA
CGATGGCGTAGGCGCGTGGGCAGCTCGCCCCAGAGGTCATGCTGGGTTGTGGTCGCGACTGATATTGCACTTCTG
GGCGACGGCCATCGAAGAAGAGTCGGCGCAGAACCTATTCCAGCAAAAGGCCTACCAGCCTGACCCCGTTGCGTC
TCTGCAGACGGCATTTGAGCAAACACAAGAAGCAACCGGTGCTCATGACTGGCAGG > SEQ ID NO:245 214658_300863_1 *Trichoderma harzianum*
ATCAATTTCACTTCATCTCATCTTACCATTGCAGCTACCACATGGCAATTACCGTCAGACTTGAACGAATCAGCT
AATACGCGTACTCTTACCTTCAATTCCGCCTTTGGTACGGGTATCTGTACAAGTACGAAAGGTACAAGATCGGGG
GGACTCTCCGCCTCGACGAGGCTAAAAGAATGTGGAATCGGGCCAACTCGACGATGACGGACTGACGAATCTTTC
CACCGCAAAAGCTTCTTTCAATGGAATAAAACGGTCCAGTCTACGAAAGCTTCTACTAAGCACCTAATTAATTAT
AGCAGTAGCAGTGCAATAGTAGTGAATTTCAAGTATCCATGACGTCT > SEQ ID NO:246 214659_300863_1 *Trichoderma harzianum*
ACGCGGCTTCGCAGTACAGCGGTGTCGTGCTCCGAGTTCTCTTTGATGCTGGAAATCAATGGTTTGCTGCAGATG
CAAGCCATCTTTTTTTTTTTGCCCACTTTGGCTCACCGCAGGTAAAATATGGGAACGAAGAAGAGAAAAAACCGT
AAGTTCCTTAGCCACTAGGCAGCTCTGCCACTTTAGATGGAAATCGCTCCGAGAAATTGGCCGCGTTGATAAGCT
TGTGAATAACCT > SEQ ID NO:247 214666_300863_1 *Trichoderma harzianum*
GACCATTACCATCATACAGCCAACCTCTACATAAGCACAAATACCATTCAAAATGTCTTACGGCGGTGACAACAA
CGACAACTCTCGCCGTAATGACGACAACTTTGGCTCCGGAGGAGATTCTTTCGGCTCTGGTGGAAACCAGCAATA

Figure 1 continued

TGGCTCCGGAGGAGACTCATTTGGCTCTGGGGGAGATTCATACGGCTCTGGTGGAAATCAATTCGGCTCCGGCAA
CCGCCGTAACGATGACAGCTCATTTGGTACCAGTGGCCAGGGCGAGTTCGGCTCTGGAGGTAACTATGGCAGCTC
TGGCGGTGACTCCTATGGGTCTGGAGGAAACACCTATGGCTCCGGCGGCAATGACAACTTTGGCTCTGGGGGCAA
TGATACGTACGGCTCGTCCCGTAACCAAGAGTCTTCTTTTGGATCCA

> SEQ ID NO:248 214667_300863_1 Trichoderma harzianum
AGACTCTTTGCTTGATTCACCCTGTATAAGTTGGGTTATCAAGTTTTCTTGTTGTGAACTTTCTGGATATCTAAG
AGAGCACTCATTGTGACTTGGGTTTATACTTGGTAAACTCCTTCATCATGCAGCAGCCTGAAAACGAATCCGGCC
ACGTGCTGGTCACCCCCCTCTGGGTGTTCATTTGCCGTATTTTCCAGATTCTCGTCTCTCTCATCATCCTTGCCT
TGGCTGCTCGTTTGATGCATGATGCCTACCTTGACGAGGAAGGTCTCGCTCTGGCTATTGCTATCATCACATGGC
TCGTCTGCTTGTACATTATCCTGAGTGAGAAGCTGCCAACTCTGAACCAATTCTACCATGTCATTGCCGTCATCG
TCCTTGACGGTGTCATGATGATCCTCTGGCTTGCAACCTTCGCCGCCGTGGCTGCCAAGCGCGCCCAGTTCCGCT
TCAATGTCAGGGTCGACGGCTGCTTCGACGACGGCAGCTTGTTTAACAGCAAGACATGCTACAAGAAGCGCGACT
TTGTCAAGAAGCGTGACGTTATCCTCTTCAAGTCTGGTGGTGACATGCTTTCCGCCATCGCTGGCC > SEQ ID NO:249 214668_300863_1 Trichoderma harzianum
GGACGGCCGCGTGCCTGAGCTGGCGGACGATGCCGACGACGACGAGGCTCTGCGATACGCGATAGCGCTGTCGCT
GCAGGATGAGGCGAATTCGCCGGTGGTGATTGTCGATTCGGATGATGACGATGATGGGACAAAGGCGGGCTCTTC
GGGGTCGACACAGCAGATGTGGTCGCAGAGACAGAAACAGACACAAACACAAACACAATCATCACAGACGCAGAC
GACGCAGTCTTCACAGTCACAGCATCAGTCCCAGTTCGGCAGCCTCCTTCTTGACCGCAAGGCCATGGAGCAAGA
ACGTCTCAACCGTCTCGCCAAACGCCAACGTTCACCCACTGATGATGGGAACGATGACGATGATGTGGTCGAGGT
CCCTCCGCCCAAGAAGCAAGCCAGAACAGCTCCAGAAACCACGAGCAAGACCACGAGCAAAGCAAAAGCAATAGA
GTCAGTTATGACGAACAGCATCAAAAGCAGCATCACAAGCAGCACCACCAGCAGCACCACCACCAGAAGCAACTT
ACCGTACCCAAACGGCACCGTCAAACGGACATGGTCTCGCGGCTGCCCACGAACAGGCGACGAAATCACCATCGA
GGAAGTCTTCCAAAAGGACCAGCTGGAGCTCGCCGTGCTATCATCTTT > SEQ ID NO:250 214672_300863_1 Trichoderma harzianum
gacacaattcctcgctgcgtgtgactcgtgtctccAGCAAATACCGCAAAGATGTCTGACGACGGGCTCTCAATA
TACGATGAGATCGAAATCGAAGATATGACCTTCGACGAGGTTCTTCAAACATACTTCTACCCGTGTCCCTGCGGC
GATCGTTTCCAGATCGCTATCGATGACCTGCGCGACGAGCAGGATATTGCTGTGTGCCCCAGCTGTAGCTTGATG
ATTAGAGTTATTTTCGACCTTGACGACTTACCCAAACCTCCTCCTACTGGCAATACTGGTGGCCAGATACCAGTC
GCTGCTTAAAGCCATCGCTATATTTGAGCTTCCCTGGGCGAATACTTGATCTATTCGGCAGACACATCGAGATAC
TACACTAATTAGGCCCGCATAGCGTACACAGTGCCTCAACGGCCGTTCTGAAGAGGCTTCTCAGATTGATCCGTC
TAACATCGGATGTATTGATAGACGCGGACGAGAAGACGACGATGTACCAGCGACAGACCAAAGTCATCCCAAGCA
TCCAAGCTACTGATGCAAAAATATGCGTGCCTTGGGAGTACCACTCTCCGAGGCAAAAATTCAGTCACTTAAAGA
GACAGGCTTCGGGAATGCCATGAAGAATTCAGGCTCACGTGGGGGACAtTTGATG > SEQ ID NO:251 214678_300863_1 Trichoderma harzianum
CCCACGCGTCCGCGGACGCGTGGGGTTCCAGGTAGGCACATGTATGGAGAGCCTGTACAAGCCACCAATACGTTG
AAATGAGCTAACCAGTGTGTTACTGTTCCTGGTCACACTAATACTACAGAGTCTATGTCGAAGAGATGACAACAA
TTGTTCTGAAAACCCAGAAATAACTCTTCAACGCATTGAATGTTTGGTCGCGTTTAAGATTATGGTGCCAATCCC
CGGCCGGTGGCTGGTGTTGTTGCCAAGAATCGTCTTCGTATAGCCCGCATAGAGTACACCGTACTTATCGCTATA
CCAGAATCAATACGTGTGTTCTCAGCAATGTATTTGCACCAACAATCTCTTTCTGATGTCTTTCTGGAATCTATA
ACTCGTATTTTTACATGATCAATATAAACCGGCGGCAATCGTTCCAATC > SEQ ID NO:252 214680_300863_1 Trichoderma harzianum
GAAGCCCTCACCTCACATAAACACGGGAGAACTACATTCAAGATGGATTTCTCTAAATTCAGCAAGGGTTTCTCT
GATTTCAGTGCGCAGATTACTCCGTTTGCGTCACGGACCTTCCAGTTTACCAAGGAGCAGTTGGGCCAAGCAGAT
GATCGAACTGAGCTTCCTGCCGATTACATCGACCTCGAGAAAAAGGTCGATGCGCTGAAACAAGCCCACCAGAAG
ATGCTTGCGGTGACTTCGCAATATACCAACGAAGCCTATGACTATCCTCCCAACATCAAGGAGACATTTCAAGAT
CTTGGCCGAACCGTGAGTGAGAAGGTCAGCCTTCTATCTTCGGCTACATCTACTTCAGAGGCCCAAGCAGCTCTT
GTGGCTCCAGCATCTGCGAAGCCGCAACCAAAGACTTTCAACCATGCCATCTCTCGTGCGAGCTTATCCAGCAGC
CAGCTCCTGCACCAGCACCACACTGGTGCTGGCGAAGATCCTCTGGCAACAGCTCTCGAGAAATATGCACTCGCG
ATGGAACGAGTGGGCGACGCGCGCCTTGCTCAAGATTCACAAATCCAAAGCCGATTCCTAGCAGGATGGAACACA
ACC > SEQ ID NO:253 214690_300863_1 Trichoderma harzianum

Figure 1 continued

GTGCTGAGTTCGCGGGTCACGGACCTTTGTTGAGGCTGAGACATTGGCTTCAACAAACATCCCGGATCCTTGAGA
GCGGCTCATAGATATACATAATATGAGTGATGTAACCATTGGGGTCGAATGGTCATTGTGAGCTTGGTAGAGGGT
GAGCGGGAGACGGCGTCGGCGAAGACCGCAAAGCTATTCCTGACAATGAAAAGATCTCACAGAAGATCAGACAAT
TAAACTTTCTTTTGTTTCTCCCCAAGCGAAGAAAAAGAGACCAGTTCGTGATAGGGCCCCTCATAGACCAATAAT
GGTTCTGCATAGGACGGCAGAGTGAAGCCTCATGGACGCGGTGGCGCGGCGCTTCTTACCTTTACATAAGAATAC
ATGAGAAGATGAGAGGGACTCTACTAAGATCGTCAATGTCCTACACGATTGATAGATGATGGAGTTTTTGTAAAA
ATCGTTATTCTATTATTCAAGCTCATCTTTGTC

> SEQ ID NO:254 214693_300863_1 *Trichoderma harzianum*
GCCTCCCCCCAGCCCATTCCCTCCCGGCGACTCGTCAACACCATCGCGAGAATTCCAACGCCAGGAATTGTCTCT
GTTGGCCGTCTCATTTTTTGGGCTCCACGCAAAACCGCTTCTTCTGGCCAGTTTGCTCGTCATCCTAGCATTGTT
TCGACTCGACTCAGGCTGCCGTCGACCCGTGCTCGCCCCATTTGTGCTTTGGACAGGGGCCCCCGTAACATTAAT
TACTAGCACTGCTGTGCGACGACGACAAGAGTCAACCTTGGACATTATCGTCCGTCCTCTCTGCGACCCGCATTG
ATCGCTCGATCCCCACGACCGTGCCGAGTGCCCTAGGCACCGTCGTCGCAAGAGCCCCAGCTATCTCGTCTAGCT
CAAGATAAAGAAGCTCCAGTCCCAGAATCAGGCACCATGGCGACTCCGGCAAACAAGGAGCGCCCTCTCCCGTCG
CCTACTCAGCAGGCCTTCTCGTCGCAGTCGGCGCAGCAGCAGCAGAGGCCCAATTCGCGACGATTTAGCTTC
TTGTCCGACAAGTCTCGCAAGAACAGCGTC > SEQ ID NO:255 214694_300863_1 *Trichoderma harzianum*
GCGTGATGCTTGACCATGTCCCATATTCCTAAGCCGATAGCACCCACGCGAGGCGGGCGTGATTGATTACGCTTT
CGCAGGAGCTGAGCACGCAAAATGGCTTTGTGACCTTTTGCCTCCTTCAGCATGCTCTACTCTCTGTCTCTATAT
GGGTATTGTTTGATGGGTTACTGAATCGGTGCTGATAGCAGATATCGGGCTTGATTCGCGATTCGGAGAAGAAAA
AGCTGGAGGCAAGGCTCGGCGAGACCGATGTCGGATACTACGCATAGACGATTGCTTGGGATGGCAAACACTTGA
AGATCGAAATTTCTCGAGCTTTCATGTTCATGGGGCTGTGATAGTCTTAGGGATTTTGACGACCACCGATGCTGA
CCTTCCCTGTATTTGCTCATTTGATACCCTGCCACTGCGACGAGCCAGCAACGGTGAAATGAGATACAGACTCAT
GATGCGAAAGGATATATAAGAACCCAAAGTGTCGCTTAATGTCGTTTAATTAGATGGCTATACCGGACCCGCCAA
AAAAAAAAAACAA > SEQ ID NO:256 214695_300863_1 *Trichoderma harzianum*
ATCAATCGTCGCAAGCACAAATCAGCTCGAATCCATCACCATGGCAGACATCACAGAAGAACCCCAGGCCCTCCC
TGTCGATGAGACGCCCATCTCTTCCGTCAAGACCAACTCCGCTCGCAAGAACTCTCTTTCCAACTACCTCAAGCA
CCGAACCGAACGCTCCGAGCTGGTAGAGAAGAACATTCTCCCAGACTCTACAGCCGCACCCGGCCTCCTCGCTCA
GCAAAAAGAGCTTCAGAAACACATGCTCGGAGACAAGCTCAACGACAAGATTTCACATCGTCCCTCCCCCGACGC
CCTCCTCAAGGAAGGTGTCTTACACGAAGAACCCCGGTCCCCAGAGGAAAAGTACGCCGAGGCCATCGAGGAGGA
GTACGCTAAGCGGGAGGGCGGCGCTTAAGCAGCATTAGAGCTACATGGCGAACACGGATGCTGGGAAAATGCGAA
CTTGTTTTTCTTTTTTTTTT > SEQ ID NO:257 214696_300863_1 *Trichoderma harzianum*
GGAGTCTCAAAACCAATACTATGTGAAATGACGTTCATGGGCGAGGGGCGGCTCTTGGGCTAGGTTGTTTTCGTA
CATACGTGTACGCATGCACGTACCTGTAATGTGCAGTGCAGTGGTCAAGTGAGGCATAGTTGGAGGCCGCCTGAG
TGGAATAGAGGCAACGAAAGAGGAGGAGGGATGAGAATGGGCCAGAGTCGGAGGGTTGGCGATAAAGGTCTTAGG
ATGCAGGGATAGCGTTGTTTCTCTTTTTCCGCTTTGTCGTTTTTTGTTGCTGCTTTGCATTGCTTGGTGTTTCTT
TGCATGGGGGAGGGGGATATGCATGTGCTGTCCAACACGGAAAGGATGCGGTGGACGAGTGCAGACTGATTGATA
TTCGGCTCTATTATTTCTTCTATTTGGGGTCATGCATGTAACAATCCATGAAGGGAAAATGGGAGATTTACACTC
GCATGGAGTCTATCACTACCTATGTACTGCACCGAGTTTAGCG > SEQ ID NO:258 214706_300864_1 *Trichoderma harzianum*
TCGACCCACGCGTCGGGATGGTGGTCCGCCGGAAGCCGGAATAGCCGGCCCAAGCAGGTGAGGTGATAGATTCGC
CCAGGTAGACAGAGACAGTGGATTCGGGTTCCTAGCGCAAAT > SEQ ID NO:259 214707_300864_1 *Trichoderma harzianum*
CGTGAAACGAGCCACTCTCACTCTCACCCTCATTCTCACTCCCACTCTCACTCTCACATGTTTTCTTACAGAAT
CTCCACCAGTTCAAAGGTCTGATCCTTCTGGCCACTGCACTGCGCAGACTCCACCCGGTCAGCGCCAGCGACCAA
GCAAGTCGTGTTGGTGGCCGAGGCGGGAGTAAGGATGATGTTGTTGTCGCCCGCCTTGAAGGGGAACAGCTGCGA
AGTCGCGGTTTTGCCACCTGTTGAGGTTCATCGTTAGCATTTGATCTCTTGTGAAACTAAAACGGTACAAACGCG
ATAACTCGCATGCCCTTGGATCGGGTGGATCGAGCAGATCACCGAGATGGGGTGGGGGGAAATGATGTCAATGAC
TTACTTCCATCGGCGCGTCCACCGCAAGAAAACATGATGACCTGGTCGTTGGCGGCTCTGCGGCCATCAAAGTTG
ATGCAGCCGTTGGTGAGCACGCTGACAAGCAGCGCCTCGCCGGCCTGAGCGTCGTCGTGGACTCCCTTGGTGACA

Figure 1 continued

ACGTCAAACTTCTGGCTCGCGTCTTCGCTGCAGGTAGCCAGTCCAACGGGGATCAGGTTCTCGCGGAAATCACCG
GCCGTGGGGTTGACAAAGAAGCAGCGTCCATCGGCGGCTCGGATGTTGACACTCTCC

> SEQ ID NO:260 214708_300864_1 Trichoderma harzianum
GCTTCTCTTTGTTTTATATGTCGTGCTTCATTCGCATCGATTGATTTCTCAAGCTGCGGTTCCGTCATCGCTAAT
GCGCATTCACATGTGCTTGTGCTTATCGCATCACACATGACCCGCGCAAAATGTCATCCTCACCAAGCCAAACCC
CCGGCTCTGGCGACGCCAGCAAGGCCACGCCCTCGGGAGCAGCAGTAAACGCAGATGACAAGCCGCGGCTCACAG
AGGAAGAAAAGAAGCAGAACCACATTGCATCAGAACAAAAGCGCCGTCAGGCCATTCGCGAGGGCTTCGATCGGC
TGACTGAACTCGTGCCTGGTTTGGAAGGGCAAGGTCGCTCTGAGGGACTGGTTCTGAAGCGTACCGTGGATTACA
TGCGCGACCAGATTGTGCAGAGGCAGGCCTTGATTGAGCGTATCGAGCAGGCAGGCGGCAGCGTTGACCCCAAGT
ACAAAAAGGTTTCACAACTGTCAAGACAAGGGCTTGGCCGGTGAGCGGCTTCCCGATGTTTGCGTTGCCCTCAGC
TTGGGGTGAGAGTCGAGGATCGAGCGAGATTGGGCCGCAAAGTCATCATGGAGTCAGTTTGATCTCCCCATGACT
GCTGCAGAAAGCAGAA > SEQ ID NO:261 214710_300864_1 Trichoderma harzianum
GTAATTCGCATGCAAACAGCAATTCCAAGCCATTGCCAAATCTCACAATGCTTCGTCAAGTAAAACCCCGTAACG
CCCGCTCCAAGAGAGCCCTCGAGAAGCGCGAGCCCAAGGCCGTCGAGAACCCCAAGACATGCCTCTTCCTCCGCG
GCAACAACTGCTCCCANGGTCGTCCAGGACGCCATGAACGACCTCTTCTCCATGCGCCAGC > SEQ ID NO:262 214711_300864_1 Trichoderma harzianum
GGACATGTTCGTAGCAACTTGGCGTTGTGGAATCATGACGTTTGTATGACCCGACGTTCTTCACACAAGAAATTG
GTTGGGGCTTTTTGCCTTTTTGCTCCCCCAAAGGCGATTGAATTTTCACCAGCTGGGCGAGCAGCCAGGCGACT
GAGGCGCGGAACGGCTCGAAGCATATTTCTGTTTTATTTCATTCCTTGTTTTACCTGGTTTCCTCCATTCTTTCC
TCTTCTTTTTTTTTGGCCGAAAGCTGCAGTGTTTCGTAACGGTTTCTGGTCAGACATGTGCGTCTGATTGGCTGT
GATAAGGGCAGAGACGGGTGGTACGCGCAAGCCCCGGGTGTGGAATGAGGCCCATTCCCATCCTGTGAGACTTGC
AATTTCGAAGGTTTGCTTACGGGAGAAGAAATTATGGAGTCTACAGCAGACAAACAAAACACATGCAGCCAATAC
AATACAGTCGGAACTTTTTAGATTAAGAATTGAATTAGGGAGCCAATGCATAGAAGCTGCCAAGGGAAATGGAAG
AAGCAATAGTTGAGGGAAAAAATGAGACAAGTGACAAAAGGTTTCAAACTCCGCCGTCAAGTTGTAAGCCGTCGC
TCGTATCCCGAAACAGCCGTCCGCCACAGCCCGTCAAGATCGACTGCCACCCCCCTCTGCCACGTATACGAGGAG
AATCCACGCACTACAGGAT > SEQ ID NO:263 214715_300864_1 Trichoderma harzianum
TAATGAACGAGGAAAAGCTCGGCCACAGTAATCATGAGGACATTGTGCCTCCAGAATCCTCTACTGGAGATGAAT
TACAGACACCATCTACGGATTCCAAGGGCAAACAGAAGGCAGGCCTGGAGTTAGCAGCATCTCAACTTGGGGCCT
CTACAAAGCTGGTCGTCAATGCCATCACAACGTTTCGGGAAATGCCAGCTTTGGCATCAGAATCAAAGTCCTCTC
ATGGTTCAAGTAGCATGGGCTCGTTTTCATCTATCGCTGGCGAG > SEQ ID NO:264 214717_300864_1 Trichoderma harzianum
TGGAGTGTTGAATGAAATGATCCGCCATATGCACGCACGATCCAATACTACTCATAATAGGCCCGTCGCATCGAG
CCTAGACGCACATAACCCATGTATTATTACACTTGACGTTACACACCCGCATATAGATCAAAAATACCCTCGCGG
CCTCTGTTTATTGCGCCCTTGATTTTGCTTGTTTTCGCCTCTTTCCCCTGCATCATGATAGATCACGTCCTGGGA
CGGCCATCGTCCAAGTCGAGGCGTCTACAAGTCCTGGCTGTATTGTCTTTTAGGACGTTTTACCTCTACAAAGCC
CACAAACCATGGCCCGTCGTTTGCGCAAACAATATCCAAATTCTTCTCTCGACGCTTGACAGCATGGCAGACCGT
CATCATCACCATGCTCTACCTTTACGCAGCCCGCAACTTCAGCGCACTCGTCGGCCTGGCTAGTCCCG > SEQ ID NO:265 214719_300864_1 Trichoderma harzianum
AGAGGAAATCCGGTCGATTCAACGCCCTGGACAATCATTGCCTCTCTGGAACTCGAGCTCCAGTGGGGTCTCGT
CTCTGGTGGTTCTAGAAATTCCAACGGCGCAGGTGGAACGATCCAGCACCATCGAGAGTTTCTGCACCCAACTTG
GAAGCTTTTTAGCGCACAGACACCTAAAAACCCCCCCAATCACAGCATCCATCGATTGCCGTCAATTCATTCAT
CCATCCGTCATCCCATCCGACTAAAGCTTCTGCTGTTGTTTTGCTTCATCCCGCCCGCGATTATTTATTTCTGC
ATTTCACTCCACCTCTCGACATCGGCATTCAATTATCAGTCAAGTGCATTCCCAAACGTCTTTTATCAATCAGCT
TCATTTTGCTATCTATTTTCAACTTCTTTCGTCTGTTTGCAGGCCTCAATTCATCATGAGCGGGTCGCGGCCACT
GCGGGGCGGGTGCCAATGCGGCCGGAATCGTTACATCATCGTCATCCCAGAGAATGGCATCAAGGACGCTGAGGT
CCTGTTTAACACTGAGCCACAGCATCAGATCCCTCTCGCAACACCTCTAGCAGCGTACATTCGTGTGCCGCTATC
ATGGTACCACAGCTCTACGTATGCCTTTTTCCCAGATGAAACACACACCATGATC > SEQ ID NO:266 214724_300864_1 Trichoderma harzianum

Figure 1 continued

ACTCGACCACGCGTCCGTCGGATCGGCCTCTTTTCCTCTCTTCCCTCTCTGCTTTCCATCTGCCCAGCAGACCGA
GTTTGGCAGCGCAATGTTGCCTCTATCGGTGCGGCGCGCGGTGGCCGCTGCTCCTCAGGGGGCAAGTGGGCTGAC
TTCTCTCGCCGCGTCGGCTCCAAAGATCACAGCCTCGAGCTTCATCCTGAATCGTCCTCAGCGGCGCTACTCCTC
GTCGAAACCCTCAAGATCCGATGAGCCCAACGATATTGCTGCCGGCCAGTCGGTGCCGGCATCTACCTCGCGCGG
AGAGAGCAAAGGCAGCAGGAAACGAAAGAGCAAGGATTTCAGCCGACCGAAATGCGGCTTTCAAGAAACTGCCCA
GTGTCCCTAGCACTCACCACATGTTTCAAGAGGCCCTGAGCTTATCGAGCTTCTTCTCACTCCAC

> SEQ ID NO:267 214727_300864_1 *Trichoderma harzianum*
TTCACACTCAATAACTCAAATCACCATCAAAATGCAGTCCGCTATCGCCTTCACTGTCTCCCTCCTTGCCCTTGT
TGCCTCGGCAGCTCCCACCACTCGCACCGTTGGCACTGTTCAAGTCCAGTTTGCCAACGATGTCACTGGAGCAAA
CGGCAATGCCCGTATCCCTCTTGACGGATCCAACATAAACCTTGGAGAGGCTTATGGCAACACCAACCTAGAGAA
GGACGGCACCCTCTTTGTCACCAGCCTT > SEQ ID NO:268 214756_300864_1 *Trichoderma harzianum*
TCTCATCTTCTCTCCAATCCCCAATCCTCAATAACCTACGCCGTGTCAGTCAAGCAGCTGTACATCATCGCATAT
CGACCGACGACGACCTTGTCCTGCCGTCTTCCATCTCCAATTCTCACCCACCACTTACACCATCACACATCACAA
TGCCTGCTCCTCAGGTTAACGGCGAGGTCACCAGCCATGTCAATTCCGCCTTCCTCCAGCACCTCTTCTCCTATC
CTCTAGTTAGCGACGGCATTCACACTGTGACCACCAACGAATACGCACAGCGGCCTATCAAGCTGGGCGAATCTG
CCTATAAAACTTTTGCCGCCCCTGTTCTTCCCTACTTTTCCAAGCCCTATGGTATTGTCTCTCCCTACGTCCAGA
GGGCCGACTCCTTTGGCGACAAGACCCTGGACCGCATTGACGAGCGTTTTCCCATTGTCAAGAAGCCCACTGGTG
ATCTCTACAACGAGACCCGTGGTCTGATTCTGTTCCCCTACCAGAAGGGACTCGAGGGCAAGGAGCACGTTTTCA
AGATCTATGCTTCCGAGCTTAAGAAGCTTGAGCAGGAGGGCGTCGTGGCCCAGGCCAAGGCTGCCGTTTCCACCG
CCTTCGTCATTAGCAACGAAACGCTGGCCTGGCTGAGCAGCTGGGTCGCTGTCAAGAAGGCCGACGCCTC > SEQ ID NO:269 214841_300865_1 *Trichoderma harzianum*
GTACCAAATGGCGGGATACTTGCTCGAGTATACTTGTAAAAAACACACCGGTCTGGCAAAGGTGCATCCGGAAGC
TTGATGGCGTTTGTACGGGTCCTCTGGATGTCACCGCCGCCGCCCTTTTCGCTCTTGGAGAAACCACGTTGATGC
TGTTGGAGAGCATCATGTACGGGATCGAGACGATGGGTAAGCAAGCCCGCATGTGGGAAAAGAGACATGAGCCTG
GGCGTAGTTGGTTGTCACCGTGAAGAGCGAGCGATGCCGGCACAGGGCCAGGCTCCATGTTAAAGCCAGGTTATG
TCCATGCCACTTGGGTTGGCCCCAGCGCCCTCCGTTCGAGGCGAGGCGGAGGAGCCTCCCGCTGCTGTCCCCGAA
ATTCGTCCCCCCCGATTTCCCCGGGGCTCAAGATTCTGCTTGCTCTGGATGACTGCTTTGCTTGAC > SEQ ID NO:270 215114_300878_1 *Trichoderma harzianum*
GAACAAGCCACATCGGGGAGACGGGAAGATGGTGACACGGATGCGTTTGTGGAGGTGGGTAAGCTTTGCGCAACA
TGTGCCAGCCTTATCTTGATATTGGACGCGGCGACGGCGAAATGGTTGGAAGGGTGTGTCTATGTGTACCGACAA
ACGCATGGCTGATGAGACGGTGAATAAAACTGCACCAAGAAAGAGATGCATGAGAGATGAATGACCAGTACCTAA
GGTCTATGACATGTCGCTTTGCACTCGGTCGGACTCATTCACATGTAGTAAATACTACATAACACCCACTTGCTC
CAGTAATCATCACTTATAATAATACGGCGAGAAGACAAGTTGACACAGGGCGAAACAGGGCGGAACAAGGCCAAA
AAAAAAACAA > SEQ ID NO:271 215167_300878_1 *Trichoderma harzianum*
AGCATCTTTATGATACAATGATGAACGTGTCCTTCTCTACCGGCCGCGCTGCGCTGCGCCTCAGCCGCTCGTCCT
TCCGCCACCTGTGCGCATCCAGAGTCGCCGGCTTTGCTTACCACTCCTATCCGCTGCCGTCCAAAATCCCCGAGC
CTCCCACAAGCGACAACCTCTCCAAGTCATCCCTTGCCCAGCCAGAGGCCCTTCCTCGCGTCCACGAGACACGGC
CGCCTCCTCAACACGATGCCGTACCCAAGCCGATGGCCCCACCGCAGGTTGAAGCTCAGTCGCCTTCTCCAACAA
CCTCCTCAGTTCCTCCATCTCCCAAAGCCGCCGAGACCGATGCGCAAAAGACACAGCCTGCTCCCGCTGCTCGAC
CTCGTTCCAAGCTTCGCGCGCGCAAGGCCGCAATGAAGCTCACACCCGCCGCCGTGGAGCAGCTGCGCGCACTGC
TCAACCAGCCCGACCCGAAGCTCATCAAGGTCGGTGTGCGGAACCGAGGCTGCAGTGGGCTCGCATACCAGCTGG
AATACGTCGATAAGCCGGGCGCT > SEQ ID NO:272 215174_300878_1 *Trichoderma harzianum*
TCGACTCGAGCTCCGTCAATCGCAAATCCCTACAAGATGCTGCGCTCTATGGTTCTACGAGGCAATGCCTTGACG
CAGACCACCCGACTGGCTGCATCCAGGGCCATGTCGAGCCAGGCGCTCTCCAACCCGACCCTGTCCAACATCGAG
AAACGCTGGGAGGGAATGCCTCTCCAGGAGCAGGCCGACCTGTGGATGGCCCTGCGTGACCGCATGAAGGGCAGC
TGGAACGACCTGACCCTGCAGGAGAAGAAGGCCGCTTACTGGATCGCCTTCGGCCCTCACGGCCCCCGCACGGTT
GACGCTCCCGGAGCCGGTGCCCGTGTTGCCTGGGGAGTTGCCGTTGGCCTTGCCGCCTCTCTCGCTCTCTTCGCT
GCCATCCGAGTTGCCGCCAAGCCTGCGCCTTACACCATGAACAAGGAGTACCAGGAGGCCACTAACGAGCTTCTC

Figure 1 continued

AAGGCTCAAGGTGCTGATCCCCTCACTGGTATCTCTTCTCCCGGCTATACTGGCAAGGGTGTTGTTCAGTCTCCT
CCCAAAAACTAAAATAAAACACGATAATATCGCTTCAAGCTTCGCACAATTGGGGCGGGCATG

> SEQ ID NO:273  215181_300878_1  Trichoderma harzianum
GCCCCGCCGCCGAGGACGACGATGATGTCGACCTGTTTGGCTCTGACGACGAGGAGGAGGATGCCGAGGCTGCC
CGTGTCCGTGAAGAGCGTCTGGCTGCCTACCGCGAGAAGAAGGCTGCCAAGCCCAAGGTTGGCGCCAAGTCTGTT
GTCACCCTCAACGTTAAGCCTTGGGATGACCAGACTGACCTGGCTGGCATGGAGGCTGCCGTCCGTGGCATTGAT
CAGGATGGTCTGGTGTGGGGTGCTTCCAAGCTGGTCGCTGTCGGCTTCGGTATCAAGAATCTGCAGATCAAACTG
GTTGTTGAGGATGATAAGGTCTCCCTGGATGAGCTCCTAGATCAAATCCAGGAATTTGAGGACTGGG > SEQ ID NO:274  215183_300878_1  Trichoderma harzianum
GTATTCCCCCTAACACCCTCTCCATCAAGGCTCGACTGAGCTCTCATTCGCCTCATCGTCATCCCGAACATGGC
CAGCGCATGGCTAGCCCGCGTGCGGCGCCTCAACGCCCATAACCTGACGACATTTCGAGATGCGCCCTGGCCGA
GATATCCGGCTCTTTGGGCGATTTGGGCACCCTGGTTCCCCTGATGATCGCCCTCGCGGCCAAGGGGTACATCGA
CCTGGGCTCGACGCTCGTCTTTTCCGGCGTCTTCAACGTCCTCACCGGAGTTGTCTTTGGCATCCCCTTGCCCGT
GCAGCCAATGAAGGTATGTCATGTCCAAGTACTACTGCTATTACTACAGTAGCTTGCTGTACTCGTACGAATATG
TATGCTGTGTGGAGCACTCTTTACCCCCTGGATTTAGACCTCGGTACTCGATACGATACTCCGTATACATGCCTA
CATCAACTACACACATACATGACTGTCTTCTTATCTGCCCAAGGAGCCTTACTTTTTTGCTAATCCTCTTCCCG
CCTCATGTGGGTACTTAGGCCATCGCC > SEQ ID NO:275  215185_300878_1  Trichoderma harzianum
AGAAAACCAAGGTCGACGAGTACGAAAGCGGCGTTCCCCTTGTCGAGAAGCTGTATGAATACCCCGTCGGTGGGG
CCAATCTCGAACACATTGTCGAATTCCCTCCCAGAGAAGAGGTGGTCCCTATCAAGCCCATCTTCCTCGACGTTG
CGTGGAACTATATCCACTATCCAGGAAAGGAGCCCCGGGTGGCGGTGGGCGGGCAAGCCGTCGAAGGCGCCCAGG
AACCCGAGGAGCCTGCTCAGCCGACCAAGAGAGGCTGGTTTGGCTTTGGGAGGTGATGATGCCAGTGCACACGTG
TTGTATATTGCACTAAAATCTAAACAACAAAATACTCTTTTTAATGAAAAAAAAAAGGAAAAG > SEQ ID NO:276  215213_300879_1  Trichoderma harzianum
GCAGAAACTGGCCAGCTAGCCAATTCAACATCTGTTGGGCCAGAACTCGCAGTCGAAAAACATATTCGTCCCTGC
TCGTCCCTTGAGGAATTCTGCCCGTCGAAACGAATCAAGACGAGCGAATACGAATAAGCCCGACAGCCGTCTCTG
CCCGCCATGGAGTCATTCGTGATCAAGACTCCGTGCTCCAGCGCCAACATTGGCCCTGGCTTCGACGTCATCGGC
CTCGCATTGTCCATGTATCTCGAGCTGCACGTCACCATCGACCGCTCAAAGACAAAGTCGGAGCATCCCCTCAAC
TGCAGGGTGACGTACAAGGCCAGGGTGAAGAGTCTGGCGATATTAGCCTGGATCCGCAGAGCAACCTCATCACC
AGGGTTGCGCTCTATGTCCTGCGATGTCACGATCAGCGCAGCTTCCCGATCGAGAGCCATGTCCACATCAAGAAC
CCTATTCCGCTGGGCAGGGGATTGGGAAGCTCTGGAGCACCTGTTGTGGCTGGCGTGATGCTGGGCAAGGAAGTT
GGTGGTCTGCATCACTTGGA > SEQ ID NO:277  215221_300879_1  Trichoderma harzianum
CTCACAGAGCCGATCAAATACCGCCAAAATGCCCAAGGAAGTCGCTGACATCAAGAAGTTCATCGAGATCTGCCG
TCGGAAGGACGCTTCCTCCGCGCGGATCAAGAAGAACAAGAAGGCCCACAACATCAAGTTCAAGGTCCGATGCCA
GAAGAACCTCTACACTCTGGTGCTGAAGGACAATGACAAGGCCGAGAAGCTCAAGCAGAGCCTGCCTCCCAACCT
GCAAATCGCAGAGGTCCCCAAGAAGAACTAAGGAAATGAATTGGTGGTAAAATAGGGGTGGCTTTGGGCGTGGGA
AGGGTTTACATGCACAACTGGGCGTCTCGGGATACCTTGCATTTCATGTGCTCAGAACGCACGCTCGCAATAGAG
CTCAAAAAATAACGATTTGAGACACAAAAAGCAACAATCGCACACCAAAATCTGGTGAGCCCGATGTCTTTCTTG
TGCCGGCTATGCTACCTGAAGAAAGGGAGCCCCCCCGGTTACTCGGTGATGCCTATTTACACGACGTGCCTGAAG
CGGCGATGATCTTTCTTGAGGGCGAGGCTCGCCAATCCTTCCAGTCGTTTCTTCGGAACATCG > SEQ ID NO:278  215255_300879_1  Trichoderma harzianum
ATCAAACAAACCTCAAGTACAGTCAACGAAACACCGACAAAATGGCTCGCCGTCCTGCTCGTTGCTACCGATACT
GCAAGAACAAGCCGTATCCCAAGTCTCGGTTCAACCGTGGTGTCCCCGACCCCAAGATCCGCATCTTCGATCTGG
GCCGAAAGCGCGCCAACGTCGACGACTTCCCTCTCTGCATCCACCTCGTCTCCAACGAGTATGAGCAGCTGAGCT
CCGAGGCCCTCGAGGCCGCCCGTATTTGCGCCAACAAGTACCTCGTCAAGCACACCGGTAAGGAGGGTTTCCACC
TCCGTGTCCGCGCCCACCCCTTCCACGTCGTCCGTATCAACAAGATGTTGTCTTGCGCTGGTGCCGATAGACTGC
AGACTGGTATGCGTGGTGCCTGGGGCAAGCCCAACGGCACTGTTGCCCGTGTCAACATTGGTCAGATCATCATGA
GCGTCCGCACTCGTGACTCTAACCGTGCTCTGGCTCTTGAGGCTCTCCGACGATCCCAGTACAAGTTCCCCGGCC
GACAGAAGATCATCATCTCCAAGAACTGGGGTTTCACTCCTCT > SEQ ID NO:279  215267_300879_1  Trichoderma harzianum

Figure 1 continued

CATACGCTGGTAAGGAATCATGGCTGGGGGAAAGAACAAGAGACTCTCCAAGGGCAAGAAGGGCCTTAAGAAGAA
GACCGTGGACCCTTTCACCCGAAAGGACTGGTACTCTATCAAGGCTCCTAACCCTTTCAACATCCGAGATGTTGG
CAAGACTCTTGTGAACCGAACAACCGGTCTCAAGAACGCGAACGATGCTCTGAAGGGCCGCATCGTCGAGGTCTC
CCTGGCTGACCTCCAGAAGGATGAGGACCACTCATTCCGCAAAGTTCGTCTCCGCGTCGACGAGGTCCAGGGCAA
GAGCTGCCTGACCAACTTCCACGGACTTGACTTCACATCCGACAAGCTCCGATCCCTCGTCCGCAAGTGGCAGAC
TCTCATCGAGGCCAACATCACCGTCAAGACCACCGATGAGTACCTCATCCGCCTCTTCGCCATTGCCTTCACCAA
GCGACGCCCCAACCAGATCAAGA

> SEQ ID NO:280 215280_300879_1 *Trichoderma harzianum*
AACACTTCTCACATCTCTTCCACCCTAAGGAATATCCGTTAACAGCGCATCTTCTTGCACTCTCTACGAATCTCC
CAGCGGCCAACGCTTAATCCGCCACCATGCAAATCTTCGTCAAGACCCTCACCGGCAAGACCATCACCCTCGAGG
TCGAGTCTTCCGATACCATCGACAATGTGAAGTCCAAGATCCAGGATAAGGAAGGCATTCCTCCTGACCAGCAGC
GTCTGATTTTCGCTGGCAAGCAACTCGAGGATGGCCGAACTCTGTCCGACTACAACATCCAGAAGGAGTCCACCC
TCCACCTGGTCCTCCGCCTTCGTGGTGGTATGCAGATCTTCGTCAAGACCCTCACTGGAAAGACCATCACCCTCG
AGGTGGAGTCATCTGATACCATCGACAACGTCAAGTCCAAGATCCAGGACAAGGAGGGTATCCCTCCTGACCAGC
AGCGACTGATCTTCGCTGGTAAGCAGCTTGAGGATGGCCGAACCCTCTCCGACTACAACATCCAGAAGGAGTCCA
CTCTCCACCTTGGTCTTCGTCTCCGTGGTGGTATGCAGATCTTCGTCAAGACGTTGA > SEQ ID NO:281 215290_300879_1 *Trichoderma harzianum*
AACCACTCTCAAGCAACAATAACAACCTTTACCCAACTTCAAAGACTTTCAGTCTCTCAACTCAACACCTTCAAG
ATGTCTCCCTGGTGAGTCTTCTGAGGACCATTGGTCCATCACTTGCTCGGGAGTTCCTCTTTGCTTTACCTTCAG
CGTTCCACTACCTGATCTATGATACCTTCTTTCCCACCACCGAGCAAAGCACTCATTATACATGTCACTAACGAT
TTTCTTTCAATAGCGCATGCAACTCCTGTGGATGCAAGGACAACTGCTCCAGCTGGTCCTGCACCAGCTGCAGCC
ACTAAATCATCGTGCTCTTTTTCCTTCGCTGGATCTATACTCTCTCGGAATGACAGCTTGAGGGCTCGGATGTGC
TTAAGACGCCATGG > SEQ ID NO:282 215308_300880_1 *Trichoderma harzianum*
CAGGGTGTTTCACAATGCCGATTGCACCTATAATCACATTCAAGGGCGGCCAGTGTGACGTCGACACATCGTCNA
AGCCATACAAGGTCACGCCACAGCCTGAACCTGGTTATATCTATCTATACTCCGAAGATGATCTGGTGCATTTCT
GCTGGCGACGACGGGACCAGCCTCTGGATGACCCCGAACTCGACCTCGTCATGGTTCCCACAGACGGTAGCTTCC
TCCCATACGAATACAAGACCACCCCTCAGCCCACAGCGAAGACCAACGGGCGCATATTCGCCCTGAAATTTGGCT
CTTCCTCTCAGCGCCACCTCTTCTGGATGCAGTCTAAGCCCCAGGGACGAAGTGGCGACGCGAGCTACTTCAGCC
CCCGGGATCGCAAGATCGGCGACATTGTTCACAGACTCTT > SEQ ID NO:283 215316_300880_1 *Trichoderma harzianum*
TAAATTCCATCGATTGGTTTCTTTGGGAGGGTTAATCGACCTTTCTCATTCTTCATACCATCGGCGTCGTTGGCA
TTTATACGGCATCTCGTCTTGTTTCCTTCGTACTCGAGACATCATGGGTGGGTGGCAGTCCTGGAACCCCTTCAG
TAAGAGGGAGACGCACAGCAATGGCTCCATCGTCGCATACAAGATTTTAACCTTGGTCTCATGGCTTTTGTCCGT
CGTCGTCACTGTCTACTATGCCGTTGACGAGCCTCACGATGGGTTCCACATCCGCCGGCACATATGGGATCAGAA
CTATCTGTATCCCAGCGCCTTTACCATGAACCACATCCTCGCTGATATCTACTGGATTGTTCTCTTCATCCTCCA
GTTTGGATACGTCACATCGCTCTTCTCCAGCAGTGCCGACGTCGTTGCCGCAGCTGCTGGTGTCGGGAGCCACTT
CATCCTCAACAACTTGGTTCACTCTGCATTCGTCATGCTCTTTGTGAACTCGCACTTCCACAT > SEQ ID NO:284 215338_300880_1 *Trichoderma harzianum*
ATCTGCATCTCTTTTTGGTATCTCAAAACTCCCCAAACAACCCACATCAATCATCATGACTGGACGCGGCAAAGG
TGGCAAGGGCCTCGGCAAGGGTGGTGCCAAGCGTCACCGCAAGATTCTTCGTGACAACATCCAGGGTATTACCAA
GCCCGCTATCCGACGTCTCGCTCGTCGTGGTGGTGTCAAGCGTATCTCTGCCATGATCTACGAGGAGACCCGTGG
TGTCCTCAAGTCCTTCCTCGAGGGTGTCATCCGTGATGCCGTCACATACACTGAGCACGCCAAGCGCAAGACCGT
CACATCACTAGACGTTGTCTATGCTCTGAAACGACAGGGCCGCACCCTGTACGGTTTCGGTGGTTAAGCGATCTG
CCACTAGGTCGGGTCGACATAATGTGTTATTCGCGTGTTTGTTACGATTGGGCTTTTCACTATGGGCGCGGGTCA
TTGCTTTTTGAGATTTTGTACTGTACAACGTACTGGGAAATGGGTGACCCCCGAAAGGGGGTAATTGAGACTTAT
TCAGTGGTGACCTTGAAATAAAGCATCACATATACTCTAAA > SEQ ID NO:285 215343_300880_1 *Trichoderma harzianum*
GTCCAACGTTTAATCCTGTGCTTCCTCCGGGGTCCACTATTTCACGTGGGCCTTGCCCTTATTCTCAGAGTCCAG
CTGAGAAAAGAAGAAGAATTTCTTTTTGTTTTGGAAATAGGGAGACGCTCATCGTTCAATTCGTCCTCCAACACA
GACCGCAGCAATGGACGAAAAGCACAGCGGCTCGGGTCGCAACTCGACCGATGTCCGTGACACCGAAGTGCCATT
CGCTGCCGACCAGGTTGTTTGCCCGCCGCACACAACTGAGCGGCGCCTGATGGCAAAGATCGACATGCGAGTCGT

Figure 1 continued

GCCGTTTCTCTGCATCATGTACCTGCTTGCATTCCTGGATCGTGTCAATATTGCCAACGCAAAGCTATTTGGTCT
CGCTGGTGATCTGGATCTCGGCACTGGCGACAAGTACAACACGGCCCTGGTCATCTTCTTCGTGCCCTACTGCAT
CTTCGAGGTGCCCTCCAACATCCTGCTCAAGAAATTCAAGCCCCATGTCTGGCTGTCCATCAACATGTTCCTCTT
TGGCTTTACCACCATGATGCAAG

> SEQ ID NO:286 215352_300880_1 Trichoderma harzianum
TTCGCTGGTAAGCAGCTTGAGGATGGCGGAACCCTCTCCGACTACAACATCCAGAAGGAGTCCACTCTCCACCTT
GTCCTTCGTCTCCGTGGTGGTATGCAGATCTTCGTCAAGACGTTGACCGGCAAGACCATCACATTGGAGGTTGAA
TCATCAGACACCATCGACAATGTCAAATCAAAGATTCAGGACAAGGAGGGTATTCCCCCGGATCAGCAGCGTCTT
ATCTTTGCTGGCAAGCAGCTTGAGGACGGTCGCACCTTGAGCGACTACAACATTCAGAAGGAGAGCACACTTCAC
CTTGTCCTCCGTCTTCGTGGTGGTATGCAGATTTTCGTCAAGACTCTGACCGGCAAGACAATCACCCTCGAGGTG
GAATCTTCCGACACCATCGACAACGTTAAGTCCAAGATTCAGGACAAGGAGGGCATTCCTCCTGACCAGCAGCGC
TTGATCTTTGCTGGTAAGCAGCTGGAAGACGGTCGCACCTTGAGCGACTACAACATCCAGAAGGAGAGCACACTG
CACTTGGTCCTGCGTCTGCGTGGTGGCCAGTAAATGTGTCTTTTGCTTACGACCGCACTGTTACGACTGAATTGG
ACGGTTGGGCGTTTTTGGGAACTTTTTTTCAAAGCAGATATGGGAAC > SEQ ID NO:287 215372_300880_1 Trichoderma harzianum
GATGCCCGGAAGACAAGACGCTTATTCCGGGTCCATGCCCACAAACTCTCCTCCTCCCCCACAGAGCATCTCCAG
CTACTCTCGCTTCATCCACGACCACACAAAACGCCAAATGCAGGCCTTTGGAGCTGCTCTATCGCCTACAAGTTC
CGGTGCTTCGGGTCGATCATCAGTCGGTACATCCATGACCAACGGCACAGCACCTGCCATGTAACCATCTTGCAT
TTCCGCGGGTGTCCAAAAGCGAAAACTCGCTGCTTGAATTTGCGCATGTTTAGCTTTAGCGGTGCTTCTCTTTTT
TCCAGTAGCTTGCCATTATGGCAGCTACATTGGTAATCTGGACGGGACTTGGAAAAAAATGAATTTCGGGACAGT
CTAATATGGAATAACGCCCCCGGTGTAACATGGCGAATCCAAGATTGGAACGCCTGCATAGAGACAAAGCAGCTT
CTTTTTACCGATCACGCATTTACACTACAGCAAAAGCAACTCTTGCGTCACATCGAAAACGAGCCGACTTGGTGC
CACTCGCTAATTTGTCGCTTCGTTTCTATTTATTATTGATTTTATGACTATATGATACACGCACGGGGTTTTGGG
GGGGATCTTTATGGCAGGATACTAATCGG > SEQ ID NO:288 215373_300880_1 Trichoderma harzianum
TGGGGTCGCAAATCTACAGCAAAAATGGGGTCGACAACGACCAAGCAGACCCCGGCGTCCTTTGTCGGGACCAGC
AAGGTCGTCGAGACTGACTATCCGCTCATCGACAACGACCCTCACTTTAAGCGGGTTATCGGATATGCGAGAACG
TCAGACTACGTAGCTGGTGCAACCTCTGCGGCCTTTGCACCGACTGCTCTCTATGCCCTCGAGAGGCTCGCCCCG
TCGCATGTTGGCCGGGGAGGCTTTGCCAAAGCCATGCGGTTAGCCGGATTCATTGGCTTGGCCGGCGGTTTCCTC
TACTTTTACCAGCGATCAGCCCTTCGATTCTACGGCGCCACTGAGAACTCAAGGGAAGTCGAGATGGATATGCGA
GAGATGGTTTCCAAGGTCAAGGCGGGACAGCCTCTGTATGGCGAGAGCAAGCTGAGCCCTCACCTGCAGGGAGTT
GCGGCCCGACAGAGCAGATACTCTGCGCTCTTTTTCAGCACAGTACCGTGGTTCAACTTTGTCAACCACAACCAG
CACGGCGTGGACACGGGCAAGTACTATCAGCAGGCCGAGAGGGAACTGGA > SEQ ID NO:289 215379_300880_1 Trichoderma harzianum
CGACAAGTCGATTGCCCTGGTGAGCACCATTATCATCAGAAACCGCAATCATGGGTATCTCTCGTGACTCTCGCC
ACAAGCGCTCCGCCTCCGGTGCCAAGCGCGCCTACTACCGGAAGAAGCGCGCTTTCGAGGCTGGCCGCCAGGGTG
CCAACACCAAGATTGGCGCCAAGCGAATCCACACCGTCCGCACTCGTGGTGGTAACCACAAGTACCGTGCCCTGC
GTCTCGACTCCGGCAACTTCGCCTGGGCCTCCGAGGGCTGCACCCGCAAGACCCGTGTCATTGCCGTCGCCTACC
ACCCTTCCAACAACGAGCTGGTCCGAACCAACACCCTGACCCGTAGCGCCATCGTCCAGATCGACGCTGCTCCTT
TCCGACAGTGGTACGAGTCCCACTACGGCCAGCCCATCGGCCGTAGACGCCAGAAGGCCCAGGCCGCCAAGGAGG
GCAAGGAGGTCGAGGAGGTCAAGAAGAGCAAGTCCGTCGAGAAGAAGCAGGCTGCTCGCTAC > SEQ ID NO:290 215382_300880_1 Trichoderma harzianum
TCAACGCCCCGACAACCCCCAAGTCACGGGAGCCATGAGGTACATTCACTCTCAGGAGATCCTGGAAATTCCAGA
GGGCGGTACGTTTCACCATTTTCCTTTTTTTGATTTCGGCCTTGCAGATTCGATCGATTGCACTGGAGGAAAAC
ATGTCTTGGATGACGATGGAAAGGAAGAGGTGGAACTTAATCTCTGCTGTTGGAGATGAGGGATTGGACTGGAAC
AATGGGAGGGAACTACGATCGAACGAAAATCTGCTTGCTGGCTTGGATTACGCACTTCTTGAGGAAAACGAAGCT
GACATTGAATTTTTTTCTCCGAATAGTCAAGGTCAACATCAAGACCCGTATCGTCACCGTTGAGGGTCCCCGAGG
CAAGCTCACCAAGAACCTCGGTCACTTGGCTGTCAACTTCGGTCACCCCAAGAAGAACACCATCTCCATCGAGAT
CCACCACGGCAACCGTAAGAATGTCGCCACTCTCCGTACCGTCCGCTCCATCATCGAGAACTTGATCACCGGTGT
CACCAAGGGCTTCAAGTACAAGATGCGATACGTCTACGCCCATTTTCCCATCAACGTCAACCTGGACAAGAACAA
GGAGACCGGTCTG > SEQ ID NO:291 215383_300880_1 Trichoderma harzianum

Figure 1 continued

GAAAAAGGATTAATCGCAACTCCGAGATCGTGGTGAATCACAATGAGACCTACTCAGGTTCGTCTGGGCGGCGGC
GCCCCTCAACCCAAGACTGGCCACTGGCTCGGTGACTGGGGCTCCTTTGAAGGGCATTATCGACTACGGCCTGTC
TGCCAACCGTCAGAACCCCTTTGCCGGTGCTGCCCACGATGCCATCTTCAACACCTTCCGCCGCACCAAGTCCCA
GATCTTCTACTGGCTCCCTCCTATGCTGGCTGGCTACTACCTGCTGAGCTGGGCCACCGAGCGAAACCACTACCT
CAACTCCAAGGCTGGCCGTGCTGAGTTTGCCGACTCGGAGTAAAATGGTGCACGAATATGTTGAATTATGGGTGT
CCAGGGGACACAGTGTATATCAGCGTCTAGATTAGGAGAAAACAATAGAAACGTTTGACTTTAAAAAAAAAAAAT
AA

> SEQ ID NO:292 215409_300881_1 Trichoderma harzianum
ATTCTGCGCGGGAGACCATGGCCTCTGTGGGATCGGCTGTGACAGCATTGCCCCGCAAAACGGCAGCAGGATACC
AGTCCAGCTATTACCCCTCCATCCCCAGACCCAGATCTCTGTCTTCATTTTCATCTTTGTCTTTGTCTTCATCTT
TGCATCGTTCGGGCCCTCCGTCCTTTTCTCCGAGTCACGCACAGAGACACCAGCTAGCCACGATGTCTACGCAAG
CCGCGCACCCGGGCCTGGTCATCCCAGGGCCCATTGAGTTTGACGATGCTGTGCTCCAGTCCATGAGCCACTTCA
GCGAGTCTCATGTTGGGCCTGGCTTCGTGGGCACCTTTGGCGAGACTCTGAGCATGCTCCGGCAGGTCTTCCAGA
CCACCGATCCTGGCTCTCAGCCCTTCATCCTCAGCGGGTTCCGGGA > SEQ ID NO:293 215410_300881_1 Trichoderma harzianum
GTCGCCTCGGTTCCACGGGTTCGGATTGGAACACGCGCCCACAGACAGAACGCTCCGTTTCCCATTGAGCGTCAA
CCTCTACTGAGCTTTCATCAATCAGTACGAGGCCATCTTCGACAATTTTCAGAAAAAGAAAAAAGCCTTTCGAGA
ACATCAATTCGGAAAGAAGAGCCACTTCTTCACCATGGCTGATGATGAGAAGCACGTTGCGGAGCCTGCCATTTC
GGACGTCGCCCCCGTCGACTCCTATGCGGCTGCCCAGAACGAGTTTCATGACCGGCCTCCCGGATGGATTTACAA
GGGCCACAAGATCTTCGGTAGGGAGATCTACTATGCCTCACCCAGAGTCCAGCTCGTGCTGGTTGCTCTCGTGTG
TTTCCTCTGCCCCGGCATGTACAACTCCTTGACTGGTCTGGGAGGTGGTGGTCAGGTCNACCCCACGGCCCAGGA
CCACTCCAGTGTCGCCCTCTACAGCACCTTCGCCGTCGTTGGTTTCTTCTCTGGTACTTTTGCCAACCGTCTTGG
TCTCCGTCTCACTCTCGGCTTTGGTGGTCTCGGATACTGCATCTACAGCGCCTCTTTCCTCAGCTACAACCACAA
CAAGAACATCGGCTTCGTC > SEQ ID NO:294 215420_300881_1 Trichoderma harzianum
ACACATCAAGATGGCCTCTTCCGCCCGTCAGTTTGCCCGCGTGGCAACCCGCACAACCACCCGCTCCTTCGCTGC
CGTCCCCCGACAGGCTTTCCGCCAGCAGGGTCGCCGCTTCTACTCTTCTGAGCCCGAGAAGAAGTCATCCTCCTC
TCTCCTGTACCTTGGTGCTGCCGCCGCCGCCGGTGGTCTCGGTATCTGGTTCTTCACCTCTGGTGCCTCTGCCTC
TTCCAAGACCTTTGTCCCCACCCAGGCCGATTACCAGAAGGTCTACAACGACATCGCCGAGCGTCTCGATGCCGA
TTATGATGATGGCAGCTACGGCCCCGTCCTGGTCCGTCTTGCATGGCACTGCAGCGGTACCTACGACAAGGAGAC
CAAGACTGGTGGCAGTAACGGTGCTACCATGCGATTCGCTCCCGAGAGCGGCCACGGTGCCAACGCCGGTCTGAT
TGCTGCTCGTGACTTCCTCGAGCCTATCAAGGCCAAGTATCCCTGGATCTCCTACTCTGATCTCTGGATCCTCGG
TGGTGTTTGCGCCATCCAGGAGATGCACGGTCCCATTGTCCCTTACCGACCTGGCCGCCGTGATGGTGACGCTGC
TGCTTGCACCCCCGA > SEQ ID NO:295 215429_300881_1 Trichoderma harzianum
CCCACGCGTCCGTCATATGCGCTCGTCGATACCCTGCGCGTCGATAGGCGAATCCTTGGAATCAACACACAACCG
CGATCATGGCTGACGAATACAACGCCGAGGAGGCCGCTGAGATCAAGAAGAGAAGAACCTTCCGCAAGTTCTCTT
ACCGAGGAATCGACCTTGACAACCTCCTCGACCTCTCCTCTGACCAGCTCCGAGATGTCGTCCACGCCCGTGCCC
GCAGAAGGATCAACCGCGGCCTGAAGCGCCGCCCCATGGGCCTCATCAAGAAGCTCCGAAAGGCCAAGCAGGAGG
CCAAGCCCAACGAGAAGCCCGACCTCGTCAAGACCCACCTCCGAGACATGATTGTCGTCCCCGAGATGATTGGAA
GCGTCATTGGTATCTACTCCGGCAAGGAGTTCAACCAGGTCGAGATCAAGCCTGAAATGGTTGGCCACTACCTGG
GTGAATTCTCTATCTCATACAAGCCTGTCAAGCACGGTCGACCTGGTATCGGTGCCACTCACTCTTCTCGTTTCA
TTCCCCTCAAATAAGAAGGTTGTGGTCTTGGGTGGTTTCTGCATTCACGGACATTTTTGGGCGAAAAGGACTGGT
TTTAGTAGACGGAGGAAAGCCGCTACTGAAGTTGTTGATGGCAATGATTTCTATGATAGTACAATGAG > SEQ ID NO:296 215431_300881_1 Trichoderma harzianum
AAAACAACCGCAGCAATGGCCGCCGAAAGGTCCAGCAACCCCATGCGGGAGCTTAAGATTCAGAAGCTCGTTCTG
AACATCTCCGTCGGTGAATCTGGTGACAGACTCACTCGTGCCGCCAAGGTGCTTGAGCAGCTGTCTGGTCAAACC
CCCGTCTACAGCAAGGGCCGTTACACCGTCCGTACCTTTGGTATCCGCCGTAACGAAAAGATTGCTGTCCACGTC
ACCGTCCGCGGCCCCAAGGCTGAGGAGATTCTCGAGCGTGGCCTCAAGGTCAAGGAGTACGAGCTTCGCAAGCGC
AACTTCTCCGAGACTGGCAACTTCGGCTTCGGTATCAGCGAGCACATCGATCTTGGTATCAAGTACGACCCTTCC
ATCGGTATCTACGGCATGGACTTCTACTGCTGCATGACCCGCCCCGGTGAGCGTGTCACCCGCCGCCGCCGCATG
AAGAGCAGAATCGGTGCTTCTCACCGCATCAAGCGCGATGAGACCGTCAAGTGGTTCAAGGGCCGCTTCGATGGC

Figure 1 continued

ATTGTCCGATAAACGGTTTAAAATCCAAACCGAATAAAATACTTTTTTTTTCTTGTCTTGAAGGAAATGGGCATG
GCGAACATTTGGGGGTAAAAAGGATCATATGGTCATGTATTCTTCCGCTTGATTTTTACATCAGCTCGTACCAA

> SEQ ID NO:297 215432_300881_1 *Trichoderma harzianum*
CCCACGCGTCCGCCTCACTCCATCCAACCCTTCCAGTCCAACCTTCCAATCCCTCCTCAAACCATCAAAATGGCC
TCCCGTGTCTTCGCCTCCCGCCTGGCCTCCCAGATGGCCACCAAGGCTGCTCGCCCTGCCATGCGTGCTCCTCTC
GCCGCTACCAAGCGCACCATCACCACTGGCAGCCCCATGCAGGCCATGAAGCGCCAGACCATCCAGGCTGGTGGA
CGCAACGCCTTCCAGGCTCAGCGCCGCGCCTACTCTTCCGAGATCGCCCAGGCCATGGTTGAGGTCTCCAAGAAC
TTGGGTATGGGTTCTTCTGCCATCGGTCTGACCGGTGCTGGTGTTGGTATCGGTGTCGTTTTCGCTGCCCTTATC
AACGGTGTTGCCCGCAACCCCGCTCTCCGTGGCCAGCTCTTCTCCTACGCCATTCTGGGTTTCGCTTTCGTTGAG
GCTATCGCTCTTTTCGACCTCATGATTGCCCTGATGGCCAAGTTCACCTAAATTGCCTCTCGAGAGATTGGAAAA
GCTCCGGCCAGTGGATGGAGCAATTAATAT > SEQ ID NO:298 215461_300881_1 *Trichoderma harzianum*
ACCGACCGGCTCGGGCAGCTTCATCAATGGATTGCCCATCGACTGCGAGCTACTTACCCGCAGCTTGGAATAGCT
TGAGCTTTGCCCGTCGCCGGAGGACCCGCTTCGCAGATATATATACCTTCGTTATATATGCACACATGTCGCTAA
CCCGAGTGCTCGCGCAGGCACTGATGCCCGTTTCCCCAACGTGAATCAGACCAAGCACTGCTGGCAAAACTACGT
CGACTACCACAAGTGCATTCTCGCCAAGGGAGAGGACTTTGCGCCTTGCCGTCAGGTACGGAGACCGGAAGGAGC
TGTGACTTATGCGCGCATCTGAGTATACTGAACCATTGTGTAGTTCTGGTTGGCCTACCGATCACTGTGCCCTTC
TGGATGGTACCAGCGATGGGACGAGCAGCGCGAGTCTGGTAACTTCCCTGTGAAGCTCGATGCTTAAATTCCATA
TTTGAGGTGGCGGGGTACATAAGCAAGGGTGTTCACATAGATTAAGCAGCCAGGCGGCGCATGTGCTGCCAGAAA
ATGTAGTAGTAGTCAATCACAAGCAAACAGGCTT > SEQ ID NO:299 215482_300881_1 *Trichoderma harzianum*
TGCTTCTGAACATTCGAGGGTCGGCCCACGCTCAGCTGGCAATGTACCCCCCAGTTGCCCTGGTGGCAAAGTGTT
CGCAGGTCTAGTTCCATCCGGCTCCGATCAACATTCAAAAACGCGCGGCCCAAGAGAAGAGATGCGATTCGCAGC
GTGTAGGCATGAACGGTGGATCGTGGTGATAATCGTGTGCGGATGAGGATAATACCATGAGCATCTCAGGAACAA
CTGGACGTCTAAGGATTCGGGTCCAGGCCCAGGCCCGGGCTCGGGAGGCGCTGTGTGAGGAGAGCTTCGGGGCGC
TATACCCATCTTTCACGCCACGATGGCTGCATGGCCAGCTCGACTCCTCGCTACGGTCACACTATGCGCCCAGTA
AATGATAATGTCGGCAAAATCTCTTCATCCCTACTTTCCGACATTCATCCCTACTCCATGCGCCTAGTGCCAAAT
CATCCATCGATGCATGACTTCTATTGGACCATCACCTGCTGCGCCTTACGACTGCGATGCTGGGATAACGGGTGC
ACAAGCTGCAAATCCATGGATATACGTGCATATCAGGTTGAATG > SEQ ID NO:300 215516_300882_1 *Trichoderma harzianum*
TTCTCATCACATTCCAACCATCTTCATCCAGTCGTCTTGGATTCATCAAACAGCTCTTGGATCCGTTCTGATCCA
GCCAACCAACCATCGCCATGTCTGAACCTCTCACCAAGGTCGAATCCGGCGGTCAAGGGCTGTCATCATCACCGG
CCAAAGAGAAAGGCCATAGGAAAACAACCTCTAGCGCGGGTGGTGTTATGACCATTGGGGAAATCAATGAAAGCC
ATGCTCCTCTAAAACTCGCAATAGAGACACAGCAGACAGCGTGGAAAATAAATCATCGGCCCAAGGATCTCGACA
ATGATCATCTGCTACAGGTTCCCCTCAGCAAGCCTCCCATC > SEQ ID NO:301 215523_300882_1 *Trichoderma harzianum*
AAACAACCTTCTTCATCAATTCTACTACAACGACCTTCCTACTTAAACAATCTCTCGATACCAACTCCCCAAGAT
GAAGTTCACTCTCGTCCTTGCTACCTTTGCCGCCGTCGTCTACGGTCAAACCATCGATGACATTCCCGCATGTGC
TCGTACTTGCATTGAGAACGCCGTTCTAGCCGCTGGTTGCTCGTCTGGAACTGACGTCGCATGCGCTTGCGCACA
TTTCACTGGTGTTCAGAATGGCTCTACTAGCTGTGTCATTGCTGCTTGTGGCGTTTCTGTCGCCATTAACCAAGT
TCTGCCTGGCACCCAGGCTCTTTGTGCCAACCAGTGAACTCATCCATCGAGAGGGAGAAAATGACATGGGAGAAA
ATCAGGTACTCTTGTACATTGACAAACAAGTACATAGCTGAATGGTGTGAATGAATAAAACGCATT > SEQ ID NO:302 215549_300882_1 *Trichoderma harzianum*
AGCCGATTCTCGTTCTCGTCCTATTCACAGGATGCTTCGCAATGGGGCCCTCCGTCGTAATGATAGACACCTCG
GACGACTTCTTCGCTGCCCCGGTGGCAACATCACAGACGAAGCGAACTCTCCTCCTGGCGCCGGCGTCTCTCGCC
TCTCACCCAACTGCGCTCACCAACGTCGTGTCTCAATATGATCGCTCTGCTACAGATCTTCAGATGATCGACCGG
TTGTCAGCCGGTCTCGTCAAGCTGCCGTCTGCTACATACGACCTCGTTCTCGTCCTCGCCGATGCGTCTTCCTCT
CTCAACGAGACCCTACCCCTCTTGACTAGAAGCATCCTCGGTCCCATCGCAGAGTCGCTCAAGCCCAAGGGTCGA
TTGCAGTCGCAG > SEQ ID NO:303 215550_300882_1 *Trichoderma harzianum*

Figure 1 continued

TTCCTCCCCCCGCAAGCAAACACAGTCTTTTCAGCTCTCTCTGGGCTTTTATATACGCATAGACTCTTCCATCGT
TCTTTGTCAAATTCATCCTCCTCTTCAACCACAACAAGCCTTCGTTACACCGCTTTACGAAGCCCCTTCTTCTCT
CCTCTCCTCCATTCTTCTACCTTTTCCACACAACAAACACACACACAGTCACAATGGCCTTCTCTACTCGAAGCG
TACTGCGCGCCTCTCGCGCCGTCAACTTCTCAGCTGCCTCCCGTGTTGCTGCTCCCAGCAACGCCGTCCGCTTCT
TCTCGGCCTCCCGTGCCGTCCGCGTGTCTGACACTGCCAACAAGAAGAGCGTTGTTCGCGAGAAGGAGGTTCCCG
TCACCGTCTATGGCGCTGGCCAGGGTGACAAGCAGACACTGCAGGTTCCTGATGGCGCCTCCAAGGTCCCCTACG
ACAGCCCCGTCCCCGCTGAGCGTGAGGAGGTCGAGCCTCTTAACAAGAAGGTCTACG

> SEQ ID NO:304 215552_300882_1 *Trichoderma harzianum*
TCGTTCCCAATCAACTCCGTCTGCCTCTCTCGCCCGCATCAACAACATTGCGAGCCACATCTCTCCCACAATGGC
TTCCACCACCAGTTTCCCGGCAGAAACGGTGCCCCAGGCGCCTGAAGATCCCCTCTTTGGCCTGGCCCGCGCCTA
CAAGGCTGACAACAGCCCGCTAAAGGTCGACCTGGGAATCGGCGCCTACCGAGATAACAATGCGAAGCCATGGGT
TCTTCCTGTGGTAAAGAAGGCTGATGAGATTCTCCGAAACAACCCCGAACTGAACCACGAGTATGCCCCGATTGC
AGGTATCGAGAGCTTCACCAGCAAGGCTGCGGAGCTGATGCTCGGCGCCGATTCGCCCGCTCTCGCGGAGCGCCG
CACTACGTCTATGCAGACCATCTCGGGAACCGGTGCCGTTCACTTGGGAGCTCTGTTCCTCGCCAAGTTTTACAA
AGGCAGCCAGACCGTCTATGTGTCAAATCCCACATGGGCAAACCACCATCAGATCTTTTCCAATGTCGGCATCAA
GGTCG > SEQ ID NO:305 215553_300882_1 *Trichoderma harzianum*
ACGACTTCCGAACAACGACCACCGGAGCCCACGTGATCGCAAGCAGACACAATGGCGATCAAGCACAACCAGAC
GATCATCAGCAACCATTTCCGCAAGGATTGGCAGCGCCGGGTTCGCACCCACTTTGACCAGCCCGGTCGCAAGAC
ACGGAGACGCACTGCTCGTCAGGCCAAGGCTGCTGCTCTCGCTCCTCGTCCCGTCGACAAGCTGCGACCCATCGT
CCGATGCCCTACCGTTAAGTACAACCGACGGGTTCGTGCCGGTCGAGGTTTCACCCTCACCGAGCTCAAGGAGGC
CGGTATCTCCAAGTCCCTGGCTCCCACCATCGGTATCTCCGTCGATTTCCGCCGACAGAACCTGAGCGAGGAGAG
CCTTGCCGCCAACGTTGCCCGCCTCAAGGCCTACAAGGAGCGCCTCATCCTCCTGCCCCGCAAGTCCAACGCCCC
CAAGAAGGGTGACACCAAGACCGACGTCGCCTCCCTCGACAAGGTCGCCTCCATCGCCGCTGCCCTGCCCATCGC
CTCCGTCTCTGCTGGCTTCTCCGAGATCAAGAAGAGCGAGATCCCCG > SEQ ID NO:306 215579_300882_1 *Trichoderma harzianum*
TCGTTCTGCGCACCAACTCGCCCATCATGGTGTCTCGAAGCATAGCCGTCGTCTCTCGCATGGCGCCCATGCGCC
ATTTGCGCCCTTCTCCTGTCTTCCGCCAGGGACTTCCCAGCCTTGTCCGGTACTATGCAGACAAGATCATCCAGG
TGCCGGTCATGGCTGAGTCCATATCTGAGGGCACTCTCAAGCAGTTCTCCAAATCCATTGGCGACTACGTCGAGC
AGGACGAGGAGATTGCCACCATTGAAACCGACAAGATCGATGTCGCCGTCAACGCAACAGAAGCTGGTGTTATCA
AGGAGTTTTTCGTCAGCGAGGAGGACACCGTGACGGTC > SEQ ID NO:307 215586_300882_1 *Trichoderma harzianum*
CCCACGCGTCCGTCACAGGCTTGCCTTGGCAAATAGACAACAGAAACCCTGTTTCAAGCCCGTTGACTCTGTGAA
GCCAGATCTGGATTTGGCTTCCATGCGTGCGTCTTATACTTTCAGGAGAACGCCGCAGTAGACTACTTAAAGACT
TACTCTCCCCACGTCAAGACGTTCCTCTTCATCCATCTTTTCCAAGCACGACACCATGACTACCCGCTCCCTTCC
TAGCAATGGCAGCTCTGCCTTTGACTACATCATCGTTGGTGGAGGCACCGCAGGCTGTGTGATTGCCTCGAGACT
CTCCAGCTATCTGGCCGAGCTCCGCGTTCTTCTCATCGAGGCTGGTCCCTCCGACTTTAACCTCAACCACGTCCT
CAATCTG > SEQ ID NO:308 215593_300882_1 *Trichoderma harzianum*
TTCTACCACTTTGCTCTCCTTTCAAGGCATCGCGAAGACTCTTGTCAACTCTTTTTATAATACTCTGACTCTTCG
TCCACTCTCTGCTTCTGAACCACTTCGACTCATACTACTTGCACTTGCATACACTCGGGACTCTTCCCCCGCCTA
CTCTACTCTTCTACACAACCAACCACCAACGCAATGGCTCTGCAGATGTGGACTCACGAGTTCTGCCTTACTTGC
GACCGACAGGTCCAGGTCGACGGCGACGCCTACTGCTCTGAAGCATGCAGAATGTCCGACTTCGAAAAGACTCCC
TCTACTCCCAGCTCGCAGGCCAGCTCGCCCGGCTTCTCTCCCGTCTCCTACGCTAGATCAGGCAGCCTCTCCAGC
CGACCTGCTCCCACCAAGTTCTTCCTGTCTCCCGCCTACGACTTCAACCAGGCCCAGCCCTACGGCTCAACTCCT
CGGTCGTCATCGTCGTTTGGCAGCTACATGTCGGACATGTCACCTCTCTCCTCCAACCGGGGCCTCACCCCCTCG
AGCTCACACA > SEQ ID NO:309 215595_300882_1 *Trichoderma harzianum*
TACAATAAAAACACAATCTTCAATTCTTTGAACCTTTTTCAAGTTTCGCCAACATGAAGTTCACCACTACTGCCG
TTCTTGCCATTGCCGCATTCGTTGAATCGGCCACTGCTCTGGGCAAGGCCCGTGTCGTCAACAAGTGCCCCTTCA
GCGTCACCACCTGGTCCGTTGGCAGCGCCATCTCCAACCCAACAACCCTTGCTCAAGGCGGTTCCTATGGCGAGA
CCTTCTCACGAGACCCCGTAACCGGCGGTCGTGCCATCAAGGTCACCGTCCAGCCCGATGGCCTCTACACTGGCA

Figure 1 continued

AGCCCCAGACCAACTTCGCCATCAACCTTGAGGGGAACACCATCTGGTACGATCTTTCAGATGTCTTTGGCGATG
CCTTCAACG

> SEQ ID NO:310 215606_300883_1 *Trichoderma harzianum*
ACTGGACAGCACTTCCACAAGATTTGTTTACTTTCATATCTTTTTGCATAGGTTCAGCAACAAGCATCAAGCTGT
GTTATCGTAGCTGCTGCTTCTCTCCCAAAGTGACCTGATTGTCACCTTTTCCACTTGCAATTGGCACCGCAAAGC
TCCAATACCGCAAACATGTCTGCTGTCAACGGCGCTCACAGCAGCACTTCCAAGGGCACCGATCAAGATGGGTCT
TCGGTTCCCGGCTTCCAGCCCCAGAACAAGATGACGGTCCAGCCGCCCAGGGGAGAAGACCTCCAGGTCAGCTAT
GCCGCTGAAATTGGAGGCGAGGCCAACCCCAAGGGCTGGTATGGCAGCATGATCAACAATCTTGGCGCATGCATT
GGAACATGCGGCGCCATTCCCTGCTGTGTCATCTGGCCCAACCCTTATAAGCACGTCAACCAAGGGCATGTTGGT
CTCGTCACCAAGTTCGGTCGTTTCTACAAGGCTGTCGACCCCGGTCTGATCAAGGTCAACCCCCTCA > SEQ ID NO:311 215611_300883_1 *Trichoderma harzianum*
TCGATCAGTCGACAATTCATTCAAGATGGGTAAGGAAACGCCTGCAAAGACCGGTCTGGCCGTTGGCCTGAACAA
GGGCCACGTACGTCAATACAACTCGCGATCTCACCTCGTGGAGGATCTCTGCCCCCAACCTTGATCTCGGCAGAC
GATGGACGCTGACGTTTTATGGTTTGTGTTTGCCTGAATATAGAAGACCACTGCTCGTGTCGTCAAGCCCGTGT
TTCTCGCACCAAGGGCCACCTGAGCAAGCGAACCGCTTTCGTGCGTGAGGTCGTCAAGGAGGTTGCTGGCCTCGC
CCCCTACGAGCGTCGTGTCATCGAACTGCTCCGAAACAGCAAGGACAAGCGTGCCCGTAAGCTGGCCAAGAAGAG
GCTCGGTACCTTTGGCCGTGCCAAGAGAAAGGTCGATGAGCTCCAGCGCGTCATCGCCGAGTCTCGTCGTGCTCA
CTAAACGATTTCTTCTTTAAGCGAGCGGGAGAGATTCATCTTGGTAATGGGGAAAAACAAAAATTATTTCAACAG
GGAAATGAATTTAAAAAAACACTACGGGTTTCGCATGGATTTGGCGTGGTCATGAATTTTGATTGAAT > SEQ ID NO:312 215615_300883_1 *Trichoderma harzianum*
ATTCATCACATAGCACCTGTCAACGGCTGGCCAGCATGATTGCTAGCCGCCTGATACCCCGAAGTGCCATCCGCA
CGCTGCCCAGCAGGCAATTGACCCTGTCACGATGGAGTCGAGGATTTGCCTCTGCTTCTGAGGAGAAGGACCTGA
TCATCATCGGTGGTGGTGTTGCCGGATATGTGGCCGGCATCAAGGCCGGACAGGAGGGCATGAAGGTGGCCTGCA
TTGAGAAGCGTGGCACCCTCGGCGGTACCTGGTTGAACGTTGGCTGCATTCCCTCAAAATCGCTGGTCAACAACT
CCCACCTGTACCACCAGATTCTCCATGACTCAAAAAACCGGGGTATCGAGGTCGGAGAGGTTAAACTCAAGCTCG
AGACTTTCATGAAGGCCAAGGAAACCGCCGTTACCGGGCTGACCAAGGGTGTCGAGTTCCTCCTGA > SEQ ID NO:313 215630_300883_1 *Trichoderma harzianum*
GAGGAGGAAGAGAGAAGAAACTGCATTACAGAGTGAAGAAGATGTGAAAACACAGTTATATACCATTATCGAAAC
AAATGCAGCCTCCTATAGAGAAGGTTGTGTATGGTTAGCCAAACACTTTAAGGAAGCCCCAAATGCCGATTCCGC
TAAGCACCGGGATCGTCAAGTTGTCCAAGCAAACAGCTTGGATCAACAGCCTCATTAATTGGCTTCAATATACCC
TCATACATTAATATATATACCCCGACAGCACCGCCACCTCGAGCTCCTTGAAGCATCGTCATCCCCACAACACCC
ATTAATACCCTTTAGAAGCAACTTGCACTTAATACCGCCAAAATGTTCGGCAACTTGGAGCACGCTACCCTGCGA
TACATCGCCTTCGCCAACCACTTGATGATTCTCATCTCCTCGACCATCGTCACTGGCCTTGTTTCTTGGTTCCTT
CACAAGTACGACTACCGCGGTGTTAACATCGTCTACCAGGAAGTCATCGCCACCATCACTTTGGGCTTCTGGCTC
GTTGGTACCATC > SEQ ID NO:314 215637_300883_1 *Trichoderma harzianum*
AAAGTTGATTCATCTCGCCGCTTCTCCAACCCCATTGACGTTGCTGAGCGTGAATACCGAGAACGTTTCCGTCCT
CAACAACCCCGAAGCTACTACCGGTCTTGAACTAGTTCAAGTCCGTCGTCCTCATCACCAGAAGTCAAAGTCCTCT
CACAAGGTCTCTGACATCACCGTCGACGAGCGTGTTTCTATTGCCCGTCCCAACTTCCGTGAGGATATCAAGATC
ACTGAGGAAATCCGCGAGTCTACTCCGTATCCTTCCGAACAATCAGCCAAGATGGGTTACTACGACGACGAAGAG
CACGTTGAGGTTGATGTTGTCCGCCACGATGCTAATTCTTCGCGCCGCCCAGCTCCTGCCACCGAGTCGCAGCCT
AACACTGTGTCCATCCCCTGCCACCACATCCGTCTGGGTGATTTCTTGATGCTCCAGGGCCGACCATGCCAGGTC
ATCCGCATCTCGACCTCGTCTGCCACTGGCCAGTACCGCTACCTTGGTGTTGACCTCTTCACCAAGCAGCTGCAC
GAGGAGTCTTCCTTCA > SEQ ID NO:315 215638_300883_1 *Trichoderma harzianum*
ACTGGCTCGCTTTCACAGTCCAGCTACATTCGTTGTCTGAACACTAAACCAAAAAACTCCAAAAAAACAACTTAA
TACACACCCCCCCAACAACACTTAATACCGACAAGATGAAGGCCGCTTTCGTTGCTGTTGCTCTCGCCGCTCTGG
CCCAGGCTCAGACCCGCGCTGATATCCCATCCTGCGCTCTGCCCTGCCTCGACGACGCCGTCAAGGCCAACACCA
AGTGCTCCACCACCGACTACGCCTGTATCTGCAAGGACTTCAACGCTGTTCAGGGCGCTGCCACCGGCTGTGTCG
TTGAGAAGTGCGGTACCGACGTTGCCATCAACAAGGTCCTCCCCGCCACTCAGGCTCTCTGCGCCGCCAACTCTG
GATCCGGCTCTGGCTCTTCTTCTGCTGCCAACACCACTCCCGCCCAGCAGACCACCTCTGCCGGCCAGTCTTCTT
CTGCTGCCCAGTCTTCCTCTGCT

Figure 1 continued

> SEQ ID NO:316  215639_300883_1  Trichoderma harzianum
GCCAAGGAGATTGGCTGCACTCCTGAGCAGCTCCAGAAGACCTTCCAGACATACAATGCTATTGCCGATGGCAAG
CAGAAGGACCCCTGGGGCAAGAAGTTCTTCCACAACCTGCCCGTCGACATCAACGACGACTTCCACGTCGCTCTC
ATGGAGCCCGTCCTCCACTTCACCATGGGTGGTGTCGAGATCAACGACAAGGCCCAGGTCCTCAACCAGGAGAAG
CAGCCTTTCGAGGGTCTCTACGCCTGTGGTGAACTGGCTGGTGGTGTCCACGGTGCCAACCGTCTCGGAGGCTCC
TCACTGCTTGGCTGCGTCGTCTACGGCCGTGTTGCCGGTGACAGCGCCAGCAGCTACCTCTTCCAGCATGCCCTC
CAGGGCACCGGCGGCGCTGCTCAGCGTCTGGGCCAAATCTCCCTGGACCTCGACCCCTCTGCTCCCGGCAAGCTG
ACCGT > SEQ ID NO:317  215661_300883_1  Trichoderma harzianum
ACTCCACGCCTCGCCAATCTCGAACGCCTGTCAAAATGCTCTCCCGCGCCGCCACTCGCACCACCTCCGTGGTCG
CCCGCCGAGGCTTCCACACCACCCGCCCTCGCATGTCCTCTCCTTACCACTACCCCGAGGGTCCTTACTCCAACT
TGCCCTTCAACCCTCGCAGCAAGTGGTTCGGCGCCGGCTACTGGGCCTTCATGGCCACCGGCTTCTTCGCTCCCT
TTGGCATTGCCGTCTACCAAACCTACAAGACCCAGTAAACGGATGCTTCGATTACAAAAGGCTTATATGGGCTGG
ACGCTTGGTGCTATGAATGGGTGGTGGACTGTTGCGACAGAGTAAATAGCTCGAATTAGACGTGGGACCAATTCA
CAAGTCACATACATCAC > SEQ ID NO:318  215669_300883_1  Trichoderma harzianum
AATCAAACTCTTAATCTCTATTCTTAAATACATCTACCTCTCACAATGGATTTCGTCAACAAGGCTATGGGCAAG
GAGGAGCGCTCCACTCAGGGCACCGCTCCCGCTGCTCCCCAAGCAGGCGGCCAGGTCCAGAAGGACGATTACGTC
GACAAGGCTTTCGCCATGGGTGCCAAAAAGAGCGGCCACAACATGGATCGCAACACACAGGAGAAGATTACGGAT
GCAGGCCGTAACATGTACGAGAAGGTGACAGGAAACAAGGTCGACCCCAAGTGGTCTAATTAATGAACGGACGAG
TTATGACTCACAACAAGACTGTACAATAGTAATAATAACATCTTACC > SEQ ID NO:319  215670_300883_1  Trichoderma harzianum
ATAAATTCGAGGTGTTTTAGACGCAAGCTTCTCTTTTACACACTGAAGCTGCTGCTGCAACCATCACCAACATAC
CACACGCAACAACACAACACCACCACGTAATAACGAGCAGAACACCCCTCGCTTGAACTTGTTGCAAAAAACACT
CTCGCCTCTATTTCATAAATCAAATTACACACGAACAAAACAATGAATCCAACAGTCAGAGGCTTCTCAACCGCC
GCAAGAGTGCACCCGCCCTTTTTGCCACATCTCCGCCCATCGCCGCGCCGAGCCCCGATCCGACGCTGGTAAGCA
CTCAACTCTCTCTCACGTCCCCCATCCATAAGGATACCATAGCAGCAAAAAGACACAACC > SEQ ID NO:320  215672_300883_1  Trichoderma harzianum
ATCTAACAGTTCAATCCAGACACCGCCAAAATGGTCAAGAAGAGAAAGAACAACGGCCGCAACAAGAAGGGCCGC
GGCCACACCAAGCCCATCCGCTGCAGCAACTGCTCGCGATGCACTCCCAAGGATAAGGCGATCAAGCGCTTCACC
ATCCGCAACATGGTCGAGTCTGCTGCCATCCGTGATATCTCCGATGCCTCTGTCTTCGCCGAGTACACTGTCCCC
AAGATGTACCTGAAGCTGCAGTACTGCGTCTCTTGCGCTATCCACGGCAAGATTGTCCGTGTCCGATCTCGCGTT
GGCCGCCGTAACAGGGCTCCCCCCCCTCGTGTCCGCTACAACAAGGACGGGAAGAAGATCACCCCTACCGCTGCC
CCCAAGGTTTAAAAAATGGGTATGACGGGAATGGGTTGGACGGAGTCTGGTTTACTTTAACGCCTTCATGTAATT
TGCTTAGATGAATACCCAGGACAAAGAGAATCCTGGAGCCTAAATGAATCGGACTTTTTTTCTTG > SEQ ID NO:321  215678_300883_1  Trichoderma harzianum
AGCAAACAACAATACAATCCATAGAGGATTACCTCTCAACTCAACCACCTTTACGACAATCGCAACTCAATAAGA
TTCTTTCAGTGTATTATCACTCAAGATTTGAATTTCGATTCGACCAAGAAAACTCCAATCAAATTTATTACACCA
TATAATATTTTCAACTTCAAACATTTTTCTCAATATGTCTGCTGCTACCGTCACCCGCGCTGCTGCCAGCACTGT
TCGCAAGCCTATTTCCTTCTACACTCAAGTCCGAAGAATGGGCCGTGTCTTTGAGAGCCACCCATACGAGAGATT
TGCAACCACCATGAAGCCTGCAAAGCCCGACTACTACAAGAACATTTCTTTCACTGCTGGCAAGGTTGTCACTTA
TTTCCCCATCATCGGCGCCATGCTTGGCTGGCCCGTCCTTTGCAAATGGGCTTTGGACGGACAGATCGGTCGCCT
GGTAAGAGGTGATAGAGGCAATGGTATAGAGTGGGACAGCAAAAAGATATAGAGATGTCCATCTTTCGACTGTAT
ATATACACTTTGGGCGTTTGGATGGACTATGGG > SEQ ID NO:322  215685_300883_1  Trichoderma harzianum
ATCACCAATTGCACCCCGCCATGGCTTCACCAATGGCTGCCTCTCGCCATGTCCAGCGCGTGGCTACACAGATCC
GTCTGCGCTCAGCGCGGGTTCCCAGAGGCCAATTGACCTTCAATCGATGGGCATCGTCCGCTTCGGGCAGTCGGC
GAGCTCCCGCCAGCTTCGGAACTTCATCCTCGGCAGCCGTTTGGCTTGCAGCCGCCGCCATTGGCATCACGGCTC
CCTTGGCCTACAGCTTGACAACAGCAGAACCTGCAAAGCTCGACGTCACATCCCTTGCCGAAAAGGATGAGCAGA
AGAAGAGAGAGGCGGTTGTCACCGAAGAGTCGCCCATGCGCCTGCGGATGGAAAAGTTCATCAAGGAGCAGCAGC

Figure 1 continued

AAATAATTGTCAAGGAACTCGAGCGCATCGACGGCAAGAAGTTTCGCAAAGACGAGTGGACGCGACCCAATGGCG
GCGGCGGCATAACCTGTGTGCTGCAGGAGGGCAACGTATTCGAAA

> SEQ ID NO:323 215722_300884_1 *Trichoderma harzianum*
GTCTCCATAGAGCTCCGGCCCAGGCTCTTATAGAAGTCAGAATTTTTTGCATTCCAGTCTTCATGAGTCGCACCT
ACTCTATGCCAACGATGTCTTGTACGTATTTACCAGCAGTACAGAGGTAGGACGTCAACTCGCCAGCAAAAATAG
GGATGAACTCACTCTGAAGCTGCGTCATGTCAATATATATTGATCTCTTTGCATATCTTCTTGTCGACCGTTTTC
TTTTGATAGATCGTTGATCTGGCCAACTTTCTGCTATCTTTCAATCCGCCACCGTTGGAATCCCAATGATATTGA
GGCCCTCTTCTATAAATGTACGTATGATTCAAGTACCAGATCTCGAATCCTCGAATATATCGACTTTAATGTGTT
CTGTTTTTCCTCTCAGATTCTGAGTCATATAGATGGTGTACCAAGCAATCGACCCATCTAACAATAACTCGTATA
GAAAAGAGGTGCTACTTCTTCATCCAAGCAATATTTTATTGTTTACTAGAGTCCTTGCCTCGCTCATTANAATAA
ACGGTGGAGCGTTGTAGCGTAAATAAATGAAAGCGGAGGGGTTGCCACGAGGTCGACAACTCAACTCAAGTCACT
CC > SEQ ID NO:324 215747_300884_1 *Trichoderma harzianum*
GGTTGATACCAAACAAAGGTGGAAGTGGATCTTGGGGAGAGGGAGAAAGATGATTGCTTGACATGTATGATACCC
AAGATACCCAGGAGAATGATGGCCGATAAGCAAAACATTAGTTTAATAGCAGCTACTTTTGAATTTT > SEQ ID NO:325 215771_300884_1 *Trichoderma harzianum*
TCGACCCACGCGTCGACCCGGCCAGGCCAATTGTTGGGCCTTTTGAGATCCGGAGTGCGGTTTGCACACACGGGC
CGGCCACGAGGGGCTGCGGCAGGATCCCAAGACGCCGAGAGCCATGGAGAGAATATCTGGGTGTTTGCCCACAGA
AGATCAGAACAGGTCATTTACAGCTTCACCAAGCAATTGGATGGGTTCCATGGCCTGAAACAGCTGCCGTTCAAC
GGCAAGAAGACCAAGCCTGCAAAGCTTCGCAAAGACTACTGGTCACCGCTCGCCCACATTCGATTCCAGCCCGGC
CAAGGATCCGTCGGCCGCTCGGTATTCCAGAAGCTGCGAGAGCTGAAGCACCNNTTCACCGAGGTTNNGCATGGA
CNNAGACGAGTTGCGACATAAGCGGCCGGAACAGTACACCAGCCAGGACAAGAAGAAGATTGCCGAGGAGAAGGA
AGGGATTCGATTACCAACCAATCCGGAGCAAGCAGGAGCGTGGAATCGCTCTCAACGCCCAGAAGCAAAATGCGA
TTGCCGATATGGCATCCGTTTTGGCGGGCGAAGGCCGTGGCAACAAGGTCTTGACCGCGGA > SEQ ID NO:326 215783_300884_1 *Trichoderma harzianum*
CAAAAACAAATAATTCAATCTTCTACAGCTGCTTCAACTACACCACATCAAGCATATCCTCACTTTTTGTCTCAC
TTCAAAACACCAACCATCTCAACTTATTCACCATGTGTGGCGGAAACTGCGGCTGCTCTTCTACCTCTGCCTGCA
GCTGCGGCTCCAACTGCTCCTGCTCCAGCTGCCACTAAGAACATTGTTTTAAACTCTTGCACATGGCTTGCATCA
CTTGATGCTTGAGAGAAATACGGCCAACTGCATCTACAGCACTGGCTCACTCTTCTCAAATTATACTACACGACG
ACATATCACCAAATGCAATTCAATGATGGCTAGCTAGGGCACTTTATAATCAATGTATTTTTATTGAACTAC > SEQ ID NO:327 215882_300885_1 *Trichoderma harzianum*
ACATCACCAGAGAAACCCAGCTGAGCGCACATCGCAAGCATAGAAGCCGTCATCAGTCCTCCATTTCTCGATACC
TCCAGCGAGTTGATTTCATCGCAACAGCTTACTGCGTTGTCTGCCTTTTTTTCTCCGCTTACTCCTGAACCCCAA
CAACCAAGATGGCGAACCCTCTCGATACCGATGCTGGCTCCGAACTTTTCAGCTCGTATGAGGCGGAGCTCAAGC
TCGTACAGGCCGATCTGGCGCAAAAGCTGGACCAGATCCCCGAACTGAGTGGTGAACCGCGCAAGGCTGCCGTCA
GCCAGGCTGAACGTGCCCTGGAAGAGGCAGATGAACTGCTTGGTCAAATGCGCCTTGAAAAGCAAAACATCCCTA
CATCTGCACGAGCCAAAGTCAACCAGCGCTTCCGCAACTACGAGTCCGACATCGATTCAAACCGCCGAAAGCTTA
CGGGTCTCGCCACTAACCGAGCGGCCATGTTCGGTTCACGCTACACCGACGAACCATCCGGATCAACGGATATCA
ATCTGGAACAGCGACAGCAGTTGCTGT > SEQ ID NO:328 215884_300885_1 *Trichoderma harzianum*
GCCCCCGCCACTGCCCAAAGAGCGCGATTCTGCGGGGGTAGCAGTTTTATCAGAATGAATGCGGATTGGAATTGA
GCGAGCGATGTACATTATTTTGTCTTTTATTTGATTGAGAAATTCTTTCAATTTTTTACGCATTTATCATTTGCC
AATGTTGTTGTTGCTGTTGTTTTCACGGTTAGGCGTTGTGAGTGAGCTGTCAAGAGTTCCTTGATCTAATCAGTA
TAGCTTCAATATTAATCACTTTGGCAACTTCCC > SEQ ID NO:329 215907_300886_1 *Trichoderma harzianum*
GTCATCATGTCGCACCCAGAGTCCCCCGAATTTCTCCAGGCGCAGCAGGCCACTGAGGCTTTCACCACGAAGCCT
ACCAACGACGAGCTCCTTCGCCTCTACGCTCTTTTCAAGATCGGCAAGGGCTTCGATTTGGAGTCGGCCCCCAAG
CCTGGAATGTTCGATATTTTTAACAAGGCCAAGTACAACGCGTGGAAGGCCGCTGTAGAGGAGGAGAACATCACC
GACCCCGAGGAGGCACAGAAGAAGTATGTTGAGTTTGTCGAGGGGCTCAAGTCCAAATACGCCTAATCTCGACAA
GACTCGAGGATTGAATTAGAAGGGGGCACGCTGCGAGTGTAATACATGGTACTAGAGACGCATGGCTTTTGGGAT
AGAATGCCAGTTAGCATGAAGAAATAAAGTAAACAAATTGTTCAAGAT

Figure 1 continued

> SEQ ID NO:330 215915_300886_1 *Trichoderma harzianum*
GCCAAACAACGCATCTTACGGCTTCACAACAGCTTGGAAAGCTCTCTATTCGCAATGGCTATCGCACCGATCACT
GGAGTACGTCCCTATTCCGGCCAATGGCGCAGCGTCGCACTGGGAATCGTTGCAGGTCCTGCTATAAATTCATTG
GAGTAGCTAACACAGGATGCAGATGCTGCGGCGACATTTCATCCTTGCACCTCGGCGTTGGTCTTGGATCCGGAT
TCATCATGGCCAACTGGTACTGGTACGGCTACCACATGCCCCGAACCAACGGCCGAGACGCCTACTACGCCAAGA
AGGAGGCCGACCGTGCCGCCGCGGCATCACAGTAAGGGGGGCACTTGTATACTCGATGGACCGAGAGGGAATGCG
GCATGAACAACTGCTGGTCGAATAGAAGGGGAATGACTGGGCCAACGGGCTGTTCATGCCTGCAGGAGCATAGTT
GCTGGACAGATGTCGAATATCACTGAAGAAAGGCAACCGGGCGAACCTCTACTTAGACCAATAAGTCGCGGGGCA
ATACGATTCAATTATCTC > SEQ ID NO:331 215917_300886_1 *Trichoderma harzianum*
GCGTCGGGTTTGGGCAGAGGTTGCCCCCACCCCGCCGTAAGGTCCCGTCGTGTGGGTGGTTGATGGGTTGAGTTT
GGATAGCAGGAATCTAGCTTGGGAGCCGCCTGCGTCGCAAATGATGAATCTAGGCAGTTTGGAATCGATCTGTGA
TGAGGTCCTAAAGAGTAATGTTAGCCGTTACTACAAAAAAAAAATTATT > SEQ ID NO:332 215918_300886_1 *Trichoderma harzianum*
GCCTCACCAAAAAGGACACAAAATAACGACATTCACTCTCTCTCTCTCTCTCTTCCTCTTTTCTCCATTCTCT
CGCGGGGTCATCCGCCCACCATGGCCCAATCCACCGCCCACCGCCGCCTCCTTCAAGAATACCGCGCCCTCACAA
ACAAACCGGCCGAAGGCATCACCGCCGGCCCCGTCTCCGAGGACGACCTGCTGCACTGGGAATGCCTCATCCAGG
GGCCTGAGGGAACTCCCTTTGAGGGCGGCGTCTTTCCCGCAGAGCTCAAGTTTCCCAAGGACTATCCGCTGGCGC
CGCCGACGATGAAGTTTCTCGCTGACATGTGGCATCCGAACGTCTACCCCAGCGGCCTCGTCTGCATCTCCATCC
TCCACCCTCCCGGCGAACGACCCCAACCACTACGAGCACGCCTCCGAGCGCTGGTCCCCCATCCAGTCCGTCGAA
AAGATCCTCATCTCTGTTATGAGCATGCTAGCTGAGCCCAACGACGAGAGCCCCGCCAACGTCGAGGCCGCCAAG
ATGTGGCGCGAGCGTCGGGATGAGTACGAAAAGACGGTCCGCGACGGTGTTCGGCGCATGTTGGGTTTGTAACAG
CGCATGTTGGGTTTGTG > SEQ ID NO:333 215926_300886_1 *Trichoderma harzianum*
CGCGTCGCCCGCTCAGCATGGAGGATATGGACCACCTCAGCCTCAATACGGCGGCCACCAGAACCAATATCCTCC
TCCCGGCGGCCCTCCCCCGAGCCACTACGCACCTCCTGCGCACCATCCTCCTCCGGGTCTAGATGCTTACGGCTA
TCCTCTCAACCCTCCGACTGCCATGCACGCAAAGGCCGGCCCCCCGTCTCCCTCGGCCCCTCAGCAGTTTGGCCA
CGGTGCTCCGGGCGGCTACACCTTCCAGTACTCCAACTGCACAGGAAAGCGAAAGGCGCTGTTGATTGGAATCAA
CTATTTTGGCACAAAGGCCGAGCTCAAGGGATGCATCAACGATGTCCACAACGTGTCGGCATTCTTGGTTGAGCG
ATATGGCTATAAGCGCGAGGACATGGTCATCCTGACAGATGACCAAAGCAACCCTGTCATGCGCCCAACCAAGGC
CAACATCGTCCGTGCCATGGGATGGCTTGTTAATGGCGCCCAGCCCAACGATGCCTTGTTCCTTCACTATTCTGG
CCACGGCGGCCAGACCGAGGACAAGGACGGCGACGAAGACGACGGCTACGATGAAGTTATATACCCCGTTGACTT
TGAACAAGCTGGACATCTTGTAGATGATGAGATCCACTTCCATGTTGTCAAGCCTCTGCAGCAGGGAGTGCGCCT
CACAGCCATTTTCGAT > SEQ ID NO:334 215930_300886_1 *Trichoderma harzianum*
TGTCTGTCATTATTACTCGACCACGCGTCGTCCTCTTCGCAGCTACCCGTAACATCGCAGCCAGCGACGTCGAGT
CACCATGGGTAGAGTTATTCGCAACCAGAGAAAAGGCCGTGGCTCCATCTTCACGGCCAACACCCGCCTGAACAA
GGCTCCCGCCAAGTTCCGCACCCTCGATTACGCCGAGCGCCATGGCTACGTCCGTGGAATCGTGAAGGACATCAT
CCACGACCCTGGTCGTGGTGCTCCTCTCGCCAAGGTCCAGTTCCGCCACCCTTATAAGTATAAGCAGGTCACCGA
GACCTTCATCGCCAACGAGGGCATGTACACCGGCCAGTTCATCTATGCCGGAAAGCGCGCTGCTCTGACCGTCGG
CAACGTCCTGCCCGTCGGTGAGATGCCCGAGGGTACCGTTGTCTCCAACGTCGAGGAGAAGATTGGCGACCGTGG
CACTCTCGGCCGTAACTCTGGTGGCTACATCACCATTGTTGGCCACAACCCCGATGAGGGCAAGACCCGTATCAA
GCTTCCCTCTCTGGTGCCAAGAAGGTCGTCCACTCCCGATCTCGTGGCATGATCGGCATCGTTGCCGGTGGTGGCCG
TACCGACAAGCCTCTGTTGAAGGCTTCTCGTGCCAAGCACAAGTTCGCTGTCAAGCGTAACAGCTGGGCCAAGAC
TCGTGGTG > SEQ ID NO:335 215937_300886_1 *Trichoderma harzianum*
GGTTGCATGTGATGCTTGGCATAGGCTTCTGCGGTGTCATGTCGATATTCTCGTCCTTACACTCGTGCCTCGACG
CCCCCAATCGAGAGAGCCATTTGGGATGGGCGCTGGCGTTTTGCCATTTGGCCTGTTCTTTGACTTCCTTGACG
GCAAGGTTGCCCGATGGAGGAAGAAGAGCAGCCTCATGGGCCAGGAGCTGGATTCCCTTGCCGACTTGATCTCGT
TTGGTGTCGCCCCCGCCATGGTGGCCTTTTCAATTGGTCTTCGAACTACTGTCGATACCGTCGGCCTCACCTTCT
TCGTCCTGTGCGGCCTGACCCGACTGGCCCGCTTCAACGTTACCGTCGCGGTTTTGCCAAAGGACGCCAGTGGCA
AGAGCAAATATTTCGAGGGCACCCCCATTCCGACGTCGCTGGGCCTGGATGCCATCATGGGCTACTGGCTGAAGC

Figure 1 continued

AGGGCTTGATATTGGACAACATTCCGTTTGGCACCTTGCTTGAGGGCACTCCGCTCGAGTTCCACCCCGCCGTGC
TCTTGTTCATGATTCACGGCTGCATGATGACCAGCAAGACAATTCGCATTCCAAAGCCCTAAATCAGGCGACTGC
ATCAGCCGTAGCAAGTT

> SEQ ID NO:336 215940_300886_1 *Trichoderma harzianum*
CGGACGGAGCAGCGAGTACTTCACAAGGGATCGTCCCCGGATTCTCGTGCCCTTTTTTTTTTTGGATCCTGTTC
GGTCGCAGATCAAAAGTTCAGACGACACAGTCTTTGTTTCTTTTTCTTTTACAATTGTACAAAAGAGAAAAGATC
TTCTATTTAAAGGGATCAATTGGTGTTGGGACGCGAATCTANTTTTANGCGCATATAATACAAAAGGGGCTTCCA
ACATCCAGCCATGAAGTTCACGACTCTCCTCTTCCTTCTACCAGCCGTCCTCGCTCTTCCAACCGAGCAGGCGCA
AGACTCCAATGCCATCGATGCGAGCCGCAGTTTCCACTGCCCCGACAAAGTCCAGGGCTTCTGCTCCGCGTCCAA
CATCAAATCGGGATGCAGCTCAGACGGAAAGTTTCATTCCGAGGCCATGGATACATGCAGCGAGTGTTCATGTGA
TTGAGTGGTGGTGGTTACGGTGATTTGGTGGTATAATCATAGTACATGGACGGGTTTCACGTGCTTCTTGTTTTG
TCAATGCTGCGAGTTTGATGCGAGTTCCTTGCTAGCTGCTTAGATTGTTCTAATTACTGTCAGTGGAAAATGTAA
ATTGAGCATCAGTCTATTATAATTGTCTAATAGCATGTGAACAACGAAAA > SEQ ID NO:337 215955_300886_1 *Trichoderma harzianum*
CGATCCAGTAAGACATCACGCACGCGAAAAGTTAAACGTTTGGGCGCAAATGTATGGATTGTATTACTAAAAAAT
TGCAGTATCTTCTTGCATGTCCCTGCATGGGAGAATAAACCTTCATCCCTTTGAGCGCGCTTCATCTAGTGGGGA
ACCGGGCAGAGGTCGGAGAAGAGATGGAAGTGGAAGTGGGCTTTAACTTTGAGGAGCAGAATGTATATCAGTTAG
GCTGTCACAGTCACATGCGACAAAAAAATGATGACGGGACTTTTTCACGGTTAAAAG > SEQ ID NO:338 215957_300886_1 *Trichoderma harzianum*
GCAAGATGGCGACCGAGTTGACCGTCCAGTCGTAGCGTGCTTTCCAGAAGCAGCCTCACATCTTCTTGAACTCCA
AGACCAAGACCAAGAGCGCCCGACCGGGTAAGGGAGGACGACGATGGTACAAGGATGTTGGTCTGGGTTTCCGTA
CCCCCAAGACCGCCATTGAGGGCAGCTACATCGACAAGAAGTGCCCTTTCACCGTTTTCGTCTCTATCCGTGGCC
GTATCCTGACCGGCACCGTTGTTTCCACCAAGATGCACCGAACCGTCATCATCCGAAGAGAGTACCTTCACTACA
TCCCCAAGTACTCTCGTTACGAGAAGCGACACAAGAACCTTGCCGCCCACGTCTCTCCTGCTTTCCGTGTTGAGG
AGGGTGACCAGGTTACCGTTGGCCAGTGCAGGCCTCTCTCCAAGACTGTCCGCTTCAACGTCCTCCGCGTTCTGC
CCCGAACTGGCAAGGCGGTCAAGTCCTTCTCCAAGTTCTAAATTGGGTTTCTCTACTGGCATTTTTGGCGTGATA
AACATCGGGGGGAACGAATCATCCCCGCTGGAGGGTCGGCATGGGAAGT > SEQ ID NO:339 215962_300886_1 *Trichoderma harzianum*
TACCTAATAGTATTTTACATAGGAGCGTTTCTCGTTCGCGTCCATTTTCATTTTGCGTCTACAGCGAAGCGATAC
TCTTCCAGCACTACGCGATACCCCCTTTTGTCTATACTCACACCACCAAACGTAGCGACAAGCACAGCGACGCAA
CATTTACAATGAGCGCAAGAAGCGGAGCGAAACGACTCATCAAGGATCTTGAGAGCTGGCGCCAAGGGAGCGGC
AAGGACGAAAAGGGCGTGGAGAGGCTGGGTCCGATCAATGAGGATGATTTATTCGAGTGGGAGGCCGTCATCAAC
GGGAGGGAGATTGGATCGGGCTATGATGAGGGCCGCTGGCTCATACACATCCAAATCCCCGCGCAGTATCCCTTG
CAGCCGCCCAAGATGCGCTTCGTGACGACCATTGTGCACCCCAACATTGCGCTGCAGTCGGGCGAGATCTGCCTC
GACCTGCTCAAGGACAAGTGGACGCCGACGTACAGCGTGCTGCAGTGCGTGCGCGCCGTGCGCATGCTGCTGAGC
TATCCCGAGACGGACAGCCCGCTCAACGTCGATGTCGCGGCGCTGCTTAGAGGAGGCGATGTTTTGGGGACGCGA
AAGCTGGTGCAATATTGGTGCTC > SEQ ID NO:340 215968_300886_1 *Trichoderma harzianum*
GCTACTGGGCTCTGCAACAACCAAGGACAACTCGCAAGAGAGAATATGGCGACCAAGCGTGATGCCGCCGCAACA
CCGGCAGCACCGGTACGAGGGCCGGCCGACGTCGGTGTCCTAGCCGTGACGGTAGCTATGGGTTCTTTCTTGTCC
GGTGCCATGATGAGCCTGTCGGCATTCGCGGTGCCCGTCATCCTCGACACAAACCCGGTCGACGGCGTGCACACG
CTGCGGCAGTGGGTGCGCGTCTACCACTACGGACACATTTACCTGCCGGCCCTGTGCGTGGCCACGACGGGGCTG
TACGCCTTTGAAGCCCTGCGGAAGCGCTCTCAGGGCAAATACCAGTGGGTGCGGTACGCACTGGCGGCGGTTCG
ACCCTGGTCATGGTGCCCTTTACCTGGATCTTCATGACGCCGACCAATAATACGCTGTTCGCGCTCGAGGCCGCC
GCCGCCGCGTCGGATCCGGGAGCTCTGGCAGACACCCCGGGCGCCGTGGTACGCTCGCTGGTCGTCCGGTGGGCA
TGGCTGCACGTGACGAGGTCGCTGACGCCTCTCTTCGGGGCATATCTAGGCTTTACGGGGCTTCTGTGCGAAATG
CGATCGTCGGCCTAAACAGCTAGTGC > SEQ ID NO:341 215973_300886_1 *Trichoderma harzianum*
AATCATTCATCCATCCTCCATCCCATCCCATCCCATCTTCCAAACCACATCATCAATCTCTAAGCGTTGCCCATT
ATGAAGAGCGCTTTGATCGCCGCCGCGGCGCTTGTTGGCTCCGCCCAAGCTGGCGTCCACAAGATGAAGCTGCAG
AAGGTCTCCCTCGAGCAGCAGCTGGAGGGTTCAACCATCGAGTTCCAGGTCCAGCAGCTCGGCCAGAAGTACATG

Figure 1 continued

GGCATCCGCCCTACTAGCCGTGCCGATGTCATGTTCAATGACAAGGTGCCCAAGGTCCAGGGCGGTCACCCAGTG
CCCGTCACCAACTTCATGAACGCCCAATACTTCTCCGAGATTACC

> SEQ ID NO:342 215986_300886_1 Trichoderma harzianum
AGCTGGATAAATTTCTCCTGTCATCCTCATTTCGCTGCCCTGCGCCACGACACCGGCTGCTGCAGTCCCTTTTCT
AGGCGATACCCAGCATCTGCACTCTGCCCTTTTTTATATTCTCTCCTTTGAAACTCTTATTCTCGTCGCGATAGC
TATTCCAGCGGTTGCCCTAACTTTCTATTTGCATCACATAACCTTTTTAAATGGGTGAATCCAGACAAGAGCTCC
TCAATTGGCTGAACAGCCTCCTTCAGCTTAACATGACCAAGGTCGAGCAGTGCGGAACTGGCGCTGCGCTCTGCC
AGGTCTTTGACAGCATATACATGGACGTGCCTATGTCCAAGGTCAAGTTCAACGTCAGCGGCGATTACGCCTACA
TCCAAAACTTCAAAGTTTTGCAGAACACGTTCCTCAAGCACCAGGTCGATAAGCCCATCCCCGTCGAATCGTTGG
TGAAATGTAAGATGCAAGACAACCTAGAGTTCTTGCAATGGACGAAGAAGTTCTGGGACCTCAACTTCCCCGACC
ACGATTACGACGCTGTTGCACGAAGAAAGGCTGGCGGTGCGCCCGCAGCCAGTTCAGGACCGGCGCCCAGGGCTG
CTGTTTCTAGCGCCGCTGCCCGACGAGTTGGCG > SEQ ID NO:343 216008_300887_1 Trichoderma harzianum
GCACGGAGCACCACCATGGCTTCAAGGTTGAAGATCTGGGGTGCCTGCAGGACTCTGGCGGTCCGGACGCAGCCC
GTCCGCCTTGCGGCTCAGCCATTCCGAAACCAGGTTTCAGCGACTCGATTCTATGCCGTCGATGCGACCAACAAA
CCCTCCAATTCTCCGAGCGGTGCAAAGAGAGAAGCTTCTAGATCATTTTCTAAATCAGAACCAACAAGTTCCAGG
GTTACTGAGGGCACCTCTGGAGAATTGACCCAGAAAGCCGCACAAGAGACATCTTCATCACAAGCCTCACCCATT
GAAGCGCTAGACGATGCGACCTTGGAACAAATACTATATGGCGGTCGACCCGTAACAAGTCAGCGGGAGGGCGGC
TTGACAGAGGCGCAAGAGGAGGCTCTATATCGCGAGGGTGTCATTCCCCCACCAGAGCAGGCGGAAGCTATCGTT
GCTGCCGGGTCACAGTCAATAGTCCCTGTTGGCTCAGAAGTGCAAAACGCCGGCCATAAGTTTGGTCTTCCTCAG
AAGCCCTATCCGGACGGGTTCCATGTCAAGAAGCGATACCACCCCGTGCTGGAGCAAATCACTAGGCTCCTGATG
CGACATGGAGAACTCAGTGTTGCGCAAAGAAACATGGCTGCTGTCATGAACTTCTTACGAACGTCGCCCGCCCCT
ATCTACAGCCCGAAATTCCCCCTATTAC > SEQ ID NO:344 216012_300887_1 Trichoderma harzianum
GCAAGAATCTGCACCTCACTCGATAATAAAAAGAAATCGGTACTCAAGGTTTATAACTCATTCAAAATGCGTTAT
ACTGCTGTCCTCGCTGTCCTCGGCTTCTCCGGAGTCATGGCCAACAAAAACTTCGGACCCTTCGGATTTTTCGGA
CCCTGGTTCGATGGCGACTTAACTATCGATGACCTCGCTGACTTTCTGTTTCCTGAGAACCCTTGTGAGTTCATT
GGTGGTACTTGCGAGATCGCCACTTCCCTTACATTCTGCGCTGGTCGGGGCGACTTCAGCGTTGATTTGCCTTGT
GGCGTTGGCCTCGGCTGCTGCTGGCACCAGGACACCAGCAATGTTTGGTTTGAGCAATGGAAGGAGTGGCTCGAG
CTACACAGCCGCATCAACTAAAGCCGCTTTAATGTCTTGACGCTTTGATGGCTTGACGCTTCTATGGCTTGACGC
TTCTATGGCTTGATGCTTTAATGGCTTGACGGAGTCTTCAATTGGCACGGTAGTGGGTGATGGAGAAATTAGCCG
TACTGAACTCAATGAGAGATTGTTAACCCCTG > SEQ ID NO:345 216030_300887_1 Trichoderma harzianum
GGAGATGTGTGAGTGAGTCTCTACATATGCAGCAGACCTTGACAGAATCATGTTGAGTCGCCAGGCAGGTCACAG
CGGTAGTGGGAATTAGTGGGATAGATTATAGCGGGATAGCGGGCCAAGCGCTGTGGGAAGTACATGTACAAGTAC
GGGTACCAGGTGCTAGGCATGTATTTGCGGATGCTGAGTGGCTGGAGCGGTGCACGATAGCTGGGACGGCGGGGC
GCGAGATGGCCCAGAAGTGGCTCTGCAGTACTGGGAGATACATGGATGGGCATCGGGAGGTACAAGCTGGAGATG
GATCTCTCCAAACCTT > SEQ ID NO:346 216036_300887_1 Trichoderma harzianum
GCGCATCATTATGCCGGCATGGGCCCGGGGTCTGACCCTCACCATTTCCGAGACCAGAGCGTGCCGCATTTCGAC
AAGGCGGGCCATACGCGGACGCACGAGCGGGAGGATCACCGGCGGTGGCAGCGGCAGAGAAGGGCTGTGGGGGAT
GATGGCATAGAGTTTGAGCCGCAGACGAG > SEQ ID NO:347 216037_300887_1 Trichoderma harzianum
CATCATCAGAAGCATGCACATATGCGAGTGATACATGGACAAGAGGGTCCAGAGCTTACGCTGTAATCATTCTCT
GCAGATTGGAGTTGTGTCTGTCTTTTATAATCTCGATCCCCGATATCCGTACCCCGATCCCAATATCCCAATACA
AGTACACGATAATAGTACAAAGTTCGAGTCATACTAATAATACAACGCCCCCTTTTCCTTTCTCTCTCTCAGTGA
TTAGGGGGAAAAGGGAGGCGAATGAAAGACCAAAAAAAAAAAACAC > SEQ ID NO:348 216039_300887_1 Trichoderma harzianum
AAGATCAGGACAAGACAATTCGAGAGTGCCAAAAACAGCAAAAGGGCAGAGAGACGTCATCATGGCTCATGCCAA
GTTCGCCGTTTATCCCAGCCTCGTCGACCGCACCGTCGTCATCACAGGTGGTGC

Figure 1 continued

> SEQ ID NO:349 216046_300887_1 *Trichoderma harzianum*
AATCCCCTAATGATTTTGGTAAAAATCATTAAGTTAGGTGGATACACATCTTGGTCATATGATCAAATGGTTTCG
CGAAAAATCAATAATCAGACAACAAGATGTGCGAACTCGATATTTTACACGACTCTCTTTACC > SEQ ID NO:350 216047_300887_1 *Trichoderma harzianum*
GCGCGAAGCTGCTTACGTTCACCGAGGTGTTTGGCTTTCTCTCCATGACTCTTTGGACTGTAGGCTGTAGAGGAG
TATGGAGCCGTTGTGTGCCTCTGTCTGACATTGGAGGATTCTGGATCCATTGTGTGCCTCTATCTGGCATTGGAG
GAGTCTGGAGTTGCTGTGTGCCCCTGTCTGGCAGTGGAGGAGTGCGGTGTTGCTGTGTGCTCTTGTCTCGTCGGC
GAAGCATCAGTGTAGCCTGAGCAGGTGCCGTAAAGACCGGTGCTACGGGCAACTGTGGGAGCTTGGGAGGAAGGA
CAAACGGTTTTGCCGCCTCTGGATGCTTTTCCAAGAACGCTTGTTCATATTTGACCAACCCCGAAGAACTCGTCC
AAGT > SEQ ID NO:351 216059_300887_1 *Trichoderma harzianum*
CAGTCGTGTCTTGTCATTATTACTCGACCACTCGAGCAAAGGCAAGATTGATCAACGTCCGGCTCATCTCCATGG
CCATGACCGGCTTCTTCTACACCTTCAAGCGGCCTAGAACATCGCCCATGATGGGAATGCTGAAATACGACCCGA
TAGTCCGCAAAAAGGTCTTGTTCCTAGAAACGAAAAAGCGATCCAAATAGAGACATTTCCGAGCAATGTAAAATT
TCAAACTATACACCTCACGGACGGGAAAATAATGATTGGGTTGCGGGCGGTCTGGTTGTTCGAACCTGCGGCCAC
CTATGTACATGTATCAATACGAAGAGCATTTCTGGAGTTTTAGGGATGGGCTGGCATTGCGCTCGATGCGCTGAC
AGGTCACGATATCTGGTCTGATTGGAATATAAATTCACTCCCAAATATTCC > SEQ ID NO:352 216061_300887_1 *Trichoderma harzianum*
AAGTAACGACACCGCACACCGTCGTCAAAATGGTCAACATTCCCAAGACCCGTAACACCTACTGCAAGGGCAAGG
AGTGCCGCAAGCACACCCAGCACAAGGTCACTCAGTACAAGGCCGGCAATGCTTCCCTGTTCGCCCAGTGTAAGA
GACGTTATGACCGGAAGCAGAGCGGTTATGGTGGTCAGACCAAGCCCGTCTTTCCACAAGAAGGC > SEQ ID NO:353 216062_300887_1 *Trichoderma harzianum*
GAACATTCAGCCTTGTGCAGGGAAGCAGAAATCATATAGAGCATTTATCAAGCGAATAACAGACCCTGAGACACT
GAATCAGAGAAGCTTAGAAGCTCTTCTTCTCTCTGTCTCCGCGCCTCTTATCGCAAACAGCCCCTCTACTGCTGC
TGCTGCCTTTGTCAGGCCTGTCTTTTCAGTGTCGCATGCCCCGCCTCATCTTTCTACCTTGCACAACTCAGCCTT
TGCGCTAATCAACGACATCTGCGATCTGTGTCGGCAGCAGAAGAGTCCCA > SEQ ID NO:354 216067_300887_1 *Trichoderma harzianum*
TGCCGGAAGCCAGGTCAAGAACTGCGGTGCGGATAAGGATGTGACTTTGACTCTGTGTGCTTAGAGTTAAGGGAG
GACGGAATCATGTCAAGGGAAAGGTTTAAATCAAGTTTATGATAGAATTTCAAGTCCTAGCTATGTTTAAGACTT
ATGACAGTATGAATTGATGAGTTTACTTC > SEQ ID NO:355 216071_300887_1 *Trichoderma harzianum*
TATTATCTCGACCCACGCGGCGAAGATGAAGTTGAACATCTCTTACCCTGCCAATGGCAGCCAGAAGCTCATCGA
CATTGAGGATGAGCGTAAGCTCGCCGTCTTCATGGAGAAGCGCATGGGCGCTGAGGTCCCCGGTGACTCTGTCGG
CGACGAGTTCAAGGGCTACATCTTCCGCATCACCGGTGGAAACGACAAGCAGGGTTTCCCCATGAATCAGGGTGT
CATGCACCCCAGCCGTGTCCGCCTCCTGCTCTCCGACGGCCACTCCTGCTACCGCCCCGCCGAACCGGTGAGCG
CAAGCGAAAGTCCGTCCGCGGCTGCATCGTCGCCATGGACCTGTCCGTCCTCGCCCTCTCCATCGTCAAGCAGGG
TGATGCCGACATCCCCGGCCTGACCGACGTCGTCCAGCCCAAGCGCCTCGGACCCAAGCGCGCCACCAAGATCCG
CAAGTTCTTCAACCTCACCAAGGATGACGATGTCCGCAAGTACGTCATCCGACGAGAGGTCCAGCCCAAGGGCGA
GGGCAAGAAGCCTTACACCAAGGCTCCCAAGATCCAGAGACTGGT > SEQ ID NO:356 216076_300887_1 *Trichoderma harzianum*
GGATATTCTTATGTGTGTTCGTTCAAGAGTGTAATGATAATACTGTTTGGTAAAATGGTGGAATTTTGGTGGTGT
GTAGATGTGATAACCGTAAGGTGGACG > SEQ ID NO:357 216093_300887_1 *Trichoderma harzianum*
CTCTCCCTGACATTCATTCCACCATGGCGCGCCGCCAGCATCTCACAGCGTCCATCCTGTTGGTCGTCGTCCTGT
TCTTCAGCTTCTCGTATTTCCTGTCCGGCTCGTCCAGCCACGATGTGGACCGAATCCATGAGCCTGCGGGAGAGC
CCAAGTCGGAATTCAAAGTGGACCTGGGTGGCATGCCAGCTAGTCTGCTTGACGGAGAGTCTATAGCCCCCAAGC
TGGAGAATGCAACACTCAAGGCCGAGCTGGGTCGTGCAACATGGAAGTTTATGCACACAATGGTCGCCAGATTCC
CCGAGCAGCCCTCAAAGGAAGAGCGTAAGACTCTCGAGACGTTCATCTACCTCTTCAGCCGCCTATATCCCTGCG
GTGACTGTGCGAGGCACTTCCGGGGGCTGCTGTCAAAATACCCTCCCCAGACGAGCAGTAGGAATGCGGCGGCTG
GATGGCTGTGCTTTGTGCATAACCAGGTTAA

Figure 1 continued

> SEQ ID NO:358 216113_300866_1 *Trichoderma harzianum*
CCGAGTTGAAGAGCTTCCCGACGACGAGACCAAGACCAAGCCCACGGTCGAGGAACAGGATTCCAGCGATGAGTC
CGATGCTGAAGAGCTCGGCGATGGATCTCTCCCCGCCGGTTCTACTGGTGTAGTCCACTCTCGCTACGAGAAGAA
AGCTCGCAAGGGCCTGGTGGAGAAGGGCAACTTGGTCCGAGTCCCTGGCATCACCCGAGTCACTCTCCGCCGGCC
CAAGAACATCCTCTTTGTCATCAACAACCCCGAAGTCTACAAGTCCCCCAACAGCAACACCTACATTGTCTTTGG
TGAGGCTAAGATCGAGGACATCAACGCCACCGCTCAGCAGGCTGGCGGCGCTCAGCTTGCCCAGGCCAACGCCGA
GGCTGAGCACGCTGGCCACAACCACGAGCACGAGCACGATCACGATCACGATCACGACCACGATCACGGCAAGGA
GGGCGAGGCTGAAGCCAAAAAGGAAGAGGAAGAACAGGATGACGGTGAGGAGGTCGATGCCGAGGGTCTGGAGGA
CAAGGATATCGAGCTCGTCATGACCCAAGCCAACGTCAG > SEQ ID NO:359 216130_300866_1 *Trichoderma harzianum*
AAACAACCATGCCTCACAAACACAAGTCAAGGAAGGGCGAATTTGAAGCAGAATTCGATCTCGCCCCTACAGAGA
AAGCGCGATCTCTTCCAGTAAACAAACGAAAAGCGGCATCAAGTTCTGGAGAGCAAGTCACAAAGAAGCGTGCCA
GAAGCTCATTAAGAGGCAATGACACTCCGCGAGCATTCAAGAGAATCATGGCTGTGGCAGGGGGAAGAAAATTA
GATCAGGCTTGGATGATGGTCAACTCGACAAAACGACTACGAAGGCTACCGATGTAACGAGCGAGAAACTTCAAA
TTCGTCCCGGTGAAAATTTAGGGGCCTTTGCCAGCCGGGTTGATGCGGCTCTACCAGTATCAGGGCTTGCGAAGA
AAACCAGCACGAATGCAGAGGGCAAAGACGCATTAGGATTGAAAGTGTATCGCACTCGCAAAGAGCGCAAAATGC
ACAAACTCTACGATCAGTGGAGGGCAGAGGAATCCAAGATACGAGAAAAGAGGGAGGAGGAGCTAGAGCGCATAG
CAGAACGCGACTTGGAAGACGATGCTGCCGGCATTCTTACTTCAGCTGCCTTCGAAAACGACAATAGCCACACGA
AAAA > SEQ ID NO:360 216131_300866_1 *Trichoderma harzianum*
GAAGCCTGCATCGCCCGCCATGGCCATTACGCCGACCCAATTCGCCAAGAAGACGGCGCAGTCGACCAGCTGGTC
GGATGCGAAGCGTCGAGTCCTTTCTTCGTACCGCGAATGGATCCGAGCTGCGCCTGAGATCCAGACCATGTACAA
TGTCCCTCTCCCCATTTCTACCCTCCGAACACGGATGCGACAAGAGTTCGAGCGACACCGATACACGAACCAGCT
GTCCATAGTTGACGTGCTTCTCTTCAAGTCCCATGCAGAGTACCAGGAAACAATGAACTTCTGGAAGCAGCAGAC
TCACATCTTGTCTTATTTCGGCGAAAACTTTAGAGGTGACAAGAGGCTTCCGTCCAGCTTCATGGCTGGTTTCCT
TGAGGGTCGAAATTAGAAAGACAATGCAAGAAAGTTTGTTTTGTAAATATCTCTGTATAAAGATTTTGTGCCGAA
ACCCTCCAA > SEQ ID NO:361 216157_300866_1 *Trichoderma harzianum*
GTATCATCATCATCATCAGCCTTCTCAGACCACTCGAATTTCTACCCCCCTCCTAAAAAGACCGCCCCAAAGAGA
AACTTCAATGGCTACCTTGAAGCAACGAAAGGTCGCCATCGTGGGCAGTCGATCCGTTGGCAAATCATCGCTCGC
CGTGCAGTTCGTCGATGGTCACTTCGTCGACAGCTACTACCCCACGATCGAGAACACCTTCAGCAAGACCATCCA
GTATAAGGGCCAGGATTACGTCACTCGAGATCGTCGATACCGCGGACAGGATGAATACAGCATTCTCAACTCGAA
GCACTTCATCGGCATCCATGGCTACATGCTAGTCTACTCCGTGTCGTCCCTGCCCTCCTTTGAAATGGTCCAGGT
TGTCCGCGAGAAAATCCTTAATCATCTAGGTACCGAGTCCGTTCCCATCGTCATAGTAGGTAACAAGAGCGACCT
CCGACCAGAGCAGCGCCAAGTCAGCCCCGAAGAAGGCAAGAAGCTGTCAGAAAAGTTCGACTGCGGCTGGACCGA
GGCCAGTGCAAGGTACAACCAGAACGTCGGCA > SEQ ID NO:362 216187_300866_1 *Trichoderma harzianum*
ATTTATCGAGTTTCACAGGGCTTAGCAACTCCTGTCGGGGGGATTGGCAGATCTTGACAACTGAGGAGGACCGG
ATGCCGTGACGTGTAGCTGCTAGGATGAATCTTGGATTGGAGATTTGCCAGTCGATTTGGATGGTGCCTTTCGGG
ATGGAGGGGTGGAGGGTGGAGAGATATGACTAGTGTGGAGGTATCACAGCGTCGGGGGGCTGTGGAGAGTTCAGG
GTAAGCCATTTGCGGCTTTCACGCTCAGTAACACTCGGGGGTTTAAAACTGACTGATGGCCCATCTATACCTTGC
AGAAAAAATTTAGGTCCTCGCAAGACTCTCCCTAGAGCCGCGTCCCGTCACTACTGCTGCTTTGGCATCAAATAG
TGCTCAATGGCTAGGCCGAGGGATTTGAAGACGATAGCAATGTAACCCATACGATCTGACTGAACGACAAAACAA
AACGATAC > SEQ ID NO:363 216189_300866_1 *Trichoderma harzianum*
CAATCATCAGTCAAACTCCAAACGAGGTATGTATGGCCTTGGTCACCGCTGACGGCGATTCGGACCTGGCAGGAT
GACGCCTTTTATCGTGGCTGGGGACAGCAATCGAAGACGCCGGCCCCGATGAGCGACAATGAACGCGCGATGATG
CATCACATCACATCGCGGTTTTCTGTTTGGCACACAACGGCTTTGGCTGGCGTTTCTCGATACGCTGCTTCCC
CTTCGGCAATGAGCGGGCTGAACCCTCGTCGACGGATCGCTGAGGGCACTCTCCACGCTTCTGGGCCACTCCTAG
TCTAACATGTGTTTCCCTTCTGGCAGATACCTCATTTCCAACTCCGACTTGAGAATCTCCTTTTCATCAATACCG
CCAAGATGGTCCGCACTTCCGTTCTCCACGATGCCCTCAACAGCATCAACAACGCCGAGAAGGCCGGCAAGCGTC
AGGTCCTGATCCGACCTAGCTCCAAGGTCATTGTCAAGTTCCTCCAGGTCATG

Figure 1 continued

> SEQ ID NO:364 216191_300866_1 *Trichoderma harzianum*
GAGCGCGGGTATCAGTAAAAGATTCAAAATAGCCCTTATCAGGGCGACGCGGTGTTTTTCGTCTCCATCTTCTCA
AACACCCGCAGCACCTAAAATGCCTCCAGCACCCATTCTCAAGCTCAAAAACTGCCTGGTGCGGGCTTACGATGA
AGGAGACGTGAAGTCCCTCGCCAGAGCAGCAAACAATCCCAAGATATCGCGATGGATGCGTAACACATTCCCACA
ACCATACACGACCGATGATGCCAAGAAGTGGATCTCTATCGCCAACTCTGCATCTCCGATCCGTGACTTCGCCAT
CTGCCAGCTGGACAGTTCAGTGGTTATCGGCGGTATTGGTCTCAAAGCACGAGACGACATCCACTACCGAACGAT
GGATATCGGCTACTGGCTGAGTGAACATCGCTGGCATCAAGGTATAGCCACAGAAGTCGTCATTGCCTTCTCCGA
CTGGGCTTTCGAAAACTTCAAGCAGCTATTAAGACTAGAGGCCGAAGTCTTGGAGGGGAACGTAGGAAGCTGCCG
GGTTCTAGAGAAAGCGGGCTTCGTGTTTGAAGCAAGGCAGAAAAACGCGGTTGAGAAAATGGGCGCAGTCATGGA
T > SEQ ID NO:365 216193_300866_1 *Trichoderma harzianum*
GACACTATACGTCAAACCAACAGCCTAAGAAGTGGGTCAAGGAGTTCAAGAACGCCGGTTGCGACCTGTACTGGT
TCCACTACGAGGCTGCCTTTTCCTCTGCCGCAGAGTCTCCCGAACAAACGACCGATAAGAAGACCAACCCCAAGG
AATTGATCCGATATATCCACGACCAGGGACTGCTTGCAGGCATTGCCATTAAGCCTGACACATCCGTCGACGTGC
TTTGGGACATTCTCGAGACTTCGGATCCCAAGGAAAAACCTGATATGGTTCTAGTCATGACAGTCTACCCCGGCT
TTGGAGGACAGAAATTCATGGCCTCGGAGCTGCCCAAGGTGCAGGAGCTACGAAAGCGATACCCCGAACTGAACA
TCGAGGTTGACGGAGGACTCGGCCCCAGCACCATTGACCAGGCCGCCGACGCGGGAGCCAATGTCATTGTTGCGG
GCAGCGCCGTCTTTGGAGCCAAGGACCCGGCCGAAGTCATTTCGCTGCTACGGAGGTCCGTCGACACCAAGGGAG
GCAAGCTGTAAGTGTGGAGAGTTGGATATAGAAGAACAAATAGCTGCATGAAATAGAAATAGCGATT > SEQ ID NO:366 216228_300867_1 *Trichoderma harzianum*
TGTGATCACAACTCGGCATTCTATTGGGCTTCGAGGCAATACACACACCGAAAATGAGTTCGGAAGCACACGACA
AAGCACCGGGTGATCTTTTCCCCAAAGAGGACACTGTGCTTTCGAGTGCGGCATCCTTCACACAGGACTTTAAGC
CGGTTAAGAATATATGTGCTCATCTTAACGCTTTCCACGCTTATGCGAATGATCCTATGCGATCCGTGGAAGCGA
ATCATTACTGCAGCCAATTGGACGACGAGGTTCGGCAATGTGTGTTATACGACTCTCCGGAACCCAATGCACGGA
TCATAGGCATAGAATACATGATCACACCGAAACGCTACAATCTCTACCCGCTGATGAGCGCCGCCTGTGGCATT
CCCACGTATACGAGGTGAAATCGGGGATGCTGGTGATGCCTAACCGCATGGTACCCAAAGCAGCATGGGAATTAG
CAGAGAAGAGGGAGATGGAAAAGATTATCACGCTATATGGGAAGGCGTATCATTTGTGGCAGACGGACAGAGGGG
ATGAGCTTCCGCTGGGGGAGCCACAGCTCATGATGAGTTATACGAGTGATGGGCATTTGGACTTTGGGAGGGTG > SEQ ID NO:367 216237_300867_1 *Trichoderma harzianum*
ACAGCCTGAAACCGCGAGTACAAGCATCTTGTTGTAAGCTCGACGTGTGAGCTCTCCTTTCGTCTGCCGTCAAAA
AGTCGATGCCAAGGAGGGTATTGCAGATGTGTTGTTGGCCATCAGCTTACCACTGCAGAGATCCAAGCAGTCATC
CCGTGTGCAGGCACAAGCCCAGTAAGCCGCTGCTCCCAATATGGACCACGTCAGCCATGCCGCCAACCGAGTCCC
TCACCGTCTTCCAAGATGGAGATGCTGTAGGGCTCACCCAGCGGTCGAAACATACCGCCTGTCTGAGGCCCCCTC
CAGGGCATTTGCTAGCCGACCTACTGTACTCGTGTCTCGTACACGGCAGTCGAATTGGTATACCTCCTCCGAAGC
TGGTTCGTCATGCGCATGAAAAGGCTGTAGCGAGCAAGACTCAGCCGCCCAATCACGAATATCTCGGGCATCCTT
GTCCGTCCAGGAATAGGCACACCACTCGAAATTAAGCTGCCATGCAAGACGTGGCATGCGGGGAGGGTCCCAAAG
ATCCTTCCAAACATTCCAGACA > SEQ ID NO:368 216251_300867_1 *Trichoderma harzianum*
TCTGCACAACCCTGTTAATACCGCCTTGTTGGACTCGGTACCCCACGCATCACGAGCGTTTCCTCCATCCACTTG
TCACCCGTGCTTGTACGAGTATGGAGTGCCTTTATCTTGAACAACACTGAACGCAACATAAATGCCTCTCCCGGC
GGCTGGCACAGATTCCCCAGCTTCGGCCTGGGCTGCACTCGTTGCAAACGGCTGAATATCTTTGCACTCCTCCAA
ACGAGCAAGGAGCCGGATATCTTTGCGCAGGCTCCAACAGCCAGCACTGAACCGGGGCTTCGTTTCCACCGATG
AAATGTGCACTGTCGAATGCTGCTCACGATTGTCATATGTTATCCGTTCATGTGTGTCTACTTGCATCTCATCTG
TGCACTGTAGTGCTGTCCTCCTCGTATCAAACGTCCACTTGTCTGGATTGCGTAATCCGAGACGGCAAGCGAATT
TTCGGATGAATGGTGGTATTTTGTATCGGATGGTTCTGGTATAGGTTACCTCGCTTTGAAAGCGTATAAATTCAT
CTCCTCTCTGCATGTNGGTTATCGGTACGAGGTTTTATGTGATAGATGACACCTACA > SEQ ID NO:369 216259_300867_1 *Trichoderma harzianum*
GTTGGAAGTATATAACTTATCCGGCTACAAGGTTGAATAGCGTTGCCCAAAATGAATCCCTATCCATTCCAATTC
AACAGCACATCCTCTTCAAAAGATGAATCAACCAGGGAT > SEQ ID NO:370 216262_300867_1 *Trichoderma harzianum*

Figure 1 continued

AGAGAACGCAGATACCTTCAACAGGCTCGAGGCTCCCGTGTCTCGTGTTGCTGGATGGAGTATCCACAACGCTCT
GATATTCGAAAAGTTTCACGTCCCAGATGTTGCAAGAATTTACGACAGTATTAAAAAGACGGTTCAGTACTAAGA
ATGTGGGGAGCGAGTAACGTGTGACTTTATCTTTGAATTTCTAGAGCTTCTTCCTAGCATAAGTGTAAATAATAG
AGAATAAAGCTTTCTGTAACACAC

> SEQ ID NO:371 216268_300867_1 Trichoderma harzianum
GACACACAGACGCACTCACACACTCAGCTTAAGCGAGCGAGCGAGTGAACGAGAGAGAGAGACAGAGATGGCGAG
TGTTGCCTCCTTCCCGGTGATCAACATGGAGAACCTGGAGACCGAGGAGAGGGGCGCAGCAATGGAGGTCATCCG
CGACGCCTGCGAGAACTGGGGCTTCTTCGAGATGCTGAACCATGGCATCGCGCACGAGCTGATGGACGAGGTGGA
GCGGGTGAGCAAGGCGCACTACGCCAACTGCCGGGAGGAGAAGTTCAAGGAGTTCGCGCGGCGGATGCTGGAGGC
CGGCGAGAAGGGCGCCGACGTGAAGGGCATCGACTGGGAGAGCACCTTCTTCGTCCGCCACCGCCCCGTCTCCAA
CCTCGCCGACCTCCCCGACGTCGACGACCACTACAGGCAGGTGATGAAGCAATTTGCGTCGGAGATCGAGAAGCT
CTCGGAGAGGGTGCTGGACCTGCTGTGCGAGAATCGGGCCTGGAGAAGGGTTACCTGAAGAAGGCCTTCGCCGG
GTCGAACGGCCCAACGTTCGGCACCAAGGTGAGCAGCTACCCGCCGTGCCCGCGCCCCGATCTCGTCGACG > SEQ ID NO:372 216270_300867_1 Trichoderma harzianum
ACAACATTTTTCTGCTATTCAAACCCGTCGCCCGACGACCTCCAGATTCAAAATGTTTGCCCTTTCAGAAGAGTC
CAAGGAGCGCATTGCCAAGCTCATTGACATTTCTCGAGTCGCCATTCACTATGGCTACCTTCCTCTGATTCTCTA
CCTCGGCTACACCCGCAGCGACCCCCGACCTTCAGTCATCCGCCTTCTCTCTCCTCTTTCCTAAACGCAAACACA
GACGGACATGCGATGTTGTACGATATACGATTATAATACGGCTCAAGGGCACGGGAAAAGGCATGCAACAAGAAG
AGGCGAACAGTCAGAGAGAAGCTCAACGTCCAGCATTCATCATGGCGTTTGGGTAATATGCACATGTCTTGGAAG
AAGGCAGGACAGGGCACGGGACGGGTGATACAATATGACGACAAGGTCGCCGAGAGGACGCAGAGGAGGACACCA
AATGCTGCCATGTACCAATAAGAATGTATTATCTACTGCTCCGTACTGTAATTGGACCAAGTAACCACTCCGAAN
AAAAAAAAAAAA > SEQ ID NO:373 216277_300867_1 Trichoderma harzianum
GGACAGGGGAAGGGGGTGTTACTTGCGATAGGCGATGTCTGCATGTGAAGGCCACTACTTTACCAAAAGAGGATG
CTGGGATGGCTGTCGCCGGTCGAGTAATTAATATGCATAATAGTATCCGCAGGTGATGAGGTGATTTCAATGTAT
AATTGCTAAA > SEQ ID NO:374 216305_300868_1 Trichoderma harzianum
GGCGCTGTAATCTTCTCTTCTTCACTCCGGTTTCTCTGGCTTGCAGATACAGAGTCGCTGTAAAAGAAAAGAGGA
AAGGGAGAAAGGAGGAGCATGCCTTCACACAGCTTCACCACGTCCAGGTGGCTTGCGCCGCCCATCCAGTTCGCG
TCCTTCAAGTCGCTCCTCGTTATTCCCATCATCCTCTCCGTCGGCACCTTTGTCGCTCTCTTCGCCCATTCCGAC
GTCGACATCGCTTTACTGTGGTCGCAATGCCACTCCCGCGCCCGCATCCCCGGCCTCAGCCACATCCCGCTCATC
GGCACGCCGAGCTGCTTCCTCGTCAGCTTCTTCCAGTGCGCGCTGGACTCGCTGCGGTCCAAGGCCGTCATGGCC
GTGATTCTGTCGTATGTTGGCGCGCTGGCGACTGTATGCACCGTGGAGTCGGCCAGGCGCTGCAACAAGCCTAAT
TCGCTGATTGCGAAGCCCACGCTGTGGTGGCTGTTGTTCAACTTGCTGGGAGGCGCCATGGTCTGGCAGTTGGTG
ATTGTGCCGGCGT > SEQ ID NO:375 216319_300868_1 Trichoderma harzianum
AAACCACCGTCATCATGCCTCCAGCAAGGTACTCGCGCCCGCCACAACACGACTCGTGGTTCGCGCCTCTATCCG
TCGACCTGATCCTCAAGGTTCTCAACGTCACCATCTTCCATCCCTTCATCTGCTGGCTGATCCCGCTGTGCCTGC
GCGCCCAGACGACCAAATGGGAGGCGCCGCCCATGGTGGGCGCCATTGCCTGGGCCATCTTCATCTCGGCCATGT
GGATCGCGAGCGCGGTCAACCAGCGCATTGCCAACGGCGCGCCGCGCAGGTGGACCTGGGCGAGGAGGTGATTG
TGGTGACGGGCGGCGCGAGCGGGCTGGGCATGCTGGTGGCCGAGGTGTACGCATGAGGGGCGCCAGCGTGGCCG
TGCTGGATGTGAACGAGATGGAGAATGGCGAGGCGAGGGGCGTGACGTTTTACAAGTGCGATGTGAGCGACAAGG
AGCAGGTGGCCAAGGTTGCCGTTGAGATTGAGAAGGATCTCGGTACGCCTACTGTGCTCATTAACAACGCTGCTA
TTGTCGTGGGCAAGCCGCTGCTGGACCTCTCCATCGATGAGATCGAGACCAGCATCGGCACCAACCTCCTCGGCC
CCTTCTACTGCCTCAAGACATTCCTCCCAGCCATCAT > SEQ ID NO:376 216320_300868_1 Trichoderma harzianum
GTCTATCGTTAATACAGCAAGATGTATGAGGTGGTATCGAAACAAGGACAAGAACAAAGAGAAGAAGAAGTCGTA
AAGAGACTGAAGTGCTGTTTGAGCTGGTATCGTTGACTGGTTGTATGTAGTGTAGCAAAGTTGTGACATATGAAG
AGATGAAGCAGAGAAGGGTTCCGTTGTTGCTCAAGACGTTCGGGGGGTGGCAGCTTTGATGAGTGGCCGCCCGCC
CAATTACAGCTACAGCTACCAAGTACGAAGTACCAGACCTTACAGCATCGACACGACATGAATGCATGTACCTGC
TGGTACAGCGACGGCCCTGGCGCTGGTTGTCAGTGACTCGATAACGCGGGGGGAGGAACAGAAGGTTCCAGGTCC
GCTGGCCGGGCCTTGCAGTGGCAGCTGTTGGGGGCGTGATTCCGCCAAGGGGGGCCGAAGGGGGGTCGCATCCC

Figure 1 continued

AGCCTGCGAGGTCAGAGGGGGAGGGGGCGTGCCGCGTACAGTGACGGCGAGGTACTGGGCTGGCAGAGGTGACGG
AACAGTGGTCAGCGGCCACAGGGGCAAACAGCGCTCGCG

> SEQ ID NO:377 216329_300868_1 *Trichoderma harzianum*
GATCGGGATCGAGTGGGGAAATAAGATGGAGAGTCGAGAGTGCCTTATGTAAAAACCTGACCACCGGCAGGATGG
AATCACCAGAATCACCAGACTTGTCTCCGGGTCTTTCCTCTATCCTGCATTTTCCTGCAGGACAGGGAGAGCTGC
CTGCACCTGCACACCGAGGTACCTGGATACTCCGCGTGGTGAGGGGCAGGCAGCGTGCGTCCGAGGTACTGCCAG
GCTGCCAGGTACTTGGGACGGCAGTGCACAAGCTCCGTACTTGGCGCGCCCTGCCCTTTGGTCCAGCTTTGGGAA
GAGATCTCCGTTCCGGCTGCCTATCCTCCGCTTTCGTGCAGCTGGGGGGAGGGTTAAAGACGGCTTTCGGTCAAG
AGTCGAATCGGTCCTGATTCAGAAAAGAAAACACGAACAAAAAAAAAAAA > SEQ ID NO:378 216338_300868_1 *Trichoderma harzianum*
GGGCGGACGCGTGGGCGACCACCAGCGCCGCCAGAATGTTCGCCGCACGATCAAGGGCAGTCTGCGCCGCCCGCC
AGCTGCAGCGGACAACCCGAACCTACGCCTCCGAGTCCCACGGCCACCACTCGCCCGCTCCGGTCAACGAGTCCT
TTGGGGCCGGATCTGTTATTGCCCTGGGCGCTTTCCTGGGCACCGTCCTAGTCTACCAGTTCCGCCCCACGGAGA
GCGACAACTGGACGCCCTCTGCCCTGCTCAACAAGTATCGATCAAAGGCCGAGGACTGGGAGGCCGTCAACACTC
TGCACACAAAGGCCATGGAGCAGGCCGGCTATGACAGGAATCTGTTCGAGAACGGCTCCAACAAGCACCGATTTG
TCGACGTCGCATACCCCGAAGCTCTCCAATCCCACGCCGCGCGAAACATCCAGGCCGGCCACCTTGCCAACATTG
ACCATGCTGTGGAACACTACCGACAGCAGCACCTGAAGATGGAGGAGAAGAAGGCGGCCAAGCTGGCGGCTGCCA
AGGCAGAGTAGTTGCAGTTGCTACAGTATATCCAATTTATAGAACAAAGTTT > SEQ ID NO:379 216345_300868_1 *Trichoderma harzianum*
ACGGGACGAGCGATCGATCAAGTCAGAGACAACAAATACCGAGTGGCGATGCCTTCATCCGATAGTCTTGGGAGG
CGGGCCTCACACGGCGCTGCCAGCCTGGCGACGTCGGCATCTTCTATACACGGCGCAGCAGTTGGGTTTCGAGAA
GGCCTGGGCTTGGCTGGAGTTGCGAGGAGGACGTTGGGAATCTGCTTTCTGCTATTGACGGTGTTTCTATGGACG
CTGTCCAACTTTCTCGCCAGCTTTATCTTTTCCGATGCAACCTACGATAAGCCCTTCTTCCTCGTCTACTTCAAC
ACCTCCATGTTCGCCATCTCTTTAATACCCATGTTTGTACGATATCTGCTCCAGAAAGGATTCCATGGCCTACGA
AGCGACGTCAGGCGCATGTGGGCGGAGCATCGATACCAAGCCGCCCAGGCAGTCCCGCGATAGATGAAGAAGAT
CACCTAGCTCAAGAACGCTTGCTAGTAGACGAACGAGACCCCATGGCACCAACCTCGACTCCTTCAAAAGAGAAG
CTCAGCTTCCGAGAAACCGCAGTACTGAGCCTGGAGTTCTGCATGTTGTGGTTCCTCGCAAACTATTTT > SEQ ID NO:380 216351_300868_1 *Trichoderma harzianum*
TGTTTCAATCCAAGCAAAACATAACGGGTGGGGATGGAGTCGTCAACAATACAGTGACGACGGGTAGAGAAGCTG
AAATCATTCTCAACCATTGGCTGGATTCCATGGACACCTTCGAAAACTGGTACGGCCACAATGAGGAATTTGTGC
ATAAGCCGAAAGCACTTCCTCAACAGAAGCCTCCAGAGATAAATAAAGTTTTCACGATTAAGAAGGAGGACTGGT
ATCTGGCTATTAAAGAATACCTACTAGTTGCTTATACTTGGTATTACTAGAAAGAAAACGAAGGAGGCGAATGTT
GTTAGCTGCCCTTATATAAGGCTTATTATAAGCGGCTTCCTAATGTTCTAAAGCCAGTTAAACAGTACTTTACTT
ATCTCAGTATTATCTCTGGTTTACCTGCGGTATGACTTAACCTTTGGGGTCTGGTAGTTATAGTATACTTAAATA
GTGCCTGGAGCTAGTTTACAGAAGGTAGTGATAGAGGATATAGAGTAATATTACTGGCTAAGAACTTTATTTTAA
CTATTAGCTAGGGGAGTATCAATGCT > SEQ ID NO:381 216354_300868_1 *Trichoderma harzianum*
GAAGCTCTATTCCAGAGCTGCAAGTGCACGCTTGGATACGAGCTCTGGTGGTTGGACTCGTTTTCACGATGTCCA
GGAAGTAGGGCTAATAACCCCTCGATCCACCCACGATTCTCTCCATTTTCAAAAGGTAATTCTACATTCTCTCAT
ACCTCAACCTATCCCACATGATGAAAATTTGAACGAACGGGCGGACATATCGAGCCTTGCTACTCTTCATCCCTG
AGAAAGCGAGGACGTACAATCCTTGTGGTGAAGGGGAGTGAGAACTCAGGATGAGATCTCGTCACCTGATCGTGG
TTCATAGGAATCGGTTCCTTGTTCAAGCTGGGATTGCGCATGTCAGCTAACATGTACAATGATAGGTACTTATTA
TACAAAGCTTTCTTCTTAAAAAAAAAAAAAGAAAACAAAAAAAAAA > SEQ ID NO:382 216355_300868_1 *Trichoderma harzianum*
CTTGCATCTCGCCATAAGTTTCATCTCAAACATAGCGGGTTGCTTCCTAGTCTGATAGCGGCAAAATCTCACACT
CAAGGTTTTACTGCGTATCCAGCATACTGCCTCCGCTCTCTCACACCATCTCACAAGACAACGTCAAAAAGGGCA
TCTTTTCACAGCACAGCAATAATGAGCGCTCTCGAGGAAGACGACTCAAGCATCTCCGCTCAGATTGCTATCGAG
GATAAGCTCGCGGCGCGGAAGGAAGCCAAGAGGGGGTGGTAGAGGAGGCAGAGGAGGCGGCGGTGGTAGCCAGAGC
AGAGAAGTGCAGGTGTCAAAGACGCTGTCGAAGCTGTTGAGACATCAGGCTGGGAATGCCGGCATCAAGCTTGAC
GCGGAGGGTTTTGCAGCTCTTGACGAGGTGCTGAATTATGGTCCCATCCGGTCTCTCAACGTCACTCTTGCTGAA
GTCAAGGAGGTCGTTGCCTCAAACGAAAAACAACGCTTCACCATGAAACTAAACTCATCACTCTCCGCCGAACTT

Figure 1 continued

GTTCCTTCAGATGACAGCGCAACCCCCTCTCAATACCTCATCCGCGCCAACCAAGGCCACTCCATCAAGATTGAA
TCC

> SEQ ID NO:383 216377_300868_1 Trichoderma harzianum
AGAGCATCTGAGGCTGTACTGCAAAACACGATCCGCCATATGGTTTATCGAGGCAAACCGTCACCAGCCTGCGCG
CTATGTAGGAAGAGGAAGATTAAGTGCGATCTCCAGAGACCAAGATGTTCACAATGCAGACGAGCGAAAGAAACG
TGTACAGGGTATCGTGATCTTATTGATGTGATATTCCACGATGAAACCAACTCGACCAAATCCAAAGCTCTTGCC
AGGATCTGTCGCGCTCAAGCCGAAGCCCATGCGGATAATAGTATTGCAATCAACAATGCCATTTCTTTGTGTTTC
CTGCCATACAATATTGACGAACAAACCAAATCGTATTTTGTCCATAGCTATGTCCTTATCCAAGAAGGCACTGCT
GGCTATCTATCCGGCGTGGCTCGACTGCTAGTTCGACCAGGCCTCAACAGCGCCTTGGAGGCGGCTATGGTTGCA
GTTGGTTCAGCGGGGATGGCGTGCAAAGAATCATCACCACTTCTGGAGCTGAAGGCAAGGCAAAGTTACGGCATT
GCTATAAATTACATCAATGAAGCGATCCACAACACGGCCAAGATAAAAGAGGCTGGGACGCTCGCCGCCATTCTG
GCACTTGGGCTTTATGAAGTCAGTGACA > SEQ ID NO:384 216408_300869_1 Trichoderma harzianum
ATCAATCTAATCGCAAGATCGCAGCTCGGGCCCAAAATCAGTCAAAATGGCCCCTCAGAAGAAGAGCAAGAAGGA
TGCCAACAGCATCAACTCCAAGTTGGCGCTTGTTATGAAGTCCGGAAAGGTCACTCTCGGCTACAAGTCTACTCT
CAAGTCTCTGCGATCCGGCAAGGCCAAGCTGATCATCATTGCTGGCAACACTCCTCCCCTGAGAAAGAGTGAACT
CGAGTACTACAGCATGCTGTCCAAGGCTCCCATCCACCACTTCGCTGGTAACAACATTGAGCTCGGCACTGCCTG
CGGAAAGCTCTTCCGCTGCTCCACCCTTGCCATCCTGGATGCTGGTGACTCTGATATCCTCAGCGACCAGCAGGC
TTAAATAGCCGAAATCTAGTGCATTCAAAACGGCGTTGGGGGTAAAACGGTTCAAGGGCAATATGGATACCATAC
ACTTTCACATTATGTGCGAGACGAAAACTTTTGATGCGAGACATCATCTACTAGGAAGGCAAATCCTTTGGGGAT
GGAAAAAAGCCCCAGAAATTTCCAAGTGATAGTTATCTCAATGGAATAATACAGCCATGA > SEQ ID NO:385 216461_300869_1 Trichoderma harzianum
AGCCGAGTTAAGCGGCGATAGAAGCAACAGAGGTGAAGTTGTGCCGGTCTGGTGGTTTATTGGAAAGAAACGAAG
AGAAGAATGTTCCGGTCAAGGGAAGCGGCCTTTGGTCAGTAGCCAAAGGGCAGATCAAGCGCCGCCTTGGAGGAT
TAAAAGGGCGGCTGCAGGGGTCCCAAGGCTGGTGCGCCTCATGGAATTGTATCGAAGAAAGTCGATGGTGTGGCG
GTGCCCGATAACGCAAAAAGCTGGCAACCTTTGTGCTGCCATGCGGGCTATCAGCGGGTACCGCCGAGTATTTGT
TTGTCACTGTACAGAGGCGAGACGTGAGGCCGAGATTCGCATTGGTTCGGAGTCTGGAGTAGGGAGGACAATATG
GTAGCACGATTGTCATTGTGATTGCTTTGTTTATTAGTACTTAAAAAACAAATAAAAAACGAAAAAAAAACAACCA
C > SEQ ID NO:386 216463_300869_1 Trichoderma harzianum
GCCAATAGGTGGCCTGCAGGCTGTTTCTGATACAAATCCTCGTAATGCACAGACGTGAATAGTGCTGGCACAAGT
CACATTGCTGCTGCCTTGAAGGGTTCCATTTACATTTTGGTGCAGCTCTACCAACCG > SEQ ID NO:387 216464_300869_1 Trichoderma harzianum
GCCGTTCTCACCACAGCCTGCGCGCTCTGTCGCGGACCGGGCGCGCCTTGGGAGTGCGGATAGACAGCCCTTTGT
CGCAACAAACCGTTCGGCGGAAATCAGGTCCGTACGGCTACACTCAGGCCAAGGCTCTTGTCTTCTCCAAGAATG
GAGAGCCATCAGATGTACTACAGTTGCACACGTTTTCTATTTCGCCCTCGATTTCGTCCAAATCCCTTTTGTTGC
GGTCTCTTGCGGCTCCCATTAACCCTGCGGATATAAACACCATTCAAGGGACTTATGGCTCTCAGCCTAGCTTCA
CATCTTTAATAGGGACGTCTAGCCCGTCCGCCATCCCAGGAAATGAAGGTGTCTTCGAAGTTGTTTCAACGGGCG
ATCCGGCATCACCTATTCGCAAGGGGGATTGGGTCATCCCGGCAGTTGCGCAATTCGGCACATGGAGGACGCATG
CCGTTGCAGAGCTGGATCAGGTCTTGAAGATCGACAAGGAGGGACTGCGCGCGACTCAGGCGGCAACCATCTCTG
TCAATCCCAGCACAGCATATCGCATTCTGAGGGCATATGGCCCCAGCACTGGACTGGGAGGCATTGGAATGCGAC
CGCTGGAGGTGGGCAGTGGCGAATGG > SEQ ID NO:388 216471_300869_1 Trichoderma harzianum
GAACAATGCAGCTGGTGACAGGTTTGTCAAGTGGCAGGGGAGAATCGTATTCGTGTGGCGATGGTGATGTCGAAT
TTCGAATGAGGGAGCCTTGGCGCGAAGAAAAAAGAAGAGAGAGAGAGAGCGGAGAGGAGAGGAGAGGAGAGTGAA
AGAAGGAGAAGTAGAGAGGAGAGAGGAGAGAGACGCTGTGGTGCTAAGCAACCACGAGAGAGGAAGATGAATGCG
GTTTACAAGGTTGACATTGGCGAACGAGCTTGGACCGCTTTGACAATGTGATGTGATGCAGGCTGGGTACTCCAA
ATGTTTCCAATTGAACGAATATCCAATCAGACAAGTAGAGAT > SEQ ID NO:389 216477_300869_1 Trichoderma harzianum
GCTGTACATACGTAATTGCAGCAGGGAAACGGGGGGGAAGGACAGCCGTCGGTGATGGGACTGTCAGGTTCACGG
CCACTCCCCGGTCTGGCTTCGCCTGGGCTGGACTCTTTCACCCTGTCCTCTGTCTAATGCAATGCCAGCCAACGG

Figure 1 continued

CCACCGAAGTGCTGCATGTGCTTGCATACGTTGATGTCTCAGGGCACACACGGCATGCATACGAGTAGGTAGATC
C

> SEQ ID NO:390 216483_300869_1 *Trichoderma harzianum*
GTGGATGCGGTCGTCTCAGTTTACCTGTCCCATTTCTACTCATGCCATTCTTGTTTACCATCTGCATTGCTCTGT
CGAAAACCACAACTGCCTCGTGCCAAAAGTCATGACTCAGCAGGGAACAATTCGAAAGGCAGAACCTCAGCTAGA
ACGCCAGGCTTTCCTCCTATCGGGTCCATCAGCTTGATTCGGCAGCCTGCAATTGAATTGGCCATCATGTGGGGT
TCCGATGTGCAAAAACCCGCAATTGGGGGACCTTGTGCGAAGCTCCCGCTCTGTACAGGCACGGGTACAGGTAGA
GGTACACGTTACATGTGTCACGGAATACGGGGGCACAAGAGACAGGCGGAGAAGCCGTCCCGAACGAGTACCTGG
CGGCGAACAGATGGGCAGAGACAAGTGTCGGAATAGCCGACCTTGCATCAGTCCTTACAGTAGCGAGCGTTTGCA
CAACGCTCTTGGTATTGCTCGGGAATAAAACGTCGAAGGAGGATGTCATCAACTTGTTGGCTCAGGCAAGGTATG
TACGAGTACCAAAAGGTTAAGCATAAGGCACTCGCAGTGCTGCTACCGGTTTGTATGTACAGCCCGCAGGCATGG
AGGTCCAGGTTGGTGGGTTCGCGGGCTGTGTGTGTACATGTACTCGTACCTTGCAAGTACCTCGACGTTGTACCC
ATGGCAGGCCAATG > SEQ ID NO:391 219049_300927_1 *Trichoderma harzianum*
ATGGGATTGAATCGTCTTTGAGCCATGGTTGAAAAGTGCTTGGGGAGAGGTNATGGGGATGTGGATTATAGAGGG
GTTCATCGTATTAGCAATTTAGCCTAAATAGAGCTTTTGTCTCTGCTACTTTGAGGCGTTGCTAGCAAGCGGTAT
CTTGGCTCGGGATCGATGTATACAGTACTTGAGCCAAAGATGATATTGCTCTTGGCCATCCACAAAACTCCGTAC
GAGTACTCATACTTGATACTTCTCATCTCAAGTAATAGATGCCATGCCATAGAGGTAAGCAAGTCAACTTGAGGA
ACAGGGTATATACAGATTGCCATCGTTCATCTAAATTCTCTTCGTGCACCTCTTTACCTTTACATGCACCAATTT
GAGCACTACCTCCTCCCACTACCCCTGGCCACGAACCATCAACATCATCAGACAGCCAAGATAACGGCCTGACTG
CGGAGCCGGAACCAGACCCGGAGCAATGCCGGAGCAAGGGACTACGGAATATTCGCATGAGATCGGAGCCGGG
GCTTTGCGGGCCTTGGCGAAGCAATAGCCGTGTGTAAATCAAGTCTAGTACTACCTTGACCCTATCTACCTTGTC
TAGGATTTATACAGAAAATGGAAAATCAAT > SEQ ID NO:392 219053_300927_1 *Trichoderma harzianum*
CCCACGCGTCCGCCCAGGCGTCCGCTCTACTCTACATCAAAAGACCAGCATACAAACATTCACCATGCTTCTCAA
GTCTGTCCTCCTCACTCTCGCCATCTCTCTCGCCTCAGCGCAGAGCGAATTCGGCCGGCCCTGCGGCTTCAAAAT
TGCTCCCTGCCCCTTCGACATGAAATGCGTCGCCGACAACCCGTACTGCCCTGATCGCAACAAATGCCCCGGCCA
CTGCGAGTTCAAGAACAAGTACGCCTCGTGCGGAGGCTTCACCCCGAGACCGCACAACTGCGACGGCAATCACGT
GTGCCAGGACGACCCTCGGCTGCCTCCAAACTGCGGGATGGCTTGCGATATTCCGGGAATCTGCGTTCCGAAGAC
TGCTGAGTTTTGTGGAGGATTTGCGGGTTTTGCTTGTCCTGCGGGAAAGTA > SEQ ID NO:393 219080_300927_1 *Trichoderma harzianum*
AAGCCGCGTGTGTTTGATGGAACCCCTCATCTTGCGGCATGGGGGATTGTCCTCAAGAGGCCATTGGTTGGGACG
GGCAGAACAAGAGGCCATTGGTTGGACGATAGGCAGAGGAAGAGATTATTGGTTGGACGATAGGCAGAGGAAGAA
AGACGCCAAGTACTCTGTACTACCCTCACAAGGTAGCAGTCCCAAACACGCCATTCCAAGGTTCTGGGATCACCCA
GAACTGCCGAACGCAACCGCGCCCTTGCCCTGGAGATGGCGGGAGACGAACTGGTGTTGGTTGTGAGCGCCGCCC
CACACGATGCCCCGTGCCGATACGGAGGGGATAGATT > SEQ ID NO:394 219090_300927_1 *Trichoderma harzianum*
ATTAGGCATTGACAGCAAACCAATTCCCTCCATAACTGGGCCTCTTCACACCCGTACTCAGAATGACCGACAGAA
TATTCCGCATCTTTAACCCGGGAGAACCAAAGGGTGATCCCGTTGAGAAGAGGCGCGCTCAGCTGCGACGTGCCC
AACAATCTTATCGAGATCGCAAGGACAAGTACACCAAGGCGCTCGAGGCTGAACTAGCACGGTCTCGGAAGAGCG
AGGCGGGCTTGACGTTCCAGATCGAGCAGCTTCGTGTCAAAGTTCAGAAACTGGCCAGTCTCTTGTCCCAAAATG
GCATCTCACTTCCTCCAGATTTTGACAATGAGGAACAACTTCATGATGATGTACCGCGTATAGATTCATCTCCGC
TCACAACGCGTGGACAACCACAAACCGCTGAAGGCTTCCTATCAAGTACAGATTCAACCTCTCCTGAGTCGGTGA
CGGACCAAGGAGCTATCTTAAATAGTGGAAACCGCACTCTACGGCAGTACAGTTCGAGAATCTTTTCCCGACATC
ATGAACCGCAGGTTCCAGCGCCGACGAGGACCGTCCAAGATGAGCCCGGTGACAGGACTCGCCTTGCTGAACTTG
ATCCCACACAGGTC > SEQ ID NO:395 219159_300928_1 *Trichoderma harzianum*
CGAAACCAAGGAGTGGCTCTCTGAGGTTGCTGAGCATGCGCAGGCGCTCAAGGTCGATGGTGGCTTCGATGAGGG
TGCCGATCTGGGCCCCGTCATCTCCCCCAGAGCAAGGAGCGCATCTTGAGCATCATTGACAGCGCCGAGAAGGA
GGGTGCTACGATCCTGCTCGACGGGCGTGGCTTCAAGTCTGAAAAGTACCCCAACGGCAACTTCATCGGACCCAC
CATCATCTCCAACGTCACTCCCGACATGACCTGCTACAAGCAGGAGGATCTTCGGCCCCGTGCTGGTGTGCCTCA
ACGTCGAAACCATCGAC

Figure 1 continued

> SEQ ID NO:396 219178_300928_1 *Trichoderma harzianum*
GACTCATTGTTGGCATATGGAGCATCCCAATCTTATTCGTACTCATGTGATCGTCATCGCTCATCATGCTGACCA > SEQ ID NO:397 219215_300929_1 *Trichoderma harzianum*
GAGACGAGCAAGTTCGTGAGCGGATTATCACCCCGACTCATTCCTTATTCCATTGGGCCGTGGAAAAGGTACAGA
ACAGGCGAATACTGGTACAGATAGGTGGCGGCGAGGCAATTTTCTTGCTACCTGATGTATACATGTCTCCCTGGG
GAATAAATCCCGTGCATGTAGGTACAGGTACCGGTACTGGCACTCTTCGAAGTTCTTTTGCCTCTCTAACACAGC
ATGACGCTTCTCACAAGTGATTCTCCAGCTGTCTCACATCCAGCATCCATGTTCTCTGCAGAACTACAGACAGCC
AACCAACTGAGAAATCCTCAATGCAATCATCTGCCCATCCCAAGCAAAAAGTCTCACAAGGCACGTCCCGCAACA
CTCAACTTGTCTCTCCTCTGAGTCTCTTCCTCCCCCACATCTGTTGGGAATTTTGTTGAGGGGCCACATAAACCC
GCCCAGCCCCAGCGCCAAGGGTCCCCTTTCCCTGGCCCGTCGATCTGGCGTGGGGCACCCCGA > SEQ ID NO:398 219216_300929_1 *Trichoderma harzianum*
CGAGCAAACAGAAAGCAGCCCGTCATCCTTCGGGAACCCGCATGATCAGCGCCTGGCCGTCTGGGGGGGCTGAGA
GGTCGCTGGGTCGCGGGTTAATGAAACACGGGCTCTGCGTTTATTTGGTGGTGATCGACACTTTTGCCCTCGCAG
CGTGAGGACTTTTTGGGGTGAGCCAATGGAGAAATGTGTCGAGCATCTCCATCAACGCGCCCCAGATTTCATCAC
CGCTCTAACGTTAGCAAGAAAAAGGGT > SEQ ID NO:399 219218_300929_1 *Trichoderma harzianum*
GTGTGGTACAGACGCCCCGAGGCCGCCGCTGGTCCCGTGTCCAACGGGTCGCATGCCAGCAAGGCCAACCCAGC
CAGCTCTCCGTATCAGAACGTCAACGACTTCATCTCCAATGTCGCCCGATTCAAGATCATCGAGAGCACTCTTCG
TGAGGGCGAGCAGTTTGCCAATGCCTTCTTTGACACTGAAACCAAGATTAAGATCGCCAAAGCTCTGTAAGCCCG
AACCACCTCGCAACTCACTTGGTTCTGTTGTTCCTCTCCACACTCGTCTCATATGCTAACATCCCTACGGTGACG
AGTTTGGTGTCGACTACATAGAGCTCACAAGTCCTGTGTCTTCTC > SEQ ID NO:400 219224_300929_1 *Trichoderma harzianum*
ATCGCATCTACCGAACTCCGGGGTTCTCGCAAAAGGTTCGCACATTGTATTTTCGAAAGCGAAGATACACATATA
CACAAACAACTACAATATGTCGGAGAACCCTACGACAAACGGGCACGACGCCCTTGAAGAGAAGCTCGGCCGCCT
GGCTAGGAAACCCGGCATCAAGGCCAGCCTCGTTTTGGACCGAGCAACCGGCGCAATCCTCAAGACGAGCGGCCA
GATCGACGCGCTCCAGACGGCGAAATCGCGAAACGCGTCAACGGCGGCCTCATTCTCCAACGACGCTCCCGCAAC
GGAGGAGGGCGAGGCGCAGGGCGTCGAACAGTTTGCGGAAATGATCTGGAACTTTGTCAACAGCTCCGGGCAGCT
AGTCGGGGACATTGACACAGAGGACGAATTGAAATTACT > SEQ ID NO:401 219226_300929_1 *Trichoderma harzianum*
GGCTCGTCAACATCGTCCGCCATACCAAGAAGAGGCTGAGAATAAATCTGGTGCATGCAAAGAATGATAGGGATA
TCCCCTGGACGGAGGATAACAAGCTGTTTCGCGCTGCCGCAAGCGAGACGATTGGCACTTTAGATGACGATGAAT
TCGACACTTGGAAAGAGTCTTGCACAGTTCGAACGAGCAATGATTCGTTTGTGACTACATTGAAAACAGGCGATG
ACATTATCATTCGTCAAGAGCTATTTCCCTATGGCGGACACAATGAAATTCTGGGCTTTGCACCGGTCAGCTTGG
CCATTATGAGGTCGTTTGATCTTGAAGGCACCGCCTACGATTAATAGCGATGCCACATAGAAGGTATAGCACGCA
CATGACTGAATATTCGGTGCGAGTTGCGAGCTGTATACTCGTACGAACCACGTCGAGTCTAATGGCTGAATCATT
CAAACCAAATCTAAACATCAAGGAATTGAGCAGTTGTTTTGCAGGAATG > SEQ ID NO:402 48411_300376_1 *Nicotiana benthamiana*
GCCATTACCGGCCGGGGTTTTGATTAGGGTTTGTAGATGTAAAGAATTGTCCAATTAGGGTTGCATTTGACATTT
GTGGCATGTAATGGACATCTATATTATGAATGAAGAGTTTTCTGTTTTCTCTGTT > SEQ ID NO:403 48435_300119_1 *Nicotiana benthamiana*
GCCATTACGGCCGGGGATGACTATATTGAGAACATGGGCGAAAACCAGAAGGCCATTTACTATTTGGCTACTGAT
AGCTTACAGAGTGCTAGAACTGCTCCTTTCTTGGAGAAGTTGGTTCAGAAAGGTATTGAGGTGTTGTATCTTGTC
GAACCAATAGATGAGGTGGCTATCCAGAATCTACAAACATACAAGGAAAAGAAGTTCGTTGACATAAGCAAAGAG
GACCTAGAGCTTGATGATGACGATGAGGTGAAAGAAAGGGAAGCCAAGCAAGAATATAATCTTCTATGTGATTGG
ATAAAGCAACAGTTGGGTGACAAGGTGGCTAAGGTACAGGTTTCCAAGCGTTTAAGCTCATCACCATGCGTGCTT
GTATCTGGAAAGTTCGGTTGGTCTGCCAACATGGAAAGGTTGATGAGAGCGCAAACCTTGGGAGACACTTCAACC
CTGGAGTTTATGAGAGGGAGAAGAATATTGGAGGTTAATCCTGATCATCCAATCGTCAAAGACCTAAATGCTGCA
TGCAAGAaTGCACCCGACAGTTCTGATGCcaagCGAGCTGtacaacTATTGTACGACactgcatTGATctcaagt
ggaTttactcCTGATAGTCCagc

Figure 1 continued

> SEQ ID NO:404 48443_300376_1 *Nicotiana benthamiana*
GCCATTACGGCCGGGGGCAAGAGTTTGAGTGGGCTTTTCTTTGATAGCATTGGCACTGAACTCTCTCATTTCCCC
ACTGGACCTGCTCTCACTTCTCAGTTCTGGCTATGGTTGGTGTGCTGGCACTTGGGCTTGTTCATCTGCCTAACT
TTTGGACAAATTGGATTCAAGGGACGGACTGAGGACTATTTCTCAAAGTAAAATATTCCCTTCTGAAAATTTGTG
TATAAATAAGAAATACGCTATTTCAGTTCCTTAATATTGGTATTTTCCCTTCATTTCAGCATGTTATGAGCGTCA
GAAATCCCTTCTACTTTAATGTCATAATAACATATGACATTGTGTTATT > SEQ ID NO:405 48445_301343_1 *Nicotiana benthamiana*
GCCATTACGGCCGGGGCAGAGATGGCCTATTATAAGGCAATGGGAATTGATCCCCCTAATTCTACAACTACTTAG
GTGGGACGCTCACACGATTTAGAATGTTTGTAGGACGCCAAACGTTGTGTGCAAATATCTAATGATGGTTTAGAG
TTCCAAGTGGGTAGAAAGAAATTTCTGTATTCTCCTTGTTATTTGTTATTAGTAATATATATCATTTTGTGTC > SEQ ID NO:406 48469_300376_1 *Nicotiana benthamiana*
GCCATTACGGCCGGGGCGGAAGAAGCAAAGACAAGAGAAAGAAGCGGAAGAAGCAAAGACAAGAGACAGTAGTGT
GCTAGCTTCGTTGGAACCACCAAGCATTACACCAAGCCTTTCCTTGATGATTATTGGTGCAACTTGTAGTTAACA
TTGAGTGTCATTTGCTTATTGCATCAAATTAGGATAGAGGCCTCGGCAGGATGATGAGGAGGGCCTAAATACGAG
GCTGATCTCCACGTAGATCTGGTGACACCAGAAATCCCACAAAAGTGCGAAGGGTGTAATCACTTATAGCTCCTA
ATTCATTTTGTCATTCTACTTTTCCTTTTCAATCTTATTAACTCTTCTGTAACTTGCATATGCTTCTAAGCTCCA
AATTTTGATTCTAATTCATCGTTAGTTCCGAGATC > SEQ ID NO:407 57821_300037_1 *Nicotiana benthamiana*
GCCATTACGGCCGGGTGATGAAAAAGATGAGCCCTTTGTCCTTGAAAAAGATCAATGTTGGGTGCTGGCTGACAA
TGAAAATGTGAAGCCTAAGCAGGAAGCCAAGGATAGCAGAACTTTTGGCCCTGTTTCCTTGACGGACATAGTTGG
CAGAGCTATATATTGCTTGAGGACAGCAGTGGACCATGGTCCTGTTAACAACAGTCACTTTAGCGTCCAGAAGGA
TTCACCAGTCCTTGAAGTTGAACTGGATGTTGATGAGATGGCACGAAGTCACAAAGCATAGGTTGTGTGCGCTCT
TTGAGGAAAAGATTTCATAGGATTACTGATTTGGTTGTACCATCTTTTTCTTGTTTCCTCTTTTTTATCCGAGCG
AAATTCATTGGAAAAAATAAAAGTTGTGTATTAGTGATTTTGGTACACATTTTCCTTCGACCAGATGCTGTCATCC
CAAGTCTTTCCTCTCAATTGAGGCACCGAACCAACTGTAAACCTTTGAGGTCTTCAGTTCTAATTTGAACTTATT
TCAAggCTGAACCTGTAGTACGGATGGAAGTTTGCaa > SEQ ID NO:2256 DR - VX *Trichoderma harzianum*
TTAATTAACTCGACCCACGCGTCCGTGAAGATTTGCTTTGTTTTCTAAGTTCATTTGGTGCAATTGAGTCTTCTA
AAGCGTGCTGGTGCAACATTCAAGCTGACGTTGGATAAACCTTCAACCGTAACTCTTGTACCTCTCAAGACATCA
GAATCAGATGATGGATGGATTGATGAACTGACCTGCATCTGCCCACTCAACAATTTAATCCAGTCGAGCTTCTAC
AACGCCAATCTCAAAGCTCACAACTCTGTATTCACTCATCTTGACCAATTCTCTTTCAGTTTGACCTCAATCACT
CTTTCCCTCATGAAGACCGACGACGCAGTGTCACAAACCAAAAAAAATAAAAAAAAAAAAAAAAAAAAAAAGGGCGG
CCGC > SEQ ID NO:2257 216187FL *Trichoderma harzianum*
TTAATTAACTCGACCCACGCGTCCGCATTTATCGAGTTTCACAGGGCTTAGCAACTCCTGTCCGGGGGGATTGGC
AGATCTTGACAACTGAGGAGGACCGGATGCCGTGACGTGTAGCTGCTAGGATGAATCTTGGATTGGAGATTTGCC
AGTCGATTTGGATGGTGCCTTTCGGGATGGAGGGGTGGAGGGTGGAGAGATATGACTAGTGTGGAGGTATCACAG
CGTCGGGGGGCTGTGGAGAGTTCAGGGTAAGCCATTTGCGGCTTTCACGCTCAGTAACACTCGGGGGTTTAAAAC
TGACTGATGGCCCATCTATACCTTGCAGAAAAAATTTAGGTCCTCGCAAGACTCTCCCTAGAGCCGCGTCCCGTC
ACTACTGCTGCTTTGGCATCAAATAGTGCTCAATGGCTAGGCCGAGGGATTTGAAGACGATAGCAATGTAACCCA
TACGATCTGACTGACCGAAAAAAAAAAAAAAAAAAAAAAAAAAAAAAAGGGCGGCCGC > SEQ ID NO:2258 200671FL *Saccharomyces cereviseae*
GGAATTCCAGCTGACCACCATGAACGTAACATCGAATGCAACTGCAGCCGGTTCCTTTCCACTAGCATTTGGTCT
CAAGACCTCATTTGGGTTTATGCACTATGCCAAGGCCCCTGCCATTAATTTACGCCCCAAGGAATCCTTGCTGCC
GGAAATGAGTGATGGTGTGCTGGCCTTGGTTGCGCCGGTTGTTGCCTACTGGGCGTTGTCTGGTATATTCCATGT
AATAGACACTTTCCATCTGGCTGAGAAGTACAGAATTCATCCGAGCGAAGAGGTTGCCAAGAGGAACAAGGCGTC
GAGAATGCATGCTTTCCTTGAAGTGATTCTACAACATATCATACAGACCATTGTTGGCCTTATCTTTATGCACTT
CGAGCCGATCTACATGACTGGGTTTGAAGAAAATGCCATGTGGAAGCTTCGTGCAGACCTTCCTCGGATTATTCC
AGATGCCGCTATTTATTACGGCTATATGTACGGAATGTCCGCTTTGAAGATCTTTGCAGGCTTTTTATTCGTTGA
TACATGGCAATACTTTTTGCATAGATTGATGCATATGAATAAGACCTTATACAAATGGTTCCACTCTGTTCATCA
TGAACTATACGTGCCATATGCTTACGGTGCTCTTTTCAACAATCCTGTTGAGGGCTTCTTGTTAGATACTTTGGG
AACCGGTATTGCCATGACGTTAACTCATTTGACTCACAGAGAGCAAATCATTCTTTTTACCTTTGCCACCATGAA

Figure 1 continued

```
GACTGTCGATGACCACTGTGGGTATGCTTTGCCACTTGACCCATTCCAATGGCTTTTCCCTAATAACGCTGTCTA
TCACGATATCCACCACCAGCAATTTGGTATCAAGACGAACTTTGCTCAACCATTTTTCACTTTCTGGGACAATTT
GTTCCAAACTAACTTTAAAGGGTTTGAAGAATATCAAAAGAAGCAAAGACGTGTCACCATCGACAAGTACAAAGA
GTTTTTGCAAGAGAGAGAATTGGAAAAGAAGGAGAAACTCAAAAACTTCAAAGCTATGAATGCTGCTGAAAATGA
AGTAAAGAAAGAGAAATAACATGGCAATTCCCGGGGATCGCGGCCGC
```

> SEQ ID NO:2259 216131FL *Trichoderma harzianum*
```
CCCACGCGTCCGGAAGCCTGCATCGCCCGCCATGGCCATTACGCCGACCCAATTCGCCAAGAAGACGGCGCAGTC
GACCAGCTGGTCGGATGCGAAGCGTCGAGTCCTTTCTTCGTACCGCAATGGATCCGAGCTGCGCCTGAGATCCA
GACCATGTACAATGTCCCTCTCCCCATTTCTACCCTCCGAACACGGATGCGACAAGAGTTCGAGCGACACCGATA
CACGAACCAGCTGTCCATAGTTGACGTGCTTCTCTTCAAGTCCCATGCAGAGTACCAGGAAACAATGAACTTCTG
GAAGCAGCAGACTCACATCTTGTCTTATTTCGGCGAAAACTTTAGAGGTGACAAGAGGCTTCCGTCCAGCTTCAT
GGCTGGTTTCCTTGAGGGTCGAAATTAGAAAGACAATGCAAGAAAGTTTGTTTTGTAAATATCTCTGTATAAAGA
TTTTGTGCCGAAACCCTCCAATAAAAAAAAAAAAAAAAAAAAA
```

> SEQ ID NO:2260 216268FL *Trichoderma harzianum*
```
GACACACAGACGCACTCACACACTCAGCTTAAGCGAGCGAGCGAGTGAACGAGAGAGAGAGACAGAGATGGCGAG
TGTTGCCTCCTTCCCGGTGATCAACATGGAGAACCTGGAGACCGAGGAGAGGGGCGCAGCAATGGAGGTCATCCG
CGACGCCTGCGAGAACTGGGGCTTCTTCGAGATGCTGAACCATGGCATCGCGCACGAGCTGATGGACGAGGTGGA
GCGGGTGAGCAAGGCGCACTACGCCAACTGCCGGGAGGAGAAGTTCAAGGAGTTCGCGCGGCGGATGCTGGAGGC
CGGCGAGAAGGGCGCCGACGTGAAGGGCATCGACTGGGAGAGCACCTTCTTCGTCCGCCACCGCCCCGTCTCCAA
CCTCGCCGACCTCCCCGACGTCGACGACCACTACAGGCAGGTGATGAAGCAATTTGCGTCGGAGATCGAGAAGCT
CTCGGAGAGGGTGCTGGACCTGCTGTGCGAGAATCTGGGCCTGGAGAAGGGTTACCTGAAGAAGGCCTTCGCCGG
GTCGAACGGCCCAACGTTCGGCACCAAGGTGAGCAGCTACCCGCCGTGCCCGCGCCCCGATCTCGTCGACGGCCT
CCGCGCCCACACCGACGCCGGTGGCATCATCCTGCTGTTCCAGGACGACCAGGTGAGCGGCCTCCAGCTGCTCAA
GGACGGGGAGTGGGTGGACGTGCCGCCCATGCGCCACGCCATCGTCGCCAACATCGGCGACCAGCTGGAGGTGAT
CACCAACGGCAGGTACAAGAGCGTCATGCACCGCGTCCTCACGCGCCCCGACGGCAACCGCATGTCCATCGCCTC
CTTCTACAACCCCGGCGCCGACGCCGTCATCTTCCCGGCGCCCGCGCTCGCCGCCGCCGACGCGGCGGCGGCCGC
```

> SEQ ID NO:2261 216463FL *Trichoderma harzianum*
```
CCCACGCGTCCGGCCAATAGGTGGCCTGCAGGCTGTTTCTGATACAAATCCTCGTAATGCACAGACGTGAATAGT
GCTGGCACAAGTCACATTGCTGCTGCCTTGAAGGGTTCCATTTACATTTTGGTGCAGCTCTACCAACCGAAAAAA
AAAAAAAAAAAAAA
```

> SEQ ID NO:2262 219090FL *Trichoderma harzianum*
```
TCCAATTAGGCATTGACAGCAAACCAATTCCCTCCATAACTGGGCCTCTTCACACCCGTACTCAGAATGACCGAC
AGAATATTCCGCATCTTTAACCCGGGAGAACCAAAGGGTGATCCCGTTGAGAAGAGGCGCGCTCAGCTGCGACGT
GCCCAACAATCTTATCGAGATCGCAAGGACAAGTACACCAAGGCGCTCGAGGCTGAACTAGCACGGTCTCGGAAG
AGCGAGGCGGGCTTGACGTTCCAGATCGAGCAGCTTCGTGTCAAAGTTCAGAAACTGGCCAGTCTCTTGTCCCAA
AATGGCATCTCACTTCCTCCAGATTTTGACAATGAGGAACAACTTCATGATGATGTACCGCGTATAGATTCATCT
CCGCTCACAACGCGTGGACAACCACAAACCGCTGAAGGCTTCCTATCAAGTACAGATTCAACCTCTCCTGAGTCG
GTGACGGACCAAGGAGCTATCTTAAATAGTGGAAACCGCACTCTACGGCAGTACAGTTCGAGAATCTTTTCCCGA
CATCATGAACCGCAGGTTCCAGCGCCGACGAGGACCGTCCAAGATGAGCCCGGTGACAGGACTCGCCTTGCTGAA
CTTGATCCCACACAGGTCGGAATGGAATTTGTGCTCGCACTAGAAAGGCCTTGTCTAAACCATCTTCATGGAAAC
CCCAAAAAGCCCCTAGAACCACACGGCCATGCCTTGACACTAACAGTCCAGCTACAGGCCTCCTTGTCACTTCCT
CCGATCGATCCAAAGAACCCTGTACCTCCGTCATACCACAACGCTCCCGCAGCCGTACTCGATCGCCTATTGAAT
CTTGCCCCAAGTGTATCACCAGACGGCGACGTGACGCCGATCCAAGCGTGGCATTTTATCCGTCGCCAACCGCAA
TTCGGATATTTCGAGGTGCAGCGCCTCAACAGGCTGGCGGAGAGGTTACGGGAAGCAGCAAAGTGTCACGGGTTT
GGTGCTGCTGTTCAGACGGGCATCTTTGAATCGGCTGTACGGGAAATCCTCCACCCCTTGGCTATAACAGCAGCT
TGACATATACCCCAGAAATGGGGCTACCTAACCTACCTTTTCTTCTTCTTACAATTGTTAAACATTATTTACTCA
AGTATCCCATACATGGGTCACTGGCAATATTACATGGAGAATGATCTCACCAGAACGAAACAATATATACAACTG
CATAGAACCGTCATTTTAAACGTGTTCCTTTTTCAAGATTGGTACTCGAGATGAGAAGTTTTAATAGATTTTTTA
ATATCATTCTTCACCATTCAAAAAAAAAAAAAAAAAAAAA
```

> SEQ ID NO:2263 216062FL *Trichoderma harzianum*
```
GAACATTCAGCCTTGTGCAGGGGAAGCAGAAGATCATATAGAGCATTTATCAAGCGAATAACAGACCCTGAGACA
CTGAATCAGAGAAGCTTTAGAAGCTCTTCTTCTCTCTGTCTCCGCGCCTCTTATCGCAAACAGCCCCTCTACTGC
TGCTGCTGCCTTTGTCAGGCCTGTCTTTTCAGTGTCGCATGCCCCGCCTCATCTTTCTACCTTGCACAACTCAGC
```

Figure 1 continued

CTTTGCGCTAATCAACGACATCTGCGATCTGTGTCGGCAGCAGAAGAGTCCCAGATCACTGTCTCTCTTTTATTC
TCCTTCTTCTAAACAGATCTGTGTTGCCCCCAAAGCAAGCGAGAATACGTCAAGATGGCTCTTCCGAAACGCATC
ATCAAAGAAACCGAACGCCTTATGGCGGAACCAGTTCCCGGAATCAGCGCCGTGCCTCACGAAGATAACCTGCGA
TACTTTGACGTCGAGATCCACGGCCCTGCATCGTCACCATACGAAGGCGGCATTTTCAAGCTTGAGCTCTTCCTC
CCAGATGACTATCCCATGACTCCGCCCAAGATTCGATTCCTTACTAAGATTTTCCACCCAAACGTTGACAAGCTG
GGCCGCATTTGCCTGGATGTGCTTAAGAACAACTGGTCTCCTGCGCTGCAGATCCGGACGATTCTGCTTTCTATC
CAGGCCCTCCTCGGTGCTCCCAACCCCGATGATCCTCTTGCCCCCGATGTTGCTAAGAGCTGGAAAGAAGACGAG
GCGGCAGCCATAGCAACGGCAAGAGAGTGGACAGAGAAATATGCAAAGGCCTAGACTTAGAATCGGAAGACGAGA
GGCAAGAGGAAGAAAAGAGAGATATATGAAGATATATTTTCAAGACCTGCGATAAGTTTTGATATCAAAACGGAA
GCTTGCTATGGGGTACGAACATTATTATGGGAGGAGTTGAGAGATTATTCTTTTTTTCCATTTTCTTTGGCTTGG
TTGCAAATATTTTAGAAGGCTCAAATTTGTTTCGAGATGAGCCGCAAGCGTTACTGTCCGCGCTTCTATGGTGTA
TGTTTTAGATAGTACAAGTGGTCTTGCAGCAGATATACCACTGGCGCAATACATCATCACATTACACTTGCTGTT
TAGAAATACAAAAAAAAAAAAAAAAAAAAA

> SEQ ID NO:2264 216130FL *Trichoderma harzianum*
AAACAACCATGCCTCACAAACACAAGTCAAAAAAGGGCGAATTTGAAGCAGAATTCGATCTCGCCCCTACAGAGA
AAGCGCGATCTCTTCCAGTAAACAAACGAAAAGCGGCATCAAGTTCTGGAGAGCAAGTCACAAAGAAGCGTGCCA
GAAGCTCATTAAGAGGCAATGACACTCCGCGAGCATTCAAGAGAATCATGGCTGTGGCAGGGGGGAAGAAAATTA
GATCAGGCTTGGATGATGGTCAACTCGACAAAACGACTACGAAGGCTACCGATGTAACGAGCGAGAAACTTCAAA
TTCGTCCCGGTGAAAATTTAGGGGCCTTTGCCAGCCGGGTTGATGCGGCTCTACCAGTATCAGGGCTTGCGAAGA
AAACCAGCACGAATGCAGAGGGCAAAGACGCATTAGGATTGAAAGTGTATCGCACTCGCAAAGAGCGCAAAATGC
ACAAACTCTACGATCAGTGGAGGGCAGAGGAATCCAAGATACGAGAAAAGAGGGAGGAGGAGCTAGAGCGCATAG
CAGAACGCGACTTGGAAGACGATGCTGCCGGCATTCTTACTTCAGCTGCCTTCGAAAACGACAATAGCCACACGA
AAAAGAGGAAGGGGGGCAAGAGGAAGAGAATAGTAGAGGAAGACCCTTGGCTAGAATTGAAAAAGCGAAGAGGAG
AGAAAAAGGCAAAGGTTCATGATGTTGTATTAGCACCGCCGGAACTTCATAAAGTAGAATTAAAATAAATAGTAA
TATTAATATTAATAATATAAGAAAAAAAAAAAAAAAAAAAAA > SEQ ID NO:2265 213827FL *Trichoderma harzianum*
GCGGTCGAATAAACACCGACTGCATCTCCATCAGATTGCGCTTGGCGGCCGGGTCTACTGTTGCAGTTGATGCCG
CCCAACTCTGGCAAAACCTGGCGCTGCGGCTGCGGCTGGAGACCGGGGGAGCGATTCTGGCTGCCCAAACGAGAA
CCGGGGGGGATGTCAATGCACAGTTGCATCGAAATTTGGCGATTAATTTTTTTACGAGGGAGGATTAGGATTAGG
ACTTTGCACGGTAGTATTACTAGGACCCCTAGGCAGAAAGTTGGATATAGATTGCATTGGATGTTTTGATTGAGT
TGCCTTGCTGGGATGTTGAGAGTCTATCAAGCAAGCAAGGCAGACGAGGATGCCTTGTGCAGAGACGGCATTTCA
ATTCACTAATTGGATAAAATAGATATCAACGTATTATACAGAAATACTGCATGCAAAGTAATAACGAAAAAAAA
AAAAAAAAAA > SEQ ID NO:2266 213882FL *Trichoderma harzianum*
CATGTGGCCACGGGAATGACGCAAAAGGCGCCGAGAGCGGAAATGGAGAGAAAAAAAACCCAATTGCACCTCGTG
ATGATGCCACTCAAATGTCTGTGGTCGAGCCACTGGCTTCTACCTACGCTTACATTACCTAACAAGGAACGAAAC
ATTTTGCGGCAAGGAGAATTGGATCATTGACTTGGCGAATGGCCTAATGAATGTCGTCAATTGCAGGCCTCGTGG
TTTGGCGGTTGGATGAGAGGGGGAATTGGAGTGAGTGGGATGGGGAGTTGGAGTCATTGGATTCATTTGACAATT
GGTTATTACGAGCGGTTTAGGTAAGAATGTAACAATGGAACAGCAAAACGTGCACGCAAAAAAAAAAAAAAAA > SEQ ID NO:2267 214194FL *Trichoderma harzianum*
GGCAGAGCTACAACGGCCCTAGCACACAATTGGCCACAATTCACGCCTCACAATCGCCAAGATTGCTCTAATTCT
CGGGCAGTCAAGTCTTGTCAAGTCTTGTCAAGTCTCGAACTCGTATCCTTGAGCATATGCAGGTGGCGTCTGTGT
CTCGAGACAAGAGAGGGTGAACATGTGCACAGAACAAGGCACCGAAGCCGAAAGGGACAAACCGAAGCCGAGGTG
GGAAAAAGGCGCCACGAACCAGTATCCAAGAGTTTAGCCACTGTGTCCTAATAGAATCCCCCCTTCTTTTTTTC
CTTCAAAAAAAAAAAAAAA > SEQ ID NO:2268 214309FL *Trichoderma harzianum*
GAGGTGCTTGTTGTCTGTTTCTGTCTAGAGGTATTGGATGTAAATAAGATCAGCACGAGATGAGATGAGATGAGC
AGACAGACGATCAGATGGCGAGATTGAGAGGCAAATTGCAAGTGAATTTAAATTGCTTCGCTGGCGCCTAAATTG
GAAGCATCCATGGCTCGCCTTTTGCCTCCCCACGTGTGGAAAGTAGAGCCGAGAGCGATCCCTAGCGGCTATTCT
ATTCTGGCGGTTTGGAGTCAATCTGGCCCCCCGGAGATTGAGATGGTGGCTGTCGAGGTGCCGGATGGGATGGGA
TGGGCTTGTCTTTGGATACTTCATCTTTTCATCAAAAAAAAAAAAAAAAA > SEQ ID NO:2269 214411FL *Trichoderma harzianum*

Figure 1 continued

CGGATGGATACTTGCAGTAATATGGGGTAAGTGAGTGAGTGAGTGAGTGATATGGATACAGCGGGATGATGATGA
TGGTGGTGGTGGTGGTGTTGTCACTGATGTTGTCGAGTGAGTTGTTTGTTTTGTTTACCTTTGGAATTGATTGAA
ATGAAATGAAATGAAACAGCCCAATGCACAGCCTAAGTCCAAAGAAAACAAACCAAAAAAAAAAAAAAA

> SEQ ID NO:2270 214439FL *Trichoderma harzianum*
CGAAGCATATCGGGCTGAAACCCCCACAACGGGAAGACGGGACGATACGAGGCAATGAGGCAATTCAGCGGCCGG
TAGCTGTCGGGATGTTTTTTCCCCGGGGAATTTCGCGGTGGCTGACACTTGGCGTCTCGGGAAATGATTTGACGG
ATGGATGCCTAAGAAATGATCCGACTGATCAGGTACGGCTTATCGGCTGTTAATGACGCAGCATAAACAAGTTGC
ATGTGTATCCTAAGAGCATGCTCGCCAGATGTAGATGGACAGAGGGCACAAGGATTGGAAGAATACATTGCCAAT
AGTGGTTCATATAGGGAGTAACTACATGTATCTTACGCTTGAGCGCCTGCTTTTAAGTAGCTATGTAGTACAGAT
GGAGGAAGCACCAAAAAAAAAAAAAAAA > SEQ ID NO:2271 214441FL *Trichoderma harzianum*
CAAACCGGCAAAGAAATACCCTGCAGTCCTCGAGACTCGCGATAGAGCAGAAGTACATCAGTCTTATTTACTAGC
GAGCAAGACAGTCAAAATGTCGTGGGCGGGTACGGAGCTTGCGGATGCCCCGCTGAGAGAGAGGGAGAGGGCTG
ACGGGATTCTAGGATTCAAGAAGAATGTGAACCGCGCGACGACGCAGGTGATGATGAAGACGGGTGAGCAGCGTT
GGTATTCATTCGGTTGGGATAGCATTCTGATCTTGTGGTTGCAGGGCATGTGGAAAAGACAAACGATCGAAAAAA
AAAAAAAAA > SEQ ID NO:2272 214473FL *Trichoderma harzianum*
GCGAGGGAGAAACGGGTATGGGCTGGGGGGGCCGCACTAGATTCTTTGACGTGTCTTGTACGGAATTCCAGCGCG
GTGGAAGGGTGTGGCTGCTGCACGTTTTCGGGGGCCAGGTTCTTTACACTATTCCCACGGACAAGGTTCCCAAGT
GAGGCTGATGGAGGGTCCGCGGGCCTTTTGGGGGGGAGGGTCCAATCGAGTGTTGTTTGTGTGTTCACCAAGTT
CAAGTACATGGGTATGCGTATATTTCGGCCATGTATGCGCGATGGATTCCTGGTGTTCGGCAGCGAGCATGAGAA
AAAAGGGAAAATAGACTGCGAGAGAGAGAGCGACAAAAAGAAGGAAATGCTCCGATCACGATTAGGGGCGGAATT
GGAAATCCGAAAAAAAAAAAAAAAAA > SEQ ID NO:2273 214533FL *Trichoderma harzianum*
AGAAGATGAAGCCGGCGTTACTGCAACGGCAGTTTGGTAAGATCAAGTATGCTAATACGGTGTTTAGGGTGTGAT
AGTAGAGGCATCCGGCGAGGCGGCTGAGACATATGAGGGCGAAACAGGAGTAGAGGAGACAGTGGCAGCAGCAGC
AGCGTTAATGGCAATAACAATAGATGGCAGAGAACGGCCGGGCCCTCGGATTCCCTCTTGAGAGCGAAGGCGAAG
GTGAAGGTTCAGCTGATGGATAAAACCGGGAGACAGCCGAGCGACGCAGAGGATGTCAGGCGTAGGTTGCGTGAG
GGTGGCTGCAGAGGCCGAGAGCAGGTTCAATCAATGGGCGAGAGACGGCTAATCGAGCAGAGCGTGACGAGGAGC
GCGGCAATGGCGAGTGCGTGAAGGGGTGTTGATTCAAGACTGCGCGCGTGAGGGTGTGGGAGAGATGAGGCAGAG
GCCAGAGGCAGCTCAAAAGGGTTCAAAGTTGAAAAAAAAAAAAAAAA > SEQ ID NO:2274 214579FL *Trichoderma harzianum*
GGCTGACAGATGCTCTATGACGGAGAGGCGAAGCTGGGTCGAAGCAGACGGGCAAAGCGATTTGAAATGGTGAAC
AGGGGAGAATTTGCTCGCTGGCCAAGGGGGAAGAAATGATGAGAGAAAGATGAGAAGAAGAAGAAGAAGAGGGAA
GAGAATTGCTCCAGCGGGATGGGCAGAAGGTGGTGTAGGGACTTATTAGTGACTGAATGGATGGTTCCGGCGCGG
TAAATCCAAGTGGGTGGAAGTGACGTGCGGCTGCTGCGCCTGCAAGAGGCTAGCAGACAGCAGCTAAACAGGACC
TGGTAGTGGGTTCAGTATGTAATGCGAAAAAAAAAAAAAAAAAAAAA > SEQ ID NO:2275 214602FL *Trichoderma harzianum*
GGCGGATAGTTGTGCTATCGTTGTCTTCATGTTTTCATGTTTGCACATAGATACGAGAAGAGTTGTGGGAGTTGG
TTGCGTCATGACATAAGTTGTAATTATAGTATTTGCTGATTATAGCTGATTACGCAGGGTGTGTTTCCTAGTTGT
GTGGATGGATGTGTGTTGATCTGGCCCCCTGCATATTTCGGAGTAAATCATCCTCCCGATGGCTATAGTCGAGAG
GTTAATGGGCTCTACTCGAGTTCTGTCGTGTAACAGCATCCATAAAGACAGTCATAAAGAAGTTCTTGAGTCATT
TCTGATTCTCCCTGTCAACATCATGATTCATCCAACTGAGGAACCATAATGAGCTTGTATAAACACTCACTAACC
TCATTCTAGAGCATCCTTAAGAGGGTCTCTAAAAAAAAAAAAAAA > SEQ ID NO:2276 214623FL *Trichoderma harzianum*
TGTGAATTCGCGAGCGAATGAAACTCGTCGCATGCTTTGGATCCTGCTTCCGACAAGCTCCCACGACTTGGCTTG
GATAAACCTCTAACCTCCATTTTGGAATCGAGTGTCCTCCATGGCTCGAGAATAAGTCACATATTCAATCAACAG
TATACATAGTTGTAATCGATACACCAATTTCTACTGGAAAAAAAAAAAAAAAA > SEQ ID NO:2277 214637FL *Trichoderma harzianum*
ACGAGAAAAGGAACAAGCCGCGGGTTCTCAAAGTCTTCCGGTGCCGCCGGCCGTTTGGCTGCGGACCGAAAGGT

Figure 1 continued

```
GGACAGGAATCAACTCGTGATGAGATCCGGGAAATGGCGGCCTCCGCCGGGATTTGGATTCCATTCTTTCGTTTT
TTGTTGGTTTCTAACGTTGATGACCATTCAGTGGCGGCGGCTATGAAGGATATGATGAGAGGTGGTGCTTATGCC
GGTGTGTATCAAGTAACGAGTCCGCCTGGTCCAGGCATCATCATACGATCCATCAATCATAATCAAGGGGAACAC
AGAGGCAAAAAAAAAAAAAAA

> SEQ ID NO:2278 214666FL Trichoderma harzianum
CGACCATTACCATCATACAGCCAACCTCTACATAAGCACAAATACCATTCAAAATGTCTTACGGCGGTGACAACA
ACGACAACTCTCGCCGTAATGACGACAACTTTGGCTCCGGAGGAGATTCTTTCGGCTCTGGTGGAAACCAGCAAT
ATGGCTCCGGAGGAGACTCATTTGGCTCTGGGGGAGATTCATACGGCTCTGGTGGAAATCAATTCGGCTCCGGCA
ACCGCCGTAACGATGACAGCTCATTTGGTACCAGTGGCCAGGGCGAGTTCGGCTCTGGAGGTAACTATGGCAGCT
CTGGCGGTGACTCCTATGGGTCTGGAGGAAACACCTATGGCTCCGGCGGCAATGACAACTTTGGCTCTGGGGGCA
ATGATACGTACGGCTCGTCCCGTAACCAAGAGTCTTCTTTTGGATCCAGCGGCCGC > SEQ ID NO:2279 215373FL Trichoderma harzianum
TGGGGTCGCAAATCTACAGCAAAAATGGCCTCGACAACGACCAAGCAGACCCCGGCGTCCTTTGTCGGGACCAGC
AAGGTCGTCGAGACTGACTATCCGCTCATCGACAACGACCCTCACTTTAAGCGGGTTATCGGATATGCGAGAACG
TCAGACTACGTAGCTGGTGCAACCTCTGCGGCCTTTGCACCGACTGCTCTCTATGCCCTCGAGAGGCTCGCCCCG
TCGCATGTTGGCCGGGGAGGCTTTGCCAAAGCCATGCGGTTAGCCGGATTCATTGGCTTGGCCGGCGGTTTCCTC
TACTTTTACCAGCGATCAGCCCTTCGATTCTACGGCGCCACTGAGAACTCAAGGGAAGTCGAGATGGATATGCGA
GAGATGGTTTCCAAGGTCAAGGCGGGACAGCCTCTGTATGGCGAGAGCAAGCTGAGCCCTCACCTGCAGGGAGTT
GCGGCCCGACAGAGCAGATACTCTGCGCTCTTTTTCAGCACAGTACCGTGGTTCAACTTTGTCAACCACAACCAG
CACGGCGTGGACACGGCCAAGTACTATCAGCAGGCCGAGAGGGAACTGGAAGCAGAGCGGGCGGCGGGCAAGAGC
TAGACGGGACCAAATGTGTATATTTAGCGGGACTACCACTTCTTGCGGAGAAGGAAAAAAATATTGGAAGCTTCA
AAAAAAAAAAAAAA > SEQ ID NO:2280 214417FL Trichoderma harzianum
GTTTGTTAGCCTTTGTGATGCAATAGCATGTTGTAAGATTGTTTGTGTAAGTGAAGTCTATAGCAATGCCTGGAA
TGTGATGGAACATAGGAATACAGGATGGATGACAGAGTTGGTGATGGATATGTACACTTACCCTCGCTGATACGG
CACGTCGTCAACGGTCTGGTATTCTTGTGGCTGGACGATAGACATTGTTGCGGTTTTCGAACGGTTTGTTATGTG
CTTCAATGGTTTCTTGGCTTTGTAAGTTGTCACACGATCCAAATAACCCAAAATCACCAAAAAAAAAAAAAAA > SEQ ID NO:2281 214639FL Trichoderma harzianum
ATGCTCCACCATTGCTTGCCTTATCGCATTCAAGGCCAGGTAACGACACTTGCTGCTGAGTCGAACGCAACACCG
CCTTCAACAGCTCCTCTGCAAGTCTCCCGCAAAAGGACAGGCTCAGTCTTGTGTGGGCAGCATGCGCGTCATTGC
CCTTTTCTCGGCCCTGTGTGCCGCAGCTCTGGTCCAGGCCGATTTCCACACGGCGCAAATCTATGTGCAGCCCGT
CGAAAACTCCGAGTCGCCCAGCCTCCTCGCCGAAGTGGCATACGATCCTAGCATCAGCGGGTCGTCCTCTATCAT
CTCCTACGAAGCTCCTGAAATCCCGGAGTCTACACAGCTGGTCCGCGTCGGGTTGTACGACGTCAAGTCTGCGCG
ATGGATATCTGGCACAACTGTTGCCTCGGTGGACAACTTTGGCAAGGGCTACTCGCCCAATTTGATACTCTCAGT
CGATGAAAAGGGAGAGCTTCTCAGTGCTGCTCTCAAGGGCGTAAGGATCGATGCGGGTCAGACGAGAGACTTGGC
CCGCAAGCGGTGGTGCTGCCGGTGCTCAAGGGCAAGCAGCCAGAGCTGAACAAGCCAATTGTTCTATCGCCAGAG
GGGAAGAAGGTTGAGGAGGTTGAGAAGACGCCCCTTCAGAAATACTGGTGGGTGATTGCCATTATAGTGTTCCTG
GCAGTGAGCGGAGGAGGCGGCGAGAAATAGAGCCGGCAATTGACACATACTGTACATCAATCTGAATATACGCTT
CCGTGATGGGATGACCGCTGGCAAGGGTTGAGCTGTTACAGCTGTCAGTGATCCCTGTCCTCTCACCACTGTCTA
GGTACATGACTATATTGTTTGTCTTTGATACATAATACCCTATAATAAGACTATTGCCTGTTCAAAAAAAAAAAA
AAAAAA > SEQ ID NO:2282 215595FL Trichoderma harzianum
CTCACTACAATAAAAACACAATCTTCAATTCTTTGAACCTTTTTCAAGTTTCGCCAACATGAAGTTCACCACTAC
TGCCGTTCTTGCCATTGCCGCATTCGTTGAATCGGCCACTGCTCTGGGCAAGGCCCGTGTCGTCAACAAGTGCCC
CTTCAGCGTCACCACCTGGTCCGTTGGCAGCGCCATCTCCAACCCAACAACCCTTGCTCAAGGCGGTTCCTATGG
CGAGACCTTCTCACGAGACCCCGTAACCGGCGGTCGTGCCATCAAGGTCACCGTCCAGCCCGATGGCCTCTACAC
TGGCAAGCCCCAGACCAACTTCGCCATCAACCTTGAGGGCAACACCATCTGGTACGATCTTTCAGATGTCTTTGG
CGATGCCTTCAACGGCCACAAGGTCGTTGTTTCCAGCGCCAACACTGCTTGCCCCAGATTGTTTGGGGCAGCGG
AATCCCTCCTGCCGGAAGCCAGGTCAAGAACTGCGGTGCGGATAAGGATGTGACTTTGACTCTGTGTGCTTAGAG
TTAAGGGAGGACGGAATCATGTCAAGGGAAAGGTTTAAATCAAGTTTATGATAGAATTTCAAGTCCTAGCTATGT
TTAAGACTTATGACAGTATGAATTGATGAGTTTACTTCGAAAAAAAAAAAAAAAA > SEQ ID NO:2283 214307FL Trichoderma harzianum
```

Figure 1 continued

TGATGATGAATAGAATGATGGACCAAGGGAATGGTTGGTAAGATGTTCTGGGAGGAATCTGTGTTTTTCTCAGGG
TGAGAGTGTATAAATGTGTAGCGTGTACATGTGTTGAGGCTCGTCGATACCCGGCAACATGATGACTGTGCGCCA
CCGGCCATTGATTTGTGCTGATCTCTGCTTGATGAACACTGCCCTGTTTACACTGTCGTGTACTGTTAGTATGTC
CATCGTGAAATGGTGGTGTGCGATGTTTGTCGCGGGCTATGAAGATAAAGCAATGAGAAAAAAAAAAAAAAA

> SEQ ID NO:2284 214438FL *Trichoderma harzianum*
CCTGGATGGGGTCCGGACTGGTCTCACTGGATTTTCTTCTTCTTCTTTGGCTGTCCTCCGGTTCTTTCGGGCTCG
GGCTCTGGCGGTCTTCGCGGCAAAGGGAGATAAGAGCCCACGTGCGAATTTACGAAAGCCCTAGCGCTGATCGGG
TTTAAAGCAAGTGACGTGATGAATCCGAGTTCATTTGCATAAAAAAAAAAACATAAAAATAATAGAGCCAGAGATT
TGCCGACCAGGGCAGGGGGCGCAACCATCTTCATCGTCCATCTTCGAGTGTGTGCCACCCGGAGCAGCAAAGACG
GTGCCTCGGCCAAGAGTCAAATGTCAAAAGATGGAGATGCAATATCACGGAAGCCGAGCTCCACTTGATGCTCGG
GCGGCAAGTATTACACAATGGCAAGAGATCCGGGGTAAACACCGCAGTCCCGGCCGATCCTCGAGGCCTATTGGA
TGAGCGTTCCGGCACCCAAAGGGATTTTTCGGAACCGATGGTCGGGGATTCCCACCCCCAGCTTGCTTTCTCCCA
TGTGTCTGTGGGCCAGAACCAGAATGCGGGGAGTAGATACATAGATCTAGAATTGCCTTGAGATCTCCTGATATT
TGAAGAATAGGAAATTTTTTAACCTTTAAAAAAAAAAAAAAAAAAAAAAAAAAAA > SEQ ID NO:2285 214613FL *Trichoderma harzianum*
CGAGAGACTTGCGCTTCGGCCCGGCATTTGCACATTTTGAGAACCGAAACGAAGAAGAAAAAGGATAAAAAAAAC
ATGGCTTCTAATCAGTTTGATTCCCAGGCCTCGACCAACTACAAGGAGGCTTTTGCCCTGTTCGACAAGCGCGGC
AACGGTCGCTGTGCCGTCGACTCGCTGGGCGACCTGCTGCGAGCATGCGGCCAGAACCCCACGCTGGCTGAGATC
CAGGAACTGGAGAAGGGCCTTGGAGGCGAATTTGATTTCGAGGCCTTCCAGCGCATCCTGAACCGACCCGGCGGA
TTCCGCGACCCTGGCGAGCCCGAAGAATACTGCCGTGGCTTCCAAGTGTTTGATAAAGACATGACGGGCTTTATC
GGCGTCGGCCAGCTCAAGTACATCTTGACCAACCTGGGCGAGAAGATGACGGAGGAGGAGGTCGACGAGCTGCTC
AAGGCCGTGGACACCAGCTCTGGCCAGATCAACTACACAGATCTTGTCCGAACTATCCTCGCCAACTAAGATTCC
CCTTGTACGAAGAACCTAACCCCCGGTGGTATCTAAGTGCATCTGCGAACGGGATGGCGTTGCTATGTGTTTGTT
TTGATTATGGCAGTGAAATTGGGCACGCTTGGGATTGATGAATTTTTCTTTTGTACGGGATGGCCGTAGACTTTG
TTTGCTACCAGTGGAATATGAACATGTGTTGGTACTTGGAGTGCACAATGAAATGAGTCGGCCAAGCACTAAAAA
AAAAAAAAAAAAAAAAAAAAAAA > SEQ ID NO:2286 215114FL *Trichoderma harzianum*
GAACAAGCCACATCGGGGAGACGGGAAGATGGTGACACGGATGCGTTTGTGGAGGTGGGTAAGCTTTGCGCAACA
TGTGCCAGCCTTATCTTGATATTGGACGCGGCGACGGCGAAATGGTTGGAAGGGTGTGTCTATGTGTACCGACAA
ACGCATGGCTGATGAGACGGTGAATAAAACTGCACCAAGAAAGAGATGCATGAGAGATGAATGACCAGTACCTAA
GGTCTATGACATGTCGCTTTGCACTCGGTCGGACTCATTCACATGTAGTAAATACTACATAACACCCACTTGCTC
CAGTAATCATCACTTATAATAATACGGCGAGAAGACAAGTTGACACAGGGCGAAACAGGGCGGAACAAGGCAAAA
AAAAAAAAAA > SEQ ID NO:2287 215669FL *Trichoderma harzianum*
AATCAAACTCTTAATCTCTATTCTTAAATACATCTACCTCTCACAATGGATTTCGTCAACAAGGCTATGGGCAAG
GAGGAGCGCTCCACTCAGGGCACCGCTCCCGCTGCTCCCCAAGCAGGCGGCCAGGTCCAGAAGGACGATTACGTC
GACAAGGCTTTCGCCATGGGTGCCAAAAAGAGCGGCCACAACATGGATCGCAACACACAGGAGAAGATTACGGAT
GCAGGCCGTAACATGTACGAAGGTGACAGGAAACAAGGTCGACCCCAAGTGGTCTAATTAATGAACGGACGAG
TTATGACTCACAACAAGACTGTACAATAGTAATAATAACATCTTACCAAAAAAAAAAAAA > SEQ ID NO:2288 215670FL *Trichoderma harzianum*
ATAAATTCGAGGTGTTTTAGACGCAAGCTTCTCTTTTACACACTGAAGCTGCTGCTGCAACCATCACCAACATAC
CACACGCAACAACACAACACCACCACGTAATAACGAGCAGAACACCCCTCGCTTGAACTTGTTGCAAAAAACACT
CTCGCCTCTATTTCATAAATCAAATTACACACGAACAAAACAATGAATCCAACAGTCAGAGGCTTCTCAACCGCC
GCAAGAGTGCACCCGCCCTTTTGCCACATCTCCGCCCATCGCCGCGCCGAGCCCCGATCCGACGCTGGTAAGCA
CTCAACTCTCTCTCACGTCCCCCATCCATAAGGATACCATAGCAGCAAAAAGACACAACCAAAAAAAAAAAA > SEQ ID NO:2289 212363FL *Trichoderma harzianum*
TCTTACAGTATCACTACTCCATCTCAGTTCGTGTTCTTGTCATTAATTAACTCGACCCACGCGTCCGCCCACGCG
TCCGCCCACGCGTCCGAAACAACCTTCTTCATCAATTCTACTACAACGACCTTCCTACTTAAACAATCTCTCGAT
ACCAACTCCCCAAGATGAAGTTCACTCTCGTCCTTGCTACCTTTGCCGCCGTCGTCTACGGTCAAACCATCGATG
ACATTCCCGCATGTGCTCGTACTTGCATTGAGAACGCCGTTCTAGCCGCTGGTTGCTCGTCTGGAACTGACGTCG
CATGCGCTTGCGCACATTTCACTGCTGTTCAGAATGGCTCTACTAGCTGTGTCATTGCTGCTTGTGGCGTTTCTG
TCGCCATTAACCAAGTTCTGCCTGCCACCCAGGCTCTTTGTGCCAACCAGTGAACTCATCCATCGAGAGGGAGAA

Figure 1 continued

AATGACATGGGAGAAAATCAGGTACTCTTGTACATTGACAAACAAGTACATAGCTGAATGGTGTGAATGAATAAA
ACGCATTGCTGCTGGAATAAAAAAAAAAAAAAA

> SEQ ID NO:2290 214267FL *Trichoderma harzianum*
AGAGCATCTTCCTGACATGCCGGGGTTGATGCAACGCTTTGACTGTATGGAAACATCCGTATTGCTGACATACAT
GTCTTCCATGTTGTCTTACACTGCACTCAGGAGGAGCAGTCATCCACCGAGTTGATTCACATGGCAGCAAAATTG
TGCTGGATCTACTGCAGCGCAGATCCTCTATTTGGGCATTTCTTCTCGGAGACAGACACAGATCGGCTCGGCGAA
CCCGAGAGCAAGTGATAGCAAGACAAGCACAGATATGCTTGGCGAGGCTGTCCTCACCAGGAAACGAAAGAGGAG
GTTTCACCAGCAACTCCATTCCCAGCAGAGGTCAGCCTGTCCTACCTGTCACATTAGAAAAAAAAAAAAAAAA > SEQ ID NO:2291 212454FL *Trichoderma harzianum*
AGATACCCTCCCCTTCTTCTTCTCTTCTTTCCCCCCCTTCACATTTGTGTCTTGACGTCGTATTTCGCTTCAGCG
TCATCCCCCATCACACATACACACATAGCAACTTGCCGACGTCATGGCTGAGCAACTGAGATACGACGGCCAGGT
CGTGGTCATCACCGGAGCTGGCGGTGGTCTGGGCAAGGCCTATGCCACTTTCTTCGGCTCTCGAGGCGCCAGCGT
GGTCGTCAAACGGAAC > SEQ ID NO:2292 213911FL *Trichoderma harzianum*
AATAGAGGGAAAACAAGAAGCGCTGCTTAGCCCCGATCATGCGTACAATCTTCACACACTTGTGTCAGCTCATAC
CAAATCGAGCTGGGATTGGTTGCCTCTGATTCGGGGGGTATGGCAAGAAGGCACATGGTCTGGAAGCCCTGAGAA
TGGCCGCTGATTTCGTCTGTGGCCAACACGAGTTGGTGCCCGACGTGGAAGGCATTGCCTCGTCGAACCGCAGAG
CAACTTTGCTCATAAGACAAACTATGAGCGCTGTGTAACATATCCTTTGCGAGATTCGGTGTGTGATCGCTGGCT
GGGCGGGGAAAAAAAAAAAAA > SEQ ID NO:2293 212492FL *Trichoderma harzianum*
GTTTCGGAGGCTGATTGAGTCGGAGGGGCTGCCTTATTGCGGCAGAGGAATAGTGACGTCATGACTATCAAGGAC
CCTGGAGGTTACCTAAAAGAAAAGCATCTGGACGAGGTGACGTAGCCATCAATGCGATCGATTGTTTGCTCTATC
TCCTCGGGTCGGCTGTTGATTTAGTATTAAACTAATGGATATGAATAGTGTTAGAGTGTGCGAATGGATCTCATT
GTTTGAAAAAAAAAAAAAAAA > SEQ ID NO:2294 213120FL *Trichoderma harzianum*
GTTTGGCTTGCAGTAAGACCGGCTTATGAGAAAGACCATTGTGAGAGATGTAAGGCTGATCCGGAGCTCTACGTC
ATCTGAGACATGACATTGGCATGATGAGGGTCCAGTAACTACCTGATGATTGGGGTAATCGAAAGAGATGCAGAG
AGAAACACGCAACTCTGAGAAAGCGTCCCGTTACACACGGAACACACTGCCTCCGGACAGCGGCTTGTGGCTCAT
TGCTTGAGTCCCTTAATCAGCAATCCCCAGGTTCTCTTGACAGCTCAGCGGTGCAGTTTTGCGGGCACAGCTGAT
CCACCCGTCAACGGGGCGGGACGCCGGGAAGCCGGGACTCCGGGGCTAAAATGACATCGCCATGACATCCGCACC
GTCCGACCAGAACTGCTACTACTCAAGACGGTAAGCAAGTGCTAGCAAAAGTGAGTTTTACGAGGTAAGCAAGTA
GGAACGTGGCTTATAAAGCCACAGCTAGCTTGAGGCGAAGGCTGCTAGTAGGAACTAAAGTCAGCTTATACTATT
TATAAGCTCACTGCATGGGCTAGTAATAATAGCTCAAAAAAAAAAAAAAAAAAAAAAAA > SEQ ID NO:2295 213894FL *Trichoderma harzianum*
CCCACGCGTCCGGCGTGAAGATAGGAGAGAATAGAGATAGAGAGGCAATTGCACGGAATGTTTAGCCAACAAGTT
GCTCGTGGCGGGCGCCGCATCGGCCAGATGGCTCGAGGCGGCCAATATCCGTCACTCGCTGCGCTCAGAGGAGCT
GCTCAACGACGATGTTATGCTGAGGCTGCACAGGCAGCCCCAAGGGACGTATCGGTCGAGGCCTCGGGCTGCTC
CTGTATGGCGTTGCATTTAGCGGCCTCGGAGCAGCAGCAACATTCTATTCGATGGTACAAAAGGGTTTCGCCTCG
TTCACCGACGCCGAGTCAGCCAAACTGTTTGTCCCAGATAGCGACGAGCTGCAACAAATCGAAGAGACAATCAAC
AAACACCCGCTCGTCCAAGAGCTTCGATCACGACCAGAGTTCAAGGAGTCACGACCACACCTAAAGATGTCAAGC
GAAGTCCGCAGCCGCACCCTCACCGGCGGCGCTCTACAAGGCGACGGCATGATCATGGTCCCCCCCGTCGCCTTC
ATCGAGGACGGCGGCAAGTCCATCGTCAGCGTCACGTACATTGGCGACAAACTATGCGGCCACCCAGGCCTCGTG
CACGGGGGCCTGCTGGCGACGATGCTGGACGAGGGGCTGGCGAGGGGCTGCTTCGACGCGCTGCCGCACAAGATT
GCCGTGACGGCGAGCCTGGAGATCAACTACCGCAAGCCGACGCAGGCCAACAGCTTCCTGGTGCTGCGCGGCAAG
ACGGTCAAGGTCGAGGGGCGCAAGGCCTGGGCTGAGGGATGCATTGAGACGTTGCCTGCGCCGGGCGAGAAGCCG
GTCGTTTTGGTTGAGGCGAAGGGATTGTTCATCTCTCCCAAGTATGCGGCGCTGATGCCCCGAATTACCTAAATG
ATACATGCGGTGGAGTATAATGGCGAGATGAGAAGACGAGCGCATAGAGCTGCGAAGTTTTTGTTTTGCACCCAT
TTTTCTATGTTTACTTTGCCCTTTTTGACATTTTTTGGAAAGCGACGGCGGGAATAGATTATACATACTAGAACT
GCACATATTTTAACAGCGAGGCAGTAGACGCCGTGCTAGAAAGCAGAGAGGAGATTGCTTGTTCGTCTTTGCAGC
AGATGGAGCTGAGCCAGATGGGCGCTTTACATGATATACCTCTAGTAAAAAAATAAAAAAAAAA > SEQ ID NO:2296 213967FL *Trichoderma harzianum*

Figure 1 continued

AGCAAATACCGCAAAGATGTCTGACGACGGGCTCTCAATATACGATGAGATCGAAATCGAAGATATGACCTTCGA
CGAGGTTCTTCAAACATACTTCTACCCGTGTCCCTGCGGCGATCGTTTCCAGATCGCTATCGATGACCTGCGCGA
CGAGCAGGATATTGCTGTGTGCCCCAGCTGTAGCTTGATGATTAGAGTTATTTTCGACCTTGACGACTTACCCAA
ACCTCCTCCTACTGGCAATACTGGTGGCCAGATACCAGTCGCTGCTTAAAGCCATCGCTATATTTGAGCTTCCCT
GGGCGAATACTTGATCTATTCGGCAGACACATCGAGATACTACACTAATTAGGCCCGCATAGCGTACACAGTGCC
TCAACGGCCGTTCTGAAGAGGCTTCTCAGATTGATCCGTCTAACATCGGATGTATTGATAGACGCGGACGAGAAG
ACGACGATGTACCAGCGACAGACCAAAGTCATCCCAAGCATCCAAGCTACTGATGCAAAAATATGCGTGCCTTGG
GAGTACCACTCTCCGAGGCAAAAATTCAGTCACTTAAAGAGACAGGCTTCGGGAATGCCATGAAGAATTCAGGCT
CACGTGGGGACATTTGATGAAAGAACACTGCCGAGGCGTTGGCAATACAGAATGGACCTATGAAGGACGGCCAT
TTCACTCATATACCGTCAACATAACAAACCAAGATACCAAGGGTGTATTACATATTCACCTAAATTCCATGAATG
CAAACTGAAAAAAAAAAAAAAA

> SEQ ID NO:2297 214087FL Trichoderma harzianum
CAAACAACGAAACAACCGCCCAATCGCCAATCGCCGCCTCGACATGGTGCTCGGCGACTACGAGGAAGCACAATA
GGCGGGACGCGAAGCAAACAAGCGCTGGGCGTCTGAGAAGTAGCCCGAGAGTCACAGCTACAGCTACAGCTACAG
TGAACACGCGATAGAGTGATTCAGGACATCCAGAGACGAGACGAGGCGCCTGAACGAGATACGAAGCAAACAGAC
ACGGGAAAGCAGATGCAATGTCGGCAAACGTAACAAAGCCGGCGCCCAATCGGCCGCAGCGGCGCGTAACGGCCG
GCCAGATCCTGTCGATGCCGCCGAAATGGCTCGGCATGTACGACGAATTCATCACCAAGAACGCCGGCCAGGTGT
CGCAGATTGAGAGCGCGCTGAGGAGCTTGACGTATATCATTCCAGGCCGCTTTCGCGATGCTGAAATCGCCTCCG
AGTCGATTCACTCGGGCGTCCAGCTGCTGTCGCTCTACCACGACGGCATCCTCTCGCAGGCAGTGTCCAAGCTGC
CCACGCCGCCTGTCCGGTCGGCTCATGCGCGCTACACGCGATACTGGACGCAGAAGAGCAAAACGTACCGCAGGA
TAGCCATGGTGCTGCAGATGGTCGTCTACACGGAGCTGCTGTGCGAAATGAGCGCCAAGCGGCGCGGCGGCGAAA
AGTCCCGGTGGAACGTCATCGTGCTGCTCGAGGCCATCAAGGCCTTTTGCCGCCTCATCCTGCTGCGCGTGACGC
GGTCGCGCCCGCTCGTCACACCGGTGCTGCCGGAGCGAGAGCCCATCCCCGAGGACGACGATGTCGACGAGGATC
TGATTACGGCCAGGAGCGAGAGCGAGCTGATGGACGAGACTTCGCCCAACGGATCCGCCGTCCTTGTCAGCAGCA
GCACGCCGCCGAAGCCTGCGTACGAGAGAGAATGGACGATGCCGCGGACGGGAATGAGCTTGCCGTCGTTGCCCA
ACCCTGGCGATGTTGGCTCGTACCTCTTGGGGCGCGTCTTGACGGCCGACGACATCAAGCCTGCCAACAAGCTCC
TCAACACTTTGCAAGGAGGCGGCCAGTTTGCCGAGATGCTGCACATTCTGACGCCCTTGATCTACGCAGTGGCGC
TGGCTAGGACAAAGAATAAGAAGTCGTGGACGCCGTGGCTGGTGGGTGTGGCGGTCGAGTATGTCGCTCGCCAGC
TCCGCCAGCGTAACCTGCGAACCTCGGCTCTGGAGCGAGACGAGTGGAACAAGAGAGGCTGGGCTATGATCTGGT
GGATGATGCGCGGTGCTTTTTACGAGAACGTGACTAAGGGGGCCGTCAACGGGGTGACGAGCAGAATGCCAGGCT
TCATCGGCGGAATCCTACAAGACTACGAATATCTGTGGGAGAATTACTACTTTAGCACGAGTGGCTGATTGACTG
TCATGCCAGCCGTGGAGCGGTGGCGCTCGTTCCTCTTCTCTCTCGCCATATAACTTATATTGGTGCTACCGAAGC
ACATGCAAAAAAAAAAAAAAA > SEQ ID NO:2298 214471FL Trichoderma harzianum
CTCTCGCCTCAAAATTCATGCGCCTCAAAGAATGGAAGAAAACACAGGCGAATGACGTGAAACGAAAGATAAAAA
GACAGGCGCCTTCATGCGAGGGTTTCGCCAGTCGCCTCTAGCGTGTTTCGAAGCGCAGGGTTGAAACGCGGCTGC
ATGATGCCCGGCCGCCCATCTGAGGCATGGCGGCTACCGGAACAGGACGACATCCGAAGACTTGAGGAGGCTCCG
TGTTTGTTCGTTTCGTTTCGTCTTTCGAGTGAAGGGTTGGTTCTTGTTTTCGGCTGTTGTGTGTTTTGGTTGACT
TGTGTTTACGGGTTGGGGTGAGTTGAATTGAGTGCGAGACTAAAAAAAAAAAAA > SEQ ID NO:2299 214707FL Trichoderma harzianum
TTTTTTTTTTTTGTGGATTTTTACAACGTTCTCTTCGTGAAAAGCCTATCCTTCTTTACTTCTAAGCCTCTCCTT
TGCCGGTCCTTTGAGATATCATTCTTTTATTACACAACCCTCTTTATTGAGCGAAAATGATTTCCAAGACGACTT
TTGCCGTGCTCTTTGCAGCCCTTGCTGCTGCTGGCCCCATCCAATTCCGAGAGGTGGCCTCTCTTGACCCAGCTG
CTACCGCTGAGGCCCATCCCAGAGACGACACTGCTACCCGCGCCTTTTCCAATGTCCAGATCAAGACGCAGGCCT
GCTTCAACTTTGACCCTCGACGTGCAGCCGGAAACCAGGTCCTGCTCTTCTCGTGCGGTGGACGGGCTGATGGCG
GCGGACAAGTGACCAACTCTCAGCTCTTTGCCTTTACCGGAGGCAATGGCCCGCTGAGCTTCGCCCCTGAGAACG
ATCCCACAAAGTGTTTTGCTGCCAAGGGCAATGTCATTGACATTGCTGACTGCAATGCCAATGATGCCACCCAGA
AGTTTACCTTTGGTGGTGCTGCTGCCGGAGGTTCTGGCAATGATAGCAACAACAACAGCTCTGCCGCCGCCAGCT
CGGCTGCTGCTACATCTGAGGCTGCTGCCTCTTCCACCCCGGCCGCCGCCGTGACGACCGCTGCTGCTGCTGCTT
CTTCTGCGGCCCCGGCGAATGACGACAACGCCCAATGCTCTGCTCCCAAAATTGTTACCGTCACTGAGGTTACCA
CTGTCACTGCGGGATCTCCTCCTCCAGCCGATGCCAGTCAAACTGCGGAGGCTGCTGCTACCACTTCTGCTGCTG
CTGCTGCTGCCACAAGTGACGCAGTCGTTGTCAACCCAGGCGAGGGCAGCTCCCAGACCACTGCAGCTCCTCCTC
CTCCCGTCATCACCGGAAACCCAACGACCCCCGTGCCCGTCTCCGGAGCTGGAGGCACCCTGAACCCTTCTGCCG
TGGCCGAGGCCCAGGCATTTGATGCCGGCGCCGTTCGACCCCTGGAGAGTGTCAACATCCGAGCCGCCGATGGAC
GCTGCTTCTTTGTCAACCCCACGGCCGGTGATTTCCGCGAGAACCTGATCCCCGTTGGACTGGCTACCTGCAGCG

Figure 1 continued

```
AAGACGCGAGCCAGAAGTTTGACGTTGTCACCAAGGGAGTCCACGACGACGCTCAGGCCGGCGAGGCGCTGCTTG
TCAGCGTGCTCACCAACGGCTGCATCAACTTTGATGGCCGCAGAGCCGCCAACGACCAGGTCATCATGTTTTCTT
GCGGTGGACGCGCCGATGGAAGTAAGTCATTGACATCATTTCCCCCCACCCCATCTCGGTGATCTGCTCGATCCA
CCCGATCCAAGGGCATGCGAGTTATCGCGTTTGTACCGTTTTAGTTTCACAAGAGATCAAATGCTAACGATGAAC
CTCAACAGGTGGCAAAACCGCGACTTCGCAGCTGTTCCCCTTCAAGGCGGGCGACAACAACATCATCCTTACTCC
CGCCTCGGCCACCAACACGACTTGCTTGGTCGCTGGCGCTGACCGGGTGGAGTCTGCGCAGTGCAGTGGCCAGAA
GGATCAGACCTTTGAACTGGTGGAGATTCTGTAAGAAAAACATGTGAGAGTGAGAGTGGGAGTGAGAATGAGGGT
GAGAGTGAGAGTGGCTCGTTTCACGCGGACGCGTGGGCGGACGCGTGGGTCGAGTTAATTAATGACAAGAAC
```

> SEQ ID NO:2300 214421FL *Trichoderma harzianum*
```
ATTGAGTCCCTAGGCCAGAACCGCGCGAGTATACATCTATCTGCAACATCTCTTACCTCCATCTTCGCAATGGCT
TCTGATAAGATGGACCGCGGCCTCGACGAAATCATTGCAGACAAGCGCAGCAATGGATCTCGAACCCGACGCGGT
GGCGACCGCCGTCGTGACCGTCAAGACTATCCCCGTGATGGGGTGAAAAAGTCTCTCCGCAACGAACCTCGAAAC
TTGGATAGCGAATGGGTACATGATCGATACGAAGAGAACACGTATCGCAATAGAGGCCCTGCACCGCGTCGCAGG
CGCGAGTCTCCCAGCGGGGGAGATGCCCGCGGCGCACGACTCCGAGTCGAAAATATCCACTACGATCTCACCGAG
GAGGATCTCGATGAACTTTTCCGAAGAATTGGCCCCATCACAAAATTGCAACTGCGTTATGATCGGTCTGGACGG
TCCGAAGGTGTAGCTTTCGTAACGTATGAGAGCAAAGACGATGCCGCAGAGGCTGTGAGACAATTCGATGGTGCC
AATGCGAACGGCCAGCCAATTCGTTTGTCCGTCATGTCAAGTGGGCCTTCTCGAAACCCGTTTGATACTGCTGTG
ATGCCAGGCAAGCCTTTGTCCGAACGCATTTCTGCTCCTGGTGGCAGATCTCGATCACTCTCCCCTCGCCGATAC
GATGAAGAAGATGCCGCTCGCAGAGGCATTGATCGATATGTTCCAGGCGGAAGTCGCTCTAGAAGCCCCATGCCC
CCCCGCCGTGGAGGGGGGGTGGAGGGCGCCGCCCTGGTGCCCGACGAGAGGGTGGAAGGGATCAGGATGCCGCT
CGTGGCGGCCGGGGAGGCAGAGGAAACGGAGGAAGCGGAGGAAGCGACCGTGCTGCACGAACAAACACACCGCGA
CTCAAGAAGACCCAGGAGGAACTGGACGCCGAGATGGAGGACTACTTCAACGCCAACGGCGGTGCCCCTGAGCCT
GCTGCAGAAGCTGCTGCTGCACCCAGCGGAGAGGCTACTGCACCCGTTAACGCTGATGACATTGACATGATTGAG
TAACCTGGATCATTGTGTTTTGGTAAAGGGGAATGTGTTTTATGAGGGTATTGGAGTATTGGACTCGTTTTACAG
AAAATGCCATCTGAAGCATGGGAGGACAGTGCATATATATAATTAAGCAGGGTGTGTTGTCATTACGAATGTATT
GCTTTTCGGGCCAAAAAAAAAAAAA
```

> SEQ ID NO:2301 214724FL *Trichoderma harzianum*
```
TCGGATCGGCCTCTTTTCCTCTCTTCCCTCTCTGCTTTCCATCTGCCCAGCAGACCGAGTTTGGCAGCGCAATGT
TGCCTCTATCGGTGCGGCGCGCGGTGGCCGCTGCTCCTCAGGGGGCAAGTGGGCTGACTTCTCTCGCCGCGTCGG
CTCCAAAGATCACAGCCTCGAGCTTCATCCTGAATCGTCCTCAGCGGCGCTACTCCTCGTCGAAACCCTCAAGAT
CCGATGAGCCCAACGATATTGCTGCCGGCCAGTCGGTGCCGGCATCTACCTCGCGCGGAGAGAGCAAAGGCAGCA
GGAAACGAAAGAGCAAGGATTCAGCCGACCGAAATGCGGCTTTCAAGAAACTGCCCAGTGTCCCTAGCACTCACC
ACATGTCTCAAGAGGCCCTGAGCTTATCGAGCTTCTTCTCACTCCACCGTCCCATTTCCATCACCCAGACCATGC
CCAGGACTGTTACCGACGAGCACTTTGCATCCATATTTGCGCCTCGATCAAAATCGAACAGGATACGAGACACTG
TCTCTACAATTTCTGACACCATTGAGCAGCTGGAAGGCCCCATGGCTCAGGTGACAATAGGATCTCAGGACCAAG
GGGCTGGCGATGGTATGCACAGAGTTGATGTCAAGAACCCTGACGGAACCGAGTCGAGCATCTATCTCCAGGTTG
ACACCATGTCTGGAGACTTCTTGCCTTTCCGCCCCCCTCCGCTGCCCGAGGCGCAGCAAGGCATTGAGGCTGAAG
GAGTTGCGGCTGAGGCTGAAGCTCTGGAAGAGGCAGCTCACCACCGAGTTTACAAGGCCATGTTCACCATTGAGG
AGTCCACAGAGTCAGACGGCCAAATCAGGATCATCGCCCACAGCCCTCGAATTATCCAGGACGAGCAGCCCGGA
GCTTCTTGGAGCGTCTGGCAGTCCGCCAACTGCGGGTTGACCAGGCTCGCGGTCAGCGTGACCTCTATGCCATCA
GCGTTAAGCGACAACGGAAACTTAAGATGAAGAAGAAGAAGTATAAGAAGCTGATGAAGCGAACAAGAAACTTGC
GTCGCAAGCTGGATCGAACCTAAGGGGGCTAGGCTTGGGCTGTGTAGAAATTCGCATTTATTTCATTTTTCCTCT
ATTGCGTTGGGATTCGACCGGTTCATGGGTTGGTGTCTGTCTGGCGGTTGACAGCTTTTTGTCAGCCATGAGTTA
CGCAACGCGCTCCTGAGACTTTTTCTCTTCCATAGACTCGTGAAGATGACTTGTTGTCATGTGTTGTGGTGCATG
GCTGGGGCATGGCATTTTCCCGTTACATCGATTTTGTAAAATTAGTATGAATAAGACGAACATGTATCAACACAA
AAAAAAAAAAAAAA
```

> SEQ ID NO:2302 214548FL *Trichoderma harzianum*
```
CCCACGCGTCCGACCGAACCGCCAGCGAATCGACGAGGGCATCTGTGTCGGTACCGGATGCTGCCTTTGCGGATG
GAGCGTCTTCATCGAGACGGCAGGTAGAAGGAAAGACATGGCCTTGTTTGTGGCGCCGCGGGCACTGGCAACGTT
GGTCCCTCGGCGGTATCCCCTGGAGAAGCAGTGGCGAGAGAAGTTGATATTCGCAGCGAGCACGGCAGTCGTGTT
TACTTGCGCCCTTGAGAATCCAAAGAGAGTTAGAGGCGTACTAGGGGGGATTTTGGGCATGGTGTTGAAGAAATA
AACCGGGCATATGGGCAAATATGATCTCTTTTAGGGAGTTCTGAGACGTGACATGACTAATTTCTTCTTCTTCTT
TGGATGTCTTTGGAATAAGCTACGGTTTTTAGATGATATACACAAACAACCCTGATGCTATAATTGGTAATAAAT
CAAAAAAAAAAAAAAAA
```

Figure 1 continued

> SEQ ID NO:2303 214326FL *Trichoderma harzianum*
GGGCGATACGTCGAGATGATTCGTCCGCAGCTTCAGTCCGTGAGATGCTGGTGCTATCAGATGCTAGCAGATGTT
ATCCCAAGTTACCCGATGCTACAGACCATCCACGCTGCAGATCAACGGCCGCTTCGTGATGCAAGTCTCACGCAA
ACTTTACCCTCTTTCAGTTCTTACGAGATGCAAGGGATTGATCCACTGGAGTCAGAGAATCTGAACCGCGACCGC
GACCGCGACGGCTACGCGCAAAGTTTGGGCCAGTGACTGACGCGGCCGTTGTTTGTCATCAAGAGTCACAGAGTT
CAATGGCCCTCAGGACAGCGGCATTTGCTGAATACGAAGCGCTGTGCTCATGGCATGGGGCAATGTTCCTGCAGT
AGCGCGTGATATGCAAAACCTCTGTGCGTGCAGCTTGCATGATGCTAGGATGCAAGAGCCACTGCGGTTCACTGG
GCTGAGCCCCAGACTCCTGACATGGCTTACAATACAATATGGATGCTGTGCTCGTAAGCAAAAGGCTTCTCCAG
TAGGTACCTTGCTGCCCGTTTGGAAAAGCGCCGAGAGCCCATGAGATATCGCAACACCGGGCGATTAGTCGTTTT
CTCGCACAGAACAACAACACATGCGGGATTACCACGACATACATGTGTGGGAGTTATTATTTAGCCAACAATAGT
GGAGCATATACTTGACAGGCACACCAACTCTTGATGTTTGTTTTTCTCAGCTTCAGTCGCGGTATGATCACCAAG
AGAGCTTGTGAATGCTCAAACCACTACCGCAGATTACCGATTTGATTCAAACCCTCGATTTTATGCCGCCGCGTG
GCTTGGGCGCGATTGAGCCCTGGTCGCGATCATATGTAAACGCTTTGGCCGCCGATTGACGAGGCAAGAGGCTAC
GCGGGTTTCAGTGCGATTCTTTGACCCTGGCCGTCATGGCAAACTAGGACGCCCGAGATTCTGATGAAACACCCG
CGATGGCCTTGCGCATTTGCTATTTCATACAGAGAGGACGGAACAAGACATGGCCATCAGCATCGTTATCATCTT
GTCCAAAAAAAAAAAAAAAA > SEQ ID NO:2304 214672FL *Trichoderma harzianum*
ACACAATTCCTCGCTGCGTGTGACTCGTGTCTCCAGCAAATACCGCAAAGATGTCTGACGACGGGCTCTCAATAT
ACGATGAGATCGAAATCGAAGATATGACCTTCGACGAGGTTCTTCAAACATACTTCTACCCGTGTCCCTGCGGCG
ATCGTTTCCAGATCGCTATCGATGACCTGCGCGACGAGCAGGATATTGCTGTGTGCCCCAGCTGTAGCTTGATGA
TTAGAGTTATTTTCGACCTTGACGACTTACCCAAACCTCCTCCTACTGGCAATACTGGTGGCCAGATACCAGTCG
CTGCTTAAAGCCATCGCTATATTTGAGCTTCCCTGGGCGAATACTTGATCTATTCGGCAGACACATCGAGATACT
ACACTAATTAGGCCCGCATAGCGTACACAGTGCCTCAACGGCCGTTCTGAAGAGGCTTCTCAGATTGATCCGTCT
AACATCGGATGTATTGATAGACGCGGACGAGAAGACGACGATGTACCAGCGACAGACCAAAGTCATCCCAAGCAT
CCAAGCTACTGATGCAAAAATATGCGTGCCTTGGGAGTACCACTCTCCGAGGCAAAAATTCAGTCACTTAAAGAG
ACAGGCTTCGGGAATGCCATGAAGAATTCAGGCTCACGTGGGGGACATTTGATGAAAGAACACTGCCGAGGCGTT
GGCAATACAGAATGGACCTATGAAGGACGGCCATTTCACTCATATACCGTCAACATAACAAACCAAGATACCAAG
GGTGTATTACATATTCACCTAAATTCCATGAATGCAAACTACAACTGATGACAAAAAAAAAAAAAAAA > SEQ ID NO:2305 214259FL *Trichoderma harzianum*
AAAGACCAAGATCAGGACAAGACAATTCGAGAGTGCCAAAAACAGCAAAAGGGCAGAGAGACGTCATCATGGCTC
AGGCCAAGTTCGCCGTTTATCCCAGCCTCGTCGACCGCACCGTCGTCATCACAGGTGGTGCGCAGGGTATCGCCG
CCGACATGGTCGAGCAGTTTTCCCTGCAGGGTTCTCAAGTCATATTTTTCGACGTCGAGGACGAGCTTGCCGCTG
ATTTAGTCCGAAAAGTGTCTGATCAGGGCGTCAAACACAAGCCCATATACTACCACTGCGATGTCATCAAGATCG
ACGAGGAGCTCAAACCCACAGCGGCCAAGATCCTGAAAGACCATCCCAAGATCGACGGACTCATAAACAGTGCCG
CGAGGGCAATGGTGAAGCCCTCGCAGGATATCACGACTGAGTGGTGGGATGAGAGCGTCGCCGTGAACCTGCGGC
ATCAGTTCTTCCTGACCCAGGCCTTGCTGCCGGGGCTTCTCCTTGCTGCTGGAAACGCTTCGGTGATTAACATGG
GGAGCATCAACTGGCTCGTCTCTGCGACGGGTCAGGCGCCTTACACGACGAGCAAGGCCGCCGTTGTGGGACTGA
CGAGGACGCTGGCACATGAGTTTGGACCGCAGGGTATCAGGGTGAATAGTATCATGCCGGGGTCCATTGCGACAG
AGAGGGAGAGGACGGTGGTTATGACGCCCGAGTATGAGGCCAAGGTTCTGGGCAGTCAGGCGATCAAGAGGCTGA
TTGAGCCGGTGGAGGTGGCGAGGATGGCCATGTGGTTGATTGCAGATGATAGTGCTGCGGTGACGAACCAGAGCA
TGAGGATTGACGGTGGATGGACATAGGATGTGGCTTTGAATAAGTGAATAATGTCGGTTTTTAGATACTCTGCT
GATGGTTGGAACATTGAGATGGCATGTATAAGAAAAAAAAAAAAAAA > SEQ ID NO:2306 214443FL *Trichoderma harzianum*
GACGCTATCGAGGGCTGACCTGCATCGTCGTCAGTCGGCAGACGAGCGGATTAACAACATTCTCGAGACGGCTCT
GCAACGAGCAGAAACGATGGATCCCGCCTCTCTAAGCCTTCTCCAGAAAGGCTCTTCCCACAATTCCTCTCCCAA
CTATGGAGCCTCCGGAACGGTGACAAGAGGGATATTGCAAGACTATCAGGCGGTACCGACCAGCGATGAAAGCGA
TGCCACCCGTCCGAGAAAGGTTTCATACAGCGATGCGGCGAAGAAGGCCGGGAACCATGCGAAGAGCCAGAGCTC
TCTGCGGCAACGAAACGGAGTCTCCGGCTCGGAGGATACAAGATCGCCAACAAAAGCAAAGTCATCATGGACGAA
GGAAACATTTCGAAAATTTCAGTCCCTTCAGTTGGAAAACAAGGGAAGCGTGGCTAGAGATCACCTGGCTCTCGA
ACGCACATTTCTAGCATGGCTTCGAACCTCTCTCGCTTTTGCATCGATTGGCGTCGCCGTGACGCAGCTATTCCG
CCTCAACACTGATAACGCTTCCGCCTCCGATTTCGACCACACAAGGCTACAAAAGATGGGCCGCCCGTTGGGTGC
GACATTCCTCGCCATTAGTATTGTGACCTTGCTCCTCGGTTGCAGACGATATTTCCATGCCCAGGAATGGATCCT
TCAGGGCAAGTTCCCGGCAAGCCGAGGGACCATCATTATCATGTCACTGGTGGCATTGGCCCTCATGATTTTGTC
TCTAGTGGTGGTCATTGTCATCCGGCCATCATAGAGGCTTTGGACAGCTATGGAATCACCGACTTTTGACTGTTG
ATTTTCAGTTGGTTCCTTTTTGGAATGAAGAAGGATCTATGGGCTTGGTACTTGTGATTTAGGATAGCATTGGGT

Figure 1 continued

TTGAAGCATGTGATTAACGGGTTTTGGTGTTTTGGACTTTGCAGGGTAAATGTTTGGATCATATATGCATCGATG
TACATTTGCAATGGATAGAGGATATCTCTTCACTGGTTAAAAAAAAAAAAAAA

> SEQ ID NO:2307 214558FL *Trichoderma harzianum*
GGAACGTCAAGTGCGAAACGCACTGGTGTCGCCTGACGAAGCAGGACAAGAGTCAATCAATTCCAAACCAGCCGA
TAGATCTCGAACTCTGTTCAAGACCAATACCAAGATGGAAACGAAAATAGGAGAAGAGCCTATACGACATACCGA
TTTTGCCATGACAGATGCTCAGGGAGGGCGAGGCCCGCTGCAGCAACCAGCCACCACGGCACGCACCGGCTTGGC
GATGGGACGCAGGTTACAAAAATTAGCTCGCCCAAAACGCTCGGCAAGTCATGAACAGCAGTACATAGGTGACGA
GCTCCGTGGCCAAACTACTAGGCCCAGATCATCTTACGACCCGTTGGTCTCAACAGAATATAGTCTAAGACGTCC
AAAGCAACATGCGACACACAACTCGACTGCAGAACCTACGGTAAATACTGTCATTAAGCCTACTTTACGGCGACG
AGGATCCGACTCTAGTGAGAGCAGTTTCGTACGTAGTAGGTCCATCGGCAGTCCTCGAAGTGGATTTAGGTCATC
GATGCGAAGCAGCTCTTTCGATCCGAGGCCATCATCATCTGGTAATAAGGGTAGAAACAGGTTGACTCTACGCTC
GTTATCACCCACAACGTCACATCAGAGGCACCATTCTGCTGCGCCAGCTGCTCCTTCTCGGCAAATGGTAGAGAA
TCCAACTCGTCAGCCGTTCCAGCGACACTCAGTTGCGCCACGTATCAGCCAGTCTCTATCAAGGAGAGATGAGGA
TTCGACATACGGCGATCACTTGTCAGATTCTAGTGATGACGACATGAACACAACTCCGTTGACAAACGGCTCTAT
CACGGGTGATGAAAACGAACCCGTTCATTCGAGGTTGAAACAATCTATTCTTAACATGTATGCACGCAACAACCT
CCCTGACCAAACTTCTAGTGCCAGCGCAGGTATCAACTCCGTTTGCCAAAACACGATGCGCCCAAACCGAGAGT
TGACCAATACCACAATGAGGAGAACCCGCATCTACCTCTTGATCAGCTACCCGGCGCCTCGGCTCGCCGACCAGG
GCTCATCTCCACACTCAGGCGCAAGAGCCATGCAAACGTCAAAGAATCCAGCGACGCTGACGGTGCCCGTAATAC
TCTACCGCATCATCACAGTGAAGACGCAACGTCTACCCGGAACAGCGTCATACCCAACCACGCAATAGGCTGGCC
ATTGCAGAACAGGAAGGGCGAGACGAATGAAGCTTCAATGACGTCACCGCTTGGAGACACAGGAAGACGATCCGC
AGCTAGCGGCTCTATTTTCAAGGACGAGCTGACGTCAGAACCCCGCCATCAACATGAGCTTCAGCTTTATGAAGG
TAGCTCGGATGCGAACCACGCTAATACTTTCCTATCACAAGAACCTAAGCGAAAGAAGTTTAACAGCCTGAGGAA
AATGTTTAAAATTAATAATTAGGTAATTATAGAATTCGAATAATGAGATAAGATTATATAGCAATTAATGGTGTA
AAAGAATTTAATGGCACGCTAGTTTCGCTACAAAAAAAAAAAAAAAA > SEQ ID NO:2308 214262FL *Trichoderma harzianum*
GTTCGATGCACTGCCACCATCCTCGGAGAAAGGTGTGTGTAGTGGACAATGTATGTGTGTCATTGAAGAAAGTAG
GAGTAGGTGGCGGCTCCTTGGCAAAGTGGCAATGTTGCTTGGTATTATGGATCGGTGGGTTGTGCCCAGCTGGAA
TGGCTTGTCTTGGCGATAGGGGGAATATGGAGTCGTTTTGATGGGAACGGCCTTTTTGGTTTACCGAGGAGGGT
CAACATGTGCGAGCATGTATGTTCAAAGATGGGAGAGGGAGAGAAGAAGAGAGAAAAATCAAGAATCAGTTGTGC
CTAAAAAAAAAAAAAAAA > SEQ ID NO:2309 214460FL *Trichoderma harzianum*
TAATTCTATTTCACTCTTCTGCAGACGAGGACGGACCCGATTGACCATGTTGCGACAATCCTTCAGAGCCTTTGC
CCGCACGGCTGTTGCGAGACCGGCCGCGGCGAGAAGCTACGCTACCTTCAACTGGGAGGATCCCCTCAATGCGAA
CAACCTCTTTACCGAGGAAGAGCAGGCCATTGCAGAAACCGCAGAGCGATACTGCCAGGAACGACTACAGCCTAG
GGTCTTGCAGGCCTACCGAGACGAACACTATGACCCCAAGATCCTCGAAGAGATGGGCGAGCTGGGCCTGCTTGG
CTCCAGCATCAAGGGCTACGGATGCGCTGGCGTTTCTTCGGTGGCCGGCGGCCTGATTACACGAGCGGTCGAGCG
AGTCGATAGCGGCTACCGGTCTGGCATGTCGGTGCAGTCGTCCCTCGTCATGGGCGGCATCCACGAGTTCGGCAC
CGAGGAGCAGAAGGAGAGATTCCTCCCCGAGATGGCCAGGGGCAAGCTCATTGGCGCCTTTGGTCTGACGGAGCC
CAATCACGGCAGCGACCCGGGCAGCATGGAGAGCGTCGCGAAGCCGCATCCGACCAAGAAGGGATACTACTCACT
GAGCGGAGCCAAGACGTGGATCACCAACAGCCCAATTGCCGACGTGCTGTTGGTCTGGGCCAAGCTGCAAGAGAC
GGGCAAGATCAGGGGCTTCTTGATTGAGAGGAAGGACTGCCCGCCTGGAACACTCGAGACACCCGCCATCAAGGA
CAAGAACGGGCTCCGAGCTTCCATCACGGGCATGATCCAGATGGACGGCGTCCCGGTGCCTGAAGCCAACATGTT
CCCCGATGTCGAGGGCCTCAAGGGACCCTTTAGCTGCCTCAACAGCGCTAGATACGGCATCTCGCTGGGTGTCAT
GGGCGCCCTGGAGGATGCCATTGCTCGAGCTCGCACCTACTCCCTGGAGCGCAAGCAATTCAAGGGGAACCCTCT
GGCTAGGTACCAGCTCATTCAGAAGAAGCTCGCTGATGCCGCCACAGATGCCGCCTATGGCACACTGGCCGCGGT
GCAGGTCGGCAGGCTCAAGGACGAGGCAAGATGACTCCCGAAATGATTAGCATGGTCAAGAGACAGAACTGTGA
TTCGGCTCTGCGCAACGTCCGCGTGCTGCAGGAGATTTTCGGTGGAAACGCTGTGAGCGACGAGTATCACATTGG
AAGACATGTGGCGAACCTGTTTGTGACGCAGACGTACGAGGGACAGAGTGATATCCACAGTCTGATCTTGGGCAG
GGCGATTACCGGCATACAAGCCTTTGTGTAAAATATACTAGCAATATAGATGATGAAATAAAAGCATATAATCAC
AAAAAAAAAAAAAAA > SEQ ID NO:2310 214633FL *Trichoderma harzianum*
CCCACGCGTCCGCCCTCATATATTGAAGGCATCGCCAACCCGATCACAAACCTTCTTGTCCAGACTTGCAAACCA
CTCAATCGATTCCTTGATACCCCTTGGGACAACTCTACTTGTTCTCTCCAAACTTACCCCTCCAAATACCATCAT
CACCATCACCATGACCAACGACGTCTCTACCAACGGCTCTTCTGCCGCTCCTGCGACCACCTTTGCCCTCAAGGC

Figure 1 continued

```
TGGTCTCGCCCAGATGCTCAAGGGCGGCGTCATCATGGACGTCACCAACGCCGAGCAGGCCCGCATCGCCGAAGA
AGCTGGTGCCTGCGCCGTCATGGCCCTCGAGCGAGTTCCCGCCGATATCCGCAAGGACGGCGGCGTCGCCCGCAT
GTCCGACCCGGCTATGATCAAGGAGATCCAGGACGCCGTCACCATCCCCGTCATGGCAAAGGCCCGTATCGGCCA
CTTCGTCGAGTGCCAGATCCTCGAGGCTCTTGGTGTCGACTACATTGACGAGTCCGAGGTCCTGACGCCCGCCGA
CGACGAGAGCCACGTCGAGAAGAGCCCCTTTGGCGTGCCCTTTGTCTGCGGCTGCCGCAACCTGGGCGAGGCCCT
GCGCCGTATTGCCGAGGGCGCTGCCATGATCCGAACAAAGGGCGAGGCCGGCACCGGTGACGTTGTCGAGGCCGT
CCGCCACATGAAGACTGTCAACAGGGACATTGCGCAGGCCAAGGCTGCTCTTGCCGAGGGCGGTATTGTTCGTCT
CCGCGAGCTTGCTCGTAAGCTCGAGGTTGACGTCGAGCTGCTGCGCCAGACTGCTGAGCTGGGCCGTCTCCCTGT
TGTCAACTTCGCCGCCGGTGGTGTTGCCACTCCTGCTGATGCTGCTCTCATGATGCAGCTTGGCTGTGACGGCGT
CTTCGTCGGCAGCGGCATCTTCAAGTCTGGCGACCCTGCCAAGCGAGCCAAGGCCATTGTCCGCGCTGTCACTCA
CTTCCGTGACCCCAAGGTCCTTGCTGAGTGCAGCACCGGACTGGGCGAGGCCATGGTTGGCATCAACTGCGACGC
TATGAAGCCCGAGGAGAAGCTTGCCGGCCGTGGCTGGTAAATACCCCCTATTATATGATTTTAGCAAGGGAAAGC
AAGAGGAGGAAAAGCAAAAGTGTGGTATATAAAAACGGAAGAGACAGAGGAGGAAAAAATGACTGGCACAGAGCC
TCAAAATGTATCTATTCTACTGTTGGATTTGGGCGTTGTGGACTTTTTATCGCTTTGGGTGGCACTTAGCATGCT
GAACATCAAAATTCTGAAGATGCCGTCAGGATATGCAACCTATTGAGGATTATACAGCATAGCACGAAATCTACA
TTTACTTGTTTGCAAAAAAAAAAAAAAA
```

> SEQ ID NO:2311 216461FL *Trichoderma harzianum*
```
AGCCGAGTTAAGCGGCGATAGAAGCAACAAAGGTGAAGTTGTGCCGGTCTGGTGGTTTATTGGAAAGAAACGAAG
AGAAGAATGTTCCGGTCAAGGGAAGCGGCCTTTGGTCAGTAGCCAAAGGGCAGATCAAGCGCCGCCTTGGAGGAT
TAAAAGGGCGGCTGCAGGGGTCCCAAGGCTGGTGCGCCTCATGGAATTGTATCGAAGAAAGTCGATGGTGTGGCG
GTGCCCGATAACGCAAAAAGCTGGCAACCTTTGTGCTGCCATGCGGGCTAGCAGCGGGTACCGCCGAGTATTTGT
TTGTCACTGTACAGAGGCGAGACGTGAGGCCGAGATTCGCATTGGTTCGGAGTCTGGAGTAGGGAGGACAATATG
GTAGCACGATTGTCATTGTGATTGCTTTGTTTATTAGTACTTAAAAAAAAAATAAAA
```

> SEQ ID NO:2312 216329FL *Trichoderma harzianum*
```
GATCGGGATCGAGTGGGGAAATAAGATGGAAGTCGAGAGTGCCTTATGTAAAAACCTGACCACCGGCAGGATGGA
ATCACCAGAATCACCAGACTTGTCTCCGGGTCTTTCCTCTATCCTGCATTTTCCTGCAGGACAGGGAGAGCTGCC
TGCACCTGCACACCGAGGTACCTGGATACTCCGCGTGGTGAGGGGCAGGCAGCGTGCGTCCGAGGTACTGCCAGG
CTGCCAGGTACTTGGGACGGCAGTGCACAAGCTCCGTACTTGGCGCGCCCTGCCCTTTGGTCCAGCTTTGGGAAG
AGATCTCCGTTCCGGCTGCCTATCCTCCGCTTTCGTGCAGCTGGGGGGAGGGTTAAAGACGGCTTTCGGTCAAGA
GTCGAATCGGTCCTGATTCAGAAAAAAAAAAA
```

> SEQ ID NO:2313 216471FL *Trichoderma harzianum*
```
GAACAATGCAGCTGGTGACAGGTTTGTCAAGTGGCAGGGGAGAATCGTATTCGTGTGGCGATGGTGATGTCGAAT
TTCGAATGAGGGAGCCTTGGCGCGAAGAAAAAAGAAGAGAGAGAGAGAGCGGAGAGGAGAGGAGAGGAGAGTGAA
AGAAGGAGAAGTAGAGAGGAGAGAGGAGAGAGACGCTGTGGTGCTAAGCAACCACGAGAGAGGAAGATGAATGCG
GTTTACAAGGTTGACATTGGCGAACGAGCTTGGACCGCTTTGACAATGTGATGTGATGCAGGCTGGGTACTCCAA
ATGTTTCCAATTGAACGAATATCCAATCAGACAAGTAGAGATAAAAAAAAAAAAAA
```

> SEQ ID NO:2314 216338FL *Trichoderma harzianum*
```
CGGACGCGTGGGCGGACGCGTGGGCGACCACCAGCGCCGCCAGAATGTTCGCCGCACGATCAAGGGCAGTCTGCG
CCGCCCGCCAGCTGCAGCGGACAACCCGAACCTACGCCTCCGAGTCCCACGGCCACCACTCGCCCGCTCCGGTCA
ACGAGTCCTTTGGGGCCGGATCTGTTATTGCCCTGGGCGCTTTCCTGGGCACCGTCCTAGTCTACCAGTTCCGCC
CCACGGAGAGCGACAACTGGACGCCCTCTGCCCTGCTCAACAAGTATCGATCAAAGGCCGAGGACTGGGAGGCCG
TCAACACTCTGCACACAAAGGCCATGGAGCAGGCCGGCTATGACAGGAATCTGTTCGAGAACGGCTCCAACAAGC
ACCGATTTGTCGACGTCGCATACCCCGAAGCTCTCCAATCCCACGCCGCGCGAAACATCCAGGCCGGCCACCTTG
CCAACATTGACCATGCTGTGGAACACTACCGACAGCAGCACCTGAAGATGGAGGAGAAGAAGGCGGCCAAGCTGG
CGGCTGCCAAGGCAGAGTAGTTGCAGTTGCTACAGTATATCCAATTTATAGAACAAAGTTTGCAACAAAAAAAAA
AAA
```

> SEQ ID NO:2315 216036FL *Trichoderma harzianum*
```
CACGCGCATCATTATGCCGGCATGGGCCCGGGGTCTGACCCTCACCATTTCCGAGACCAGAGCGTGCCGCATTTC
GACAAGGCGGGCCATACGCGGACGCACGAGCGGGAGGATCACCGGCGGTGGCAGCGGCAGAGAAGGGCTGTGGGG
GATGATGGCATAGAGTTTGAGCCGCAGACGAGCCTGGCCGGGCACTTTTTGATTGTGGCGGGGATATTGGCGGCG
ACGCTGTTTGTGCCGGCGGTGTATTTGCAGTTTATGCGCCTGGGGAGGCAGAAGAAGGAGAAGGAGTCGTGAGGC
GGGTATGGCGTCTGGAGTGTGATAGGGAAGGCTGTACAAAGAATAGAGCAGACTTATATAGAAATAGGCAATGGG
GGGGCATGAGCGAACAATGCCGATTTTAACGTTACGAAAAAAAAAAAAA
```

Figure 1 continued

> SEQ ID NO:2316 216259FL *Trichoderma harzianum*
GTTGGAAGTATAGAACTTAGCCGGCTACAAACTTAAAGAGCGTTGCCCAAAATGAAGCCCTATCCATTCCAATTC
AACAGCACATCCTCGTCAAAAGATGAACCAACCAGGGATACGGAGCCCAGTCATCTTTGTAGGGGGCGAATACCT
TCTGTCCAAGCATCGCAGCTTCGGGCTATGATTCGCGAAGCATACTCGGACCCAAGCAAGATTCTCGCTACATGC
TGCTCTGACGATGGACTAGGATCACGTCTGGTGGAAGAAGCTAGGTTCCCGTACATATTTTTGGGTGGATTCATG
GTCGCGTCTAGCTTTGGATTACCAGACACTGGATACATTGCCTTCCAAGAAATGGTCAGCCGCATTCAAGAAGTT
AAACGACAAACTACGATTCCTATCATTGCAGATGGAGATACTGGATACGGTTCTCCCGTAAATGTTAGGCGCACA
GTCCAAGGTTTCGCCATGGCGGGTGCAGCGGGTATCATGATCGAAGATCAGACTTGGCCGAAGCGATGTGGCCAT
ACTAAAGGGAAATCTGTAGTGTCCAGGGAGGAGGCCTTCGCACGAATCCAAGCAGCTGTGGATGCCCGCAATGAA
GGAGTCGATATTGTTATCAACGCTCGCACGGATTCTTTTATCCTCGGATGGGATGAAGCAATTTATCGAGCAAAG
AAGTTCGTTGAGATTGGAGCAGACATGGTTTTCCTAGAGGCTCTCCCAGATAGGGAGATGATGAAGAAGACAATT
GACGCCCTTAATTTCCCCGTCATGGCTAACATTATTGAAGGCGGCTTGACAGATAACCTCTCAGCTGAGGAGCTT
GGCAAAATTGGTTTCTCGATAGTTGTATATCCCTTTACAATGGTGGCAGCTAGAGTCAAGGCTGTGAGGGAGGCA
TTGGAGTCTTTGAAAGTGAGTTTCACATCTGGGGCACCTCCAAGTATCATGTCTGCCGGAGAGGTCTGTGAGGCT
GTTGGCTTCAACAAGTACTGGGAGCTGGAAGAGAAGTATAAATATTAGTGGTATCAATTTTAGTGGTCTAAATGA
TAAAAGGGCTAGTTC > SEQ ID NO:2317 216187FL *Trichoderma harzianum*
CATTTATCGAGTTTCACAGGGCTTAGCAACTCCTGTCCGGGGGGATTGGCAGATCTTGACAACTGAGGAGGACCG
GATGCCGTGACGTGTAGCTGCTAGGATGAATCTTGGATTGGAGATTTGCCAGTCGATTTGGATGGTGCCTTTCGG
GATGGAGGGGTGGAGGGTGGAGAGATATGACTAGTGTGGAGGTATCACAGCGTCGGGGGGCTGTGGAGAGTTCAG
GGTAAGCCATTTGCGGCTTTCACGCTCAGTAACACTCGGGGGTTTAAAACTGACTGATGGCCCATCTATACCTTG
CAGAAAAAATTTAGGTCCTCGCAAGACTCTCCCTAGAGCCGCGTCCCGTCACTACTGCTGCTTTGGCATCAAATA
GTGCTCAATGGCTAGGCCGAGGGATTTGAAGACGATAGCAATGTAACCCATACGATCTGACTGAACGAAAAAAAA
AAAAA > SEQ ID NO:2318 216262FL *Trichoderma harzianum*
GTTCGTAGAGAACGCAGATACCTTCAACAGGCTCGAGGCTCCCGTGTCTCGTGTTGCTGGATGGAGTATCCACAA
CGCTCTGATATTCGAAAAGTTTCACGTCCCAGATGTTGCAAGAATTTACGACAGTATTAAAAAGACGGTTCAGTA
CTAAGAATGTGGGGAGCGAGTAACGTGTGACTTTATCTTTGAATTTCTAGAGCTTCTTCCTAGCATAAGTGTAAA
TAATAGAGAATAAAGCTTTCTGTAACACACAAAAAAAAAAAAAAAAA

Figure 2
Identification of internal (DAS) homologues to DR hits

*This file describes the sequence of contigs assembled from internal DAS clones that have homology to hits identified in functional screening, with a Pz <1.00E-20. See the first listing for header definitions.*

> SEQ ID NO:408    103532 (hit sequence identifier)    128863_300478_1
(homolog contig identifier)
sequence of homolog contig:
ttcacATTCAATCAATTGGAGCAAAAAAGGGTATCGTTGGATCTAACAAGCAAGAAGAAAAGATATGGGTCGTGG
AGTCAGCAGTGGAGGAGGTCAGAGCTCATTAGGATACTTGTTTGGGAGTGGTGAGGCTCCAAAATCAACCCCAAC
AAATCCCCAGGCTGTTCAAAGTGAAGCTCAGCCAATAAATAAAGAGCCATCTCCAAAGCCTGTTGCTGCTGCTCC
TCCTGCTGATGCTGCTAAGCAGATTCCCGCAGGTATTCAGAGTATCAGGGCAGATGGTCAAAACACGGGCAACTT
TATCACGGACCGACCATCTACCAAAATCCATGCTGCCCCTGGTGGTGGATCTTCTCTGGGATATCTCTTTGGTGG
TGGCAGCAGCTGATAAAGACATCCCAATCACCCATCACGGTTTTATTATTTCTGAACGTTATCTTTCAACTATGT
TGTAAGTGTGATTGTGAGTATTGCAGAATGTCAGTGTTATTTTATGTTGCTACCTAGTGGGTGAGGGAGTTTTCT
GTGTCAAGGATAAGTGGTGTAATTGCACAAACTTATGTCCATAATCTCAGTTGAAAGCTTTGATCTAAGTTGCTC
TTTTTGTTGTTACATGGGGCTTTTTTGTGACTAGTGGTCGAACATCTTGTTTCATAAATTTCATATTCTTTGATT
AAc > SEQ ID NO:409 103578    104545_300370_1
caacaatcaactataatatcaattcttttttcaccaatcacaactttgctctttctcatttccaaatggatactgc
cgggaAAGCAAAAAGGGTGCCGGCGGCAGAAAGGCTGGTGGCCAATCGAAGAAGCCGGTTTCTCGGTCCGTCAA
AGCCGGTCTTCAATTCCCGGTCGGTAGAATTGGTCGTTATCTGAAGAAGGGTCGTTACGCTCAACGCGTTGGAAG
TGGTGCTCCGGTTTATTTGGCTGCTGTTCTGGAATATTTGGCCGCTGAAGTGTTGGAATTGGCTGGAAATGCAGC
GCGTGACAACAAGAAGAACAGAATTATTCCAAGGCATGTTCTGTTGGCTGTGAGGAACGATGAAGAGTTAGGAAA
GCTTCTTGCTGGTGTCACCATTGCTCATGGTGGTGTGCTTCCAAATATCAACCCGATTTTGTTGCCTAAGAAAAC
TGGCGGAGCTGAAAAGGAACCGAAATCTCCTGCTAAGGCCACAAAATCTCCCAGGAAAGCTGCAGCTTAGAGTTT
TTTTGTGACTGTTGAATCTGAAACTTCTTTTGCTTTTTGTTCGTGTTGTATGTATTTCTGGTTTTAGATCTAGTT
CTTGTTTTAGCGAGGGAatTTgagaagaatATagCTgTa > SEQ ID NO:410 103578    108004_300057_1
CCAAAATCACAGCACAACACAACACTTCTCCTAATTATTTCGAGTTTTGTAGAGGTTAGAAATGGAGAAGAAGGG
AGCTGGAGGAAGAAAGGGTGGTCCAAAGAAGAAGGCTGTTTCCCGTTCCGTTAAGGCCGGTTTGCAGTTTCCGGT
AGGTAGAATTGGGCGTTACTTGAAAAAGGGTCGATATGCTCAGCGTGTTGGGAGTGGTGCTCCTGTTTATCTTTC
TGCTGTTCTTGAGTACCTTGCTGCTGAGGTTTTAGAGTTGGCTGGAAATGCAGCGAGGGACAACAAGAAGACTAG
GATAATACCGAGGCATGTTTTGTTAGCTGTAAGGAATGACGAAGAGCTTGGAAAACTTCTAGCTGGTGTAACAAT
TGCTCATGGAGGTGTTCTTCCTAACATCAATCCAGTTCTTCTGCCTAATAAATCCGACAAAGTTGGAAAAGAACC
TACTAAATCGCCAACGAAGGCTACCAAGTCACCCAAGAAGGCCTAATTTGTGACGATGCAGGCTCGTGTGATGGC
ACAGTGTTCTACTTGAATCCATGTTGTATGGACATTGTATTGTAGCTTTGCAATTAGGAGCTTTAATGGTGGTCG
TGAAATAATCTCTACTTGTATGTAGTTTTGGTATCTATGGGTTGCATTGCATGTAGGCAAAGTATGTTGAAAACT
AGGAATGTTTGATTTCTGTTATTATGATGTGAAACTAATGAAATTGGTTCTGTTTCTCAAGATCTTTAATGGTGG
TTACATGTGAGAATTAAAagcTTTTAtTgTCTTATGAGCTTTTaaTTTGAATTAAAATTGGCAAATGTTTATGg > SEQ ID NO:411 103578    11598_300292_1
GCCATTACGGCCGGGGACTCAACACTCAAATTACAATCCAAAAGCTTATATTTTTCTGTTACTTCTCTGTACTC
AAGCTTTGTTAACAGTTCGTTCACAACAATGGAAGCAGCAACCAAGACGACCAAAGGTGCCGGAGGAAGGAAAGG
CGGAGGCCCAAGAAAGAAGGCTGTAACCAAATCTGTCAAGGCTGGTCTTCAGTTCCCAGTTGGTCGTATTGCTCG
TTTCCTGAAGAAGGGTCGTTATGCTCAGCGTGTTGGAAGTGGTGCTCCAATTTACCTCGCTGCTGTTCTTGAATA
CCTTGCTGCTGAGGTGTTGGAGTTGGCTGGAAATGCAGCGAGAGATAATAAGAAAAGTAGGATTGTTCCTAGGCA
TGTACTTTTGGCAGTAAGGAATGATGAAGAGTTGGGGAAATTGCTGAGTGGAGTTACCATTGCAAGTGGAGGTGT
TCTTCCAAACATTAACCCAGTCTTGTTGCCAAAGAAATCTGCTGCAGCCGAGGAGAAGGCATCAACGCCCAGGTC
CACCAAGTCGCCAAAGAAGGCGTAGGACTATCAATTACAATTGATCTTTTGGTAAAATATGGCGGGCCACTCTTT
TGTCTAGTTTATTGGTACTACTTCTTGTAGTAGGACGTAGATTATTAGTTTTCTAAATTCAGTGTAATGGTGCTT
GGAAATATAATAGAaAGTaACTCTTTtT

> SEQ ID NO:412 103578    126805_300467_1

Figure 2 continued cggacgcgtgggCAAGTTTTCCTTCAAATCATTCATCATTTTTGTCTAAATTCTATTATCTGCAAATGGATACCA
GCGGAAAAGCTAAGAAAGGCGCGGCCGGAAGAAGAGGCGGCGGTCCAAAGAAGAAGCCGGTTACCCGGTCCGTGA
GAGCCGGTCTTCAGTTCCCAGTCGGTAGAATTGGTCGTTACCTGAAAAAAGGCCGATACGCCCAGCGCGTTGGTA
CTGGTGCTCCCGTTTACTTGGCTGCTGTGCTTGAATACTTGGCCGCTGAAGTGTTGGAATTGGCTGGAAATGCGG
CACGTGACAACAAGAAGAACAGGATTATCCCACGGCATGTGCTTTTAGCTGTGAGGAATGATGAAGAGTTAGGGA
AGTTGCTTGCTGGTGTGACAATTGCACATGGTGGTGTTCTTCCCAACATTAACCCAATTTTGTTGCCTAAGAAGA
CCGGAAGTGACAAGGCGGGCAAAGATCCTAAATCTCCTTCCAAAGCTACCAAATCTCCTAAGAAGGCTTAGATTT
AATGTCTGTTACAAGCCTTTTGTTTTTCTATGTTTACTTGGATCTTCACTGTATGTAATTCTTGTTTTAGAATGT
GTTTGATTTTCCTGTTGAAAAGGGAATTAGTTGGAATTGCTAGATCTTATTaggttgtcCTCTATTATCAATCAA
TGAAACCcCTTgttTCGAaTTTaa > SEQ ID NO:413  103578  119869_300360_1
TCGCAATCCAAAAGCTTCAATTTTTCCTAATACTTCTCTGTATTCAAGCTTCGTAAACTTTCATTCACATCAATG
GACGCAGCAACAAAGACAACCAAAGGTGCCGCTGGAAGGAAAGGAGGAGGCCCAAGAAAGAAGGCTGTAACCAAA
TCAATCAAAGCTGGTCTTCAGTTCCCAGTTGGTCGTATTGCTCGTTTCTTGAAGAAAGGTCGTTATGCTCAGCGT
GTTGGATCTGGTGCTCCAATTTACCTCGCAGCTGTTCTTGAATACCTTGCTGCTGAGGTGTTGGAGTTGGCTGGA
AATGCGGCCAGAGATAACAAGAAGAGTAGGATTATTCCTAGGCATGTGCTTTTGGCAGTGAGGAATGATGAAGAG
TTGGGGAAATTGCTGAGTGGAGTTACCATTGCAAGTGGAGGTGTTCTTCCTAACATTAACCCAGTCTTGTTGCCT
AAGAAAACTGCTGCAGTCGAGGAGAAGGCATCTAAACCCAAGGCCACTAAGTCACCAAAGAAGGCCTAGGACTAT
CTATTAGAAATGATCTTTTCGTTAAACATGGTGAACCAGTCTTTTGTCTAATTTATTGGTACTACTTCTTGTAGT
AGGACGTAGATTATTAGTTTTCTAATTTTGGTGTAGTGGTGCTTGGAAATATAATAGAAAGCAACTCTTTTT > SEQ ID NO:414  103578  129538_301606_1
gaatTCAGGAGGAAAGGTTGGAAGGGGAGGAAGAAAAGGTGGTGATAGAAAGAAAGCAGTAACAAAATCAGTCAA
AGCTGGACTACAATTCCCAGTTGGTAGAATCACTCGTTTCTTGAAGAAAGGTCGTTATGCTCAACGTGTTGGTTC
CGGTGCTCCTGTTTATCTCGCGGCCGTTCTTGAATATCTAGCTGCCGAGGTTTTGGAATTGGCTGGAAATGCTGC
TAGGGATAACAAGAAATCAAGGATTGTACCAAGGCATTTACTTTTAGCAGTAAGGAACGATGAAGAATTAGGAAA
GTTGCTTGCTGGTGTTACTATTGCTAGTGGTGGTGTTCTTCCAAATATCAACTCTGTTTTGTTGCCAAAGAAGGG
TCTTGAGAAGGAATCTACACCCAAATCTCCTGCCGGAAAATCTCCAAGGAAAGCTGCTGCCTAAATGATAGATCT
AGTTTGCTTTAACTTGTCCGAGTACAGTCTATTATGTAATGTAATGAAATCTAGGGACTCTTGGATCATGTTAGT
GTTTGAATGATCTGTTTTTTTTGGGGTTAGTTTTATGATTGAAATCAGTTTCGGGTTTCAATGTTCATATGGTTT
GTTGGAATATAGCTAATCAATGGAATCAAAAAAAAA > SEQ ID NO:415  103578  144886_200137_1
TTCCTCTGTCTGCAGTATAACAACAATCAAATGGCAGGTAGAGGGAAAAACCCTAGGATCTGGAGCAGCAAAGAAG
GCTACATCACCGTAGTAGCAAAGCCGCCTTCAATTCCCCGACGGTCGTCTCGCCCGTTTTCTCAAAGTCTGGAA
GTATGCCGAGCGTGTTGGTGCCGGAGCCCCTGTTTACCTTGCTGCCGTCCTCGAATACCTTGCTGCTGAGGTGCT
TGAATTGGCTGGAAATGCTGCGAGGGACAACAAGAAGACTAGGATAGTACCAAGGCATATACAGTTGGCACTCAG
AAATGATGAGGAATTGAGCAAGTTGCTTGGAGATGTAACTATTGCCAATGGTGGAGTTATGCCCAATATTCATAA
CCTTCTGCTGCCTAAGAAAGCTGCTGGCTCCTCAAAGCCATCTGCTGATGAAGATTACATTGGAAGGACAATAGG
CAGTTTCAAGTGTTAAGCCTTAAA > SEQ ID NO:416  103578  195978_300639_1
cactatccacgctgcacgtttaccattccgacatttgccgcaTCTCGCACCTTACATCTACTTTCGAGTAATTTT
TCGTTAACCCAAAAACCAACTTCAAAATGACTGGCGGCGGCAAATCTGGCGGCAAGGCCTCTGGCTCCAAGAACG
CTCAATCCCGATCCTCCAAGGCGGGTCTTGCGTTCCCGTTGGTCGTGTCCACCGTCTTCTCCGAAAGGGCAACT
ACGCTCAGCGTGTCGGTGCCGGTGCTCCCGTCTACCTCGCTGCCGTTCTCGAGTACCTCGCTGCCGAAATCCTCG
AGTTGGCTGGTAACGCCGCTCGTGACAACAAGAAGACCCGTATCATCCCTCGTCACCTCCAGCTCGCCATCCGAA
ACGATGAGGAGTTGAACAAGCTGCTGGACACGTCACCATCGCTCAGGGTGGTGTTCTGCCCAACATCCACCAGA
ACCTCCTCCCCAAGAAGACGACTGGCAAGACTGGCAAGGGTTCCAGCCAAgaATTGTAATTTTTTCGTTGGTCGT
TTGCGCTTTCTTTCGAGGTCGTTTTGGTTGTCATAAAGGGGTCAAGGGATaaggtTTACGGTTGCTTTTgTACGT
CTGGGTTgtaCattaaTCCCCAcggcTAtGATCAtgaatcaaTTAggGttttttttcaaATgc > SEQ ID NO:417  103578  194694_300765_1
ccccggcgcactcgcattcgacgacccaagaaaaggaaaaaaaagaaaaacaatcctccacgccttcgagcgca
gcaggAACCAGCTTAGCTAGACTAGCCATGGACGCCGCCGGAGCCGGAGCGGGTGGGAAGTTGAAGAAGGGAGCC
GCCGGGAGGAAGGCCGGCGGGCCGAGGAAGAAGGCGGTGTCGCGCTCCGTCAAGGCCGGGCTCCAGTTCCCCGTC
GGCCGTATCGGCCGCTACCTCAAGAAGGGCCGCTACGCCCAGCGCATCGGCACCGGCGCCCCCGTCTACCTCGCC
GCCGTCCTCGAGTACCTCGCTGCCGAGGTGCTGGAGCTCGCCGGGAACGCGGCCAGGGACAACAAGAAGAACAGG

Figure 2 continued

```
ATCATCCCGCGCCACGTGCTGCTGGCGATCAGGAACGACGAGGAGCTCGGCAAGCTGCTGGCCGGCGTGACCATC
GCGCACGGAGGCGTGCTGCCCAACATCAACCCGGTGCTGCTGCCCAAGAAGACGGCGGAGAAGGCCGCCGCCGCC
GGCAAGGAGGCCAAGTCGCCCAAGAAGGCCGCCGGGAAGTCCCCCAAGAAGGCCTAGGCGTCGGCGCCTCGCTTT
GCTTGTTTAGCTGGAGTAGaTTGGACGGGATGTGTGTCTGttagtagtCTAATGCTGttgatttaatCTATGGTG
GTgtcgttgaac > SEQ ID NO:418    103578    48682_300033_1
GCCATTACGGCCGGGGATACCGGGAAAACAATTCAAATTTGAACACGTCAACATGCCTTCAACAACAGCAACCAA
ATCGGTGGGTGGTAGAGGAAAACTCCAAAAAGCTACAAAATCCATCTCCAGATCTCAAAAGGCGGGTCTCCAATT
CCCTGTTGGCCGAGTTGCTCGGTTTTTGAAAAAGGGTCGTTATGCTCAGCGAGTTGGCTCCGGTTCACCGGTTTA
TCTCTCAGCGGTTCTTGAGTACCTTACTGCTGAGTTGTTGGAACTTGCTGGGAATGCTGCAAGAGACAACAAGAA
GAACAGAATTGTTCCTAGGCATATACAGCTTGCTGTGAGGAACGATGAGGAATTGAGCAAGTTGTTGGGGTCTGC
AACAATTGCTAATGGTGGGGTTCTGCCCAATATTCACCAGAATTTGCTTCCTAAGAAGATTGGCAAAGGGAAACC
TGAAATTAGCTCTGTTTCTCAGGAATTTTAGATATGTAGGTGTTGTATTAAGGGATTGGGTAGTGAACTTTTATT
TGTTCATAATGGTTCATGTGAATGACAAGTTTGTACCCTAATCCTATTAAGTTGACGT > SEQ ID NO:419    103578    47142_300174_1
gcagcATGGCGGGTCGGGGAAAACAACTTGGATCTGGTGCAGCGAAGAAGTCTACTTCTCGTAGTAGCAAGGCTG
GCTTCAATTCCCTGTTGGTCGTATCGCTCGATTTTTGAAAGCCGGTAAGTACGCCGAGCGTGTTGGTGCCGGAG
CTCCGGTCTATCTCGCCGCCGTTCTTGAATACCTCGCCGCTGAGGTACTTGAGCTTGCTGGGAACGCAGCGAGAG
ACAACAAGAAGACCCGTATAGTTCCACGACACATTCAGCTTGCTGTGAGGAATGATGAGGAGCTAAGCAAGTTGC
TTGGAGATGTGACAATTGCTAATGGAGGAGTGATGCCTAACATCCACAATCTCCTTCTCCCCAAGAAGGCTGGTT
CATCTAAGCCTACTGAAGAAGATTAGTAA > SEQ ID NO:420    103578    279870_200065_1
gatcAACATGAGTTCTACCGGAGAAATAAAATCTGTAGGGGGTAGAGGAAAGGCCAAAGGTTCAAAAAAATCCGT
CTCGAGATCTCTAAAAGCAGGTCTTCAATTCCCAGTTGGTCGTATTGCTCGTTATCTGAAAAAGGGTCGTTACGC
TCAGCGTCTTGGCTCTGGTTCACCAATTTACCTCTCTGCTGTTCTTGAATATCTTGCTGCTGAGGTGTTAGAGCT
TGCTGGAAATGCTGCTAGAGATAATAAGAAGACTAGGATAGTTCCAAGGCATATACAGCTTGCGGTGAGGAATGA
CGAGGAACTCAGTAAGTTGTTGGGGAAGGTGACAATTGCTAATGGTGGAGTTTTGCCCAAAATTCATCCAAATTT
GTTGCCTAATAAGAATGGCAAGGGGAAACTAGAAGCTGGAACCCAGTCACAGGAATTTTAGATTATGGGGTTAAA
TCAGTTTGTTGGGTAGACAGGTTTAATGTGTTTTTTGTGGATTA > SEQ ID NO:421    103578    271541_200035_1
cAATTCTTTCAAGCACAAAGCAAAGATTGTTGTTTTACAGTAACAAAATAGTATTAATGGCTGGTAGAGGAAAAA
CCCTAGGTTCCGGTGCTGCAAAGAAAGCTACGTCCCGTAGTAGCAAAGCCGGTCTCCAATTCCCCGTTGGTCGTA
TCGCCCGTTTCCTCAAAGCCGGCAAGTATGCCGAGCGTGTCGGCGCCGGCGCTCCCGTTTACCTTGCTGCCGTCC
TTGAGTACCTTGCAGCTGAGGTACTTGAATTGGCTGGAAATGCGGCGAGGGATAACAAGAAGACGAGGATTGTAC
CAAGGCATATTCAGTTGGCTGTGAGAAACGATGAGGAATTGAGCAAGTTGCTTGGAGATGTGACAATTGCTAATG
GTGGTGTTATGCCCAACATTCACAACCTTTTGCTGCCTAAGAAGACTGGTGGATCCTCAAAGCCCTCTGCTGATG
AGGATTAAATAGATGGCCAATTTGGAATTGAGAGCTATATGATGTTTTTgttAGTCTATAGAGAGATTTAGATCA
TGAAATTAAGCCCCCACCCCCAAATGTGGAATgttATTTCcTTAGTTCTGCTAGTTGTCAaggtTTATGTTAGTA
TGTGAATACAAATTAAGGGATGTATGaaaa > SEQ ID NO:422    103578    266810_200031_1
cgttatttattatgcatcttgactaccccctcgaccacgcgtccgcaaTTTTTTCCTTCAAAATCATTCATCATCC
TGCTCTAAATTCTTCTATCTTCAAATGGATACTAGCGGCAAAGCGAAGAAAGGTGCAGCCGGAAGAAGAGGCGGT
GGTCCAAAGAAGAAGCCGGTTACCCGGTCCGTGAGAGCCGGTCTTCAGTTCCCGGTCGGTAGAATCGGTCGGTAC
CTGAAAAAAGGCCGTTACGCTCAACGTGTTGGTACTGGTGCTCCCGTTTACTTGGCTGCTGTTCTCGAATATTTG
GCTGCTGAAGTGTTGGAGTTGGCTGGAAATGCGGCACGTGACAACAAGAAGAACAGGATTATCCCAAGGCATGTG
CTTTTGGCTGTGAGGAATGATGAAGAGTTAGGGAAGTTGCTTGCTGGCGTGACAATTGCACATGGTGGCGTTCTT
CCCAACATTAACCCAATTTTATTGCCTAAGAAGACTGGAGGTGATAAGGCTGGAAAAGAACCTAAATCTCCTTCC
AAAACTACCAAATCTCCTAAGAAGGCTTAGATTTAGTGGTTGTAATAGCCTTTTGTTTTTCTATCTTTATTTAAA
TATTTACTGTATCTAACTGTGCTGTTAGAATGTGTTCAATCGTTCTTCGGGGATGAAAAAATGGAATTAGTTGGA
ACTTGGAACTGTTGGACCTTATTAAGAGGTTGTGTTCTATTGTCAATCAATGAAGCCCCGTGTTTCGAATTTAC > SEQ ID NO:423    103578    255104_301642_1
GGGGAAGAGGCAGTGGCGGCGGGGCGAAGGGCGGGAGCCGGAAGAAGTCCGTGACGAAGACCACGAAGGCCGGCT
TGCAGTTCCCGGTCGGCCGGGTCGCCCGCTACCTCAAGAAGGGGCCGGTATGCGCAGCGTATTGGGTCCGGTGCCC
```

Figure 2 continued

```
CCGTCTACCTCGCCGCTGTCATGGAGTACCTCACTGCCGAGGTCCTGGAGCTCTCTGGGAACGCCGCCAGGGACA
ACAAGAAGTCGCGCATCGTCCCGCGCCACATCCAGCTCGCCGTCAGGAACGACGACGAGTTGTCGAAGCTTCTCG
GCGGGGTGACCATTGCTCACGGCGGCGTCCTCCCCAACATCCATTCTGCTCTCCTCCCCAAGAAGAGCTCCTCCT
CCTCGGCCGCCCCCGGCCCCGAGGAGAAGCCCAAGAAGACCCCCAAATCTCCCTCTAAGCCGAAGCCTGCCAAGG
AGTAGAGAGAGAGAGAGAGAGCGGAGCTGAGCTGAGCAGGATCAGATTTGTGCCACCTTTTCCTTCTTCCTCAAG
GTGTCTCTCAATGTCATCTGTATATGCATGCTCT
```

> SEQ ID NO:424 103578 234825_301221_1
```
GGGAAAAATGTCGGGGTGCGGGAGGAAGGAAGGGGAAGAAGAAGGCGACGTCCAAATCGACCAGGGCTGGTGCTA
CAGTTCCCGGTTGGAAGATTGGCTCGCTACCTCAAGAATGGGAGGTATGCCAAGCGCGTCGGCAGTGGAGCGCCC
GTCTATCTCGCCGCGGTTCTCGAGTACCTCGCCGCAGAGGTTTTGGAGCTGGCCGGCAATGCTGCTCGGGACAAC
AAGAAGTCTAGAATAATCCCGAGACACATCCAGCTCGCGATCCGGAACGACGACGAGTTGGGGAAGCTTCTCCAG
GGCGTGACGATCGCGTATGGGGCGTGATTCCACACATTCATGCCGTGCTTCTCCCCAAGAAATCCAGCTCCTCT
TCCACCGCCGCCGCCGATTCCAAGGCCGCGGAGAAGAGCCCTAAGGCCGAGAAGGCCGAGAAGGCGGCCAAGTAG
CATTCTTCCTGAAGAAGAGAGAGGAAACTACTCTTTGACTCTTTGTATTATATCTAATCACAACGACTTTATTGA
AAAACAAAAAACACAAC
```

> SEQ ID NO:425 103578 227559_301029_1
```
CACGCGTCGCGAATCACGCCGCGCCGCCTCTTGACCTAGCGCCGCCGCCGCTGCCGCTGCCCCTTCTCGCCGCCG
GCTTCTTCTTCTTCTTCCTTGTGTAGCGCGTGCGCCTCTCCTCTCCTCTCGTCGGCGAGTGATATGGCGGGACGT
GGGAAGGCGATCGGCGCGGGGGCCGCGAAGAAGGCGACGTCGAGGAGCTCCAAGGCCGGGCTGCAGTTCCCCGTG
GGCAGGATCGCGAGGTTCCTCAAGGCCGGGAAGTACGCCGAGCGCGTCGGCGCCGGGGCCCCCGTCTACCTCGCC
GCCGTCCTCGAGTACCTCGCCGCTGAGGTGCTCGAGCTCGCCGGGAACGCGGCGAGGGACAACAAGAAGACCCGC
ATCGTGCCGCGCCACATCCAGCTCGCGGTGCGCAACGACGAGGAGTTGACCAAGCTGCTCGGCGGCGCCACCATC
GCCAGCGGCGGCGTGATGCCCAACATCCACCAGCACCTCCTCCCCAAGAAGGCCGGGTCATCCAAGGCATCCACC
GTCGACGACGACGACAACTAGGCCGCCCGGGCGCCTTCTGCATTAGTAGGATCTTTTGCTAGCTGTTCGTCTGGA
TTTGCATTGTGTTGTTGCGCTGAGCAGTAGGAAGGGGAAAAAGAGAGAGAGAAGTTCTTGGTTGGTGGTTTGG
```

> SEQ ID NO:426 104218 108007_300057_1
```
CCCACGCGTCCGAGCTCGTCAAAGATGCTTTCCAAAACTAGCCTTTTTCTTTGCCTTTCTTTGGCTATTTTGCTA
ATAGTAATATCCTCACAAGCTGATGCAAGGGAGATGTCTAAGGCGCCTGCTACAATAACCCAAGCAATGAAGATG
GGTGCAGGAATCAACGGCGTCGGCAAAGGCGTTGGCAAAGCCGTTGGCAAAGCTGTTGGCAAAGTAGCCGGCAAA
GCTTGTAAAATTTGCTCATGTAAATACAAAATTTGCAGCAAATGTCCTAAATGTCATGATTAAAGTTAGGCCTCA
GAGACTATGTACTTGTGCTGGTGTGAGTTTAGTTTTGAGAATAAAGGGAAAGCTATGAATAGCCTAATATAATTC
TATTCACTTTGTTTTGTTAGTAGTTGCAACTTGCAACAAGTCTTTGGGTCAAAATGTACCTCGTCTTGTAGTCTT
TCAACTGTATAACATTGTACTGTACTGTATTTTGTCTTTAGCCACTTG
```

> SEQ ID NO:427 104218 44076_300114_1
```
GCCATTACGGCCGGGGACAAAAAAAATTGAAGCTCGAAATAGCTCATCAAAATGTTTTGGAAAACTAATCTTTTT
ATTTGTGTTTCTTTGGCTATTTTGCTAATAGTAATACTCCAACTAGCTGATGCAAGGGAGATGTCTAAGGCGGCT
GCTCCAATTACCCAAGGAATGGATTCAAACAACATTAGTGATCAAGCGGGTTATGCTCGGGTTTTACGTTGTTTG
GCTTGCAGATGTTGTGTCGGTTAAATTTTATATATTTTTTACGATCAAATATTATACAATGTTTTTGTATGTGCT
AAAAGTAATAATACTCCAAAATAAGGCACAACATTGTGGTAGTATTAGTTTGTGTTGTTATACATGTCTTGTCCG
GTTGTCTTTCAACTTTGTGGTACTGTAATTTTAATTCTGGTCAATAAATAGTACTACTAATTAGTGTTTATGGTT
```

> SEQ ID NO:428 104251 144991_301079_1
```
cacgcgtcggcttcacacttactctagagtgtgcttgcaaactcatccaaacattactttgattggagaagaggt
atttgCAAAGAAACTGACTCTTAAGAATGTTACCGACTACATTGCTGATGTGATCTGCAAGCGTGCAGAGTCAGG
TTACAATTATGGAGTGATCCTCATTCCTGAAGGACTTATAGATTTCATTCCTGAGAttcagCAACTCATTGCGGA
ACTAAACGAAAtAtngGCTCATGATGTCGTGGATGAAGCTGGTGTTTGGAAAAAGAAGCTTACTCCCCAGTGTCT
TGAGCTCTTTGAGTTGCTGCCCCTAGCAATTCAGGAACAACTGCTGCTTGAGAGAGATCCACACGGAAATGTCCA
GGTAGCTAAAATTGAAACTGAGAAAATGCTTATTCAAATGGTTGAAACTGAATTAGGTCAGAGGAAGCAGAAGGG
TGGATATAATGCTCAATTTAAAGGACAATCCCACTTTTTCGGTTATGAAGGAAGGTGTGGCTTGCCATCCAATTT
TGATTCCACATACTGTTACGCGTTGGGATACGGTGCAGGAGCACTGCTGCAAAGTGGGAAGACAGGGCTGATATC
ATCGGTTGGCAACTTGGCTGCTCCAGTTGAAGAATGGACCGTTGGTGGAACAGCACTCACTGCATTGATGGACGT
GGAGAGGAGACATGGCAAGTTCAAGCCAGTTATCAAGAAGGCTATGGTGGAGCTTGAAGGTGCTCCATTCAAGAA
ATTTGCTTCAAAGCGGGAAGAGTGGGCTCTTAACAACCGATACATTAACCCAGGTCCCATTCAATtt
```

> SEQ ID NO:429 104421 109080_300042_1

Figure 2 continued

CGGACGCGTGGAAAAACACACAGAAAAAATATGGCGAGCAGGAATGAAGTTGTGTCCGTTGAGCTTCCTGCTCCA
GCTGGCTGGAAGAAGACGTTTCTGCCCAAGAAAGGAGGAGGAGGGACTCCAAAGAAAAAAGAGATCGTATTTACT
GCGCCAACGGGGGAGGAGATCACTACAAAGAGACAGTTGGAGCAGTACCTGAAGTCACACCCTGGCAGTCCGCCA
ATCACGGAGTTTGACTGGGGAGCTGGTGAAACTCCGAGAAGATCCTCAAGACTCAGTGGAAAGGCAAAGGCAGCT
TCACCTTCAGCGGAAAGTGAGACTCCAAAAAAGCGAAGCAGAAAATCTTCAGCTTCTAAGAAGGCTGTGAAAGAC
AATGAAGTCCATGAAGAAACAGAAGCGGCAAAGGATGAAAAGGATGTTGACATGCAAGAAGCTGAAAAACATGAA
AAGGATACTCTGTCTATGGAAGCTGAGAAGGAGGTCGAACAGAAACAGGATGAGGGAAAAGATGAAAACAAGGAT
ATG

> SEQ ID NO:430  104421  120643_300428_1
TAAATTTTCTCTGTGGGTTTTGCTCAAAACAAAGCTGAGACTGGCTGATTTTGACTTTTAAGAATGGCAAGTCCT
ATGGAGAAGGAGAGTCATAACGTAATTAATGATGAAATTGTGTCGGTGGAGCTTCCTGCACCTCCTTCCTGGAAA
AAGTTGTTCATTCCAAAGCAAGGGAGTACACCAAAGAGGAATGAGGTTGTATTTATTGCTCCAACTGGAGAGGAG
TTCAAGAACCGCAAACAGTTGGAGCAGTATCTCAAATCACACCCTGGTAACCCTGCAATATCAGAATTTGATTGG
AGTACCGGCGAGACTCCAAGGAGATCAACAAGGATCAGTGAGAAGGCAAAGGCAATGAGACCACAATCACTACTT
GAATCACCAATGAAAAGACGCCGAACATCATCTGGTGTAAAGAAAGATAGCAAGGAAGCGGAAGCTGCAAAAGTT
GACCAGGAAAGTTCTGAAACGAAAGAGATGGAATCTGCCAAAGAAGAAAATGAGAACTTGGAGAAGAAAGATGGA
GGAGCAGAAGCTGAAATGAACAAGGGGAAGAAAGAGGTGGAAGCTGCGGATGAAGAGGCAGAGGGCATGAAGGGT
GCTGAACTACACCCGGAGGAGAAGCCAGAAATGGATGAC

> SEQ ID NO:431  104423  107135_300263_1
aagagtttCTCATCTACTTTCTATAATGGCAGCTGCTACAATGGCTCTCTCTTCCTCTTCATTTGCCGGAAAGGC
GGTAAAACTCTCACCATCTTCCTCTAAAATCACTGGAAATGGAAAAGTTACCATGAGGAAGACGGTTACCAAGGC
CAAGCCTGTTTCTGCTGGTAGCCCGTGGTATGGTCCTGACCGTGTCAAGTACTTGGTACCATTCTCTGGTGAGTC
TCCCAGCTATTTGACTGGTGAGTTTCCTGGTGACTATGGATGGGACACTGCTGGACTTTCAGCCGATCCTGAAAC
TTTCGCCAAAAACCGTGAGCTAGAGGTTATCCACTGCAGATGGGCGATGCTTGGAGCTCTTGGTTGCGTCTTCCC
CGAGCTCTTGGCACGTAGCGGTGTCAAATTCGGTGAAGCTGTATGGTTCAAGGCTGGATCCCAAATTTTCAGCGA
GGGTGGACTTGACTACTTGGGCAACCCAAGTTTGGTTCACGCACAAAGCATCTTAGcCATATGGGCTTGCCAAGT
TGTGTTGATGGGAGCTGTgagggttAtCGTGTtGCtGgtgGgccTc > SEQ ID NO:432  104423  126385_300501_1
gccattacggccgggggggacacagccggttttatctgctgagcctgaggcctttGCCAAGAACAGAGCTCTTGAGG
TCATCCATGGGAGATGGGCCATGCTTGGGGCACTGGGTTGCATTACTCCAGAAGTTCTCGAGAAATGGGTGAAAG
TGGACTTCAAGGAACCAGTATGGTTCAAAGCTGGAGCCCAAATCTTCAGTGAAGGAGGACTCGACTATTTGGGCA
ACCCAAACCTTGTCCATGCTCAGAGCATTCTAGCAGTGTTGGGCTTCCAAGTAGTTCTAATGGGCCTTGTAGAAG
GTTTTAGAATTAATGGGCTTCCTGGAGTTGGTGATGGCAACAATCTCTACCCAGGTGGTCAGTACTTTGACCCAC
TTGGCCTAGCTGATGACCCAACTACTTTTGCCGAGCTCAAGGTTAAGGAGATCAAGAATGGAAGATTGGCTATGT
TCTCCATGTTTGGATTCTTTGTTCAAGCTATTGTCACTGGCAAAGGTCCTCTTGAGAACCTTTTGGATCACCTTG
ACAACCCTGTTGCTAACAATGCATGGGTTTATGCAACTAAGTTTGTTCCTGGATCTTAAATTTTACATTTTGACT
TCCTCCACAAGAGGCTTGTACCACTGAGTCATTCAGAATGCAAATATTTGGCAGATGAAAACTATTTTGCCATGT
GATAaATACTCTTTTAGccACTAACATtTCATTAACTCTTGtggtaaggacTATg > SEQ ID NO:433  104423  126123_300460_1
cccccGACAGCTAACTTCTCTATTACTTCAGCCATCAAAAAACACTTATTTTTCCTTATTAAACCATGGCTGCT
TCTACAATGGCTCTCTCTTCCACTTCTTTTGCCGGAAAGGCAGTAAAACTCTCACCATCTTCCTCTGAAATCACC
GGAAATGGGAAAGTTATCATGAGGAAGACTGCTAGCAAGCCCAAGCCTGTCTCTTCTGGCAGCCCATGGTACGGT
CCTGACCGTGTCAAATATTTGGGTCCCATTCTCCGGTGAATCTCCAAGTTACTTAACTGGTGAGTTTCCTGGTGAC
TATGGATGGGATACCGCTGGACTTTCAGCTGATCCAGAAACTTTTGCCAAGAATCGTGAGTTGGAGGTAATCCAC
TGCAGATGGGCTATGCTTGGAGCTCTTGGTTGTGTCTTCCCTGAGCTCTTGGCTCGTAACGGTGTCAAGTTCGGT
GAAGCTGTATGGTTCAAGGCTGGATCCCAGATTTTCAGCGAGGGTGGTCTTGACTACTTGGGCAACCCAAGTTTG
GTCCATGCTCAAAGCATCTTGGCTATTTGGGCTTGCCAAGTTATTTTGATGGGAGCTGTTGAAGGTTACCGTGTT
GCCGGTGGACCTCTTGGCGAGGTTGTTGATCCACTTTACCCTGGTGGCAGTTTCGACCCGTTAGGCCTTGCTGAA
GACCCAGAAGCTTTTGCTGAGCTAAAGGTAAAGGAGATCAAGAACGGCAGACTTGCCATGTTTTCCATGTTTGGA
TTCTTTGtCCAggctATCGTTACCggaaagGGTCCATtaaataacctcgccgacCACCTtg > SEQ ID NO:434  104423  6251_300336_1
CCCACGCGTCCGGGCAGGCTCTCAGATTTTCTCAGAAGGAGGTCTTGATTACCTCGGAAACCCTAACTTGATCCA
CGCGCAAAGCATCTTAGCCATCTGGGCTGTTCAAGTTGTGCTCATGGGGTTCATTGAAGGCTACAGAATCGGAGG
TGGACCACTCGGAGAAGGACTTGACCCGCTTTATCCCGGAGGTGCGTTCGACCCATTGAACTTGGCTGAGGATCC

Figure 2 continued

AGAGGCTTTCTCTGAGCTGAAGGTGAAGGAGCTCAAGAACGGTCGTCTTGCCATGTTCTCTATGTTTGGATTCTT
TGTCCAAGCCATTGTTACTGGTAAAGGTCCCATTGAGAACTTATTTGATCATTTGGCTGATCCTGTGGCTAACAA
CGCCTGGTCTTACGCTACTAACTTTGTCCCCGGAAAGTAATTATCTTATGTATTTGCTTCATAATCTCTCTGCTT
TGTAAACTCGTGAATGTACTTATTGGTGTTTATGTGAATTTGGCACTTAATGC

> SEQ ID NO:435 104423  52310_300094_1
agCTacctcactggaGAGttccccgGTgattACGGGTgggAcACTGccggtCTATCCGcCGATccCGAGAccttTC
gctAGGaaccGTGAGCTAGAAGTTATCcacAGCAGATGGGCCATGCTCGGAGCccTAGGCTGCGTTTTCCCTGAG
CTATTGGCTAGGAACGGAGTGAAGTTCGGAGAAGCGGTTTGGTTCAAGGCTGGTTCACAGATCTTCAGCGACGGA
GGATTGGACTACTTGGGCAACCCGAGCTTGGTCCACGCTCAGAGCATCTTAGCCATTTGGGCTACTCAAGTTATC
CTCATGGGAGCTGTTGAGGGCTACAGAGTCGCCGGAGATGGTCCATTGGGAGAAGCAGAGGACTTGCTTTACCCA
GGTGGGAGCTTCGACCCATTGGGCCTCGCTACTGACCCCGAGGCTTTCGCGGAGTTGAAGGTGAAGGAGCTCAAG
AACGGAAGGTTGGCTATGTTCTCTATGTTTGGATTCTTCGTTCAGGCCATTGTCACCGGAAAGGGACCGTTGGAG
AACCTCGCGGACCACTTGGCTGATCCAGTCAACAACAATGCATGGGCCTTCGCTACCAACTTCGTCCCCGGAAAG
TGAGTTTAATTTGTGATCGAGTTGTGTGTATCCGGTTTGTTGCATCTTGGAAATGTGATGCAGATTTCATATCTT
GTAAATTACTTTGTATGTGTGTGAAATATTTAAGAAGCTTTATGATAAAAAAaaaaaccaaaaaaggcggacgcg
tggg > SEQ ID NO:436 104423  255729_301643_1
tcgacTCAGCAAGAGCTAGACATGGCTTCGCTCTCTTCCTCATTGGCCGGGCAAGTAGTGTTGAAGGCACAGAGC
TCACTCGCAGCGAAGGTGGGCAACAATGTATTGGGCGAGGCAAGAGTTAGCATGAGGAAAACTGCCTCCAGAGTG
TCGGTACCGGACAGCCCATGGTACGGCCCAGAGCGGGTCAAGTACCTAGGCCCATTCTCCGGCGACTCGCCCTCA
TACTTGACTGGGGAGTTCCCCGGTGACTACGGCTGGGACACTGCTGGCCTCTCTGCCGACCCCGAGACCTTTGCC
CGCAACAGGGAGCTAGAGGTCATCCACTGCCGATGGGCCATGTTGGGCGCACTGGGCTGTGTCTTCCCTGAGCTC
CTCTCAAAGAACGGTGTCAAGTTTGGCGAAGCTGTCTGGTTCAAGGCTGGGTCTCAGATCTTTGCCGAGGGTGGG
CTTGACTACCTGGGTAACCCTAGCCTGGTCCATGCCCAGTCTATCCTTGCCATCTGGGCTTGCCAGGTCATCTTG
ATGGGTGCTGTTGAAGGCTACCGTGTTGCTGGTGGGCCCCTTGGCGATGTAACTGACCCCATCTACCCTGGTGGC
AGCTTCGACCCCCTAGGGCTAGCTGATGACCCCGAGGCCTTCTCTGAGCTGAAAGTGAAGGAGATAAAGAATGGA
CGGctGGCTATGTTCTCCATGTTTGGATTCTTCGTGCAGGCcATCGTGactggtaagGGCCcAGTTGAGAACTTG > SEQ ID NO:437 104423  254006_301631_1
GATTTCTCTGAGATTCGTCCTCGGTTTTGAGTGGTGTTGCTACAAGGTCTCGAACTATGGCTACCGCTACTGTCT
GCGCATCTCTGAGCAGCTCCACCTTCGCTGGGCAAACGGCTCTCAAACCCCAGTCTGAGCTTTCCAGGAAGGTCA
ACAATGTCGAGGCCAGGGTAAGCATGAGGAGGACAGTCAAAACTGCCCCAGAAAGCATCTGGTATGGTTCGGACC
GCCCTAAGTTCCTTGGCCCGTTCTCGGAGAGTACCCCCTCGTACCTTACTGGCGAGTTCCCCGGTGACTATGGCT
GGGACACCGCCGGACTCTCTGCCGACCCCGAAACCTTTGCCCGTAACCGCGAGCTCGAGGTCATCCACTCGCGCT
GGGCCATGCTTGGCGCCCTGGGATGCGTCACCCCTGAGCTCCTCGCCAAGAATGGCGTTAAGTTCGGGGAGGCTG
TCTGGTTCAAGGCCGGCTCGCAGATCTTCTCCGAGGGTGGGCTCGACTACCTCGGGAACCCGAACCTGATCCATG
CACAGAGCATTCTGGCGATTTGGGCATGCCAGGTGGTGCTGATGGGAGCTGTGGAAGGGTACAGAGTTGGTGGCG
GCCCGCTAGGAGAAGGGCTCGACCCAATATACCCCGGGGGTGCATTCGACCCACTCGGGCTGGCCGACGACCCCG
AGTCGTTTGCCGAGTTGAAAGTGAAGGAGATT > SEQ ID NO:438 104423  201255_300714_1
CGCCATCTCTCTCAGCTCTCACAGCTCTGCATCAATGGCCGCGGCCACCATGGCGCTCTCCTCCCCGGTGATG
GCCCGCGCGGCGCCGTCGACCTCCTCCGCGCTCTTCGGCGAGGCGCGGATCACCATGCGCAAGACCGCCGCGAAG
CCCAAGCCGGCGGCGTCGTCGGGGAGCCCGTGGTACGGCGCCGACCGCGTGCTCTACCTCGGCCCGCTCTCCGGC
GAGCCGCCGAGCTACCTGACCGGCGAGTTCCCCGGCGACTACGGGTGGGACACCGCGGGGCTCTCCGCCGACCCG
GAGACGTTCGCCAAGAACCGGGAGCTGGAGGTGATCCACTCCAGGTGGGCGATGCTGGGCGCGCTGGGCTGCGTG
TTCCCGGAGCTCCTCGCCCGGAACGGCGTCAAGTTCGGCGAGGCGGTGTGGTTCAAGGCGGGGTCGCAGATCTTC
AGCGAGGGCGGGCTCGACTACCTCGGCAACCCGAGCCTGATCCACGCGCAGAGCATCCTCGCCATCTGGGCGGTC
CAGGTGGTGCTCATGGGCGCCGTCGAGGGGTACCGCATCGCCGGCGGGCCGCTCGGCGAGGTCGTCGACCCGCTC
TACCCCGGCGGCAGCTTCGACCCGCTCGGCCTCGCCGACGACCCGGAGGCCTTCGCGGAGCTCAAGGTGAAGGAG
ATCAAGAACGGCCGCCTCGCCATGTTCTCCATGTTCGGCTTCTTCGTCCAGGCCATCGTCACCGGCAAGGGCCCC
CTCGAGAACCTCGCCGACCACCTCGCCGACCCCGTCAACAACAACGCCTGGGCCTACGCCACCAACTTCGTCCCC
GGCAAGTGAGCGCCGCCGCCGTGCTGCCATGGCGACGCATCGCCTTCAGCTAAGCTAGCTAGGTTGACGACG
ATGCGCGTCTCTGCAGGAGAGTGTGCGTGTGTGTACGCGGTGCAGTAGATGTACGTACGTGTACCGTATAGATGT
ACGTATTCGTGTGGACCGCGTGGATGGATGTACGAGTATTGgagagaaggtgagatctgtaccggtagcccgtat
ttctgtgcaggttctgaacctgatcaatgaaatatggtgttgtgaa

Figure 2 continued

> SEQ ID NO:439   104423   175141_300530_1
GCCAAGAACCGGGAGCTGGAGGTGATCCACTCCCGGTGGGCGATGCTGGGCGCGCTCGGCTGCGTCTTCCCGGAG
CTCCTCGCCCGGAACGGCGTCAAGTTCGGCGAGGCCGTGTGGTTCAAGGCGGGCTCGCAGATCTTCAGCGAGGGC
GGGCTCGACTACCTCGGCAACCCGAGCCTGATCCACGCGCAGAGCATCCTCGCCATCTGGGCGGTGCAGGTGGTG
CTCATGGGCGCCGTCGAGGGGTACCGCATCGCCGGCGGGCCGCTCGGCGAGGTCGTCGACCCGCTCTACCCCGGC
GGCGCCTTCGACCCGCTCGGCCTCGCCGATGACCCCGAGGCGTTCGCGGAGCTCAAGGTGAAGGAGATCAAGAAC
GGCCGCCTCGCCATGTTCTCCATGTTCGGCTTCTTCGTCCAGGCCATCGTCACCGGCAAGGGCCCCCTCGAGAAC
CTCGCCGACCACCTCGCCGACCCCGTCAACAACAACGCCTGGGCGTACGCCACCAACTTCGTCCCCGGCAAGTGA
AGTGGGGGACCGTAGCTTAGCAGTGGTTAATTGTGGTTGGATGGATTTGTGGCCAGCGAGTTCGTTGTCTTTGGG
TTGGGGAAGATGGGTTTAGTGCGACGAGATGATGATCGAGTTGGTGTTGTGTACACTAAGAAGATGAAGAAGAAG
ATGATGTTTTTGCAATAATGATTTTATTCGTTTCCCAACTAATGGTcTaggTACTTATCCgtggtgttAtTctgg
ttagcggAtttcTCATCTCTAttagatcGGaaacaaatacttcccTCGAtcccaaaatAt > SEQ ID NO:440   104423   168423_300556_1
gcgcgccgggggatacagatttggttggctttgctggcttccccCCAAATCTGTATCCTCCGGCAGCCCATGGTA
CGGTGCCGACCGTGTTAAGTACTTGGGTCCCTTCTCCGGTGAGTCTCCATCTTACCTCACTGGTGAATTCCCAGG
TGATTACGGTTGGGACACAGCTGGGCTTTCAGCTGACCCTGAAACCTTCTCCAAGAACCGTGAGCTAGAAGTCAT
TCACTGCAGATGGGCAATGCTTGAAGCTGTATGGTTCAAAGCCGGTTCCCAAATTTTCAGCGAAGGTGGATTGGA
CTACTTGGGTAACTCAAGCTTGGTTCATGCTCAGAGTATTCTAGCTATCTGGGCTACACAAGTTATCTTGATGGG
TGCAGTTGAAGGTTACCGTGTTGCTGGTGGTCCACTAGGAGAGGTTGTCGACCCACTTTACCCAGGTGGTAGCTT
TGACCCTCTTGGCCTTGCTGACGATCCAGAGGCTTTTGCTGAATTGAAGGTGAAAGAAATCAAGAATGGGAGATT
GGCAATGTTCTCAATGTTTGGGTTCTTTGTTCAAGCTATTGTGACTGGTAAGGGACCTTTGGAAAATTTGGCTGA
TCACCTAgcTGATCCCGTTAGCAACAATGCTTGGAACTACGCCACTAACtTCGcaccCggAAAgtgaagaaaTTT
TGTtTGagaTTgtCagattagatTAttggaaaCTGat > SEQ ID NO:441   104423   167530_300548_1
gaattcagaactggtgaacaacaaagaagcagtagaaaaagagagtcatggccacctctgccattcaaaggtctg
cattcGCTGGTCAAACTGCTTTGAAGCAACAAAATGAGTTCATCCGCAAAGTTGGCAATGTGGAAGGTGGTCGTA
TCTCCATGCGCCGCACTGTAAAAAGCATTCAGTCAAGCATGTGGTATGGACCAGACAGACCTAAGTACTTGGGAC
CATTCTCAGAACAGACCCCATCTTACCTCACTGGTGAATTTCCAGGTGACTACGGTTGGGACACAGCCGGGTTAT
CTGCTGACCCAGAGACATTTGCAAAGAACCGTGAACTCGAAGTGATCCACTGCAGGTGGGCTATGTTGGGTGCCC
TAGGATGTGTCTTCCCTGAGGTTCTCTCAAAGAACGGTATCAACTTTGGCGAGGCAGTATGGTTCAAAGCTGGAT
CACAGATCTTCTCTGAGGGAGGTTTGGACTACCTTGGAAACCCTAACTTGGTACATGCCCAAAGCATTCTTGCAA
TCTGGGCTACTCAGGTTGTGCTAATGGGGTTTGTTGAGGGATACAGAGTTGGTGGTGGTCCACTTGGAGAAGGAC
TAGACAAACTTTACCCCGGTGGATCTTTTGACCCTCTAGGATTAGCTGATGACCCAGAGTCATTCTCTGAATTGA
AGGTAAAGGAAATCAAGaATGGAagACTTGCTATGTTCTCTATGTTTGGGTATTTCGTTCAGGCTATTGttaCCG
GAAAGGGTCCAATTGAAAACCTTTATGACCAcgtcgcCGATCctGttgcAAATAACGCATgggcTTACGCTACTA
ACTttgctccTGGAAAATGAATGTAAATttttcctaggGTGTATCa > SEQ ID NO:442   104423   158561_200019_1
cgtccgaaaattctttctgtgtgtAGTAGCTGCATTTTAAAGTATTTCTTTTTATTTCTACAATGGCAGCTGCTA
CAATGGCTCTCTCTTCCTCTACTTTTGTTGGAAAGGCAGTGAAACTCTCACCATTTTCCTCTGAAATCACTGGAA
ATGGGAAAGTTACCATGAGGAAGACGGCTAGCAAGGCCAAGCCAGTTTCTTCTGGTAGCCCATGGTACGGTCCTG
ACCGTGTCAAGTACTTGGGACCATTTTCTGGTGAGTCCCCAAGTTACTTGACTGGTGAATTTCCCGGTGATTATG
GGTGGGACACTGCCGGACTTTCAGCTGATCCAGAAACTTTTGCTAAGAACCGTGAGTTGGAGGTGATCCACTGTA
GATGGGCTATGCTTGGAGCTCTTGGTTGTGTCTTCCCTGAGCTCTTGGCCCGTAACGGTGTCAAATTCGGTGAAG
CTGTATGGTTTAAGGCTGGATCCCAAATTTTTAGTGAGGGTGGACTTGACTACTTGGGCAATCCAAGTTTGGTCC
ATGCACAAAGCATCTTGGCCATTTGGGCTTGTCAAGTCATGTTGATGGGAGCTGTTGAGGGTTACCGCATTGCTG
GTGGGCCTCTTGGTGAAGTTGTTGACCCACTTTACCCCGGTGGCAGCTTCGACCCATTAGGTCTTGCTGAAGACC
CAGAGGCTTTTGCTGAGCTCAAGGTAAAAGAGATCAAGAATGGCAGACTTGCTATGTTCTCCATGTTTGGATTCT
TCGTTCAAGCTATTGTCACCGGAAAGGGTCCATTGGAGAACCTTGCTGACCACCTTGCCGACCCAATTAACAATA
ACGCATGGTCCTACGCTACAAACTTTGTTCCCGGAAAATGAAGTTCTTTAGAAACAAAAAGCACCTCCTCTGTTA
TCACATTTTTTGTCTTTGTAAAGCTAATGTAAACTTTAGTGAATATTATATGTGAATTTTGTTTGATTGTGT > SEQ ID NO:443   104423   135477_300414_1
cggacgcgtggGAAAAACCAACCCAACCGCCGCCGCATCGCCCTCGTTAGAACGATGGCCGCGTCGGCGCTGCAC
CAGACCACCAGCTTCCTCGGCACCGCCCCTCGCCGGGATGAGCTCGTCCGCCGCGTCGGCGACTCCGGTGGCCGC
ATCACCATGCGCCGCACCGTCAAGAGCGCGCCCCAGAGCATCTGGTATGGACCTGACCGTCCCAAGTACCTGGGC
CCGTTCTCGGAGCAGACGCCATCGTACCTGACCGGAGAGTTCCCGGGAGACTACGGGTGGGACACGGCGGGGCTA

Figure 2 continued

```
TCGGCCGACCCGGAGACGTTCGCGAGGAACAGGGAGCTGGAGGTGATCCACTCGCGGTGGGCGATGCTGGGGGCG
CTGGGCTGCGTCTTCCCGGAGATCCTGTCCAAGAACGGGGTGAAGTTCGGGGAGGCGGTGTGGTTCAAGGCCGGC
GCGCAGATCTTCTCCGAGGGGGGGCTCGACTACCTGGGGAACCCCAACCTGGTGCACGCGCAGAGCATCCTCGCC
ATCTGGGCGGTCCAGGTGGTGCTCATGGGATTCGTCGAGGGCTACCGCGTCGGCGGCGGCCCGCTCGGCGAGGGC
CTCGACAAGGTGTACCCAGGCGGCGCCTTCGACCCGCTCGGCCTCGCCGACGACCCTGACACCTTCGCCGAGCTC
AAGGTGAAGGAGCTCAAGAACGGCCGCCTCGCCATGTTCTCCATGTTCGGCTTCTTCGTCCAGGCCATCGTCACC
GGCAAGGGCCCCATCGAGAACCTCTTCGACCACGTCGCCGACCCCGTCGCCAACAACGCCTGGGCATACGCCACC
AACTTCGTCCCCGGCAAGTGAGCACAACGACACGATCGAGATGGTGCCAACCAACGTACCATGTGTACACTTGTA
GTAGCCACGCACCGACCCTGCAGTTGCAGTTGCAGCAGTGCATGTATGTATGTACCTTAATTGTGTGTGTGTGTG
TGATCGATCGAGGAGATTTCTAGCTTAATTAATTTCTGTCTGTCATCATCTTTgctTCTTTGGATCGAGATTTAA
TGTAAGccgcaggccgcaTccAAGGGATGATCGAATTAaTG > SEQ ID NO:444    104423    129458_300479_1
gaattcactcaaaacatttcgcaatggctgctggaactatggctctctcttctccctctcttgctggGAAGGCAG
TGAAGCTTTCACCAGATGTCATTGGTGAAGGAAGGATCACTATGCTCTTCCAAAAGAAGACAGCAGCAAAGACAG
CAAAGCCAACCAAATCTGTATCCTCCGGCAGCCCATGGTACGGTGCCGACCGTGTTAAGTACTTGGGTCCCTTCT
CCGGTGAGTCTCCATCTTACCTCACTGGTGAATTCCCAGGTGATTACGGTTGGGACACAGCTGGGCTTTCAGCTG
ACCCTGAAACCTTCTCCAAGAACCGTGAGCTAGAAGTCATTCACTGCAGATGGGCAATGCTTGGAGCTCTTGGTT
GTGTCTTCCCTGAATTGCTTTCCCGTAACGGTGTTAAATTCGGCGAAGCTGTATGGTTCAAAGTCGGTTCCCAAA
TTTTCAGCGAAGGTGGATTGGACTACTTGGGTAACTCAAGCTTGGTTCATGCTCAGAGTATTCTAGCTATCTGGG
CTACACAAGTTATCTTGATGGGTGCAGTTGAAGGTTACCGTGTTGCTGGTGGTCCACTaggagaggtTGTCGACC
CACTTTACCCAGGTGGTAGCTTTGACCCTCTTggTCTTGCTGATGATc > SEQ ID NO:445    104423    120007_300083_1
TTTTGTGCATTCAAGAGTTATCATTTTACTTCTACAATGGCTGCTTCTACAATGGCCCTCTCCTCTTCTTTTGCC
GGAAAGGCAGTAAAACTCTCATTATCTTCCTCTGAAATCACCGAAAAAGGAAAGTTACCATGAGGAAAACCACTA
GCAAGGCCAAGCCTGTCTCTTCGGGTAGCCCATGGTATGGTCCTAACCGTGTCAAGTACTTGAGCCCATTCTCTG
GTGAGTCTCCAAGCTACTTGACTGGTGAATTTCCGAGCGATTATGGATAGGATACTGCTGGACTTTCAGCTGATC
CAGAAACTTTTGCCAAGAATCGTGAGTTGGAGGTGATCCATTGTAGATGGGCCATGCTTGGAGCTCTTGGTTGTG
TCTTCCCCGAGCTCTTGGCCCGTAACGGTGTCAAGTTCGGTGAGGCGGTATGGTTCAAGGCTGGATCCCAAATTT
TTAGCGAGGGTGGACTTGACTACTTGGGCAACCCGAGTTTGGTACATGCACAAAGCATCTTGGCCATTTGGGCTT
GCCAaGTTGTATTGATGGGAGCTGTTGagggTTACCGTATTGCTGGTgggcCtctcg > SEQ ID NO:446    104423    119229_300018_1
tttttttttttgttttttaaaaaatCACATGTTCTTCATTAATCCAAACCAATTTACACCACAATAACAATCCC
TTTACTGAACCCATAGCCCAAAATGCAACAAAAAGACCACTTTTTGGGGTTCATTACTACGTACAGGGTCACACT
ACTTGAAAATTagaGATCAACTATTGTTAAATTCACTTTCCGGGAACAAAGTTTGGGGCATAAGCCCAGGCATTG
TTGTTAACTGGGTCTGCAAGGGGGTCCGCAAGGTTTTCCAACGGACCCTTTCCGGCGACGATAGCTTGGAcgaAA
AATCCAAACATGGAGAACATAGCAAGTCTACCATTCTTGATCTCCTTTACCTTGAGCTCAGCAAAAGCCTCTGGA
TCTTCAGCAAGACCTAATGGGTCGaAACTACCACCAGGGTAAAGGGGGTCAACAACCTCACCGAGAGGTCCACCA
GCAACACGGTAACCCTCAACGGCTCCCATCAACACAACTTGGCAAGCCCAGATGGCTAAGATGCTTTGTGCGTGG
ACCAAACTTGGGTTACCCAAGTAGTCAAGTCCACCCTCGCTGAAAATTTGGGATCCAGCCTTGAACCATACAGCT
TCACCGAACTTGACACCATTACGTGCCAAGAGCTCAGGGAAGACGCAACCAAGAGCTCCAAGCATAGCCCATCTA
CAGTGAATCACCTCCAACTCTCGGTTCTTGGCAAAAGTTTCTGGATCAGCTGAAAGTCCAGCAGTGTCCCATCCA
TAGTCACCAGGAAATTCACCAGTCAAGTAGCTCGGAGACTCACCGGAGAATGGTCCTAAGTACTTGACACGGTCA
GGACCGTACCATGGGCTGCCTGAAGAGACTGGCTTAGCCTTGGTAACCGCCTTCCTCATGATAACTTTCCCATTT
CCAATGATTTCAGAGGAAGATGATGAGAGTTTTACCGCCTTTCCGGCAAATGAAGAGGAAGAGAGAGCCATTGTA
GAAGCTGCCATTATAGAAAGAAGATGAAAAACTCTTGAATGCAG > SEQ ID NO:447    104423    44507_300427_1
cccccccgagctcataACAACTAACTTTGACATCTCAAACTAGCAACCTCTCACTTTCCTCTTGATAAACCATGG
CTGCTTCTACAATGGCTCTTTCTTCCCCTTCTTTCGCTGGACAGGCAGTGAAACTCTCCCCATCTGCCTCAGAAA
TCACTGGAAATGGAAGGGTCTCCATGAGAAAGACTGTCGCCAAACCCGTCGCATCTAGCAGCCCATGGTACGGTC
CAGACCGTGTTAAGTACTTGGGCCCATTCTCCGGTGAGGCCCCAAGCTACTTGACCGGTGAATTCCCAGGTGATT
ACGGGTGGGATACTGCTGGACTTTCAGCAGATCCAGAAACATTTGCCAAGAACCGTGAACTCGAGGTGATCCACT
GCAGATGGGCTATGCTTGGTGCTCTTGGATGTGTCTTCCCTGAGCTTTTGGCTCGTAACGGTGTCAAGTTTGGTG
AGGCTGTGTGGTTCAAGGCTGGATCACAAATCTTTAGTGAGGGTGGACTTGACTACTTGGGCAACCCAAGCTTGG
TCCATGCACAAAGCATCTTGGCAATCTGGGCTTGCCAAGTTATCTTGATGGGAGCTGTTGAGGGTTACCGTGTTG
CTGGTGGGCCCCTTGGTGAGGTTGTCGACCCACTCTACCCTGGTGGCAGCTTTGACCCATTAGGCCTTGCTGATG
```

Figure 2 continued

ACCCAGAGGCATTTGCCGAGCTCAAGGTAAAGGAGATCAAGAATGGCAGACTTGCCATGTTTTCTATGTTCGGAT
TCTTTGTTCAGGCCATTGTTACCGGAAAAGGTCCATTGGAGAACCTTGCTGACCACCTTGCAGACCCCGTTAACA
ACAATGCGTGGGCCTACGCCACAAACTTTGTTCCCGGAAAGTGAATCTTAAAACATTCTCAAAATTCTGATTGTT
TGATGGCCTTGTAAAGCTGTTGTGAGTTACCTGACAATATAATGCGATTTTGTTTGTG

> SEQ ID NO:448    104423    44053_300028_1
gccattacggccggggaggaagaccgctagcaaagccgagccagcctcttctggtagcccatggtcctaaccgtg
tcaagTACTTGGGCCCATTCTCCGGTGAGTCCTCAAGCTACTTGACTGGTGAGTTTCCTGGTGATTACTGATGGG
ACACTGCTGTACTTTCAGCTTATCCAGAAACATTTGCTAAGAATCGTGAGTTGGAGGTGATCCATTGTAGATGGG
CCATGCTTGGAGCTCTTGGTTGTGTTTTCCTGAGCTCTTGGCTTGTAACGGTGTCAAGTTCGTTGAAGCTGTATT
GTTCAAGGCTGGATCACAGATTTTCAGCGAGGGAGGGCTTGACTACTCAAGTTTGGTCCACGCACAAAGCATCTT
GGCCATTTGGGCTTGCCAAGTTGTGTTGATGGGAGCCGTTGAGGGTTACCGTGTTGCTGGTGGACCTCTCGGTGA
GGTTGTTGACCCACTTTACCCAGGTGGCAGCTTCGACCCATTAGGCCTTGCCGAAGACCCAGAGGCTTTTGCCGA
ACTCAAAGTAAAAGAGATCAAGAACGGCAGACTTGCTATGTTCTCCATGTTTGGATTCTTTGTTCAggCTATCGT
TACCagaAAGGgTccATTggAGaACCTTGCCGACCACCTTGAaagtgAaGTTCTTaaCTaagaatCTCTTctagt
agttgATtggttgATaGCCcGTAAAGCTAGCTAat > SEQ ID NO:449    104423    41904_300032_1
tttctttATCACTTCAGCCATCAGAAAACTCTTCATTCTCCTTATTAAGCCATGGCTGCTTCTACAATGGCTCTT
TCCTCTTCTTTTGCCGGGAAGGCACTAAAACTCTCGCCATCTTCCTCTGAAATCACCGGAAATGGGAAAGTTACC
ATGAGGAAGACTGCTAGCAAGCCCAAGCCTGTCTCTTCTGGCAGTCCATGGTATGGCCCTGACCGTGTCAAGTAC
TTGGGTCCATTCTCTGGTGAGTCCCCAAGCTACTTGACTGGTGAGTTCCCTGGTGACTACGGGTGGGACACTGCT
GGACTTTCAGCTGATCCAGAAACTTTTGCCAAGAACCGTGAGTTGGAGGTGATCCACTGCAGATGGGCAATGCTT
GGAGCTCTTGGTTGTGTCTTCCCCGAGCTCTTGGCCCGTAACGGTGTCAAGTTTGGTGAGGCTGTATGGTTCAAG
GCTGGATCCCAGATTTTTAGTGAGGGTGGACTTGACTACTTGGGCAACCCAAGTTTGGTCCATGCACAAAGCATC
TTGGCCATTTGGGCTTGCCAAGTTGTATTGATGGGAGCCGTTGAGGGTTACCGTGTTGCTGGTGGGCCTCTTGGG
GAGGTTGTTGATCCACTTTACCCCGGTGGCAGCTTCGACCCATTGGGCCTCGCTGAAGACCCAGAAGCTTTTGCT
GAGCTCAAGGTAAAAGAGATCAAGAATGGTAGACTTGCCATGTTTTCTATGTTTGGATTCTTTGTTCAGGCTATC
GTAACTGGAAAGGGTCCATTGGAGAACCTTGCCGATCACCTTGCAGATCCAGTAAACAACAATGCTTGGGCCTAC
GCTACAAACTTTGTCCCCGGAAAGTGATTTAACAAAAGTTCATAATCTCTAATCTTCAAGTAGCTAGTGTTTGAT
ATGTAGCTTGTGAGTGATGAACCCAAAGAAGGGTCAGGTTTATTTTGAGCATTCTGGGTTATGGGTTCATTAAAG
AGATTTTAATGTGGTGTAAATTGGTTTGGATTAATTAATGAAGAACATGTGAATCTTTTc > SEQ ID NO:450    104423    31166_300077_1
cccacgcgtccgtgtttagaagaagcaatggccacttcagcaatccaacactcttctttcgctggccaaacgacc
ctaaaGCCATCCAACGATCTCCTCCGCAAAATCGGAGCCTCCAATGGCGGTGGCCGCATCATCATGCGTCGTACC
GTCAAGTCTACTCCTCAGAGCATCTGGTACGGACCAGACCGTCCCAAATACCTAGGACCATTTTCCGAAAACACA
CCATCATACCTAACCGGAGAATACCCTGGAGACTACGGTTGGGACACCGCTGGTCTCTCAGCCGATCCAGAAACA
TTCGCAAAGAATCGTGAGCTCGAAGTGATCCACAGTAGATGGGCAATGTTGGGAGCTTTAGGCTGCACCTTCCCT
GAAATTCTCTCAAAAAACGGAGTCAAATTCGGTGAAGCCGTGTGGTTCAAGGCAGGATCTCAAATCTTCTCAGAA
GGAGGGCTTGACTACCTCGGAAACCCTAACTTGATCCACGCGCAAAGCATATTAGCTATATGGGCGTGTCAAGTT
GTGCTAATGGGATTCATTGAAGGGTACAGAATCGGAGGTGGTCCTCTTGGGGAAGGGCTTGACCCGCTTTACCCG
GGCGGGGCCTTCGACCCGTTGAACTTAGCGGAGGATCCAGAAGCGTTTTCAGAGTTGAAAGTGAAGGAGCTTAAA
AACGGTCGTCTTGCTATGTTCTCAATGTTTGGATTCTTTGTCCAAGCCATAGTTACCGGTAAAGGTCCGATCGAA
AATCTGTTCGATCACATTGCAGACCCTGTGGCTAACAATGCTTGGGCTTACGCCACCAACTTCgTCCCCGGAAAA
TAgagtttgatcggataatttatgtaaattatatcttttaaacatttatcaatgcattaaagttatccctatatt
tgataca > SEQ ID NO:451    104423    284414_200098_1
AACAAATGGCCACTTCTGCAATTCAAGAATCTGCATTTGTTGGCCGGACAGTGGCTAAATCACAAAATGAGCTTG
TTAGGAAAATTGGCAGCTTTGGCGGAGGCCGTGCTACCATGAGACGTACTGTTAAAAGCGCTCCTCAAAGCATCT
GGTATGGAGAAGACCGTCCAAAATATTTGGGCCCATTCTCTGAGCAAACTCCATCTTACCTTACTGGTGAATTTC
CCGGTGATTACGGATGGGATACTGCTGGACTCTCAGCTGACCCAAAGACATTTGCCAAAAACCGTGAACTTGAGG
TGATCCATTGCCGTTGGGCCATGCTTGGTGCTTTGGGTTGTGTCTTCCCTGAAATTCTATCAAAGAATGGTGTTA
AATTCGGTGAAGCTGTTTGGTTCAAGGCAGGAGCCCAAATCTTTTTAGAAGGTGGACTTGACTACCTCGGCAACC
CAAACCTTGTCCACGCCCAGAGCATCCTTGCCATTTGGGCTTGCCAAGTTGTCCTAGTGGGCTTGATTGAAGGAT
ACAGAGTTGGTGGAGGCCCACTTGGTGAAGGTCTTGACAAGATCTATCCAGGAGGTGCCTTCGACCCACTTGGCC
TAGCTGATGATCCCGAGGCTTTTGCTGAGTTGAAGGTTAAGGAAATCAAGAATGGACGATTGGCTATGTTTTCAA
TGTTCGGATTCTTTGTTCAGGCTATTGTTACAGGAAAAGGCCCAATCGAGAACCTTTACGACCACATTAATGACC

Figure 2 continued

CAGTAGCCAACAATGCTTGGGCTTTTGCTACCAACTTTGTACCCGGAAAGTGAAATGTTTTGTCTGTGTTATATG
TaaAAATTTGGgctaaTGAAGtTTTCTGCTTGT > SEQ ID NO:452  104423  271915_200039_1
tgcagtcaagaatactttcttatctcttccttctacaatggcaactgctacaatgtctctctcTTCCCCTTCTTT
TGCCGGAAAGGCAATAAAACTCTCACCATCTTCCTCTGAAATTACTGGAAATGGAAAAGTCACCATGAGGAAGAC
TGTTACCAAGGCTAAGCCTGTCTCCTCTGGCAGCCCATGGTACGGTCCTGATCGTGTCAAGTATTTGGGCCCATT
TTCTGGTGAGTCCCCAAGTTATTTGACTGGTGAATTTCCTGGTGATTACGGTTGGGATACTGCTGGACTTTCAGC
TGATCCGGAAACCTTTGCCAAAAACCGTGAGCTAGAGGTTATTCACTGCAGATGGGCTATGCTTGGAGCTCTTGG
TTGCGTCTTTCCTGAGCTCTTGGCCCGTAACGGTGTCAAGTTCGGCGAAGCTGTATGGTTCAAAGCTGGATCGCA
GATTTTCAGTGAGGGTGGACTTGACTACTTGGGCAACCCAAGCTTGGTCCACGCGCAAAGCATCTTGGCTATTTG
GGCTTGCCAAGTTGTGTTGATGGAGCCGTCGAGGGTTATCGTATTGCTGGTGGACCTCTTGGTGAGGTTGTTGA
CCCACTTTATCCTGGTGGTAGTTTTGACCCATTGGGTCTTGCAGATGACCCGGAAGCTTTTGCTGAGCTTAAAGT
AAAGGAAATCAAGAATGGCAGACTTGCTATGTTTTCCATGTTTGGATTCTTTGTTCAAGCTATCGTCACCGGAAA
GGGTCCATTGGAGAATCTTGCAGACCATCTTGCAGACCCCGTTAACAATAATGCTTGGGCATATGCCACAAACTT
CGTCCCTGGAAAATGAAGTTCATAAAAGAGTCTTGTTCTATTGCCTTGTTGTTTGATGGTTCTGTAAAGtTATTG
TGAATTACAAAAAAATGACAATATGAAATTTGTTCGGTCtcc > SEQ ID NO:453  104423  182356_300660_1
gaattcGTTAGCCATGGCAGCTTCTACAATGGCTCTATCTTCACCCGCATTGGCTGGTAAGGCACTTGTTCCTTC
CAGCTCTGAAGTTTTCGGTGAAGGCAGAATCTCCATGAGAAAAACCGTTGCAAAGCCAAAAACCGTTTCATCTAG
CCCATGGTACGGACCTGACCGTGTTAAGTACTTGGGACCATTCTCTGGTGAATCTCCATCGTACTTAACGGTGA
GTTTGCCGGTGATTACGGTTGGGACACTGCCGGGCTTTCTGCTGACCCAGAAACCTTCGCCAAGAACCGTGAGCT
GGAGGTCATTCACTGCAGATGGGCTATGTTGGGAGCTCTTGGATGTGTCTTCCCCGAATTGTTGTCTCGCAATGG
TGTTAAATTTGGTGAAGCCGTTTGGTTCAAGGCCGGTTCACAAATTTTCAGTGAAGGTGGTTTGGACTACTTGGG
TAACCCAAGTTTGGTTCATGCTCAGAGCATCCTTGCCATTTGGGCAACACAAGTTATCTTGATGGGAGCAGTTGA
AGGTTACAGAGTTGCAGGAGGACCATTGGGTGAGATTGTTGACCCACTTTACCCCGGTGGAAGCTTCGACCCATT
AGGCTTAGCTGATGACCCAGAAGCTTTTGCTGAATTGAAGGTGAAAGAGATCAAGAACGGGAGATTGGCTATGTT
CTCCATGTTTGGATTCTTTGTTCAAGCAATCGTCACCGGAAAGGGTCCTTTGGAaaaactTGgctgACCACttagc
tGATCCAgtcgccaacAACGCCTGGAactAcgccagtAACtttgCTCCCGGAAAATGATCTGATTAATCGGTAAT
cagatgaaatggacgtgttactccccgaatttgcatttggagaattgtttgacgtgcgtttgtatgtacatttt
aaccc > SEQ ID NO:454  104423  182316_300660_1
gaattcagggctgcttcaacaatggctctctcttctccttctcttgctggaaAGGCAGTGAAGCTAACTCCATCC
ATTCCAGAACGCGAAGGAAGAATTACCATGCTCTTCCAGAAAAAGACACCGGCAAAAGCAGCTAAATCATCCAAA
CCCGCAGTTTCATCTAACAGCCCATGGTATGGTCCTGACAGAGTTAAGTACTTGGGACCTTTCTCCGGTGAGGCA
CCATCATATCTCAATGGTGAATTTCCTGGTGACTATGGTTGGGATACCGCTGGGTTATCTGCTGATCCTGAAACT
TTCGCCAAGAACCGTGAGCTTAAGTGATCCATTGCAGATGGGCTATGCTCGGAGCTCTAGGATGCATCTTCCCT
GAATTGCTCTCGCGCAATGGAGTTAAATTCGGTGAAGCCGTTTGGTTCAAAGCCGGAGCACAGATTTTCAGCGAG
GGAGGATTGGACTACTTAGGTAACTCAAGCTTAGTACATGCTCAAAGCATTTTAGCTATTTGGGCGACACAAGTT
ATCCTGATGGGTGCAGTGGAAGGTTACCGTGTCGCCGGTGGACCTCTTGGTGAGATTGTCGACCCACTGTACCCC
GGTGGCAGCTTCGACCCTCTTGGACTTGCTGATGACCCAGaggCTTtTGCTGAatggaaggTgaaggAGATtaag
aaCGGAAgattggCGATg > SEQ ID NO:455  104423  181959_300658_1
gaattcaggtaagaatggcaaccatggctctgtcttctccatcatttgcaggcaaagctgtgactctaaacccgg
gaacaGAATTCCCAACCAATGTAAGATCTGGCAGCAACAGCAAGATCTCGATGAGGAAGACATCCGCAAAGAAGC
CTGCTGCTTCTTCAGGAAGTCCATGGTATGGTCCAGACCGTGTCAAGTACCTCGGTCCCTTCTCTGGTGAGTCTC
CATCCTACTTAACTGGTGAATTCGCTGGTGACTATGGTTGGGACACTGCTGGACTATCAGCTGATCCAGAGACCT
TTGCCAAGAACCGCGAACTTGAGGTGATCCATTCAAGGTGGGCGATGCTTGGCGCTTTGGGCTGTGTCTTCCCTG
AACTCCTCTCGAGAAATGGAGTCAAATTCGGCGAAGCAGTTTGGTTCAAAGCCGGCTCTCAGATATTCAGTGAAG
GAGGACTTGACTATTTGGGAAATTCCAGCTTGGTTCATGCACAGAGCATCCTGGCTATATGGGCCACTCAAGTCA
TCCTTATGGGCGCCGTCGAAGGCTACAGAGTTGCTGGCGGTCCACTAGGTGAGGTTGTTGATCCCCTTTACCCAG
GTGGAAGCTTCGATCCATTAGGCCTCGCAGAGGACCCAGAGGCATTTGCCGAGCTAAAGGTAAAAGAACTAAAGA
ACGGGCGACTTGCTATGTTCTCCATGTTTGGGTTCTTCGTTCAGGCTATTGTGACGGGCAAAGGTCCTCTAGAGA
ACCTGGCAGACCACCTTGCCGACCCAGTGAACAACAATGCCTGGTCATATGCTACGAACTTCGCTCCCGGGAAGT
GAGCATAAGCATAGCAAAGGCAAAATGGAGTTTGAtttcctactttttttctgtaatatcctctgtacattcatt
tagcttgtaaaattgtgtagaatgtagctgcggttggtct

Figure 2 continued

> SEQ ID NO:456  104423  175675_300543_1
cacactcgctcgctcatCGCCATCTCTCtcagCTCTCACAGCTCACTGCATCAATGGCCGCGGCCACCATGGCGC
TCTCCTCCCCGGTGATGGCCGCGCGGCGCCGTCGACCTCCTCCGCGCTCTTCGGCGAGGCGCGGATCACCATGC
GCAAGACCGCCGAGCTACCTCACCGGCGAGTTCCCGGGCGACTACGGGTGGGACACCGCGGGGCTCTCCGCCGAC
CCGGAGACGTTCGCCAAGAACCGGGAGCTGGAGGTGATCCACTCCCGGTGGGCGATGCTGGGCGCGCTCGGCTGC
GTCTTCCCGGAGCTCCTCGCCCGGAACGGCGTCAAGTTCGGCGAGGCCGTGTGGTTCAAGGCGGGCTCGCAGATC
TTCAGCGAGGGCGGGCTCGACTACCTCGGCAACCCGAGCCTGATCCACGCGCAGAGCATCCTCGCCATCTGGGCG
GTGCAGGTGGTGCTCATGGGCGCCGTCGAGGGGTACCGCATCGCCGGCGGGCCGCTCGGCGAGGTCGTCGACCCG
CTCTACCCCGGCGGCGCCTTCGaCCCGCTCGgccTCGCCGATGACCCcgaggcGTTCGCGGAGCTc > SEQ ID NO:457  104423  112407_300002_1
aggactttggtcctacctagttatttatatacagttgctgcaaggccattaaactcAAGCCATAAATCAAATATT
CTTTCTGTGTAGTAGCTGCATTTTCAAGAGCATTTCACTTTATTTCTGCAACAATGGCAGCTTCTACAATGGCTC
TCTCTTCCTCTTCTTTTGCCGGAAAGGCGCTGAAACTCTCACCATCTTCCTCTGAGATCACCGGAAATGGAAAAG
TCACCATGAGGAAGACAGTTACCAAGGCGAAGCCAGTCTCTTCTGGCAGCCCATGGTATGGTCCTGATCGCGTCA
AGTATTTGGGCCCATTCTCTGGTGAGTCTCCAAGCTACTTGACTGGTGAGTTCCCTGGTGACTACGGATGGATA
CTGCTGGACTTTCAGCTGATCCAGAAACTTTTGCTAAGAACCGTGAGCTAGAGGTGATCCACTGTAGATGGGCCA
TGCTTGGAGCTCTTGGTTGTGTCTTCCCCGAGCTCTTGGCCCGTAATGGTGTCAAATTCGGTGAGGCTGTATGGT
TCAAGGCTGGATCCCAGATTTTTAGCGATGGTGGACTTGACTACTTGGGCAACCCAAGTTTGGTCCATGCACAAA
GTATCTTGGCCATTTGGGCTTGCCAAGTCGTGTTGATGGGAGCTGTTGAGGGTTACCGTGTTGCTGGTGGGCCTC
TTGGTGAGGTTGTCGACCCACTCTATCCTGGTGGTAGCTTTGACCCATTAGGTCTTGCTGATGATCCAGAGGCTT
TTGCTGAGCTCAAGGTGAAGGAGATCAAGAACGGTAGACTTGCCATGTTCTCAATGTTTGGATTCTTCGTTCAGG
CTATCGTCACAGGTAAAGGTCCATTGGAGAACCTTGCTGACCACCTTGCCGATCCAGTTAACAACAACGCCTGGG
CTTATGCCACAAACTTTGTTCCCGGAAAGTGAAGTACTTAACAATTTTTGTCTACTCTGGTATCATATTTTTATG
GAGCTTGTAAAGTAAATTAGTGAAGATTATATGTTAATTTTgttTAAttgtgtagttttCAGTTAAattTTATGT
GCTTTTCATg > SEQ ID NO:458  104423  108295_300261_1
catttatatacagttgatgcgggctcattaaactcAAGCCATAAATCAAATATTTTTTCTGTATAGTAGCTGCAT
TTTCAAGAGCATTTCACTTTATTTCTACAACAATGGCAGCTACTACAATGGTTCTTTCTTCCTCTTCTTTTGTGG
GAAAGGCGGTGAAACTCTCACCATCTTCCTCTGAGATCACCGGAAATGGAAAAGTTACCATGAGGAAGACTGTTA
CCAAGGCGAAGCCAGTCTCTTCTGGCAGCCCATGGTATGCTCCTGATCGTGTCAAGTACTTGGGCCCATTCTCCG
GTGAGTCCCCAAGTTACTTGACTGGTGAGTTCCCTGGTGATTATGGGTGGGACACTGCTGGACTTTCAGCTGATC
CCGAAACTTTTGCAAAGAATCGTGAGCTAGAGGTGATCCACTGCAGATGGGCCATGCTTGGAGCTCTTGGTTGTG
TCTTCCCTGAGCTCTTGGCCCGTAATGGTGTCAAATTCGGTGAGGCTGTATGGTTCAAGGCTGGATCTCAAATTT
TCAGCGAGGGTGGACTTGATTACTTGGGCAACCCAAGTTTGGTCCATGCACAAAGTATCTTGGCCATCTGGGCTT
GCCAAGTCGTGTTGATGGGAGCCGTTGAGGGTTATCGTGTTGCTGGTGGACCTCTTGGTGAGGTTGTTGACCCAC
TCTACCCTGGTGGTAGCTTTGACCCATTAGGCCTTGCTGATGACCCCGAGGCTTTTGCCGAGCTCAAGGTGAAGG
AGATTAAGAACGGTAGACTTGCTATGTTCTCCATGTTTGGATTCTTCGTTCAGGCTATCGTCACCGGAAAAGGTC
CATTGGAGAACCTTGCCGATCACCTTACTGACCCAGTTAACAACAACGCCTGGGCCTATGCCACAAACTTTGTTC
CCGGAAAGTGAAGTTCTTAAAAAATATGTCTCCTCTGGTATCACTTTTGTATGGAGCTTGTAAAGCTATGGTAGT
TTAGTGAAGATTATATGTGAATTTTGttT > SEQ ID NO:459  104874  103502_300363_1
TGGTATCAACGCAGAGTGGCCATTACGGCCGGGGGGATTGATCCAGTCACACACCAGCCAATTACTGTTAACCA
ACCAAACATAGAACAGCCAACAAAAAATCAACCAATTATTCAACAAGAAAAACAAACAACAATGCCAATTTCCCC
ATCTCATGTTGTCCCAGAAATAATGGATATTCTTGATCACAACAAGGAGCTGGTTGAAACTCCTATATTATCAAC
AATCACAGATATCAAATTAGACGACGACAACAACAATAACAGCAATATCAACAATAATAAGAATACGGGGACAAG
CTTCTGTACTGACGAAGTCCCCGTAATTAAACCACATGAAATTTTATTCCATTCTGAATCAACCACTTCAACATC
ATCATCTTCTTCACCAACATCCATTATTCTTGAAGATACGCAGTTTGATTTCAATTGGGGAGATGATTTCAGCAG
AACATTGGATTATTTACTTAATGATGATATTGACATGAATAATGTCATTTCCCAaGATTGGTCAAAGGTGTTGGA
AGTTTGAGCAAATTTTACTTgtgATTAATTTTCAAaggGGGGCTGAATTAAGCTttgttctTTTGATTGgCAAGT
CACTTTTTTCTTTTTTTTGgtcTATAgaagtttagatggtagttgttAcTaaagtaaaTggacaatAAaagTCT > SEQ ID NO:460  104874  316876_301427_1
GCAGCATGGGGAGACAGCCATGCTGTGACAAGCTAGGGGTGAAGAAAGGGCCGTGGACGGTGGAGGAAGATAAGA
AGCTTATAAACTTCATACTAACCAATGGCCATTGTTGCTGGCGTGCTTTGCCGAAGCTGGCCGGTCTCCGTCGCT
GTGGAAAGAGCTGCCGCCTCCGGTGGACTAACTATCTCCGGCCTGACTTAAAACGAGGCCTTCTCTCGCATGATG

Figure 2 continued

AAGAACAACTTGTCATAGATCTTCATGCTAATCTCGGCAATAAGTGGTCTAAGATAGCTTCAAGATTACCTGGAA
GAACAGATAACGAAATAAAAAACCATTGGAATACTCATATCAAGAAGAAACTTCTTAAGATGGGAATCGATCCTA
TGACCCATCAACCCCTAAATCAAGAACCTTCTAATATCGATAATTCCAAAACCATTCCGTCCAATCCAGACGATG
TCTCAGTGGAACCAAAGACAACTAACACGAAATACGTGGAGATAAGTGTCACGACAACAGAAGAAGAAAGTAGTA
GCACGGTTACTGATCAAAACAGTTCGATGGATAATGAAAATCATCTAATTGACAACATTTATGATGATGATGAAT
TGTTTAGTTACTTATGGTCCGACGAAACTACTAAAGATGA

> SEQ ID NO:461  104874  263177_301722_1
GCAGCATGGGGAGACAACCATGCTGTGACAAAGTAGGGTTGAAGAAAGGACCATGGACTGCAGAAGAGGATAGGA
AGCTCATAAACTTCATCCTTACCAATGGACAATGTTGTTGGAGAGCTGTTCCTAAGCTTTCTGGTCTTCTTAGGT
GTGGCAAGAGTTGCAGACTTCGTTGGACTAACTATCTTAGACCAGACCTTAAGAGAGGTCTTCTCTCTGATTACG
AAGAGAAGATGGTCATTGATCTCCATTCCCAGCTTGGAAACAGGTGGTCAAAGATAGCTTCTCATTTACCAGGAA
GAACAGACAACGAAATCAAGAATCATTGGAACACTCACATCAAGAAGAAGTTGAGGAAAATGGGGATTGATCCTC
TTACACATAAACCACTCTCTATCGTCGAAAAAGAAGACGGAGAACCCTTAAAGAAGCTACAGAATAATACAGTTC
CTTTTCAAGAAACAATGGAGCGTCCTTTAGAGAACAACATCAAGAACATATCAAGACTTGAAGAGTCTTTAGGTG
ATGATCAATTCATGGAGATAAATCTTGAGTATGGTGTCGAAGATGTCCCTCTTATTGAAACAGAGTCTTTAGACC
TTATCTGCAGCAATTCAACAATGTCTTCATCCACGTCCACATCTTCGCATTCTTCTAATGATTCGAGT

> SEQ ID NO:462  105059  107444_300264_1
CGGACGCGTGGGCGGACGCGTGGGCTCAGAGAAAGCAATCTGAAATCCTTGCATGGGAGAACAGCAAGAAAGCAA
GCTTGGAGGCTGAGCTCAAAAAGATTGAGGAGCAATTGTTGAAAAAGAAGGCAGAGTACATTGAGAAAATGAAAA
ACAAGATTGCTCTACTCCACAAGTCAGCAGAAGAAAAGAGAGCGATAATTGAAGCTAAACGTGGAGAAGATCTTC
TTATGGCAGAGGAAACAGCAGCAAAACACCGTGCCACTGAAACTTCTCCAAAGAAACCTCTCCTTGGATGTTTTT
GAAGTGGCAAAATATCATATACTCCTATACAATTATTGGTTACAAACATTGTATAGTGAAGTGTGCGGACTGGGA
ATTTCTTTGCATTAGAAACAACATTGTGAGATTATGCTCCTGGAGATAATTATCTGTCAATTTTTATTG

> SEQ ID NO:463  105059  156383_301365_1
ATCATATGGCAGAAGCAACTCCAGTATCTCAAGAAGCAGCTGTTGATAATTCTCCTGCTGCCATGGCTACCAAAG
CTGATGATTCTAAAGCTCTCGCCACTGTTCCTCCACCAAAGACTGATTCTTCAACAAAGAAGAGTTCAAAGGGAT
CCCTCGATAGAGACATTGCTCTCGCACACCTTGAAACAGAGAGAAGGAATTCTTATATTAAGGCATGGGAAGAAA
GTGAAAAAAGCAAGGTGGAAAACAAGGCCGAAAAGAAGCTCTCTGCAGTTGGGACATGGGAGAACACCAAGAAAG
CAAATCTTGAAGCTAAACTGAAGAAACTTGAGGAGCAACTAGAAGAAAAGAAAGCAGAATATGCGGAGAAGATTA
AAAATAGAGTAGCCGCAGTTCACAAGGAGGCTGACGAAAAGAGAGCTATGGTTGAAGCCAGAAAGGGAGAAGAAC
TTCTTAAAGCAGATGAGATGGCTGCCAAGTATCGCGCCACCGGACAAGCCCCTAAGAAGTTGCTTGGATGCCTTG
GATGCTAAAGCTGTGAAAAGTTTGTTTCTCTTTTGTAAATTT

> SEQ ID NO:464  105059  258950_301701_1
GCAGCATGGCGGAGGAACAGAAGATAGCGTTAGAATCAGAATCTCCGGCGAAGGTTACGACTCCTGCTCCAGCAG
ATACACCGGCTCCAGCTCCGGCAGAGATTCCGGCTCCAGCTCCAGCTCCGACTCCGGCTGATGTCACGAAAGACG
TTGCAGAGGAGAAAATTCAAAACCCACCTCCGGAGCAAATTTTCGATGACTCCAAAGCCCTTACTGTTGTTGAGA
AACCTGTAGAAGAGCCTGCACCGGCGAAACCTGCGTCTGCATCGCTCGATAGAGATGTTAAGCTAGCTGATTTGT
CAAAGGAAAAGAGATTGTCTTTCGTCAGAGCGTGGGAAGAAAGCGAAAAGAGCAAAGCAGAGAACAAAGCTGAGA
AGAAGATTGCAGATGTTCATGCTTGGGAAAACAGCAAGAAAGCAGCTGTCGAAGCGCAACTCAAGAAAATCGAGG
AGCAACTAGAGAAGAAGAAAGCAGAGTATGCAGAGAGGATGAAGAATAAGGTTGCAGCGATTCACAAGGAAGCAG
AAGAGAGAAGAGCAATGATTGAAGCTAAGCGTGGAGAAGACGTTCTTAAAGCAGAAGAAACGGCTGCTAAATACA
GAGCCACTGGAAT

> SEQ ID NO:465  105059  270343_200125_1
gggcggacgcgtgggcggacgcgtgggaaaagatctttcatctttcatttctgagactcTGATTCTGTTCCAAAT
CCTAGAATTCTTCTTTTTTCTGAATTCTGTTTGTAGCCATGGCAGAAGTAGAAGCTACGAAAGTGGAGACTGAGA
AAGTTGTGGACCCTACTCCCCCTGCACCTGAGGCTCCTGCACCTGTTAAAGAAGCAGAACCTGTTGTTGAAACTC
CTAAAGAAGTGGCTGATGAGAAAGCTATAGTTGCACCAGCTCTGCCTCCTCCTGAACAAGTCAAAGAAAAATCCG
ATGATTCTAAAGCACTAGTTGTCGTTGAAGATAAACCTGCTGAGGAGAAAAGGAGGGATCTATTGACAGAGATG
CTGTGCTTGCTCGAGTTGCAACAGAGAAGAGACTGTCACTAATCAAAGCATGGGAGGAAAGTGAGAAATCAAAAG
CCGAAAACAAAGCTCAGAAAAATGTATCAGCAATTGCTGCATGGGAGAATAGTAAGAAAGCAAACCTGGAGGCTG
AGCTAAAAAAGATGGAGGAGCAGGTGGAGAAAAAGAAGGCAGAATATATTGAGAAAATGAAAAACAAAATCGCTC
TACTCCACAAGGAAGCAGAGGAAAAGAGAGCGATGATTGAAGCTAAACGTGGAGAAGATCTTCTTAAGGCAGAGG
AATTGGCAGCAAAATACCGCGCCACTGGAACTGCTcccaagAAACTCCTTGGATGTTTTTGaagc

Figure 2 continued

> SEQ ID NO:466 105059 139161_300407_1
CCCGAACACTCGAGCGATCCGTCCGTCCGGCCGCCCGTCGTCGTCGCGCGCCATGGCTGAGGAGGAGGCCAAGAA
GGTGGAGGTGGAGGTCACCGAGGCGCCACCCGCCGCTGCCGCTGCCGCGGAGACGGAGCCGGCTGCCAAGGACGT
CGCCGAGGAGAAGGCCGTCATCCCCGCCCCCGCGCCGCCGGCCGAGGAGGAGAAGCCTCCCGTCGACGACTCCAA
GGCGCTGGCCATCGTCGAGAAGGTTGCAGATGAACCTCCTGCCGAGAAACCTGCTCAAGGGGGCTCTAATGACAG
AGATGTTGCTCTTGCAAGGGTGGAAACTGAGAAGAGGAACTCATTGATCAAAGCATGGGAGGAAAATGAGAAGAC
AAAAGCTGAGAACAAGGCTTCGAAGAAGCTATCTGCTATTCTTTCCTGGGAGAACACAAAGAAAGCAAACATAGA
AGCTCAACTGAAGAAGATTGAGGAGCAACTGGAAAAGAAGAAGGCTGAATATGCAGAGAAGATGAAGAACAAAGT
CGCGATCGTCCACAAGGAAGCTGAGGAGAAGAGAGCAATGGTCGAGGCAAAGCGCGGCGAGGAAGTCCTAAAGGC
CG

> SEQ ID NO:467 105059 138543_300774_1
GCTGTTTGTTTTGGCGATACCATTTGCATGGCTTGCCCAGCATCGTCGTCGTCGTCGTCGGGAGCAAGGAGGAGG
AGAGACCATCGATCTTGATTGATTTGAAGCTAGATGGCGGAGGAGGCGAAGAAGGTGGAGGTGACCAAGGACATC
GCCGAAGAGAAGGCAGTGGTGCCGCTGCCGACGCCGCCGGCCACCGAGCACGACGACTCCAAGGCCATCGTCCTC
GTCAAGGAAGCTGAGGCTACAGGAGGTTCAGCTGAAAGAGATGCTTATCTCGCAAAAATTGTGTCGGAGAAGAGA
TTGGTACTGATCAATGCCTGGGAGGAAAGCGAGAAAGCTAGAGCAGAGAACAGGGCGGCCAAGAAGCTGTCATAC
ATCACTTCATGGGAGAATGCAAAGAAAGCAGAGATGGAGGCTGAGCTGAAAAGGATCGAGCAAGAACTGGAGAAG
AAGAAGGCGGCGTACGAAGAGAAGCTGAAGAACAAGCTGGCATTGCTGCACAAGACGGCGGAGGAGAAGAGGGCG
CTCACCACGGCGAAGCGTGGCGAGGAGCTGATCATGGCGGAGGAGATGGCCGCCAAGTACCGTGCAAAGGGCGAG
GCTCCGAC

> SEQ ID NO:468 107031 108425_300382_1
agatcAAAAGCAAGAGGTATCCACACTCCGATCAATTGCCAGCCCACACTCTGAATTCTGAAAATAGTTTTGTTA
GTTTGGAGTGAAAAGCCATGGCATCTTTGGCAACCTTTGCTGCAGTGCAGCCCACTACCAATGTCAAGGGCCTAG
CTGGAAGCTCCATTACTGGAACTAAGCTTCATCTCAAATCATCTCGCCTCAATTTGAAGACCACTAAATCCAGGG
CCGGCCCTGTGGTTGCCAAATATGGTGACAAGAGTGTATACTTTGATTTGGAGGATTTGGGCAACACCACTGGCC
AGTGGGACCTGTATGGATCAGATGCACCTTCACCATACAACTCTCTTCAGAGCAAGTTCTTTGAGACATTTGCTG
CTCCATTCACCAAGAGAGGTCTTTTGCTCAAATTCTTGATATTGGGAGGTGGCTCCACCCTTGCTTACTTCAGTT
CGACAGCATCAGGGGATATCCTACCAATCAAGAAAGGTCCACAACTTCCACCCAAGCTCGGCCCACGCGGCAAGA
TCTAATTGCTTTCGGTCCAAAATTCAACCTTCAATTTGTAATTGATGTATGTTTCCCCAGTTTGTGTAAGTATAA
TTGAAGACTTTCCATTATAACAAGTTATATCTTATGGAAAATTTGTAGCATTGCTTTCTtacttggtggcttcTg
aTAttCTACtc > SEQ ID NO:469 107031 57871_300118_1
GCCATTACGGCCGGGGAGTTTTGTTAGTTTTAACTTGAAGTGAAGACTATGGCATCTTTGGCAACTCTTGCTGCA
GTACAACCCACAACTGCCGTCAATGGGCTAGCTGGAAGCTCCATTATTGGAACTAAGCTACATGTTAAATCATCT
CGCTTTAATTTGAAGTCTACTAAATCCAGGGCTGGTTCTGTGGTAGCAAAGTATGGAGACAAGAGTGTATACTTT
GATTTAGAGGACTTGGGCAACACCACTGGGCAGTGGGACTTGTATGGTTCAGATGCACCTTCACCATACAATCCC
CTTCAGAGCAAGTTTTTCGAGACTTTTGCTGCTCCTTTCACTAAGAGAGGTCTGTTGCTCAAATTCCTGATATTG
GGAGGTGGCTCAACTCTTGCATACTTCAGTTCAACAGCATCAGCGGATATATTACCAATCAAGAAAGGACCTCAA
CTTCCACCCAAGCTTGGGCCACGCGGAAAGATCTAATTTCTTTTCAATCCAACTTTCTCAACCTTCATTTTGTAA
TTGATGTATCTGTCACCAGCTTGTAAGTATTCTTGAAGCCTACCTGAGACCTTTGTTACAGAAGTTAAATCTTAT
TGCAAAGTTGGAGCATTGCTTTCTAGCTTGTCGTCTTGTGATATCGAGTGTTGAGATGTTACTTTAATTGGttCa
ggTAGGTGTCAATGAATAATGATtTTaaTT > SEQ ID NO:470 107031 44003_300028_1
gccattacggccggggagtaaaccacataattaattagggacagctttcctagtttggacagaaaactATGGCGT
CTTTGGCAACTCTTACTGCAGTTCAGCCCACCACCACAATCAAAGGACTAGCTGGAAGCTCCATTGCTGGAACAA
AGCTTCATGTTAAATCATCTCGTCTCAATTTGAAGCTCTCTAAATCCAGGGCTGGTGCTGTGGTAGCAAAATATG
GTGACAAGAGTGTATATTTTGACTTGGAGGATTTGGGCAACACTACTGGTCAGTGGGACTTGTATGGCTCAGATG
CACCTTCACCCTACAACTCCCTTCAGAGCAAGTTCTTTGAGACATTTGCTGCTCCTTTCACAAAGAGAGGTTTGT
TGCTCAAGTTCTTGATTTTGGGAGGTGGCTCAACTCTCGCTTACTTCAGTTCAACTGCATCAGGGGATATCCTAC
CAATCAAGAAAGGGCCTCAACTTCCACCAAAGCTCGGGCCACGTGGCAAGATCTAATTGCTTTTCGATCCAAATT
TCTTGACCTTCATTTCATAATTGATGTACTATCTATCACAGCTTGTAAGTATAAATTAAAGCCTTTCTCAGACCT
CTTTTCAACAAGTAAATCTTCTAgaaAATTTGATGCattgctTTc

> SEQ ID NO:471 107031 255260_301647_1

Figure 2 continued gcaaggatagcaGAGAGAGAGAGAGAGAGAGCCATGGCAGGATTAGCATCGACATCTTCCGCCGTAGCATGCGGT
GTGACCTCGTCTTCTCTCTCTGGCCAGAAGCTTGCTATTGCGCACTCCAACCTCTCTCTTCCCAgggctAGCCCA
AGAGCGGGAGTAGCTGTCGCTAAATATGGTGAGAAGAGTATGTACTTTGACCTTGAAGATATCGGTAGCACTACC
GGTTCTTGGGACCTCTATGGAGCCGATGGACCTTCCCCCTATAATGGATTGCAGAGCAAGTTCTTTGAGACAACT
GCAGGAGCATTTACCCGTCGAGGCATTCTTTTGAAGTTCTTGGTCTTGGGTGGAGGCGGCACTCTTGCCTACGTT
AGCTCCACTGCAGGAAAAGTTGTCCTGCCCATCAACAAAGGACCTCAGGAGCCCCCTAAGGTTGGACCCCGAGGC
AAGATCTGAGTATTAACTCTATGTATCAAATCTATCTCTCATGTGGATTCCAAAAGAACTGATAAATCCAGATAA
GttggcTTTTCTGTGTAGAAAaaacaaacaaacacaac > SEQ ID NO:472 107031 168110_300553_1
gaattcatgaagaacaaatctcagtataaacgagaaaaatctactacgtagagccgttctaaagctcggttaaga
atacaAATGGAAAATCAAACCCTATGCTTAAAAATATTCTTCCTTTTGTTACATAAATTTTAGGAAGAAAATGAA
GAACAAGAGCCATACAAATTCTCATGTGTCCTCTATGAATGGCTTCTCTTGCAACCTTAGCTGTTGTACAACCTA
CCGTCGTTAAAGGCCTCGGAGGAAGCTCCATCACCGGAACCAAGCTTTCGGTTAAGACTACTGCTCGTCGTAGTC
TGAGACAAACTAAAATCAGGACTGGTGCCGTGGTTGCCAAATACGGTGACAAAAGTGTGTACTTCGACTTGGAAG
ACATCGGTAACACTACCGGACAATGGGACTTGTACGGTTCTGATGCACCATCTCCCTACAACTCTCTCCAGAGCA
AATTCTTTGAGACATTTGCAGCTCCATTCACCAAGAGAGGTTTGTTGCTCAAGTTCTTGATAATTGGAGGAGGTT
CAACACTTGCATACTTGAGTTCAACAGTCTCAGGTGACATCTTACCAATCAAGAAGGGTCCTCAATTGCCTCCTA
AGATGGGTCCACGTGGAAAGATCTAAATGCTGAAAATGGAAACTCGACATCCTTTGTggTTGAGttACAGTTTAT
CTTAATTTTCAGAAttTGTAACTATGACAttGGTTTATaACTAGTCTTGTtTtCGTGTGTACATCATAAACGATT
CGGTTCGaaggcaaTTtaagaTCATTTTATGATaaAAAaaaaAA > SEQ ID NO:473 107031 127139_300468_1
cccccccccaaaaaagccaaggtatccacactggaaaccaattgccagcccacagttataattctgaAAGTAGTT
TTGTTAGTTTGGAGTGAAAGCCATGGCATCTTTGGCAACCCTTGCTGCAGTGCAACCTACGACCAATGTCAAGGG
CCTAGCTGGAAGCTCCATTACTGGAACTAAACTTCATCTCAAATCATCTCGCCTCAATTTGAAGCCCACTAAATC
CAGGGCTGGCTCTGTGGTCGCCAAATATGGTGACAAGAGTGTATACTTTGATTTGGAGGATTTGGGCAACACCAC
TGGCCAGTGGGACCTGTATGGATCAGATGCACCTTCACCATACAACTCTCTTCAGAGCAAGTTCTTTGAGACATT
TGCTGCTCCATTCACCAAGAGAGGTCTTTTGCTCAAATTCTTGATATTGGGAGGTGGCTCCACCCTTGCCTACTT
CAGTTCGACAGCATCAGGGGATATCCTACCAATCAAGAAAGGTCCACAACTTCCACCCAAGCTCGGACCACGTGG
CAAGATCTAATTAATTTTTGATCCAATTATCAACCTTCTATTTGTAATTGATGTATGTTTCCCAGTTTGTGTAAG
TATGTATAATTGGAGACTTTCCATTATAACAAGTTATATCTTAAGCTGAATTTGTGg > SEQ ID NO:474 107031 121226_300355_1
cgtgcacgtacgtgtagccGCCGCCGCAGATAGTACACCGGCTATCTATCCATCTATCTACTCAGCTTTGCGTCC
TCCCGCGAATTCACCGCAGCAATGGCGTCCCTCGTCGCCGTCCAGCCGGTCGCCGTGAAGGGCCTCGCCGGCAGC
TCCATCTCCGGCAGGAAGCTCGCCGTCAGGCCGTCGCCCCGGGCGCTCTGCCGCACCACCCGCAGGCCGCGCGCC
GCCGTGGTGGCCAAGTACGGCGAGAAGAGCGTCTACTTCGACCTCGAGGACATCGGCAACACCACCGGGCAGTGG
GACCTGTACGGCTCCGACGCGCCGTCGCCGTACAACCCTCTCCAGAGCAAGTTCTTCGAGACGTTCGCGGGGCCC
TTCACCAAGAGGGGGCTCCTGCTCAAGTTCCTGCTGCTCGGCGGCGGATCGCTGGTGGCCTACGTCAGCGCGTCG
GCGTCGCCAGACCTGCTTCCGATCAAGAAGGGCCCGCAGCTGCCGCCGACGCCCGGCCCACGCGGCAAGATCTAA
ATTAAATTCCTCGTCTCTGCCTCACCTTCTTCTTGATCCGATCCATCCATGCAAATCCTCTGTACTGTACTGCTA
GTCCCCCATGGCCGGATCGCCATGGATTAATTCCCCCTGTTTATGATGTTGATATAATTGTACTATTCCTATGGC
TATATAAGTTGtaaagGATCCAATTcg > SEQ ID NO:475 107690 126514_300464_1
GCCATTACGGCCGGGGGCCTACAACAAATCTCAGAACGTTGACCTATGTGGCTCATGCTATGGCTTCAATGGCCG
GCCTAATAGGCTCTTCTCAAACTGTGTAGGATGGTCAGGTCTGTGGTTCAACCCGTTTGATCACTGTTAGCACCA
CCATAATAGCCTTGGCTATACCACTTCTCAGGATTACAGCCCAACAGGGGTCTGCTGACACTGAAACTACCCGTA
AAGCCGTCATCGGTCTTGATGCTGCTGGCCTTGCTGGATCCTTTGCTCAAGCACCCTTTGCTGCAACTAAATCAA
TCAGGATTGGAGGCTGCTCCTCCTCCCTGCGGAGGATTACCTGAAACTTTGAACTCT > SEQ ID NO:476 107690 130502_300488_1
GAATTCAAGAGGAGTAACGGCAAGCAAAGTAGTAGGGGCGCAAGCTATAGCATCAGTATCTGGCTTAAGCAGCTT
CTCGCAAGGTACAAACAGATTGAATGTGGCTACTACCAACAGCCGAACGGCCAGAAGTCGTGTTGGTTTCAGCGT
TAGATCTGAGAAGAAGTCGGAATCGGAGACTGCTCAGAGTAGCCGTAGAGCACTATTGGGTGTCTTAGCTGTGGG
ACTGACCACTGGATCTTTCGTAAAGAATGTGCTTGCTGATGCTAGGCCTATTGTAATCGGGCCACCTCCCGCTCC
TTCCGGTGGTTTACCGGGGACTCTAAATTCTGATGAAGCAAGGGACTTAGATCTACCCCTAAAAACAAGGTTTTT
CCTACAGCCTAAGACTCCAGAAGAAGCAGCTCAGAGAGTAAAAGAATCAGCGCAAGCGATCCTAGGTGCCAAGGC

Figure 2 continued

ACAGATAGACAAAAAGGCATGGCCGTATGTCCAGAATGAACTACGATCCAGCGCCGAATATCTTCGTTACGATCT
CAGAACTATCATCTCTGCAAAGCCCAAGGATGAGAAGAAACCACTCAAAGAACTGTCTGACAAGCTCATCCAAAA
CCTCAATAGTCTGGACTATGCTGCAA

> SEQ ID NO:477  107690  127727_300472_1
GTACCACAACATTAACTTATAATTTCCCCCACGCTACTTCTATCACCCTGCCTAAAACAAATTTCAGAAGGTTCA
CCAAAATGGCTCATGCTATGGCTTCAATGGGTGGCCTAATTGGTTCTTCTCAAACTGTGTTGGATGGTCAGCTCT
GTGGTTCAGCCCGTTTGAGCACTGTTAGCACCAGCAGAATTGCCTTGGCTAGACCAGGTCTCAGCATTAGAGCCC
AACAGGGGTCTGCTGACACTGAAACTAGCCGTAGAGCCGTCATCGGTCTTGTTGCTGCTGGCCTTGCTGGTTCCT
TTGCTCAAGCAGCCTTTGCTGCAGCTAAATCAATCAAGATTGGGGGCGCTCCTCCTCCCTCTGGTGGATTACCTG
GAACTTTGAACTCGGATGAGGCAAGGGACTTTGGTCTACCATTGAAGAAGAGGTTTTACCTTCAACCATTGACTC
CAGCTGAAGCAGCCCAGAGAGTTAAGGATTCAGCCAAGGAGATTGTTAGCGTCAAGAATTTCATCGACAAGAAGG
CCTGGCCATATGTCCAGAATGACCTTCGTCTCAGAGCAGAATACCTTCGCTATGACCTTAAAACCGTCATCTCTG
CTAAGCCAAAAGAAGAAAAGGGAAAACTCCAGGACCTGACTGGAAAGCTCTTCAAGACCATTAGTGATCTGGACC
ATGCAGCAAAGACCAAGAACAGCCCTGAAGCAGAGAAGTACTATGCTGAAACTGTATCTACCTTAAATGATGTTT
TGGCCAAACTTGGTTAAAAAGCTTTTCTGAACTAGTATGTTATTACTTCCTGTAACTTATCGAATACTTCTTGAA
TCCAATTGTGAAGAATGATTTTGGATG

> SEQ ID NO:478  107690  257565_301683_1
GAAGAGGAGACAGAAGAAGAAGAAGAAGAAAAAGAAGAAAGAGAGATGGCGGCAATCTCGTCGTCTCTGGGCC
TCAGCAAGGCACAGCTCGTCGGCTCATTCGATGCTAGCGATGCGGCGAGAGGCTCTTCTTCTCGCGTTGGAATCG
CGAGATCGAAGTGTGTGATCCGCGCGATGCAGCAAGAACACGATCCATCGAGACGAGCAGCAGTCTTTGGCCTGG
TCGCAGTGGCCGCGGGCGTACTGGCAGTGGAGGAATCGCGAGCAGTGAGTGGAATCAAGATCAATGGGCCACCTC
CACCATCCGGAGGACTTCCTGGGACGGAGAACGCCGATCAGCCGCGCGACTTGGATCTGCCACTCAAAGAGCGAT
TTTTCATCCAGCCGCTGTCGCCAGCCGAGGCAGTGGATAGAATCAAGGACGCGTCGAAGGACATTGTGGGAGTAA
AGGAGCTGATCGAAGAAGAGCTGGCCGTATGTCCGCAACGATCTTCGCAGCAAGGCGACTTACTTGAGGTATG
ACATCAAAACCATCCTGGATGCCAAGCCCAAGGCCCAGCGCAAAGAGCTCAAGAAATACACGGACAGTCTCTTCG
ACACAATTGACAAGCTTGACTATGCAGCTCGAGCAAAGGATCCCGCAGCCGCGAGCAAGTGCTACAGCGACACCG
TAGCTGCATTGGACACTGTTAttgCCAAAATctcggcataaataTAta > SEQ ID NO:479  107690  252978_301610_1
GGAAGATGGCTCAGCAGTAGCGATGGCCGGGCTTGCTCATCCCTCTCCTCGGCCGCTTCCTCGCTCGACGGGGCC
GGCTCTCGCCTCTTGGCCTCCTCCCCTTCTTCCTCTGCCCCCTCTAAACCATCCCTTCGCCTCCCTTTAATCCGC
GCTAGCTCGTCGAATCCCTCAGAAGACGCTTCTGCTAAATCTAGTACTAGACGCCAAATCTTGTCCCTCGTTGCT
GTCTCTGCTTTGCTTGTCTCTAAACAAGCCCTCGCCGACCCTAGCCCTATCAAGCTCTTTGGCCCTCCCGCCCCT
TCTGGTGGCCTCCCTGGGACTGAAAATGCCGACGAAGCTCGAGATCTAGACTTGCCATTGAAGAATAGATTTTAC
CTGCAACCTCTTCCTCCCGTGGAAGCGATCGCCAGGGCGAAGGAATCTGCCAAAGAGATTGTGAATGTGAAGGCA
TTGATCGACAAGAAGGCTTGGCCCTATGTCCAGAACGGGCTCCGATCACAGGCTTCCTACCTGCGCTTTGACCTC
AACACTGTTATCGCTTCCAAGCCGAAGGATGAAAAGAAAGCTCTCAAAAGCCTTAGCACTAAGCTCTTTAACACT
ATCAATAATCTGGACTATGCTGCTAGAAGCAAAA > SEQ ID NO:480  107690  55612_300134_1
CGGACGCGTGGGTGCCACCAACAGATTCTGCAGCTAGAGTTTTAAGAATCTGCAAAGGATATCATAAATGTGAAG
CCATTGATCGACAGGAAAGCTTGGCCATATGTTCAAAACGATCTTCGTTCCAAGGCTTCTTATCTTCGTTATGAT
CTTAACACAATCATTTCCTCCAAACCCAAGGATGAGAAGAAGTCACTCAAGGATCTCACCACCAAGCTCTTCGAT
ACCATCGACAATCTGGATTATGCGGCGAAGAAGAAGAGTCCTTCGCAGGCTGAGAAGTACTATGCTGAGATAGTC
TCTGCTTTGAACGAAGTTCTTGCCAAGCTTGGTTAAGCATTTTAATTTCTGCATTTTTCTTGTAAATTATTATTC
TTGGTTTTTGGTCTTGAGTACTTTAGACTCAAATTCGTG > SEQ ID NO:481  107690  27216_300394_1
CCCACGCGTCCGAAAAAAAATGGCTCAAGCAGTGACTTCGATGGCTGGCTTACGTGGAGCATCTCAGGCTGTCCT
TGAAGGAAGTTTACAGATCAACGGCTCAAACCGTTTGAACATCTCAAGAGTCTCGGTTGGGTCTCAGAGAACCGG
ACTTGTGATCAGGGCTCAGCAGAACGTGTCAGTACCAGAAAGTAGTCGCCGGTCAGTGATTGGACTCGTGGCGGC
TGGTTTAGCCGGTGGTTCATTCGTTAAAGCTGTTTTCGCCGAAGCTATTCCGATCAAAGTTGGTGGTCCTCCACT
TCCTTCCGGTGGCCTACCTGGAACAGATAACTCAGACCAAGCAAGAGACTTTTCATTGGCATTGAAGATAGATT
TTACATACAACCATTGTCACCAACAGAAGCTGCAGCTAGAGCCAAAGATTCTGCTAAAGAGATCATCAACGTTAA
GTCATTTATCGACAAAAAAGCTTGGCCCTATGTTCAGAACGATCTCCGTTTAAGAGCATCGTACCTCCGTTACGA
TCTCAACACCGTTATCTCCGCTAAGCCTAAGGAAGAGAAGCAAAGCCTTAAAGATCTCACCGCAAAGCTTTTCCA
AACCATTGACAACTTGGACTATGCGGCGAGATCAAAGAGTAGCCCAGATGCTGAGAAGTATTACTCAGAAACTGT

Figure 2 continued

CTCGAGTTTGAACAATGTTCTTGCCAAGCTCGGTTAATGAAGaaagacttgcgttgtaatctgttgatgtcgatg
ttattataat > SEQ ID NO:482 109076 104035_300058_1
ATTTCCATCCCACAGCAAAAAACCTGCCGCCGCCGCTCCGGTGGTAAAACCCCCAAAGTTTTATCCCGCCGATGA
CGTAGCAAAACCGCTTGTGAACAAACACAAGCCAAAACCTACAAAACTCAGAGCAAGCATTACACCTGGAACCGT
TTTGATTATCCTAGCTGGTAAGTTTAAGGGGAAAAGAGTTGTGTTCTTGAAACAGCTTGCGTCTGGGCTTCTGCT
TGTTACTGGACCGTTTAAGCTTAATGGAGTTCCTTTAAGACGTGTGAATCAAGCTTATGTTATTGGTACCTCGAC
TAAGGTTGATGTTTCGGGTGTGAATGTGGAGAAGTTTGATGATAAGTATTTTGCTAAGCAGGTTGAGAAGAAGCA
GAAGAAGGGAGAAGAGGAGTTTTTTGAAGACAAGAAAGAGGAGAAGAATGTGCTTCCACAAGTAAAGAAAGATGA
CCAGAAAACCGTAGATGCAGCTTTGCTCAAGGCCATTGATGGAGTTCCTGAATTGAAGGCTTATTTGTCCGCGAG
GTTCTCACTCAAGGCAGACATGAAACCACATGAACTTGTCTTTTAGAGGAACAACATCTACAACACTTTTTTTTG
GATAAATTGATTTT > SEQ ID NO:483 109076 194843_300767_1
CCGGCTCTCGCCCTCTCCGCACCAGCTCCCCGCCGAGAGCGCCGCGAGCTGATCCAATGGCGCCGACGTCGAAGC
TGTCGCAGGGCATCAAGAAGGCGTCGCGGTCGCACACGTACCACCGCCGCGGGCTGTGGGCCATCAAGGCCAAGC
ACGGCGGCGCCTTCCCCAAGGCCGAGAAGCCCGCCGCCGCAGCCGCCGCCGCCGCGCCCAAGTTCTACCCCGCCG
ACGACGTCAAGCCCCGCCAGCCCAGCACCCGCAAGCCCAACCCTACCAAGCTCAGGTCGTCCATCACGCCTGGGA
CAGTGCTGATCCTGCTCGCCGGGAGGTTCATGGGGAAGCGCGTCGTGTTCCTCAAGCAGCTCAAATCCGGCCTGC
TTCTCGTCACCGGACCTTTTAAGATCAATGGAGTTCCGATCCGCCGTGTGAACCAGCCCTACGTCATTGCTACGT
CCACAAAGGTTGATATCTCTGGTGTTAATGTGGAGAAGTTTGATGACAAGTACTTCTCTAGTGACAAGAAGCAGA
AGGCGAAGAAGACCGAGGGTGAACTTTTTGAGACT > SEQ ID NO:484 109076 224010_300978_1
aCAACACCCTAAACATCAAAAATGTCCAAGCAGATCGGAGGAGCCAAGAACGGCGGTAGCCGAACCGTCCCCACT
GAGAAGGCCCCCAAGTGGTACGTCGCTGAGCCCACTCACGTCAAGATCCCCACCGTCCAGAACAAGTCCAAGCTG
CGACCTTCTCTTGTTCCCGGTGCCGTACTCATTCTCCTTGCCGGCCGATTCCGAGGCAAGCGAGTTGTTCTCCTC
AAGTCTCTTGAGGATGGCACTCTCCTTGTGACCGGTCCCTTCAAGGTCAACGGTGTCCCTCTCCGACGAGTCAAC
GCCCGATACGTCATTGCCACCTCCACTAAGGTCGATGTCTCCGGTGTCAAGGCTGACAAGTTCACCCCTGCCTAC
TTCGCTCGATCTTCCGCCGACAAGAAGGCCGAGAAGCAGTTCTTCGCCGAGGGCAAGCAGAAGGAGCTCAAGGCC
GAGCGAGTCGCCGACCAGAAGGACGTCGATGCTGCTCTCATTGCCGAGATCAAGAAGACTCCTCTTCTCAAGCAG
TACCTGGCTTCCCAGTTCTCTCTCAAGTCTGGTGACAAGCCCCACCTGCTCAAGTTTTAAATTATAAAAACACAA
AATGGAACATGGGGTGGAAAATGGTGGACGGTGGTgaagccgTCgtCTGTCaaAAGCTGTatagcaaTg > SEQ ID NO:485 109076 258156_301689_1
GACACCAGCAATTCGAAATGGCGGACACCAACCCCACGACCCAGAAGTTCTCCAAGGGCGAGAGGTCGATACCGC
ACCACTCGCAGAAGGCCAGCAAGTACTACCCTGCTGAGGACGTCGCCGTCCCCAAGAAGGCCCGTAAGACTGCTC
GCCCGGCGAAGCCCCGTGCCTCCCTCCAGCCCGGTAGCGTCGTCATCCTCCTTGCTGGTCGCTTCCGCGGCAAGC
GTGTCGTTCTCCTCAAGCACCTTCCCCAGGGTGTTCTCCTCGTCACCGGTCCCCTTCAAGGTTAACGGCGTTCCT
CTGCGACGAGTCAACGCCCGCTATGTCATCGCTACCTCCACCACCGTTGACATTAAGGGTATTGATGAGGGTGTC
CTGAAGAAGGCCTCCGAGGAGGGCTACTTCACCAAGGACAAGGCCGCGCACAAGCCTGGCGAGGATGCTTTCTTC
AAGCAGGGCGAGAAGCCCGAGAAGAAAGGAGACCTCCAAGGACCGCGTTGAGGACCAGAAGGCCATCGACAAGGC
CCTTTTTGGGCAACATTAAGAAGGAGGCTCACCTCGTCGACTACCTCGCCTCGAGCTTCAGCCTTCGCACCTCCG
ACAGGCCACACCAGATGCAGTTCTAAGCGTTGGGTCAGACGGGATTTGGCGTTCAGTGCATGGGATGAAAGACGA
CCTCGGGTGCTGCAGCCGTGACAGCAGGAAGTAATCCAGCGGCGGT > SEQ ID NO:486 109076 231888_301209_1
TTCCCCGCAGCGATGGTGAAGGCTGGCGAAGGATGCTGCGGCTAAGCCCAAGTCCAAGTACTACCCAGCCGACGA
TGCTCCTGTGCCGCGGGCTGATCCTGGCGCAAGATCCGCCCGACGAAGCTAATGGCGAGCATCACACCTGGAACG
GTTCTCATCCTTCTCGCCGGGAAGTACAATGGCAAGCGCGTATCTTCCTCAAACACTCCCGTCGGGATTATTGCT
CGTCACTGGTCCTCGCTCGTTCAATGGCGTCCGGCTCAAGAGGGTGAACCAGGCTTACGTGATCGCAACATCGAC
CAAGATCGACGTCTCTTCCGTGGACGTGGCCAAGTACGACGACAGCTTCTTCAAGAAGTTGAAGAAAGACGAGGA
GGTGACCCCGGAGATGAAGAAGGTATGGAAGCTGATAAACACGGCTCGGAAATCTATTTTTTCTTTTTTTCTTTTG
CTTGTCGTGCAGGCAAAGAAGGAAGCTCAAGAGGCCGTGGACAAGGTCGTGATCGAGGTGATAAAGAAGGGAGAG
CCGGAGCTAGCTCAGTACATCTCCGCCAGGTTCAGCTTGAAGCGTGGAATGAAGCCTCACGAGCTAGTG

> SEQ ID NO:487 109076 210955_300963_1

Figure 2 continued tcctctccACACCCACATATCAGACACCCGAGAGAGTCAATATGTCGGCCAAGCCCACGACCAAGCAGTTCGGGA
AGTCGACCCGGGAGGTTCCCGCCTCCGCGGACCAGGCGAAGAAGTGGTACCCTGCCGACGACGAGAGCGCCCCGA
AGAAGGTTCGCAAGTCCGTCCGAACTTGGGCCCCCCGAAAGACCCTCCAGCCTGGTACCGTCCTGATCCTCCTCG
CTGGCCGCTTCCGCGGCAAGCGTGTCGTCCTCCTCAAGACTCTTGACCAGGGTGTTCTCCTCGTCACTGGTCCCT
TCAAGATCAACGGCGTTCCCCTGCGAAGAGTCAACGCCCGATACGTCATCGCCACCTCCTACAAGGTCGACATCT
CCGGCCTTGACGCCGCCAAGATTGAGGAGATCTCTCAGCCCAAGTACTTCACCGCCGAGAAGGCCAAGGAGAAGG
CTTCCGCTGAGGCTTTCTTCAAGCAGGGAGAGAAGCCCCAGAAGAAGGAGATCAACAGCAGCCGTGCTGCTGACC
AGAAGGCCGTCGACAAGGCTCTGCTTGCTAGCATCAAGAAGGTGGATCTGTTGGCCAGCTACCTCGCCAGCACCT
TCAGCCTGCGGAAGGGTGACAAGCCTCACGAGATGGCGTGGTAAATTTGATTCAAACACAAAATCTCTCTGgCAG
GTCgAAAGCACGGGgtggagtTTACTGGGGTGTTggt > SEQ ID NO:488 109076 120093_300083_1
ccccccccccgaaaccttcactgctccatatatggatgcacattactaggtttagggtttattgaatcagcat
tctgcAAAAGCAAAGGAGAACTTCTACTTTCAGCAATGGCGGCAAAGAAGAGTCCCCGTAATCCAGAGCTGATTC
GTGGAGTCGGAAAACTTTCCCGTTCCAAGATGTATCACAAAAAGGGTCTTTGGGCAATCAAGAAGAAAAACGGCG
GCTCTTTCCCCGTCCACAAAAAAGCCGCCGCCGTCGCACCACCGGCCGTCAAACCACCCAAAATTTACCCTGCCG
ATGACGTGGCAAAACCCCTTGTCAACAAACACAAACCAAAACCAACAAAACTCAGAGCAAGTATTACACCCGGTA
CTGTTTTAATTATCCTTGCGGGTAAGTTTAAGGGTAAGAGAGTTGTGTTTTTGAAACAGCTTAAATCTGGGCTTT
TACTTGTTAGTGGACCATTTAAGCTTAATGGTGTTCCTTTGAGGCGTGTGAATCAAGCTTATGTTATTGGTACTT
CAACTAAAGTGGATGTTTCTGGTGTGAGTGTTGAGAAGTTTGACGATAAGTATTTTGCAAAGCAAGCTGAGAAGA
AACAGAAGAAGGGTGAGGGAGAGTTCTTTGAAGACAAGAAAGAGGAGAAGAATGTGGTTCCTCAggGAAAGaagg
ATGAccagaaAGCTGTgGATGAAGCATTGAtcaaggCggttGAATGtttccTGAATTgaaggctTAtTtGTCTgc
taggttCTCCCTCAAGTCGGGCATGaAaccccatGAGCtTGTcTTt > SEQ ID NO:489 109576 130439_300487_1
GAATTCAAAAAATAGTAATGGCTTCTTCAGTGATGGCCTCTGCTGCAGTCGCCTCCGTGAGGAGCTCTGCTCCCG
CTCAAGCTAGCATGGTTGCACCATTCAGCGGCTTGAAATCCGTTGCTGCATTCCCAGTTACCCGCAAATCAAACG
ACATCACCTCCGTTGCCAGCAACGGTGGAAGAGTTAACTGCATGCAGGTGTGGCCACCAAGTGGTTTGAAGAAGT
TTGAGACCCTCTCATACCTTCCCCCATTGACCGTCGAGCAACTATCCAAGGAAGTCGACTACCTTCTCCGTAATG
GATGGGTTCCCTGTTTGGAATTCGGTGCCAGAGGATTCGTCTACAGAGAACACGGTAACACCCCTGGATACTACG
ATGGTCGTTACTGGACAATGTGGAAGCTACCCATGTTCGGTTGTACCGATGCTTCCCAGGTTATCAAGGAACTAG
AAGAGGCCAAGGCTGCATACCCTGACTCTTTCATCAGAATCATTGGATTCGACAACGTTCGTCAAGTACAATGTG
TTAGTTTCATCGCATACAAGCCCGAGAGCACCAGCTACGAACAGTAAAGGATGAATCTTAATCAAGGAGCATAAT
CCAATTCATTTCTGTATC > SEQ ID NO:490 109576 271223_200032_1
gaaaaaaaaggaaaagaGAGAAAGAGAAATCTTTCTGTCTTAAGTGTAATTAACAATGGCTTCCTCAGTTCTTTC
CTCAGCAGCAGTTGCCACCCGCAGCAATGTTGCTCAAGCTAACATGGTTGCACCTTTCACTGGTCTTAAGTCAGC
TGCCTCGTTCCCTGTTTCAAGGAAGCAAAACCTTGACATCACTTCCATTGCCAGCAACGGCGGAAGAGTGCAATG
CATGCAGGTGTGGCCACCAATTAACAAGAAGAAGTACGAGACTCTCTCATACCTTCCTGATCTGAGCGTGGAGCA
ATTGCTTAGCGAAATTGAGTACCTCTTGAAAAATGGATGGGTTCCTTGCTTGGAATTCGAGACTGAGGTCAATAT
TTGTTCTAAATTTTGCATACTCCTTCAATTTTATGCTCACATTTTTTTTCCTTCTATTTGTTCCTAAAAAAAGAG
TGACATATTTATACATTTAGAAAAAAATTAACTTTTAACTTTAATATATTATTTCACATGTTGCAGCGCGGATTT
GTCTACCGTGAACACCACAAGTCACCAGGATACTATGATGGCAGATACTGGACCATGTGGAAGCTACCTATGTTC
GGATGCACTGATGCCACCCAAGTGTTGGCTGAGGTGGGAGAGGCGAAGAAGGAATACCCACAGGCCTGGGTCCGT
ATCATTGGATTTGACAACGTGCGTCAAGTGCAGTGCATCAGTTTCATTGCCTCCAAGCCTGACGGCTACTGAGTT
TCATATTAGGACAACTTACCCTATTGTCTGTCTTTAGGGGCAGTTTGTTTGAAATGTTACTTAGCTTCTTTTTTT
TCCTTCCCATAAAAACTGTTTATGTTCCTTCTTTTTATTCGGTGTATGTTTTGGATTCCTACCAAGTTATGAGa
ccTAATAATTATGATTTAAAAAAa > SEQ ID NO:491 113128 109361_300045_1
atctcTCCTAATTAGCCATGGCAGTCACTACTAGACTCCTCTTAGCTTTACTCCTCTCTGCTTTTCTCTTGTCTG
CAACAAATGCAGTCAGAGATTTTCAGGGTCGGCAAGCTGGCCAGCGGGGTGAGAGAGGCACTCGTCTGACTGAAG
CTCAACAATGCCGTTTAACAAGGCTCACTGCCACTCAGCCCACTAACCGAATTGAGTCCGAGGGCGGTGTCACTG
AGCTGTGGGACGAGAACGAGGAACAATTCCAGTGCGCTGGAGTTGCTCCCATAAGGAGTGTCATCCGCCGCAACT
CCCTTTCTCTGCCTAATTTCCATCCCATGCCGCGCTTAGTTTACATTGAGCGTGGCCAGGGAATGATTGGCATTA
CTTACCCTGGCTGTGCTGAGACTTTCCAGTCTCAGTCCCAGACCTTCCAGGCTGGCCGAGAGCCATGGGAAGAGA
GGGGCCAAGGCCGCAGAAGTGACCAACACCAGAAGGTTCACCGCATTCGTCAAGGTGATGTCGTGGCACTTCCAG

Figure 2 continued

CTGGCGCAGCTCATTGGTGCTATAATGATGGTGAGGAAGAGCTTGTTGCCATCTCTGTCAACGACCTCAACCATC
GCTCCAACCAACTTGATCAGAACTtgagggCATTCTACT > SEQ ID NO:492 113128   111471_300055_1
GGGCGGACGCGTGGGAATTAGCCATGGCGGTCACTACTAGACTCCTCTTAGCTTTACTCCTCTCTGCTTTTCTCT
TGTCTGCAACAAATGCAGTTAGAGACTATCAGGGCCAGCAAGGCCGTCAGGAGGGTCTGAGAGGCACTCGTCTCA
CTGTAGCTCAACAATGCCGTTTAACAAGGCTCACTGCTAGCCAACCCACTAACCGAATTGAGTCAGAGGGCGGCG
TCACTGAACTGTGGGATGAGAATGAGGAGCAATTCCAGTGCGCTGGAGTTGCTCCCATGAGGAATGTCATCCGTC
GCAACTCTCTTTCTCTTCCCAATTTCCATCCCATGCCTCGCTTGGTTTACATTGAGCGCGGCCAGGGATTGATTG
GCATTACTTACCCTGGCTGTGCTGAGACTTTCCAGTCTCAGTCCCAGACCTTCCAGGCTGGCCGAGAGCCAAGGG
AAGAGAGGGGCCAAGGCCGCAGAAGTGACCAACACCAGAAGATCCACCGCATTCGTCAAGGAGATGTCGTGGCAC
TTCCAGCTGGCGCTGCTCATTGGTGCTATAATGATGGTGAGGAAGAGCTTGTCGCCGTCTCTATCAACGACCTCA
ACCACCGGTCCAACCAGCTTGATCAGAACTTGAGGGCATTCTACTTGGCTGGTGGAGTACCAGAAAGTGGAAGGC
AACAAACCCAAGCAGGTCAAAGACTACAGAGCAGGCAGaggttccagaacatttccgtgctttcgacacagaac
TGATGGCTg > SEQ ID NO:493 113128   110870_300047_1
CTTCTCTACTCAATAATAATAATCATGGGTTTTAGCTGGCTCTCTTTCTCCTTGAGTTTCCTTCTGGTGTTGCAC
GGTACCTTTGCTCAGCAGAGATACCAACAGCAGCAAGGCGAGTGCCAACTCAATAGACTTAGTCCTCAGGAACCC
ACCGTCCGCATTCAAGCCGAAGCTGGAGTCACTGAGTTATGGGATCCAAATAACCAGCAGTTCCAATGTGCTGGT
GTCTCCCTAATTCGCCACGTCATCCAGTCTAGGGGAATGCTGTTGCCTTCCTATGTTAACACACCCCTACTTGCC
TATGTTGAACGAGGTCAGGGATTTTATGGCATCATGCAATCTGGATGCCCGGAAACATTCCAGTCATCCCAGCAA
TTGCAGCAAGGTGAAAGGGGTGCCGGTTCAAGATTTCAAGATCGCCACCAGAGGATTGGACAGTTTAGGCAGGGT
GACATTATTGCCTTCCCTGCTGGAGCTGCTCACTGGGTTTATAACGAAGGAAATGAGGAGCTTGTTCTTGTTGTT
CTTGAAGATAGCAGTAACAATGCCAACCAGCTTGGTCGAACTTCAAGGAGGTTCTTCATAGCTGGAAACCCACAA
CAAGGACAGCAACAACAGCAACAAGGACAATACGGTGGCCGCAGCTTGCGCAGGGAACAATTCCAATCTGGAAAT
GTTTTCAATGGCTTTGACGTACAGGTCTTGGCTGAggCATTTGGCGTAGaCCagGAGACAGCCAGGAGACTTcag
gGACAGGAAGaccagaGAggCcACATTGTAAACAT > SEQ ID NO:494 113128   196254_300770_1
GTTCGTTAGCCCAACTTCTTAGCCAAAGGAGTAGTCAATGGCAAAGTTCTCGCCGTGGAAGTCCAAGAGAGTGCA
GATTTGATCGGTTGCAAGCATTTGAGCCGATTCGCACTGTAAGGTCCCAAGCTGGTACAACTGAGTTTTTTGATG
TCTCTAATGAGTTGTTTCAATGTACTGGAGTATTTGTTGTCCGTCGAGTTATCGAACCTAGAGGTCTTCTGTTAC
CTCACTACTCCAATGGAGCAACTTTGGTATATGTCATCCAAGGCAGAGGTATAACAGGACCAACTTTCCCAGGAT
GTCCTGAGACCTATCAACAACAGTTTCAGCAATCCGAGCAAGACCAACAATTGGAAGGCCAAAGCCAAAGCCATA
AATTTAGAGATGAACATCAAAAGATCCACCGTTTTCAACAGGGGATGTAGTTGCATTGCCTGCTGGTGTTGCTC
ATTGGTGCTACAATGATGGTGATGCACCAATTGTTGCCATATATGTCACTGATATATACAATAGTGCTAACCAAC
TTGATCCTAGACACAGGGATTTCTTTTTAGCTGGCAACAATAAGATAGGTCAACAATTGTAT > SEQ ID NO:495 113128   266374_200030_1
ttttCTTCTTATTTTTTTGCTAACAATTATAATCATGGCTACTACATGGTTTTCTTTTTTCTTGAGTTTCCTTTT
GCTTTTGCATGGTAATTTTGCTCAACAAAGGTCTCAGCAGCAATATGGCCAGCAGTGTCAAATTAACAGACTCAA
TCCACAAGAGCCTTCCTTTAGAATGGAAGCAGAAGCTGGAGTTACTGAGTTTTTTGACAGAAATAATGAGCAATT
TCAATGTGCTGGAGTTTCACTATTTCGCCATGTTATTCAGTCCAGAGGCCTTCTCTTGCCTTCTTATACTAATTC
TCCACTGCTTGCCTATGTTGTTCAAGGTCGAGGATTTTATGGGATCATGAACTCGGGTTGCCCCGAGACATTCCA
ATCATCTCAACAAACTCAACAGAGAATTAGAGGCAGAAGATTTCTAGATCGTCATCAAAAGATTGAACAATTTAG
GCAGGGTGATATTATGGCATTTCCTGCAGGTGCTGCACATTGGCTCTATAATGAAGGAAATGAAGAAGTTGTTCT
TGTTGTTCTTGAAGATGCCTCTAACAATGCCAATCAATTGGATCAAACCTCTCGGAGGTTCTTTATTGCTGGAAA
CCCGCAACAAGGACAACAACAGCAAGGAAGACAATATGGTGGCAGCACAACGCGGAGGGAGCAATTTCGATCAGG
CAATGTTTTCAATGGCTTTGACTTAGAAATTCTATCAGAAACATTTGGTGTTGACAGGGAAACGGCAAGGAGGCT
ACAAGGACAAGATGACATGAGAGGTCACATTgttAGTGTTCAAGaaggGCTTAGAGTGATTAGGCCACCTTTTTC
ACaagAACAagaGGAACAaCaAGaacaaggacaaTATGGtcgtggtcCTATGACTAATGGAATTGaagaGACaat
ttgtactgctAaggttAaAGAAAACAtTgAcaatcccgctcgtgcTGATATATa > SEQ ID NO:496 113128   291305_200078_1
CAAACAATGGCTACTTTCTCCTCAGTCCTCTCTCTCAGCCTTTGCTTCCTCGTTCTCTCCCACAGCTGTTTTGCT
CAGCTCTTAGAGCAACAGCAACAGAACGTATGGCAGAGACTTCAACAGCAGCAACAACACCGCGCTCTCAGGTCA
AAAACCGAGTGCCAAATTGAGCGTTTGAACGCTCAAGAACCAACCCGGAGATTTGAGTCTGAGGCCGGTGTTATT
GAGTTCTGGGATGCTACCCAAGAGCAGTTTGAGTGTGCCGGAGTTCAAGCCGTTCGCCATCAAATTAGGCGAAAT

Figure 2 continued

GGACTTTTGCTTCCTTACTATACCAACACTCCTCTGCTCATGTACATTATTCAAGGACGCGGTATTCACTCGACT
GTGATACCGGGATGTGCTGAGACATACGAAACAGAATCTGGAGAATCCAGAACCGGAGAAAGACGCCGGAGTTTC
AATGATAGGCACCAGAAACTCAGACGTTTCAGAGCCGGTGATGTTCTTGCTTTGCCGGCGGGAGTCACTTTCTGG
ATGTACAATGATGCTGAGGAACCAATTGTCACTGTCTCACTTCTTGACACTTCTAACCACGCTAATCAACTTGAT
CTCACTTTCAGGAGCTTCTTCCTAGCTGGAAACCCACAGCGTGGAGTACAACAACAATCTGTAGGAAGACAAGGA
GAAACAACAATGCAAGAAAGGAGATCAGaACAAGAGAGaACATCTAAAGGAGGCAACATTtTCAACggTtTCGAC
ACTGAAATTTTGTCCGAAGCATTCAACGTGGACGTCGAaaCTAtaaGAagacttCAAggaCagaACgaAGaGaGa
ggtGTAATTGttAGAGc > SEQ ID NO:497 113128 266469_200086_1
aaaatggCTTCTAACTCCTCTCTCATTTGTTTTAGCCTTTGTTTCCTCTTTCTTTTTCATGGTACTTTTGCTCAG
ATCTTTGAGCACCAGCAAGTTTGGCAGAGGATGCAACAGCAGCAGCAACATCGGGCGCTCAGGTCCAGAACTGAG
TGCCGAATTGAGCGCCTGAATGCTCAAGAGCCTACTCGTAGGTTCGAGTCTGAGGCTGGTGTCACCGAGTTCTGG
GATCACACTCAGGAACAATTTGAGTGCGCCGGAGTCCAAGCAGTTAGGCATGAAATCCGACGAAATGGGCTTTTG
TTGCCTTACTACAGCAACACTCCCCAGCTCATCTATATAATTCAAGGAAATGGAGTGCATTCGGCTGTGTTCCCG
GGTTGTGCTGAGACATTCGAGACAGAGTCAGCACAATCGAGGAGGGGAGAAAGGGGAGAAAGAGGAGAAGCAGGA
CAAAGATTCAATGACCGTCACCAGAAAGTTAGACGTTTTAGAGCTGGTGATATTCTTGCTTTGCCTGCTGGTGTT
ACACACTGGACTTACAATGATGGTGAAGAACCAATTATCAGTGTCTCTCTTATTGACACTTCTAACCAGGCCAAT
CAACTTGATCTCACCTTCAGGAAATTTTTCCTTGCTGGAAATCCTCAACGTGGTGTACAACAACAAATGTTAGGA
AGGCAACAGGAGGGAGCTCCTggCCTAggAAGAAGAggTAGTGAACaaGAGAGAGGAAGCAACATCTTGAGCGGA
TTCGaCGCTcaactttttgtcagaTGCTttcaaTGTCGATCcTgaaataattaggagaCtacaagaacaagtcccg
gaaaggGGAGTGAtc > SEQ ID NO:498 113145 145775_301061_1
GCTTCATAGAAATAATTTGAAGGCTAGATTAGAGCATTTTGGTCCTGACCCGGTTCTCTATCCTTTGAAGCGGTT
CAAGTGGCTTATTGATTTCTGCGTAGACCATGAATGGTGTGCAGTAGTTAAGAAACTGTTGAGCGTTCTTCTTGA
TGGAACTGTGGGCGCAGGAGACAGTACTTCCTTGAAATTTGCTCTTACTGAGATGGGTCTTCTGCATAGAGCTGT
GCGTAGGAATTCGAGGCCTCTGGTTGAATTGCTATTAACATATACCCCAGAGAAAGTAGCAGATGAACTAACTTT
GGAATACCAATCCCTGGTTGAGATTCACGGAGAATTCTTGTTTAGACCTGATTGTGTAGGGCCTGCAGGTTTGAC
ACCACTTCATGTTGCAGCTGGCATAGATGGATCTGAAGATGTACTAGATGCATTGACAGATGATCCTAGAAAGGT
GGCAATTGAAGCGTGGAAGAATACTCGTGATAGCACAGGTTTCACACCAGAAGATTATGCACGCCTGCGAGGACA
TTATTCTTACATTCACCTGGTGCAGAGGAAGATTAGCAAGAAAGCAACCAGCGGACATATAGTGGTTGATATTCC
TATTGTTCCATCTATT > SEQ ID NO:499 113718 120549_300411_1
CAACCCCAACCCCTCTTCAAACCACTTATCACGCGCTCTGCTACCTCCCCATACAACACACACACACACACACTT
AATTTCTCTCGCTAAACCCACGAATCCATACTCCCATTTGCTTTCCCCGTGATCATTTTCCGGCGAGATCTCTGA
TACTCCGTCGGAAAATCCTGATCGGATCCGCTATCTCTGAACTGCGATTCACTTTGCGATTTCGAAAGATCCGAT
TAGATATGGCTCCAGTTTCGGCTCTTGCGAAGTACAAGCTCGTCTTCTTAGGAGATCAATCTGTCGGCAAAACCA
GTATTATCACGCGATTCATGTATGATAAATTCGATAACACTTATCAGGCTACAATTGGTATTGACTTTCTGTCTA
AGACTATGTACCTTGAAGATCGTACAGTACGATTGCAGCTATGGGATACTGCAGGTCAAGAGAGATTTAGGAGTC
TCATACCAAGCTATATTAGGGACTCCTCTGTTGCTGTCATTGTGTTTGATGTTGCTAGCAGGCAGTCCTTCTTAA
ATACTTCAAAGTGGATTGAGGAGGTTCGAACTGAGAGGGGCAGCGATGTTATTATTGTCCTTGTTGGTAACAAAA
CTGATCTAGTTGACAAAAGGCAAGTTTCAATCG > SEQ ID NO:500 113718 159101_200140_1
ACGTTTTTGCATCTGAATTCTGCCGCGAACAATCAGATTCCGTACAATTCTCGCCGGTAGATCTCTCAATATTCC
GGTGACTTTCGTGTGCTTTTAATCGCCATGAATCCAGAATATGACTACCTGTACAAGCTTCTGCTTATCGGTGAT
TCTGGTGTTGGGAAGTCATGTCTCCTTTTGAGATTTGCTGATGACACATATCATGAGAGCTACATAAGCACAACT
GGAGTTGATTTTAAAATCCGGACAGTGGATCAAGATGGGAAGACCATTAAGCTTCAGATTTGGGATACTGCTGGA
CAAGAGCGTGTTAGGACGATCACTAGCAGCTACTATCGCGGAGCCCATGGCATAATAATTGTCTATGATGTGACG
GATCACGAGAGCTTCAATAATGCGAAGCAAAGGCTGAATGAAATTGATCGTTATGCTACCCCAAACG > SEQ ID NO:501 113718 201669_300718_1
GGCGGATCGGTGGGTTGCGGGCTTGCACGTAGTCGAGGCTCGAGAGGAGGGGGGATGGCGGCGGCGGCGGCGGC
GGCGGGGTACAGGGCGGAGGAGGAGTACGACTATCTGTTCAAGGTGGTGCTGATCGGGGACAGCGGCGTGGGGAA
GTCGAACCTGCTGTCGCGGTTCGCGCGGGACGAGTTCAGCCTGGAGACCAGGTCCACCATCGGCGTCGAGTTCGC
CACCAAGACCGTCCGCGTCGACGACAGGCTCGTCAAGGCCCAGATCTGGGACACCGCCGGCCAAGAGAGGTACCG
CGCCATCACGAGCGCCTACTACCGCGGCGCGGTGGGCGCGCTGGTGGTGTACGACGTGACGCGCCGCATCACGTT

Figure 2 continued

CGAGAACGCGGAGCGGTGGCTCAAGGAGCTCCGCGACCACACGGACGCCAACATCGTCGTCATGCTCGTGGGCAA
CAAGGCCGACCTGCGCCACCTCCGCGCCGTCCCCGCGGAGGACGCCAGGGCGTTCGCCGAGGCGCACGGGACCTT
CTCCATGGAGACGTCGGCGCTGGAGGCCACCAACGTGGAGGGCGCCTTCACCGAGGTGCTCGCGCAAATCTACCG
CGTCGTCAGCCGGAACGCGCTCGACATCGGCGA

> SEQ ID NO:502   113718   201333_300715_1
ctctctctctctctcccctccctccgatctcgccgcgtccgtgtccctcgccgccgcagccagggtcgAGGGC
TCGGCGACCGGAGGAGGAGAGGCCGGAACCCGCCGCCGCCGCCGCCGCCTCCGCCTGTAGCGAGATCGCTCGATC
CGGTTCGCCTCCCGCGCGCCAGTCCGCCAGCCCAGTTCGATCCGTTGAGGGGGAGGGGACGCTCTAGTGTGGGGA
TTGGGGGAATCGATGGCGGCGCCGCCGGCGAGGGCTCGGGCCGACTACGATTACCTCATCAAGCTGCTCCTCATC
GGCGACAGCGGTGTTGGGAAAAGTTGTCTCCTCCTACGGTTCTCTGATGGTTCCTTCACCACCAGTTTTATTACC
ACCATCGGGATTGATTTCAAAATAAGAACAATCGAACTGGATGGTAAACGGATTAAACTTCAAATCTGGGATACA
GCTGGTCAAGAACGTTTCCGAACTATTACAACTGCCTACTACAGGGGAGCAATGGGTATTTTGCTTGTTTATGAT
GTCACCGACGAGTCATCATTTAATAATATAAGAAACTGGATTAGGAACATAGAGCAACATGCTTCCGATAATGTG
AACAAGATTTTGgTagGcaACAAAGCTGACATGGATGAAAGCAAAAGGGCCGTaccaacttcaaAgggcaagCA
CTTGCTGATGaAta > SEQ ID NO:503   113718   7863_300306_1
CCCACGCGTCCGCTACAATTCCTCTGTCGCTCTCACCAGTTAACAGCTACAGCACAAAACTGTAACCACGCTTCC
GATCTCTAAAACCTGAGAGAGAGAGAGAGAGAGAGAGAGACAGAGAGAAGTGTTTCAATAGTTTGGCGTGAAGAT
GGCCGGAGGAGGCGGATACGGCGGCGCATCGGGGAAAGTTGATTACGTCTTCAAAGTTGTTCTAATCGGAGATTC
GGCTGTTGGGAAATCGCAACTACTTGCTCGATTCGCTAGAGACGAATTCAGCATGGATTCTAAAGCCACCATCGG
CGTCGAGTTCCAAACTCGTACCCTCTCCATTGAACAAAAAAGCATTAAGGCTCAGATCTGGGATACCGCTGGTCA
GGAAAGATACAGAGCCGTTACAAGCGCATACTACAGAGGAGCAGTTGGCGCAATGCTGGTTTATGATATGACGAA
ACGTGAGACCTTTGAGCATATTCCGCGTTGGCTTGAAGAACTGAGGGCGCACGCTGATAAGAACATTGTCATCAT
CCTTATTGGAAACAAGTCTGAtctAGAAGATCAAAGAGCTGTTCCCACTGAAGACGCTAAAGAGTTTGCTGAGAA
GGAAGGACTCTTTTTCCTCGAGACCTCTGCTTTAAACGCAACCAATGTCGAAAACTCCTTCAACACTCTAATGAC
TCAGATATACAATACCGTGAACAAGAAGAATCTTGCATCTGAAGGCGACTCAAATAACCCCGGTTCATTGGCTGG
TAAGAAGATTCTCATCCCAGGTTCTGGACAGGAGATTCCCGCTAAGACCAGCACTTGTTGTACTTCTTCTTGATC
TGTCTCCTACTCAAGCAAGATTCATTTTTTTTCCTCCTGAAATTTGTGATAGAGAATGCTACTTTCATTGTATAT
TCTTTTTCGAATCTGGCTTGTTTGCTAGTTCATTAAACATTGGTGTGCaattggacaccgatagaaagtattgga
acaaatagcttttgaatgaaatatgaaacaaacagtctttgagagttaaaaaa > SEQ ID NO:504   113718   273944_200055_1
TCTCTCTCTTCTCTCTCTCTTCCAACCCCGTCCCCATGAAGAGACATGCTTTCTCTCTCTTCTCTCTCTATTCCT
CGAAGCTAAGAATAGCATCGTTTTACCTACTTTTCTTGGTCATTCTGAAAGTTAAAAGTCTAAATTGACACAATA
AACCCTTTAATACAATTATTATACAAACAAGTCATAAACACCCGACACTTAATTACCCGATTGATTTTTCTAGGA
TATGGGTTGCGCATCTTCAGTTGCAGATAGGAATTCAGGACGGGCTGCTGGCCTTAATCCGGATAATGGTGGAGC
ACTTGACCCTAAAAATCTTAAAGTGAAGCTGGTACTCTTGGGTGATTCTGGTGTTGGTAAAAGCTGTATTGTTTT
GCGCTTTGACCGTGGCTAATTTGATCCAACATCTAAGGTGACTGTAGGAGCTTCTTTTTTGTCTCAAACAATAGC
GTTGCAGGACTCAACTACAGTTAAATTTGAAATATGGGATACAGCGGGTCAGGAGAGGTACGCAGCTCTTGCACC
CCTGTACTACCGAGGTGCTGAAGTTGCATTTGTTGTGTATGATATTACTAATCCCGAGTCTTTTGCCAAAGCGCA
ATACTGGGTCAAGGAATTACAAAAACATGGAAGCCCTGATATT > SEQ ID NO:505   113718   272034_200040_1
GGNGAAAAAAGTAGTGAATGATGCCATAAGCATTCACAATACTTTTACTGGCCCCCTTCTCTCTCTCTCTGTATC
GCATTGTCACTGTTATATAGTAGTAGTACTTTCTGGACAAGCTTTTAGAGAGAGAAAGTAAAAGTACATATCGGA
GGAATTTTTAGGTAGAGAAAGTTGAGAAGGAGTCGTCGGAGAGTTAGCCGATGGCGACGACAGGGCAGAGTAATA
GCAGTTATGATCTGTCATTTAAGATACTGTTGATCGGAGATTCTGGAGTAGGCAAAAGTAGCTTGCTCGTTAGTT
TCATTTCTAATGTCGTTGACGATCTTGCCCCTACCATTGGTGTTGATTTTAAGATTAAGACGCTCACTGTTGGTG
GGAAAAGACTGAAGCTTACCATTTGGGACACAGCTGGACAAGAGAGGTTCAGGACACTGACAAGCTCCTACTACA
GAGGTGCTCAGGGGATCATTCTTGTCTATGATGTTACGAGAAGAGAGACCTTCACAAACCTGTCTGATGTGTGGG
CAAAAGAGGTGGAGTTGTATAGTAATAATCAGGATTGTGTGAAGATGCTTGCTCGGAAATAAAGTTGACAAAGAA
TCTGAGAGAGCT > SEQ ID NO:506   113718   266192_200084_1
AATATCAAAAGGGAAAAATACAAACCTAAAAAAGGGTTCACCTTTTGTTAATTTGATTTTTTCACCATGTCTATG
CGTAGGAGAACCTTGCTTAAAGTCATCGTCCTCGGCGATAGTGGGGTTGGTAAAACGTCATTAATGAATCAATAT
GTTCACAAGAAGTTCAGCCAGCAATATAAAGCTACAATTGGAGCTGATTTCGTGACAAAGGAGCTTCAAATTGAT

Figure 2 continued

GACAGGCTTGTAACTCTCCAAATATGGGATACAGCTGGCCAAGAGAGATTTCAGAGTCTTGGAGTTGCATTCTAT
AGAGGTGCAGATTGCTGTGTTTTGGTCTATGATGTCAATGTTATGAGATCCTTTGATAACCTTGACAATTGGCAT
GAAGAATTTCTCAAACAGGCTAATCCACCAGACCCTAAAACATTTCCTTTCATATTACTGGGGAACAAGATTGAT
ATAGATGGTGGAAATAGCAGAGTGGTTTCTGAGAAGAAAGCAAAGGAATGGTGTGCTTCAAAAGGGATACCTTAC
TTTGAGACATCAGCAAAAGAGGATATAAACGTTGATGCTGCATTCTTGTCTATTGCAAAAACTGCTTTGGCCAAT
GAACACGAGCAAGATATATACTTCCAGGGCATTCCGGAGGCAGTTTCAGAGACAGAGCANAGAGGTGGTTGTGCA
TGTTAAGGTGAATGAAGCAATTTCATTGAGTGCTATATGTAATCG

> SEQ ID NO:507 113718   265945_200082_1
tccgatcccgtatggttgGAGATATTCCCCTTCATCATTTTTTCCTGAGAAAATTCAAATGGCCGTTCCACCCGC
TAGAGCTCGAGCCGATTATGATTACCTAATCAAGCTCCTCTTGATCGGCGACAGCGGTGTGGGTAAGAGTTGCCT
TCTTTTACGTTTCTCAGATGGCTCCTTCACGACCAGTTTTATTACAACTATTGGCATTGACTTCAAGATAAGGAC
CATAGAGCTTGATAGCAAACGAATCAAACTACAAATCTGGGATACTGCTGGTCAGGAGCGGTTCCGAACAATTAC
AACTGCTTACTACCGTGGAGCCATGGGTATATTGCTGGTGTATGACGTGACTGATGAGTCATCTTTTAACAACAT
CAGGAACTGGATAAGAAACATTGAGCAGCATGCTTCCGACAATGTCAACAAAATTCTGGTCGGCAACAAGGCTGA
CATGGACGAAAGCAAAAGGGCTGTTCCTACATCAAAAGGTCAAGCACTAGCCGACGAATATGGCATTAAATTCTT
TGAGACAAGTGCCAAGACAAATATGAATGTGGAAGAGGTTTTCTTTTCCATAGCTCGGGATATAAAACAAAGACT
TGCTGAATCTGATTCAAAGGCTGAGCCTCAGACTATCAGGATAAATCAACCAGACCAGGCAGCAGGAGCTGCTCA
AAGCGCTCAAAAATCAGCTTGCTGTGGCTCTTGAAATATTGACAGCAACGACGACAGGATGATGGGGAATACATC
CTTCAAGTTACCATTTTAGTAGGAAGGGTGGAACTAATCTTTGTTATAACATTCTGACCATCGATTGTATTTTTC
TCTTTACAGTTATTTCTTCAATATCTATTTGTATTGGGTGGCAGCTCTTAGTAttgcaaaaatcagtatatgctc
actactttttggcttaatataaatgaagggacactctgccttctcatgtttcttgttc > SEQ ID NO:508 113718   249503_301593_1
agaatgaacctgtttgcgaatccaCGAAGAAAGAAGGGAAAGCGGTGCCATCGCGGGCAGGAGCAGGGCCAGATC
TGAGCTGCGCCGCCATCGATCGACGACCCAATCCACTGCCGCAGCTAAGGCGCCGCGAGATCCGGAGGTCTTTTG
CAGGGATTTCGGGGATTTTCGCTGGTTTTTCTTGATCTCTTCCTCGGTTCTGCGAAGAAGACGCATCGGCAGCAA
TGAATCCCGAGTATGACTATCTCTTCAAACTCCTCCTAATTGGCGACTCTGGCGTCGGGAAATCGTGCCTGCTGC
TACGATTCGCGGATGATTCTTACCTTGAGAGCTACATCAGCACCATCGGGGTGGACTTCAAAATCCGAACAGTGG
AGCTGGAAGGGAAGACTATCAAGCTCCAAATCTGGGACACTGCTGGGCAAGAGCGCTTCAGGACTATCACGAGCA
GTTACTATCGTGGAGCTCATGGCATAATCGTCGTGTACGACGTGACTGACCAGGAAAGCTTCAACAACGTCAAGC
AGTGGCTCAACGAGATTGATCGCTACGCGAGCGAGAATGTGAACAAGCTCCTCGTCGGGAACAAGTCGGATCTCA
CTGCCAAGAAGGTGGTCGACACTCAGACTGCCAAGGCTTTTGCAGACGAGATAGGAATCCCGTTTCTAGAAACCA
GTGCcAAGAACGCgaccaacGTAGAGCAGGCAttCATGACca > SEQ ID NO:509 113718   238174_301292_1
gagctacttactAGGCGAGAATCAAATGGCGCTGTCTTCCTCCTCCGTCAGCGGCAACGAGTTTGATCACCTCTT
CAAGATACTGCTCGTCGGGGACTCGGGTGTCGGCAAGAGCAGCCTGTTGCTGCGATTCACCGCCGACACTTTCGA
CGATCTCTCCCCCACAATCGGTGTGGATTTcAAGCTCAAGCTTATGACGCTGGAAGGCAAGAGGCTCAAGCTCAC
CATCTGGGACACAGCCGGGCAGGAAAGGTTTAGAACGCTTACGAGCTCGTACTACCGAGGGGCACAAGGCGTCAT
TCTTGTTTACGATGTTACAAGAAGAGATACGTTCACGAATCTCTCGGAAGTTTGGCTCAAGGAGGTCGAGCTCTA
CTCCACCAACCAGGACTGCGTCAAGCTCTTGGTGGGGAACAAAGTCGACAgggaTTCCGAGCGTGCGGTGACGAA
GCACGAAGGCATGGCTTTCGCCCGGAAGTATGGCTGCCTGTTCCTGGAGAGCAGTGCCAAGACGAAGATCAACGT
CCAACAATGCTTTGAAGAGCTGGTCAGGAAGATTCTGGAAACTCCCAGCTTGGTGGCCGAGGCCAAGTCGGTGAA
GAAAAACATCATCAGACCAAGCAACGATGAGGAGCcgcctgCGGctgccgaTAACTCTGGTAgc > SEQ ID NO:510 113718   234217_301098_1
aaaTTTTCGAAGGGGGAAAAAAAGGTCTATCGTTCTTGTTCGCAGCGGCGGCGTTCGCTTTGATCTGGTTCTCGA
TCGATCGACCCATCGATTGTTTCGCGGCGATGGCGACGACGGGATCCACATGCAGGCCAAGCTTGTGCTGCTGG
GCGACATGGGAGCTGGCAAGTCCAGTCTGGTTCTTAGATTCGTCAAGGGCCAGTTCTTCGATTACCAGGAATCGA
CAATTGGAGCTGCATTCTTGACGCAGACATTGGCCGTGAACGAGACGACGGTAAAGTTCGAGATTTGGGACACTG
CGGGTCAAGAACGCTACCACAGCTTGGCTCCAATGTACTACCGCGGCGCTGCCGCCGCCATCATTGTTTATGACA
TCACTAACGCGGACTCTTTTGCAAAAGCAAAAACATGGGTACAGGAACTCCAAAGGCAAGGAAGTGCCAACCTCG
TCATGGCTCTTGCGGGGAAACaaaGCtgAtTTggCtgcaaAGCGCaaGattgaaAcACAggAggGACaaTCTTAt
gcGGAtgaaAACGGgCTCTTCttcatggagacttc > SEQ ID NO:511 113718   228336_301020_1
aacgcgacagcttcgcctcgtctctccccccgagtccccaacccctcctcctcctcttcccctccccgcg
ccgcgGCGAGATCGCTCCCCCCGGGGGCAGCAGCTAGATCCCGATGGCTTCGCGCCGCCGCACCCTCCTCAAGGT

Figure 2 continued

```
CATCATCCTCGGCGACAGCGGGGTTGGGAAGACGTCCCTGATGAACCAATATGTGAACAAGAAGTTCAGCAACCA
GTACAAGGCTACGATTGGCGCGGATTTCCTCACCAAGGAGGTTCAGTTCGAGGATAGGCTCTTCACTTTGCAAAT
ATGGGATACTGCTGGCCAGGAAAGGTTTCAGAGTCTTGGTGTTGCATTCTACCGTGGAGCAGATTGCTGTGTTCT
AGTTTATGATGTCAATTCTATGAAGTCATTTGATAATCTTAACAACTGGCGTGAAGAATTTCTAATTCAGGCAAG
CCCATCAGACCCTGATAACTTCCCTTTTGTTCTTTTGGGCAACAAAGTTGATGTAGACGGTGGCAACAGCCGTGT
GGTCTCTGAGAAGAAGGCAAAGGCATGGTGTGCCTCTAAAGGGAATATCCCATACTTTGAGACATCTGCCAAGGA
TGGTACAAACGTGGAGGAGGCTTTCCAGTGCATTGTAAAGAATGCTCTGAAGAATGAACCAGAGGAAGAACTGTA
TGTGCCGGACACCGTGGATGTGGTGGGTGGCAACCGGGCCCAAAGATCATCAGGCTGCTGCTAGAACATGATGGA
CCATGAGGGCTGAGACTGTTGGCTATGCGGTAACAGAACTACCTTTGGACATtGCTGTGCCTCCATGGTGACTCT
CAaggaCCCATTCGtaaccTTTTcaaTCACCTCATgtACCcagTTAAGaTTGATGCgtctggcctgagtTgtcaa
aTttgtggatgtTGtgcagtTTatcagtagcgtCATat
```

> SEQ ID NO:512 113718 281523_200071_1

```
GCAAGATCCCAGCAAAGACTAGCCAAGATCTGCGTCTCCTCTCTCTCTCTCTCTCTCTCTCTCTCTCTCTAACTT
TCAACTGCTGATTGAGTGCACAGAAGCTTAGTGTTCTGGTTTAAAAAAAGATGGCGAGTGGGTATGGGGATGCGA
GCCAAAATATAGATTATGTATTCAAAGTGGTGTTAATCGGCGACTCATCTGTAGGCAAGTCTCAGATACTGGCTC
GATTTGCTCGTAATGAATTTAGCCTGGATTCTAAGGCCACGATTGGGGTTGAGTTCCACACCCGAACCCTAGTCA
TTCAACACAAGTCTGTTAAAGCTCATATCTGGGATACTGCTGGTCAAGAACGATATAGAGCTGTCACAAGTGCAT
ACTACAGGGGCGCAGTTGGAGCTATGTTGGTTTATGACATAACGAAACGGCAAACCTTTGATCACATACCCCGTT
GGCTGGAAGAGTTGCGCGCACATGCCGATAGGAATATCGAGATCATGCTGATCGGACACAAAACAGATCTTGAAC
ACCAACGAGCTGTCCCTACCGAAGATGCTAAAGAATTCGCCCAGAAAGAAAGATTATTCTTCTTGGACACTTCTG
CAATGGAAGCCACACACGTGGAGGATGCATTCTTGACTGTTTTGAC
```

> SEQ ID NO:513 113718 227206_301009_1

```
AAAGCCAGCCAGCCAGCCACCTCTGCATCATCCCGCCTGTCTGCCTGCGCGCGCCGGCCAGGCGGCCGCCGCCTC
GTCTGCTCCGCCGGTCCAGGTTGGGTCCCCCTCTTGACGAGGGGCGGGAGGGAGGGAGCGAATCTGAGGTGGTGG
CTATGGGGTCGCCGGGGGCGGGGAGCAGCGGCGGCGGTGGAGGTGGGCATGAGTGCAGCTTCAAGATCCTGCTCA
TCGGGGACTCCGGCGTCGGCAAGAGCAGCCTCCTCGTCAGCTTCGTCGTCGCCGCCGCCGCCGCCCACCTCGACG
ACGACATCGCTCCCACCATCGGAGTGGATTTTAAGATCAAGTTCCTTACGATTGGTGGAAAGAAATTGAAGCTGA
CAATATGGGATACTGCTGGCCAGGAGAGGTTTAGGACAATTACTAGTTCTTACTACAGAGGTGCTCAAGGCATTA
TTCTAGTATATGACGTCACGAAGAGAGAAAGCTTCACAAATCTGGCTGAAGTATGGAGTAAGGAAATAGAGTCAC
ACTCATCAAACAAAGACTGCATAAAAATGCTTGTTGGAAACAAAATTGACAAGGAGGATGAAAGAACTGTCACAA
GAGAAGAAGGGCTTGCCTTTGCAGAAGAATCTGGATGCCTATTTCTTGAGAGTAGTGCGAAAACA
```

> SEQ ID NO:514 113718 190764_300779_1

```
AAGAATTTTCAGGTTTTCTTCTCGCTTTCACCGGAGAAGGAGAAGGAGAGGAAGGTGTTGATCGAATCCTCCTCC
AATCGCGCGCGATTCGATCCCCGTTGCTGGCTCGCTCGCTCCGCCGATCCCTCATCCGATCTGAATCCCCGATCT
GATGGCGGCCAACCCCGGCAACAAGATCCGCAACGCCAAGCTGGTTCTTCTTGGAGATGTGGGCACGGGCAAGTC
GAGCCTCGTTCTCCGGTTTGTGAAGGGCCAGTTTGTTGAATTCCAGGAGTCCACCATCGGCGCGGCCTTCTTCTC
GCAGACCTTGGCGGTTAACGACGAGACGGTGAAGTTCGAAATCTGGGATACTGCAGGGCAGGAGAGGTATCATAG
CTTGGCTCCGATGTACTATCGTGGTGCGGCTgcCGCAATAGTTGTCTACGACATCACAAATGcggccTCTTTCAC
ACGTGCAAAAAAATGGGTTCAAGAACTTCAAGCGCAAGGAAACCCAAACACGATAATGGCTCTTGCTGGTAACAA
GgcTGATATGGTacaggcgaGGCAggTGc
```

> SEQ ID NO:515 113718 157926_301744_1

```
ACCTTGCTCTCCGTCATTTTCCGGCGACGATCCCTTTTTCGGCTATTTCCGGCCGTAAGGAACAGAAACATCCCC
GTTCCCTTCGCCCTTTGGATCAGTCAGCTTCGCAAAATCATGAATCCCGAATATGACTACTTGTTCAAACTTTTG
TTAATAGGAGATTCAGGTGTTGGAAAGTCATGTCTTCTCCTGAGATTTGCTGATGATTCTTATTTGGACAGCTAT
ATCAGCACAATTGGTGTTGACTTTAAAATACGTACAGTGGAGCAAGATGGGAAGACTATTAAACTTCAAATTTGG
GACACTGCCGGACAAGAACGTTTCAGGACAATTACAAGTAGTTACTACCGTGGAGCACATGGCATTATAATAACT
TATGATATAACTGATCAAGAAAGCTTCAACAATGTTAAGCAATGGTTGAGTGAAATTGATCGCTATGCAAGCGAA
AACGTAAACAAGCTTCTGGTTGGAAATAAGTGTGACCTAACTGACAACCGAGCTGTGTCATATGATACAGCAAAG
GCGTTTGCTGATGAAATCGGCATCCCGTTTATGGAGACTAGTGCAAAGAGTGCCACTAATGTTGAGCAAGC
```

> SEQ ID NO:516 113718 131361_300513_1

```
GAATTCAGATTCTGGTGTTGGGAAATCATGCCTGCGTGCTGAGATTTGCTGACGATTCATATCTTGAAAGTTACA
TCAGCACTATTGGCGTTGACTTTAAAATACGCACTGTGGAGCAGGACGGGAAGACTATTAAACTTCAGATTTGGG
ACACTGCCGGGCAAGAGCGTTTCAGGACAATCACTAGCAGCTACTACCGCGGAGCACATGGGATTATTATTGTTT
ATGATGTCACAGACCAAGAAAGCTTTAACAACGTGAAGCAGTGGTTGAGCGAGATTGATCGTTATGCGAGTGATA
```

Figure 2 continued

ATGTTAACAAGCTTCTGGTTGGGAACAAGAGTGATCTCACCGCAAATAAAGTCGTGTCAACTGAAACTGCTAAGG
CATTTGCTGATGAGATAGGGATCCCATTCCTTGAAACCAGTGCAAAAAATGCGACTAATGTTGAGCAAGCCTTTA
TGGCCATGGCTGCTGAAATAAAAAACAGGATGGCAAGCCAACCTGCTATGAACAGCGCTAAGCCTCCAACCGTTC
AGATCCGAGGACAACCCGTTACTCAGAATAGTGGTTGCTGCTCCTCTTCTTAAGGATAAGACTTTAGCTCGGACT
TTTTATCTCTCTGACAATCTTTGTCCCTCCATCCTTGTAAAACTAGTCTCTCTCTGGCACACTTATTCATCAGCC
ATCT

> SEQ ID NO:517  113718  137923_300687_1
GTTGCAACCTGCGAGCGGAAACCCACCTCCACCCCGTCGCCGGCCTGCCGCCGCCGCCGCCGCCGCTTGCCCTCC
TCCGCCTTACTCGGCCTCCGGCGCCTCCTGACCCCCGGCCATGGGTTGCTCTTCGTCTCTGCCAGCTAATAATG
CTGGAGGGGTAGGTACTATCAGCAACGAGAATTCTGGTACTGATCTGAAGAACTTGCGAGTGAAGTTGGTATTGC
TTGGAGATTCAGGTGTTGGGAAAAGTTGCATTGTTCTTCGCTTTGTCCGTGGTCAGTTTGACCCCACTTCAAAGG
TGACTGTTGGTGCATCATTTTTGTCACAAACATTGGCGTTGGAGGATTCCACAACAGTAAAGTTTGAAATATGGG
ATACTGCTGGTCAGGAGAGGTATGCTGCATTGGCACCTCTTTACTACCGGGGAGCTGGTGCCGCAATTGTTGTGT
ATGACATAACAAGTTCAGAATCATTTAACAAGGCACAATACTGGGTGAAGGAACTTCAGAAACACGGTAGTCCAG
ATATGATCATGGCTTTGGTTGGAAATAAGGCTGATCTACATGACAATCGTAGTGTATCCTCTCAGGATGCACAAG
AGTATGCAGAGAGGAACACTATGTTTTTCATCGAGACATCAGCGAAAA

> SEQ ID NO:518  113718  156705_301369_1
CACGCGTCCGAAAAGCAAATTCTCCTCTCAATTTTCCTCGCCATCTTTACGTGTCTTCATCACACGTGCTCTCTC
ATTCCATATCCTTTTGCTTCTTAATTCACCCGCGAAGATTCCGATTCAGATCCCGGTCAATTTTCGCCGGTAAAT
CCCTCAGACACCGGCGAATTTCATCTTCCCTCGATCGCAATGAATCCCGAGTATGACTACCTCTTTAAGCTTTTG
CTCATTGGTGATTCTGTGCGTGGGAAATCATGTCTTCTTCTGAGGTTTACAGACGACACATACCTGGAAAGTTAC
ATAAGCACTATTGGAGTTGATTTTAAAATCCGGACAGTAGAGCAAGATGGGAAGACTATAAAACTTCAGATTTGG
GATACAGCTGGACAAGAACGCTTTAGGACCATCACTAGTAGCTACTATCGTGGAGCCCATGGCATAATAGTTGTG
TATGATGTGACAGATCAAGAGAGCTTCAATAATGTAAAACAGTGGCTGAGTGAAATTGATCGTTATGCTAGTGAC
AATGTTAACAAAATTCTTGTCGGGAACAAGTCCGATCTTACTGCAAATAGAGTCGTCTCATATGAAACAGCTAAG
GCATTTGCTGATGAAATTGGTATTCCATTCTTGGAGACCAGTGCTAAAGATGCTACGAATGTAGAACAGGCTTTT
ATGGCTATGACTTCTGCTATCAAAAATAGGATGGCAAGCCAACCAACCAATAATTCCGCTAAG

> SEQ ID NO:519  113718  13784_300270_1
CCCACGCGTCCGCGATTTTTCGCCTGAACCTGCGGATTTTTCGATTCTTCAAATTCAATGTCTTATGCTTATCTC
TTCAAGTATATCATCATCGGCGATACTGGAGTGGGGAAATCATGTCTTCTGCTTCAGTTCACCGACAAGAGGTTT
CAGCCGGTGCATGACCTTACCATTGGTGTTGAATTTGGGGCTAGGATGATCACCATCGATAACAAACCTATCAAG
CTTCAGATCTGGGATACGGCTGGTCAAGAATCCTTTAGGTCTATTACAAGGTCATACTATAGAGGAGCTGCAGGG
GCATTGCTTGTCTATGATATCACAAGGAGGGAGACATTTAACCATCTAGCTAGCTGGCTAGAAGATGcaaggcaG
CATGCAAATgcaaATATGACGAtaatgCTCATTGgGaat > SEQ ID NO:520  115121  107884_300526_1
CCTTCTCCCTCTTCTCTCTGTCACGTGCTCGGTCTCGGTCCTTTGAGCTTCTCTCTCTGTCTCTCTCCGATTCTC
GCTCCCTGCTCCGATGCCTCGACGACCTTTCCCTTTCCTTATCTCTATCTCTATCTCTCTCCTTATCCTTTTCGC
CGTCGCCGCGAGACCTTTTGCTGCTACGACGATCTCTATTGTCGTCCTCGGCGGCGTATTCCTCGCTCCCGTCTC
TCTCCCTTCGGCGATAGGCTTTCTCGCTCTTCTCCTTCTCGGCGCTGCTGTTGTTGTGTCTTTGCTCTTTGTAG
AAGGACCACCGTTGGGCTCTTCTACAGTCTTCTCCAGATAATCGTACTCATCGAAGTCCATTTGAGGTGACTTTC
TCTGCCGGACGGCCGAAGGTTCGTTGTTCCGCCTGTGAAGAAGTGCTGGTTAGGTTTTGACAGAAACCTTAGATC
AAAAAATCAGTGTATTCCTCTCAGAAAAAAACTAAGCAGCAAAAACATTTCAAGAAAATAGCCTAAGCCATGGCC
AACATGATCATGGCTTCCTCCAAAGTCCTAATCACCT > SEQ ID NO:521  116525  120173_300359_1
ccccccccgctcttctctcattctcattccGCACAAATACATCTCCATTTCCTCCACTTTTCTAAGCCAATAATT
CTTCAATGGCCATGGCAACTCAAGCTTCTCTCTTCACTCCAGCTCTCTCTGCCCCAAAATCCTCTTCCCCATGGA
AACAATCCCTCGCTTCCTTCTCTCCTAAGCAACTCAAATCCACTGTTTCCACACACCGTCCCATTAGGGCCATGG
CCGAAGAAGCAGCCGCCGCCACAAAAGAAGCAGAGGCTCCAGTGGGCTTCACCCCACCACAATTGGACCCAAACA
CACCTTCCCCAATCTTCGGCGGGAGCACCGGTGGGCTTCTCCGCAAGGCCCAAGTTGAGGAATTCTACGTAATCA
CTTGGGAATCACCTAAAGAACAGATCTTTGAGATGCCAACTGGTGGTGCGGCTATTATGAGGGAAGGTGCTAATT
TGCTGAAATTGGCGAGGAAAGAGCAGTGTTTGGCACTTGGTACTAGGCTGAGGTCAAAGTACAAGATTAACTACA
GGTTTTACAGGGTGTTTCCTAATGGTGAAGTTCAATACTTGCATCCTAAGGATGGTGTGTACCCAGAAAAGGTGA
ACGCTGGCCGTCAAGGAGTTGGACAGAACTTCAGATCCATTGGTAAGAACAAGAGCCCAATTGAGGTCAAGTTCA
CTGGCAAACAAGTGTATGATTTGTAAGCTCATTATGTTGTGCCTTTTTATGTAATGATTTTGTGATTATTCAGGC

Figure 2 continued

CATCGTTTCATGTAATTTTATTTGCCACTACAAAATACAGCACGGGATTCTATTATTTCTCTCTCTTTTTTTTgc
tCTTATAGTTACTCTGttCTTTGAgggtGAcaaaggATGggTaTgct > SEQ ID NO:522 116525 129891_300482_1
ttttttttttttgggggggaaattatacagtaatccacatgtttaatggtaccttggaacaggaaaatacaaatta
agttcAAACAATAATTTCATTACATAACCACACAACCTACTGCAGcTcGAGGAAATCAACTACCCCTTGAATATT
CCATGGCTATGGCAACTCAAGCAGCTCTTTTTACCCCAACTCTTTCCACCTCAAAATCAAGCAATTTAGCATGGA
AACAATCCTCAACTGTGTCATTCGCCAGCCCTAAACCATTCAACTTTGCCGCACCACAACGTTCCATTAAGGCCT
CAGCTGCTGAAGGAAAGACAGAAGCTCCAGCGAAAGAAGCCCCAGCAGGTTTCACCCCACCAGAATTGGACCCAA
ACACACCATCTCCAATATTCGGAGGTAGTACTGGTGGATTGTTGCGTAAAGCTCAAGTAGAGGAGTTTTACGTGA
TCACTTGGGATTCTCCTAAAGAACAAGTATTTGAAATGCCAACTGGAGGTGCAGCTATCATGAGACAAGGACCTA
ACTTGCTTAAGTTGGCAAGGAAAGAACAGTGTTTAGCTCTTGGAACCAGATTGAGATCCAAGTACAAGATCAAGT
ACCAGTTTTACAGGGTTTTCCCAAATGGTGAAGTTCAATATCTTCATCCTAAAGATGGTGTGTACCCAGAGAAgg
TGAACCCAGGACGTCAAGgAGTCGGACAAAACTTCaggTCTATCGGAAAGAATGTCagcccTAttgaagttAagt
tcacTGgAAAAcaagcataTGAttt > SEQ ID NO:523 116525 127747_300472_1
attctGCACAAATACATCTCCATTTCCTCCACTTTTGTAAGCCAATAATTCTACAATGGCCATGGCAACTCAAGC
TTCTCTCTTCACTCCAGCTCTCTCTGCCTCAAAATCTTCAGCCCCATGGAAACAATCCCTTGCTTCCTTCTCTCC
TAAGCAACTCAAATCCACTGCTTCCACTCCCCGTCCCATTAGAGCCATGGCCGAAGAAGCCGCCGCCGCCGCCAC
AACAAAAGCAGAGGCTCCAGTGGGCTTTACCCCACCACAATTGGACCCAAACACACCTTCCCCAATCTTCGGTGG
CAGCACCGGCGGGCTTCTCCGCAAGGCCCAAGTTGAGGAGTTTTACGTAATTACTTGGGAATCACCTAAAGAACA
GATCTTTGAGATGCCAACTGGTGGTGCAGCTATTATGAGGGAAGGTGCTAATTTGCTGAAATTGGCGAGGAAAGA
GCAGTGTTTAGCACTTGGTACTAGGCTTAGGTCAAAGTACAAGATTAACTACAGGTTTTACAGGGTGTTTCCTAA
TGGTGAGGTTCAATACCTGCACCCTAAGGATGGTGTGTACCCAGAAAAGGTGAACGCTGGCCGTGAAGGAGTTGG
ACAGAACTTCAGATCCATTGGTAGGAACAAGAGCCCAATTGAGGTCAAGTTCACTGGCAAACAAGTGTATGATTT
GTAAGCTGATTATGGTATTTTGTGCCTTTTCGTGTAATGTGATGAATTTGTGATTATTTAGTGCATCATTTCATG
TAATTTTATTTGCCACTACAAAATACAGCATGGGATTCTAC > SEQ ID NO:524 116525 245554_301569_1
gGGGTTGTTTCTCAGGCCCAGCATTTGATACATCAAAGATGCAGGCCTTGGCAATGCAAGCGTCTCCAATGAGCC
TGCGCTCCACGAGCAGCGCCGGCAGCAGCACCAGCAGCTTCTTCCAAGGTCAGTCCAAGATCTCCATGGCGGCGG
CTCCTGCGCGAGTGAGCATGATGGCGACGGCAGATAAGGCAGATAAGGCGGATAAGGCAGCTAAGGCAGATAAGG
CAGATAAAGCAGCACCTGCACCCGCGGGATTTACCCCACCAGAGCTCAAGGCCGATACCCCGTCCCCAATCTTTG
GTGGCAGCACGGGCGGACTGCTGCGCAAGGCACAGATCGAGGAGTTCTACGTCATCACCTGGGAATCACCCAAGG
AGCAGATATTTGAGATGCCAACCGGAGGTGCTGCAATCATGCGCTCCGGCCCGAACTTGCTCAAGCTGGCTCGTA
AGGAGCAGTGCATGGCGCTGGGCACGCAGCTGCGCTCCAAGCTCAAGATCAACTACCAGTTCTATAGAGTGTTCC
CCAACGGTGAGGTGCAATACTTGCATCCCAAGGACGGAGTCTACCCCGAGAAGGTTAACCCCGGGCGGAAGGGCG
TGGGTGTCACTCTCAGGTCCATTGGCAAGAATTGCAACCCCGTCGATCTCAAGTTCACAgGCAaggctGcATATG
ATGTGTAAcGctTt > SEQ ID NO:525 116525 46863_300192_1
ggtatcaacgcagagtgccattacggccgggGTAAAGCGCAAGTGGAAGAGTTCTACGTTATCACGTGGAACTCA
CCGAAAGAACAGATCTTTGAGATGCCGACAGGAGGAGCAGCGATCATGAGAGAAGGTCCGAATCTTCTGAAGCTA
GCGAGGAAAGAGCAGTGTTTAGCTTTGGGGACAAGGCTTAGATCCAAGTACAAGATCACTTACCAGTTTTACAGA
GTGTTTCCTAACGGTGAGGTTCAATATCTTCATCCTAAAGATGGTGTTTATCCAGAGAAGGCGAATCCAGGAAGA
GAAGGTGTTGGTCTCAACATGAGATCTATTGGGAAAATGTTAGTCCCATTGAAGTTAAGTTTACTggCAAACAA
AGttATGATTTGTAAGATCTGTAAACTAAAAAAACcaaAAACTATGTGCATGTggtgATGATTATGACTATGTTT
CATGTTAATTtTTaATggaTTttgt > SEQ ID NO:526 116525 255851_301645_1
gctCTCAGAGCAGTGTGCTCGCGTGTGCCCACCACGAGCCTGTAGCGATTCCCTCAGCAGCAGCAGCGATGGCCA
TGTCTGCGCACGCCTCCCAGGCGGCAGTCATTGCAGCAACCGCCAAAGCAGTGCCATCAGCATCAGCTTACCCCG
CCTCTACTGCCACGGTATCCCTTCGCCAATCCTCGATGCGCGGCATGAAGCTTGTTACCCCTTCTCTCTTGTCGT
TGTCTTCTTCCTCTCCTCGCATCCGCATGGCAGCAGCTGATGCTCCTGCTGCGCCAGCAGAGGAGGCACCTGCTG
GGTTCACCCCCCCGAGCTCAAAGCCGACACCCCATCCCCCATCTTCGGCGGTAGCACTGGGGGCCTCCTCCGCA
AGGCGCAGGTGGAGGAGTTCTACGTCATCACCTGGAATCCCCAAAGGAGCAGATCTTCGAGATGCCCACGGGGG
GCGCTGCCATCATGCGGCAGGGCCCGAACCTCCTGAAGCTGGCTCGCAAGGAGCAGTGTCTCGCACTGGGATCCA
GGCTGCGGTCCAAGTTCAAGATCCAGTATCAGTTCTACCGTGTGTTCCCGAATGGGGAGGTTCAATACCTGCACC

Figure 2 continued

CAAAGGATGGCGTGTACCCGGAGAAGGTGAATGCTGGCAGGAAGGGCGTCGGGGTGAACTTACGGTCGATCGGCA
AGAACAAGAATCCGGTGGAGGTCAAGTTCACTGGGAATTCTGCCTTCAATCTCTGag

> SEQ ID NO:527 116525 142417_300435_1
TGGAGGATCAGCCCGCCGCGGGGGCGACGGAGGAAAAAAACCCACCCCCCGCGGGGTTCGTGCCGCCGCAATTGG
ACCCCAACACGCCGTCCCCGATTTTTGGTGGAAGCACGGGGGGACTTTTCCGGAAGGCGCAGGTGGAGGAGTTTT

> SEQ ID NO:528 116525 16253_300230_1
CCCACGCGTCCGATCCATTTACTCCACAGAGAAAGATTCAGAGAAAACAGAAGAAACTATGGCAACTCAAGCCGC
CGGAATCTTCAGCCCCGCCATAACAACCACTACTTCCGCCGTCAAGAAACTCCACCTCTTCTCATCAAGCCACCG
TCCCAAGTCTCTCTCCTTCACCAAAACCGCCATCCGCGCCGAGAAAACAGAGTCCTCCTCTGCTGCCCCAGCCGT
GAAAGAAGCTCCAGTTGGATTCACTCCCCCGCAGCTAGACCCAAACACACCATCACCAATCTTCGCCGGAAGCAC
AGGAGGTCTCCTCCGTAAAGCACAAGTAGAGGAATTTTACGTGATCACATGGAACTCACCGAAAGAACAAATCTT
TGAGATGCCAACAGGAGGAGCTGCGATAATGAGAGAAggACCGaATCTAttgaaaCtggcga > SEQ ID NO:529 116525 191511_300702_1
CCCCGATCTCTCTCCTCCACACCACACCACTCGAATCGAATCCACCACACGGTACCCTCCTCTCTCCTCCTCCGA
CCACCATGGCCATGGCCACGCAAGCCTCCGCCGCCAAGTGCCACCTCCTCGCCGCCTGGGCACCGGCGAAGCCGC
GCTCATCCACCCTCTCCATGCCCACCTCGAGGGCACCCACCTCCCTCAGAGCGGCGGCGGAGGATCAGCCCGCCG
CGGCGGCGACGGAGGAGAAGAAGCCAGCCCCCGCGGGGTTCGTGCCGCCGCAGCTGGACCCCAACACGCCGTCCC
CGATCTTCGGCGGGAGCACGGGGGGACTCCTCCGGAAGGCGCAGGTGGAGGAGTTCTACGTCATCACATGGACGT
CGCCCAAGGAGCAGGTGTTCGAGATGCCCACGGGCGGCGCCGCCATCATGCGCGAGGGCCCCAACCTGCTGAAGC
TGGCCAGGAAGGAGCAGTGCCTGGCCCTGGGCACCAGGCTCCGCTCCAAGTACAAGATCAACTACCAGTTCTACC
GCGTCTTCCCCAATGGCGAGGTGCAGTACCTCCACCCCAAGGACGGCGTCTACCCGGAGAAGGTCAACGCCGGCA
GGCAGGGCGTCGGCCAGAACTTCCGCAGCATCGGCAAGAACGTCAGCCCCATCGAGGTCAAGTTCACCGGCAAGA
ACGTCTTCGACATCTAGACTTCTTCTTCTTCTTCTTCTCTCATAATCGACCTATTAATTACTTGTGTTTTGG
GTGGATGGACATGTAATTTTAATCATCTGTCAGGCTGCTCTTCAGTTATTGATGATGGTGTAATCGATCGATGGT
GGGATATAATCTCTTCTTATAATATTGTAGTATATGTTTGGtgaaTTTTGATGCgtgttC > SEQ ID NO:530 120380 114994_300010_1
CCCACGCGTCCGTCTATGTCTGTGGAGGTGATCCGGAAGGCATTTCAAGCAACGGAAGAGGGTTTCCTCTCTGTT
GTGACTAAACAGTGGCCGGTGAAACCACAGATTGCTGCTGTTGGATCATGCTGCCTTGTCGGAATTATCTGCAGC
GGCACATTATATATTGCCAACCTTGGCGACTCTCGAGCAGTCTTGGGAAGACTTATCAAGGCAACTGGAGAGATT
CTTTCTGTTCAGCTGTCCGCAGAACACAATGCGAGTATTGAATCCGTAAGGCAGGAGATGCAGTCTTTGCATCCA
GATGACTCGCAAATTGTAATTTTAAAGCACAACGTCTGGCGTGTGAAGGGTATTATACAGATTTCAAGATCCATT
GGTGATGTGTACTTAAAGAAAGCTGAATTCAACAGGGAACCTTTGTATGCTAAGTTTCGTCTCCGTGAACCGATT
AGAAGGCCCATATTAAGCGCAGATCCTGCTATTTTGGTGCACTCTTTGCAACCTCAAGATCAGTTTATTATATTT
GCCTCAGATGGTCTATGGGAACACCTAAGTAACCAAGAAGCTGTTGACATCGTACAGAATCACCCACGCAATGGG
ATTGCTAAAAGGTTAGTGAAAACTG > SEQ ID NO:531 120380 280404_200067_1
GAAACATACGGTATATCAATGATCACCTCTTTCAGCATCTCAAGAGGTTTGCAGCTGAACAAAATTGTATGTCTG
CGGATGTAATACAAAAAGCATTTCAAGCAACAGAAGAGGGATTCTTTTCTCTGGTTACAAAGCAATGGCCAACGA
AGCCACAGATAGCTGCTGTTGGATCTTGCTGTCTTGTTGCGGTGATCTGCAATGGCACCCTTTATGTTGCGAATG
TAGGTGATTCCCGAGCTGTTTTATGAAGGCTTGTGAACGCTACGGGGGAGGTTCTTGCGATCCAGCTTTCAGCTG
AGCATAACGCGAGTATTGAATCTGTTAGACAGGAGTTGCATTCAATGCATCCAGATGATTCACAGATAGTGGTTT
TGAAGCATAATGTATGGCGTGTCAAGGGTCTTATTCAGATTTCTAGGTCTATTGGTGATGTATACCTTAAAAAGG
CTGAATACAACAGGGAGCCTTTGTATGCTAAGTTTCGCTTGAAGGAACCTTTTAAAAGGCCCATACTGAGCGCTG
ATCCATCAATTACGGTTCAAGAACTCGAACCGCATGATCAATTTCTAATATTAGCTTCTGATGGTCTTTGGGAAC
ATCTT > SEQ ID NO:532 120380 270994_200129_1
GTTTTCACTTCTCCTTCTGCTACTTATGTTGGTGTTTATGATGGCCATGGTGGCCCTGAAGCCTCCCGTTTTGTC
AATAGACACCTCTTCTCTTATTTGCATAAATTTTCGAAAGAGCAAGGGGGTTTGTCATCAGATGTGATAAAGAGA
GCATTTAATGCTACAGAAGAGGATTTTATTCAATTGGTGAAGATCATTGCCTGTAATGCCACAGATTGCTTCT
GTTGGATCATGTTGTTTGGTTGGTGCAATTTCTGAGGGCGAATTATACGTGGCTAATTTAGGGGATTCGAGGGCT
GTTCTTGGACGCAGAGGTTTTGAAGGGGAGACAAATTCTGTGGTTGCAGAAAGGTTGTCGACTGATCATAATGTT
TCATGTGAGAAAGTGAGAAAAGAAGTTGAATCACTTCATCCTGATGATCAAGCTGTTGTGGTTTACATTCGAGGT
GTTTGGAGAATTAAAGGCATAATTCAGGTCTCAAGATCTATTGGAGATGCATATTTGAAGAAACCTGAATTTAAC

Figure 2 continued

```
AGGGATCCTATATTCCAACGATATGGAAATCTTGTACCTCTGAAGCGGCCTGTACTAACAGCTGAGCCTTCTATT
GTTACACGAAGTATTAGGCCTCATGACTTATTCCTGATATTTGCTTCTGATGGCCTCTGGGAACACTTAACTGAT
CAAGTAGCTGTGGAAATAGTC
```

> SEQ ID NO:533   120380    125422_300631_1
```
GCGTGCTGGTCCAGAAGCTGCCCGCTTCATAAATGACCGCCTTTTCGAGAACCTCAGGAAATTCACCTCAGAGGA
TCAAGGAATGTCAGCTGATGTCATAAGCAAGGCATATTTGGCTACAGAAGAGGAGTTTCTTTCTCTAGTGAGAAA
GCAATGGCTAATTAAACCCCACATTGCTTCAGTGGGATCATGTTGTTTAGTGGGTATAATATGCAATGGGATGTT
ATTCATTGCAAATGCTGGAGACTCTCGTGCGGTATTAGGAAGAGAAGAGGGGGATCTGAAAGAGGTCAAAGCTAT
TCAATTGTCTTCTGAACACAATGCGAATTTGGAATCTGTCCGGGAGGAACTACGCTCTCTTCATCCTGATGATCC
ACAAGTAGTAGTATTAAAGCACAAAGTTTGGCGTGTTAAGGGTATTATACAGGTTTCAAGATCAATTGGTGATGC
ATATTTGAAGAGAGCAGAGTTTAATAGAGAGCCTTTGCTTCCTAAGTTCAGAACTCCCGGAACATTCGAGAAGCC
AATCCTTCTTGCGGAGCCATCAGTACTTGCGCACAGACTCCTTCCTTCTGATCAGTTTATCATATTT
```

> SEQ ID NO:534   120380    120528_300411_1
```
CGGACGCGTGGGCGGACGCGTGGCCGGACGCGTGGGCTGAGATGATGTATGTCATCTGGATTAATGAACTTGTTG
AGGGCCTGCTTTCAGCCAAGGGCATATGGACATGTTCATACAGGTTCACATGCCTGCGGTCGTCAAGATGGGCTC
CTATGGTATAAGGATATTGGACAACATTTTAATGGAGAGTTCTCAATGGCTGAAGCTCAAGCTAATAATCTACTG
GAAGACCAAAGCCAACTTGAATCTGGCTGCTTGAGCTTAAATGATTCTGGTCCTTATGGTACCTTTGTCTGAGTT
TATGATGGCCATGGCGGTCCTGAGACTTCAAGATTCATCAATAATCACCTCTTTCAACATCTCAAGAGGTTCAGT
TCTGATCAGCAATCAATGTCTGTGGACGTGATTCGAAAGGCATTTCAAGCAACAGAAGAGGGTTTCCTCTCTGTT
GTATCAAGACAATGGCCGATGAAACCACAGATTGCTGCTGTTGGATCATGCTGTCTTGTTGGAGGTATGTGCAAT
GGGACATTATATATTGCCAACCTTGGTGACTCTCGGGCAGGCTTGGGTAGGCTT
```

> SEQ ID NO:535   120380    184206_300666_1
```
GAATTCAGGACAGTGGCCAACACATGAATGGAGATTTCTCAATGGCCGTTGTTCAGGCCAATAATTTGCTTGAAG
ATCAAAGTCAGCTTGAGTCAGGTCCCTTGAGCTTGCTCGAGTCTGGTCCTTATGGAACTTTTGTTGGAGTATACG
ATGGCCATGGTGGACCTGAAACTGCACGCTTCGTCAACAATCACCTTTTCCAACATCTCAAAAGATTCGCCACCG
AACAAAAATCCATGTCTGTAGATGTGATTCGAAAAGCATATCAGGCAACAGAAGAGGGTTTTCTCTCCGTGGTTA
CTAAACAATGGCCAATAAAACCTCAAATTGCAGCTGTTGGTTCTTGCTGCCTTTCTGGTGTTATTTGTGGTGGGA
CTCTATACATTGCAAACCTGGGTGATTCCCGGGCAGTTTTAAGGAGAGTAATCAAGGCTACTGGGGGGGTTCTTG
CTATCCAGTTATCAGCTGAGCACAACGCTAGCATAGATTCTGTGAGACAGGAGCTGCGTGCAACACATCTTGATG
ATCCACACATAATAGTTTTAAAGCATAATGTGTGGCGTGTAAA
```

> SEQ ID NO:536   120380    228356_301020_1
```
CACGCCACCACCACCACGCGCGACGGACACGCTCCCCCTCACTTTCACTCCACACACACACACTTCACGGTTCGC
GCGACGAACAAACGGGCAGAAAAACCCTGCCACGACGACCCACGACTGAGCCGAGCGTACGCACGCACCCACGCA
CGCCATGGGGGCGCTGCGGCGGTGGCTGCCGTGCTGCTGCTGCTGCTGTCGCGGCGGCGGAGGAGGTGGTGGTGG
TGGGAGCGTGGGGGATGGCTGGTGTGGGACGTGGCCCTGAAGGCGCACGCGTCGGGGGACTACTCCGTGGCCGT
GGCGCAGGCGAACGAGGCGCTGGAGGACCAGGCGCAGGTGTTCGTCTCCCCGGCGGCGACGCTCGTCGGCGTGTA
CGACGGCCACGGCGGCCCCGAGGCGGCGCGGTTCGTCAACAAGCGCCTCTTCTCCCTCATCCAAGAGTTCGCGGC
GCAGAGCGGCGGCATCTCGGCGGAGGTGCTCGAGAAGGCGTTCGGCGAGACGGAGGAGGAGTTCGTGGCGTCGGT
GCAGAGGTCGTGGCCGTCGCAGCCGAGGATCCTGTCCGTCGGCTCGTGCTGCCTCGTCGGCGCCATCGAGGACGG
CACGCTCTACG
```

> SEQ ID NO:537   120445    207447_300805_1
```
CTCTGTGTTTCACTTGCTGCCTTTCAGTTGCAAAGCATAGCTGTTCTCACACCTGCCTTGTAGCTAGAGTGGTTA
GCAGAGAAGGGAAGCAGTGGAGTTCAGGTTCAGCCATGGAGGTTGAGGCTTCCTACAGCTATGGCTTCCTTCCTT
CAGGCAGGCACCAGCCTTATGCACCACCTCCTCCCCACCCTGCAGAGGAAGGCGAATTGTGGGAGTACTTTCCAT
GCCCTTTCTGTTACATCGAGGTTGAGGTGCCCTTCATCTGCAACCATCTTCAGGAAGAGCATTGCTTTGACACCA
GAAATGCTGTGTGCCCGTTGTGCGCCGACAATATAGGGAGAGACATGGGTGCCCATTTCAGAGTTCAACACTCAC
ATCTTCTCAAGAGAAGGAAACCTTCTAGGCCCAGCAGCTCATGGCCTACACCCTCCAACAATTCAGACCCCTACT
TTGAGGGGCCTCCACAGTATATGATGAACAACAGGACATACCAAGATCCTGCACCTGATCCACTGCTCTCCCAAT
TTATCTGCAGCATGGCTCAAACTGACACTAACTCGGATAACACAAACACTGAAATTGCAGTTTCAGCAGTCTCAC
ATGATCAGAGG
```

> SEQ ID NO:538   120677    155762_301359_1
```
agaaGACCCAAATCCAGTTAGAGCGAAACCCTAAATCACAACTCTCAAAGATGCTACGAATAGCAGGTAGAAAGC
TCTCTTCCTCCGCTGCTGCTCGATCTTCATCCGCTTTCTTCACCAGAAATCCTTTCACCTTCACCGATGATTCAT
```

Figure 2 continued

CATCTACGGCCAGATCCCCTTCTCCTACTTCCATTGCTTCTCAATTTGTCGATCAAATCAGAGGTTTCTCATCTA
ATTCAGTTTCCCCTGCACATCAGACGGGTTTAGTCTCAGATCTCCCAGCAACAGTGGCTGCTATTAAGAATCCCA
GTTCGAAGATTGTATATGATGATAGCAACCATGAGCGTTATCCACCCGGTGACCCGAGCAAACGTGCATTTGCTT
ACTTTGTATTGACAGGAGGCAGGTTTGTCTATGCCTCATTGGTTCGCCTCCTGATTCTTAAGTTTGTTCTGAGCA
TGTCTGCCAGTAAAGATGTCCTTGCACTTGCGTCTCTTGAGGTGGATCTTTCCAGCATTGAACCTGGGACGACCG
TTACTGTCAAGTGGCGTGGGAAGCCTGTTTTCATCAGACGCCGTACTGATGAGGACATCAATTTGGCGAACAGTG
TCGATCTTGGCTCCCTTCGCGATCCACAACAAGATGCTGAGAGGGTCAAAAATCCagAATGGCTTGTTGTTATCG
GGGTATGTACTCatcTAGGGTGCATACCTTtacCAAATGCTGgTGATTTTGGTGGTTgggttTgccCATGCCATG
GCtccCACtatGACAtctctGGTGGGATtcgtaaagGaCctgcACCAtataatctggaggtGCCTACCTACAg > SEQ ID NO:539  120677   233243_301088_1
AGGGCATTGGGTTTCTTGAGGGCTGCTCGGGCGCCATGGCTGCGTCACTGATCCGGGATCTAGGGAAGAAGATAG
CTCCGCGCATCGCGGCGGCAGCGTCGGCGTCTTCTTTCCACACTTGCTCGTCCGGCGCCTCCAGGGGCGCGGCGT
TGGGCGCTAGCAACGTAATGGCGCATTGGGACTGGGACAGGGAAGACGGCAAGACCACCCCATGGAGCCACTCCA
CTACACGAGGATGCGCCGTCACCACCCGGGGCGCCGATCTAAGCACACGAAACGAAGACTCGGCTTTCCTCCAGG
CTCTCCGCAACCCCACGGCCAACATCACCTACGACGAGGAGGTGGTGGAGCGGTTCCCGCCGGGAGACCCGGACC
GAGCAGCATTCGTCTACTTCATCGTCACGGGCTCCCGCTTCGCATACGCCGCCGCCATCCGCGTCTTCATCCTCC
GCATGATCATGACCATGTCCGCCAGCGCCGACGTCATGGCCCTCTCCAGCCTCGAGGTTGACCTCAGCAACGTCG
TCGAGGGGCGACCATCACCGTCAAGTGGCGAGGCAAGCCGGTGTTCATCCGCcgccggACCtcagaCGAGGtgg
cggAGGCAAAcagcgtttcggTGAATTCCCtgcgC > SEQ ID NO:540  120979   107980_300260_1
acttcataaaatcaatttttgttaattaaAAAAATGGCTTCTAACAAGGTTTTCTCTACTCTTGCTATTTTCCTT
ACTTTTAACCTAATTTTTTTCACATTTGTTTCTGGTTGTGGAACTTGTCCTAAACCAAAACCGCCACCAAAACCT
AAGCCTTCTTGTCCTCCTCCTCCATATGTTCCAAAAAAGGAAACTTGCCCAATTGATACATTAAAATTAGGTGTT
TGTGCTAATGTTCTTGGATTAGTTAATGTTGTTGTTGGTTCACCACCAGTGAAACCTTGTTGTAGTCTTATTTCA
GGACTTGCCGATGTTGAAGCTGCTCTTTGTCTTTGTACTGCTATTAAGGCTAATGTTTTAGGCATTAATCTTAAT
GTACCTGTCTCATTGAGTTTGCTTCTTAATGTTTGCTCCAAGAATGTCCCTTCTGGCTTCCAATGTCCTACTTAA
TTGAATTAAACGACAGTTCAGTGCACAAAGTATCTCGCGCTGACTCAGAAGTCAGATAAGAGTTAAAAATTCAAA
GTTTATCTCATTGTTTGTATTTTCTTTGAGGGTTTTCTATTTTTCATGTCAATTTTTCTTTTTGGAGTTTGGGGT
GgggGTgG > SEQ ID NO:541  120979   190811_300736_1
tagtacaattaagaagtagctaagttttccaatacgatgggcggcggcaagaataaggtgcaggtttgtgcggtg
ttcgtCGTTGCTCTGAATATGGTCATCTCCATGCAGATGGGTGCAGTGCAGGCATGCGAGCCCTACTGCCCCACC
CCGACGCCGCCGGTGACGCCGCCTCCGTCGCCGCCGTCGGGTGGAGGGAATAAGTGCCCGATCGACGCGCTGAAG
CTGGGCGTGTGCGCCAACGTGCTCAACCTGCTCAAGCTCAAGGTGGGGGTGCCGGCGAGCGAGGAGTGCTGCCCG
CTGCTGGGGGGGCTCGTCGACCTCGACGCCGCCGTCTGCCTCTGCACCGCCATCAAGGCCAACGTCCTCGGCATC
AACATCAACGTCCCCGTCGACCTCGTCCTCCTCCTCAACTACTGCCACAAGACCTGCCCTTCCGACTTCTCCTGC
CCACTCATCTGATTCTTAATCTTCATTACCACCACAACCCTAGCTACCTAATTAAGGCTTAAGCTTTGCATGGCT
TAGTCTGTGTGTTGCAGTTGTGTCATACATATATACTTATCTCGATCTATCAGTGTGATTATTGATGATCAGATC
GATCATCTAATATATGTATCTTGTTATTTTAATGCGTACTGTCAAATAAAAGTTTCCTCCAGTGTACGTACGTTC
TATCT > SEQ ID NO:542  120979   175459_300542_1
CCCCCCCGACCTCTCTCTAGTTGCAGACCATCACTTACGTAGCCCTGTGTGCAACGGCGCAAGTGCTTGTACGCT
TTCAGCTAGCGTAGCCATGGCTTCCAGGGCATTCCTCCTCGTGGCTCTAAACCTGGTCCTCTTCTTCACCGTGGC
CAGCGCCTGCGGCAAGTACTGCCCGACGCCTTCGACGCCGTCGACGACGCCATCGACGCCGTCCTACAACACCAA
GTGCCCCAAGAACGCGCTCAAGTTCGCGGCGTGCGCCGACGTGCTGGGCCTCGTCAGCGCCGAGGTCGGCCAGCC
GCCGTACGAGCCGTGCTGCGGCGTCCTCGGCGGCCTCGCCGACCTTGAGGCCGCCGTCTGTCTCTGCACCGCCAT
CAAGGCCAACGTGCTCGGCATCACCCTCGACATCCCCGTCAAGCTCAGCCTCCTCGTCAACTACTGCGGCAAGAA
CGTCCCTAGTGGCTTCATCTGTGCTTAAGCTACGTAACGCGCGTACGGTGTAACGACGTGCTAGCTTTGCATGCA
TGCAGCACGCATGCACGAACACATCGTTCGTTCTTGAGTGCCTGCATGCATATCGGTCGAGTCTTTACTTACTCT
GTTATTAGTTCTGAATGTAGAACTGCTTCagATATCAatccagcgagTTaaCTGTACTTGATTTG > SEQ ID NO:543  120979   159618_200050_1
AAAAATCTACTTATAACAACTAAAGTTAGTAGCTATATCATTCATTAAGAAATGGCTTCTAAAAAAACTACTTCT
CTTGCTCTCTTTATTCTTGTCAACCTTCTATTTTTCTCCCTTGTGAGTGCATGTGGCACTTGCCCTAGTCCTAAA
CCAAAGCCAAAGCCGAAACCAAAACCAGGTCCTAGCCCATCCAAAGGCAAGTGCCCAATTGATACTCTAAAATTA

Figure 2 continued

GGTGTTTGTGCTAATGTTTTAGGCAATTTGCTTGGACTTTTGATTGGTAATCCTCCAAAAAAACCTTGTTGCACT
CTCATTCAAGGTGTTGCGGACCTTGAGGCTGCTGTTTGCCTATGCACTGCTATTAAAGCCAACATTCTTGGGATT
AACCTTAATGTCCCTCTTTCTCTAAGCCTTCTTCTTAATGTTTGTGGAAAAAAGGTTCCATCTGGCTTCCAGTGT
CCTTGAACAGTACAACGTCCACATATTTGATTTGGGTTTTGGATT

> SEQ ID NO:544 120979 144879_200137_1
tcagtATTAATACAAAACATAAATCCTCTGCTTCGTTATGGATTCAAAGAGATACTTAGTTACTCTCTTTTTATT
CTTTAACATTCTTTTCTTTACCCTTGTAAGTGGCTGCTGGAGTGGCTGCAATAATCCACCAACTCCAAAACCAAA
TTCGAACCCGAACCCAAATCCTAACCCTAGCCCATCAAAGGGACACTGCCCTAGAGATGCCCTAAAACTAGGTGT
TTGTGCCAAGGTGCTGAACGGACCTGTCGGAGCCGTCATCGGAACTCCACCGGACATGCCTTGTTGTTCCGTACT
AGGTGGACTTTTGGATCTTGAAGCTGCAGTTTGCCTTTGCACTGCACTGAAAGCCAACATTCTTGGAATAAACAT
TGATATTCCCATTGCATTAAGCTTGCTTATTAATACTTGTGGGAAAAGTCTACCATCTGACTTCACTTGTGCCTA
AGCTATAATGCTTCTCTTTTAAAGTTCATGTTGTATTTTAGTTCTTCGTTGTTAGGACTTAGGAATGAGCACTTG
ATAATTTGTACGAAGCTAGGGAATGTTCTTCCATCTCCTTTGTAATTCACTAGTGCTTTCTCTATTGACTTGATG
AATTTCTAaTTC > SEQ ID NO:545 120979 138560_300774_1
cccacgcgtccgcccacgCGTCCGCCCACGCGTCCGCAAAAAGCAGCTCCAGCTTCTTCTGATCGATCGATCGAG
CTGAGCTATAGGCAGTAGCTGCTAATTAAGCTAATTAATTGCTAAGCAGTAGTAGAGCTAGCTAATTAATTAAGA
TGGCCGGCAAGAAGGTGCAGGTTTGTGCGCTGTTCCTTGCCCTCAATGTGCTCTTCACCATGCAGATGGGTGCAG
TAGTGCAGGCATGCGAGCCCTACTGCCCCACACCGACGCCGCCGGTGACGCCGCCTCCGTCGCCGCCGTCGGGTG
GAGGGAATAAGTGCCCGATCGACGCGCTGAAGCTGAGCGTGTGCGCCAACGTGCTCAACCTGCTGAAGCTGAAGA
TCGGCGTGCCGGAGAGCGAGCAGTGCTGCCCGTTGCTGGGTGGCCTCGTCGACCTCGACGCCGCCGTCTGCCTCT
GCACCGCCATCAAGGCCAACATCCTCGGCATCAATCTCAACATCCCCGTCGATCTCTCTCTCCTTCTCAACTACT
GCCACAAGACCTGCCCCTCCGACTTCACCTGCCCTCTCTAAATTAATCGATCCTCCGATCCCTTAATTACCATAC
CATTACACCATGCATCAATATCCATATATATATAAACCCTTTCGCACGTACTTATACTATGTTTGTCATACATA
TATATGTGTCGAACGATCGATCTATCACTGATATGATATGATTGATCCATCAGCCTGATCTCTGTATCTTGTTAT
TTGTATACCGTCAAATAAAAGTTTCTTCCACTTGTGTT > SEQ ID NO:546 120979 127691_300471_1
CAACATTTCACTAATTAGCCACATTCAATTGTTGAGAGTGCTAACTATTTAACTCTTAGAAATGGCTAAGTTTGC
AATATCCTCCATTGCCCTTCTTCTCACTTTGAACATTGTCTTCTTAACTATGGTTAGTTCCACTAATGTCCCATG
CCCACCCACCCCATCAAAGGGTCATTCCAAGCCCCACCCTAAGCCTACCCCTACCCCCTCTATCCCATCCACCCC
ATCAACTCCATCATCAAAAGGTAAGTGCCCAAAGGACACACTTAAGCTAAAAGTGTGTGCCAACTTATTGAATGA
CTTGGTGCACCTTGTTATTGGAAGTGATCCAGCCAAGACTCCTTGTTGTTCTCTAATTCATGGACTTGCTGATCT
TGATGCTGCTGTTTGCCTTTGCACTGCAATTAAAGCCAATTTATTGGGAATTAACCTCAACGTACCTCTTTCCCT
CAGTTTGTTGCTCAACAACTGTGGAAAGTATGTTCCTAAGGATTTCCAATGCGCATAAACTAGCTAGCCAATAAC
TTTCTCCCTGCAGAAAATTTCCACTTCATATATTTATTTTTCAGTGTGTTTAATTTGGTATTTTGTATGCTTATA
GTTTGCTTATGTTTTCAAAGGaAGATATATTgtATTCTAATt > SEQ ID NO:547 120979 133464_300449_1
CCCACGCGTCCGCCCACGCGTCCGAATTACTTCTCTTTACAATTGTTCTAGGAAGTACATTCTGCCTTAACTTCC
TTATAATATGGCTTCCAAAACAAGAGCCTCAATTGCCCTTTTCCTCTCCTTCAATCTCCTTTTCTTTGCCATAGC
CAGTGGAACAGATTGTATCTCATGTCATTATAATTCTCCTAGCACCGGTAATGGTGGTGGCAATAGTGGTAATAC
TGGTGGCTCGGGCAATGGCGGCGGAGGTGGCAATGGACAAGGCACGTGCCCGAGAGATGCTCTGAAGTTGGGTGT
ATGCACAAATTTAGTTGGTGGATTGGTGGGCGCGGTAGTTGGGAGTCCTCCAACGATGCCATGCTGCAGCTTGAT
CGCGGGGCTGGCGGATTTAGAGGCGGCAGTCTGCTTGTGCACAGCCATAAGGGCGAACATGTTGGGAATAAATCT
GAATGTGCCACTCTCTCTTAGCCTTGTCCTCAACAACTGCGGAAGGAATCCTCCTAATGGCTTCACCTGCTAATC
CAACGTCCCCAAATGCGTATTTCAGCCTTTTGCTATGTCAGTCATGTACTCATGTTGTGTTTGCATCAATTTTCC
TTTATGATCATTTGTTTGCTATGTTGTGCCAATTGTTATTACAATAAGCGATCGAGCTTGCAAAA > SEQ ID NO:548 120979 124502_301024_1
TCACAGTAGTGAGTGCATGCAGTACTTGCCCAGGCCCTAAACCTAAACCTAAACCAAAGCCAAAGCCAAAGCCAT
GCCCCCTCCTCCTTCTTCTCATGGTGGCAAATGCCCAACTGATGCCTTAAAACTAGGCGTTTGCGCTAATGTGC
TTAACGGTTTGCTGAATGTTACCCTGGGAACTCCTCCAGTAAAACCATGCTGCAGTCTTATTGGAAATCTTGTGG
ATTTGGAGGCTGCTGTCTGCCTTTGCACTGCCCTTAAGGCTAACATTTTGGGCATCAACCTTAATCTCCCTATTT
CTCTTAACTTACTGCTCAATGTTTGTAGTAAGAAGGCTCCAAAGGGATTCACTTGTCCCTAAATGGTTCTCTCGC
TTTTCGTTTTTCTTCTGAAGTTGGTTTTTGATTTTCATTTGTTTAGCAGTTTGTGATGTTCGATTTATCTCCTGC

Figure 2 continued

ATTAAACTTCTTGTTAGGTGCAAGGTTGTGGTTTGTTTTGGATTGATCATTGTTGGAAAGCGCTTTTGTAAGGCC
AATTGTTTGTGTACCCTTTGGAAATAAATATATTTCTTGGATGATTCTCTCT

> SEQ ID NO:549 120979 50014_300166_1
CAAAACGTTACAATGGCTTCTAAGGCTCTTGCAGTTACAGCTCTTCTTATTACACTTAATCTTCTTTTCTTCACC
TTTGTAACCTCCACAAAATGTCCACCAACTACTCCTAAACCCCCAAAAACCCCGAAATCGCCTAAGAAGGCTCCT
GCCGTGAAACCCACTTGTCCTACCGACACACTTAAGCTTGGTGTTTGCGCAGACTTATTGGGCCTAGTTAACGTT
GTTGTTGGTTCTCCACCAAAGACTCCTTGTTGTACACTTCTTCAAGGTCTTGCTAATCTTGAAGCTGCGGTTTGT
CTCTGCACCGCTCTTAAAGCCAATGTCTTGGGGATTAATCTCAATGTTCCTATTGATCTAACCTTGCTgttGAAC
TATTGTGGCAAGAAAGTTCCTCATGGTTTCCAATGTTCTTGAAGATTTGAGACTTTAAAAGAGAAAAATCTCTTT
GGTTTgCTATGTTTTTATATgtttgttTCTACTgttATCTATtggtTTgtgagaAAAAGCTtgttcTgtcACt
gttGaGtTTGATGTAATgcttgAGCttgttcATGATagaacctttgttctCTCAATATTGAGTttGATgtaat > SEQ ID NO:550 120979 4777_300317_1
AAAAATGGCTTCAAGTTCCATAGCTCTTTTCTTGGCTCTCAATCTTCTCTTTTTCACAACAATCTCCGCCTGTGG
TAGCTGTACTCCGTGCGGCGGAGGTTGCCCCTCTCCCAAGCCAAAGCCAACTCCTAAACCAACCCCAAGCCCTAG
CTCTGGCTCGAGCAAGTGCCCTAAAGACACCCTCAAGCTCGGTGTCTGCGCTAATGTGCTCAACGGCCTCCTGGA
CTTGACCCTTGGCAAGCCACCGGTCGAGCCATGCTGCAGCCTCATCCAAGGACTCGCTGATGTTGAGGCAGCCGT
TTGTCTCTGCACCGCTCTTAAGGCTAACATTCTTGGAATCAACTTGAACCTCCCAATATCTTTAAGTCTACTCCT
TAATGTTTGCAGCAAACAACTTCCTCCTGGCTTCCAATGCTAAAAACCATATTGATATATAATTTAAATACACTT
AT > SEQ ID NO:551 122157 122109_300016_1
CCCCATTGGGTAGCTCAGCTTTGCTCTCCTTTTATTTTTTATTTTTTTTTCTGTTTGTTCCAAGGTTTCTTGCAT
CACTTTGCGGCTTATCTTGTTGGTTTTCCTTCTATTTTAAGGTGTAAAGTTTGTCTCCTTGTCTTGGTTGTGCTT
GCTGTTCTTGTTTGTTTCAACCAACTTGTGCAGTTATACTTGATGCTTCTTTTTTTTTCTTTTTCTATGTGGTTT
ATGCAGGTTGTGAATTTCTTGGGGGGACACAAGAATCGTGGGATGGATGGCAATGCGAGATCGGCGGCGAATCAG
ACGAAGCAAATCGTCACGGACAACGAGCTGGTGGAGCTGCTATGGCACAACGGCGGCGTCGTGGCGCAGCCGCAG
GCGGCGCAGGCGAGGGTCGTCTCCTCCTCCGGCCGCGGCCAGAGCGCCAGCGTGCTCACCGGCGACGACACGGAG
ACCGCCGCGTGGTTCCCGGACACCCTCGACGACGCGCTGGAGAAGGACCTCTACACGCAGCTCTGGCGCAGCGTC
ACCGGCGACGCGTTCCC > SEQ ID NO:552 122157 260296_301713_1
GCGGGCATATGCATCGCGGGGAAGAGGAGGATTGATGGCCAACGACCACGGGCCAGGGGCAATTCGAGCATTTCT
TCGAGCTAGCCGAGGCTGGTTCTTCCCCGACGATCCAAACCGCGACGAGGACGATGAAGAGTCCGAGGAGGAGGG
GAGCCAAGCGAAAAAAGGATCAGGACAGGCTCCTCTACAGAACGTTCTTTCCCAGGAGATAAACATGGCCACTTC
CGCAAGCGACGAGACGCTGAAGCGAGCCACAGCCAAGAACGGGAGAACAGTCCACACTGTCTCGATGCTGGCGGC
TAGAGAGATCAACTCTTCGAAGAATGGGAAGTTCTCTTCTGCCGAAGCTTGCCATCTTTCGTCGAGATTTCTGCC
ATCCAAGGGAGCCGATGTACTGGCTCGAAGGAATTCCCGGCTCTACATCAGCCAGTTTTCCAACAATGGATCTCT
CTTCGTTGCTGGCTTTCAGGACCGGACTATCATGGTCTACGATGTTGATAACAACTGGACGCTTCACAAGAGAGT
GAAAGCCCGTAACATGAACTGGACTATCACCGATACGGCTTTATCTCCGGACCAACGATTTCTGGTCTATGCTTC
GATAACTCCAGTGTTGTTTCTAGTCAACCTTGGGaaCaatACTgGTggaaCAGAttCt > SEQ ID NO:553 127573 119219_300024_1
AACGCTTCAGGACGATTACCAGTAGTTACTACCGTGGGGCACATGGCATCATTGTAGGTTTCTCTTCTCTCCTTT
TTAGAACTATTAACAGGTGGATTTGGTCTTTCTGGCTCTGTAAAATAGTTCCTCCAACCACTATTTTGGTGATTC
TGGCAGATAGTTTATGATGTAACTGACCAAGAAAGCTTTAACAATGTTAAGCAATGGTTGAGTGAGATTGATCGT
TATGCAAGTGACAATGTAAACAAGCTTCTGGTTGGAATAAGTGTGACCTGGCTGACAACCGTGCTGTGTCTTAT
GATACAGCAAAGGCTTTTGCTGATGAAATTGGTATTCCATTCATGGAGACTAGTGCAAAGAATGCCACTTATGTT
GAGCAGGCCTTCATGGCAATGGCAGCTGACATAAAGAATAGGATGGCAAGCCAGCCAGCATCGAATAATGCAAAG
CCTCCAACAGTCCAGATACGAGGTCGACCTGTTTCCCAGAAGAGTGGTTGCTGTTCTAGTTAGAATCACTTTTCA
GGCCTTCTCCTGGTTGTATTGTGCCAGATATATTCTTTTTAATCTGCCAGTATTCTGGTGGCCTGTACAAATCAT
AAGGGTTACTCCTTAAGATTTTTCTTTCCTCTTTGA > SEQ ID NO:554 127573 183392_300621_1
ACCAAACACGCGCACACGCAGCCGAGATCGAGAGCGAGCTACTTGCCCTAGCAGCAGCAGCAGCGAGGAGCGCGA
GGGGGCGGCGGCGGCGGCGTGCATGGCGGGGGCTCCGTCGAGGTCGCGCGGCGACTTCGACCACCTCATCAAGCT
CCTCCTCATCGGCGACAGCGGAGTAGGAAAGAGTTGCTTGCTTCTGAGGTTCTCAGATGACACTTTCACTACAAG
TTTTATCACCACCATTGGCATTGATTTCAAGGTTCGGACAGTTGAGCTTGATGGAAAGCGTGTAAAATTGCAGAT

Figure 2 continued

TTGGGATACTGCTGGTCAAGAACGTTTCCGGACAATTACAACTGCCTACTATAGAGGTGCTATGGGCATTCTGCT
TGTTTATGATGTTACAGACGAGTCATCCTTCAACAACATTAGAAATGGGATCCGCAACATAGAACAACATGCATC
TGATAATGTCAACAAGATTTTGGTGGGCAACAAGGTTGATATGGATACAAAGCGGGTGGTGTCCACAGCTCAAGG
ACAAAAGCTCGCACATGAGTATGGAATGAAATTTTTTGAGACGAGTGCAAAAACAAATCAGAACG

> SEQ ID NO:555 127573 184274_300666_1
GAATTCAACGAGCCCCAGCCAGCCTTCTCGATCTGAGACTTTTTAGACAGACAGATTGCGAATCCATTATTTCTG
GTGGTGATCTGAAACCAATCACTCGGATTACTAGATGGCAGCAGCTCCGGCACGTGCTAGGGCTGATTATGATTA
CCTGATTAAACTTCTTCTCATTGGTGACAGCGGAGTCGGGAAAAGTTGCCTGCTATTGCGTTTTCCTGATGATTC
TTTTACAACTAGTTTTATTACGACAATAGGGATTGACTTCAAGATTAGGACCATCGAACTTGATGGGAAGCGAAT
CAAACTTCAAATATGGGATACAGCTGGTCCAAAACGTTTCCGCACTATTACTACAGCATACTACAGGGGAACCAC
GGGTATTCTTCTGGTGTATGATGTCACAGATGAATCTTCATTCAACAATATCCCGAACTGGATAATAAACATTGA
ACAGCACGCATCTGACAATGTAAACAAAATACTGGTGGGGAACAAAGCTGATATGGATGAAA

> SEQ ID NO:556 127573 225819_301050_1
cgggagggaagatcatCGTGCATCGCGCGGAGGTCTGGATCGGCAGCGCTAATGGCGGCGGGGAGAGCGCGGGCG
GACTATGACTACCTCATCAAATTGCTGCTCATCGGCGACAGCGGTGTGGGGAAGAGCTGCCTTTTGCTGCGCTTC
TCGGACGATTCCTTCACGACGAGCTTCATCACGACGATAGGCATTGACTTCAAAATCAGGACCGTTGACCTGGAT
GGCAAGAGGATCAAGCTTCAAATTTGGGACACCGCTGGGCAAGAACGCTTCCGGACGATCACAACTGCATACTAC
CGAGGAGCTATGGGCATTCTTCTCGTCTACGATGTGACGGATGAATCATCGTTCAACAACATCCGGAACTGGATC
AGGAATATCGAGCAGCACGCGTCGGACAATGTGAACAAGATCCTGGTCGGCAACAAGGCCGACATGGACGAAAGC
AAGAGGGCCGTATCAACAGAAAGAGGGCAAGCTCTTGCGAACGAGTTTGGTATCAAGTTCTTCGAAACCAGCGCG
AAGACGAACATGAACGTGGAGAACGTCTTCTTCACAATCGCGGGAGACATCAAGCGGAGACTAGCGGAAACAGAC
TCCAGACCCGAGCCTCCCAGGATCAACAACGTAATACTAgaCCCGTCGaAggatcaGAACAAcaacaaAgacaag
tcATCATGTTGCACCTGAGagcaag > SEQ ID NO:557 127573 50564_300167_1
TTTCTTTTTCTCCTTTTGTCCGTACGCGTTTTCTTACCGGTGACCTGAAAGTCTCAAAAAATGGCGGCGTATAGA
GCTGACGATGATTACGATTTCCTCTACAAGGTGGTATTAATCGGTGATTCCGGCGTCGGTAAATCCAATCTGCTT
TCTCGATTCACGCGCAACGAGTTCAGCCTCGAGTCTAAATCCACCATCGGTGTCGAATTCGCCACCCGAAGCATT
CATGTCGATGAAAAAAATCGTCAAGGCTCAGATTTGGGACACCGCCGGCCAAGAGAGATACCGAGCAATCACAAGC
GCATACTATCGAGGAGCTGTTGGGGCTTTGCTTGTTTATGATGTTACACGGCATGTGACATTTGAGAACGTTGAG
AGAT > SEQ ID NO:558 127573 249877_301596_1
attgtgagagtagcacaggagttTAGTTTGGATTCGGGCTCGGGGCGAGAAGAATGTCGGATTTCGATGTGAAGA
TCGACTATGTGTTCAAGGTGGTATTGATTGGCGACTCCGCCGTCGGCAAATCTCAGCTGCTGTCGAGATTCGCGC
GCGACGAGTTCACCCTCGACTCCAAGTCCACAATTGGCGTCGAGTTCCAGACCCGCACCATCTCCGTCGACGGCA
AGACCATCAAGGCACAGATCTGGGACACCGCCGGCCAGGAGAGGTACAGGGCGGTGACGAGCGCTTACTACCGCG
GCGCGGTCGGCGCCATGCTGGTTTACGACATCACGAGAAAGCAGACGTTCGAGCACGTAGCGCGGTGGCTGGAGG
AGCTGCGGAACCACGCCGACAACAACGTGGTGATCATGATGGTCGGGAACAAGTCGGATCTGACCGACAAGCGGG
CCTTGTCTTTGGAGGAGGCGCGAGAGTTTAGCGAGAAGGAGGGGCTCTACTTCATGGAGACGTCGGCACTCGACT
CGACCAACGTCGAGACAGCCTTCATCACCGTGCTCACggaGaTctacaagatcgtcAGcaagaaGagcCt > SEQ ID NO:559 127573 252756_301604_1
GAGAGAGAGAAAGGGAGAAAGAGAGATGCACCGTCTTTCCTTCGACAAAGCACTCTAGATCTGTGTTTTAGGCAG
AGAGAGAGAAAGAGAGAGAGAGAGAAAAACCAGCGACCCTTTCGAAATCCGTTGATTCCTTAAGCGGGGCCCGG
GGGCAGGTTGCGGGGTAACTGATACTTGCTATCAGGGTTTCTTCGGAACGGCGGGGTGGAAGCATGTCCTACCGA
TCGGAAGATGAATATGATTACCTTTTCAAGGTGGTCTTGATTGGGGACTCCGGGGTCGGGAAGTCCAACCTCCTC
TCCCGATTTACAAGGAATGAGTTTAGCCTTGAGTCCAAGTCGACAATTGGCGTGGAGTTCGCCCACGCGGAGCATC
AGCGTGGATGGGAAGATGATCAAGGCACAGATTTGGGACACCGCCGGACAAGAAAGGTACAGGGCCATCACAAGT
GCCTACTACCGTGGAGCAGTGGGAGCTCTGTTGGTTTATGACCTCACCCGGCAGGTGACATTCAGTAATGTACCT
CGATGGCTGAAGGAGCTGAGGGACCACACAGACTCCTCGGTGGTGGTGATGCTGGTGGGGAAC > SEQ ID NO:560 127573 240662_301316_1
ctgcttagacttcagtgaggccagcatattctgtaggttccatccAGAGGAAGAAAATGGGGTGTGCTGCTTCCA
GGCCGGTGAAAGGCTTGCAAAATCTGAACGACAGTGCTCAGGAGCACGATGCCAAACACTTGAGGGTCAAGCTGG
TTCTTCTGGGAGACTCTGGAGTAGGAAAGAGCTGCATTCTCGTGCGGTTTGTGAAGGGCCAGTTTGATCCATCAT
CAAAGGTCACAGTTGGTGCTTCCTTTCTGTCGCAAACCATAGCTCTCCAAGACTCAAGTACAGTCAAGTTCGAGA

Figure 2 continued

TATGGGACACCGCAGGACAAGAGAGATATGCTTCGTTAGCACCGCTCTACTACAGAGGAGCGTCTGCAGCCGTTG
TAGTCTACGACCTGACGAGCAAGGAATCGTTCCAGAAGGCTCAGTACTGGGTCAAGGAGTTGCAGAAACACGCGA
ACTCTGGAATTGTCCTGGCGCTCGTTGGGAACAAAGCCGACCTTGAAGACTCGCGTGCGGTCTCGTCAGATGAAG
CTCGGTCATACGCAGAGAGCAACTCCATGTACTTCAGCGAGGTGTCGGCAAAAACTgccGACAACATCAACGCGC
TTTTCGAGGAAAtcgcaaAGAGACTTCCTCGGCCTGgaaagcAAT > SEQ ID NO:561   127573   218527_300967_1
TCAAGTTTGAGATTTGGGATACCGCTGGTCAAGAGCGATTTGCCTCTCTGGCGCCCATGTACTACAGAAACGCCC
AGGCCGCCCTTGTCGTCTACGACATCACCAAGCCCACATCCCTCGTCAAGGCCCGACACTGGGTCGCCGAGCTCC
AACGACAAGCCTCACCCGGTATCGTCATCGCCCTGGTAGGAAACAAGCTAGATTTGGCTGGCGAATCGAATGGTG
CAAGCGAGGAAGCCGAGGGCGGGGAAGACGGCGATGCCCGCAAAGTGTCAACAGAAGAAGCCCAGTCGTATGCCG
AAGAGGAGAGTCTGTTGTTTTTCGAGACGAGTGCAAAGACGGGCCACAACGTTACCGAAGTCTTCACAGCTATTG
CAAATGCGATCCCCGAGACGTCTCTCAAGAGTGCTAGGGGAGCCGGCGCAGCGGGCACGGCCAACCGGGCTGGAG
ACGAGCAGAGAGTGAACCTATCAGGACCAAGGGATGCCGGAGCAAAGGACGGATGTGCCTGTTAGATGGGAGATA
TTTGAATTGTTATACAAGGTACAAGCACCATGTTGTCGGTTGCTACCGCTGCTGCGCTACCCGTCAGATGAGGTC
GGATTTGTTATGGCATGTCATTCGGGAGTCAGAGTCTTGCG > SEQ ID NO:562   127573   187377_300676_1
GGAGGGCAAAACAATAAAGGCTCAGATCTGGGACACAGCAGGACAGGAGAGATATCGTGCCATCACAAGTGCTTA
CTACCGTGGCGCTGTTGGGGCTCTCCTTGTTTACGACATCACAAAGAGGCAGAGCTTCGACAATGTCCACAGGTG
GCTTCGTGAGCTCCGCGACCATGCCGACTCGAGCATTGTTATCATGATGGTCGGTAATAAGTCTGATTTGATTCA
TCTAAGGGCTGTCTCCGAGGATGAAGGTAAGGCATTGGCTGAAAAGGAGGGGCTGTTTTTTCTTGAGACATCAGC
TATGGAGGCCGTGAATGTGGAGGAAGCCTTTCAGACTATCATCACAGAGGTCTATGGCATTGTTAACAGGAAAGC
ACTGGCCGCCAAAGAAGCAGCTGCTGCTTCTGCTCCGCTGCCTTCCCAGGGTAAAACTATCAGCATTGACAGCGC
TGCAGGAAACACAAAGAGGGCATGCTGCTCTGCTTGATATGTACAATGGAGCGTTCAACATCATATTGTAGAGAG
CCAGGTGTGAGATTCGCGGGTAGACTCGGAGCATAGTGATCTTAAATGGTTTGGAGGCAAGTCCTACTTTTTTTT
TTTCAGTTGCGTGAACATTCCAGAGTGCCTAGCTGCAGTTGCAGTTTGTTCAGTGTTTCCTAATCAAAAGTTAGA
TGTGTGTA > SEQ ID NO:563   127573   126260_300461_1
GCCATTACGGCCGGGGGTTCTGACCATTTTCCCCTTTCAGCCCAATGTTGCCGACGACTTTCTGACCTTCTCAAA
AACCTCTGTGTTTCTCTCACATTTCTGGTGCCAATCTCTTGGGTTTTGCATTTGCTGATTCAGATATTTATTGGA
GAAGACGATGGCAGCTCCACCAGCGAGGGCTCGAGCAGATTATGATTATCTTATCAAGCTCCTCCTCATTGGTGA
TAGCGGTGTGGGAAAGAGTTGTTTGCTGCTGAGGTTCTCAGATGGTTCCTTTACAACAAGTTTCATCACCACTAT
TGGAATTGACTTTAAGATAAGAACAATTGAACTTGATGGCAAGCGGATTAAATTACAAATTTGGGATACAGCTGG
TCAGGAGCGTTTCCGCACTATCACGACAGCATATTATCGAGGAGCCATGGGTATTCTGCTGGTGTACGATGTCAC
GGACGAGTCATCTTTCAATAACATCAGGAACTGGATTCGCAACATAGAGCAGCATGCTTCTGACAATGTCAATAA
GATTTTGGTTGGGAACAAGGCTGATATGGACGAAAGCAAAAGGGCTGTGCCAACTTCCAAGGGTCAAGCTCTTGC
TGATGAATATGGCATTAAGTTCTTCGAAACAAGTGCAAAGACAAACATGAATGTGGAAGAAGTTTTCTTTTCAAT
TGCTAGGGATATCAAACAAAGGCTTTCAGAATCTGATTCCAAGACTGAGCCTCAGGCAATCAAGATCAACCAATC
GGATCAGGCAGGAACTTCTGGTCAAGCTGTACAAAAGTCATCTTGCTGTGGTTCGTGAATGGAGCCAATCGTGTG
GGAAGAACATTCGTTAGTTGCATTTGGATGTAAAAATTGATTGGGATGAAAAACTGATTCCTGTTAACTTCATTA
CCAAATATttatttgccatctgatggcaagcttgatgtgtcaaaggttttactgctttcgttttgaatctattgt
catacagttaact > SEQ ID NO:564   127573   183346_300621_1
CCCCTCTCCGCCTCGCGAATCTCCTCCCCTCCCCCACGCAACTCGCCGCCTGCGCTGCCGCTGCTCGTGAGGGGG
AGACGACGCCGGAGGAGATCGCCGCCGCCGCCGCCGCCTCGGACGGCCGCGCCCCCCGCCGCGCGTGTACC
ACGGGCTTGGGGGATTGATTGGTAGCGATGGCGGCGCCGCCGGCTAGGGCTCGGGCCGACTACGATTATCTCATC
AAGCTGCTCCTCATTGGCGACAGCGGTGTAGGAAAAAGTTGTCTCCTCCTACGGTTCTCAGATGGCTCTTTCACG
ACTAGTTTCATTACCACAATTGGTATTGACTTCAAGATAAGGACCGTTGAGTTGGATGGTAAACGGATTAAATTG
CAAATCTGGGATACTGGTGGCCAAGAACGCTTTCGAACTATTACCACTGCTTACTACAGGGGAGCAATGGGCATT
TTACTCGTTTATGATGTCACCGATGAATCTTCATTCAACAACATAAGAAATTGGATCAGAAACATCGAACAACAT
GCCTCTGATAATGTGAACAAAATTTTGGTGGGGAACAAAGCTGATATGGATGAAAG > SEQ ID NO:565   130744   112169_300040_1
ccaacttctcccgggcagctgttcaaatcggaaaaccgccgaAATGGCAAGAGGGTTGAAGAAACATTTGAAGAG
GCTCAATGCGCCGAAGCATTGGATGCTTGATAAGCTTGGTGGGGCCTTTGCTCCCAAGCCTTCTTCTGGTCCACA
TAAGTCAAGGGAGTGTTTGCCATTGATTATTATCCTCAGGAACAGACTGAAATATGCTTTGACATACCGTGAGGT

Figure 2 continued

```
CATCTCAATTTTGATGCAACGACAAGTTATGGTTGATGGGAAAGTTAGGACTGATAAGACTTACCCTGCTGGTTT
CATGGATGTTGTTTCCATTCCAAAGACAAATGAGAACTTCCGATTGCTTTATGACACTAAGGGTCGCTTCCGTCT
CCACTCACTCAGGGATGAGGAAGCGAAGTTCAAACTTTGTAAGGTTCGATCGGTGCAGTTTGGACAGAAGGGGAT
TCCATATCTCAACACTTATGATGGAAGAACAATTCGCTACCCAGATCCCCTCATCAAggCCAATGACACCATTAA
GCTGGATTTAGAATCCAATAAAATTGTCGACTTCATCAAATTTGATGTTGGAAATGTGGTCATgGTGACTggTgg
tagaaACaggggaCGTGTTgga
```

> SEQ ID NO:566 130744 44180_300443_1
```
caggtAAGATACTTAAGCCGGCGGTGGCCGAGAGCTCTCGGTGAGGTGATTCAAACTCTAATAGACCAAAATGGC
TAGAGGGTTGAAGAAACATTTGAAGAGGCTCAATGCGCCTAAGCATTGGATGCTCGACAAACTTGGTGGAGCCTT
TGCTCCCAAGCCTTCATCTGGTCCACACAAATCAAGGGAGTGTTTGCCGCTGATCATTATCTTGCGAAACAGGTT
GAAGTATGCTCTCACATACCGTGAGGTGATTGCAATTCTGATGCAACGACAGGTTATGGTTGATGCAAAAGTGAG
GACAGATAAGACTTATCCAGCTGGTTTCATGGATGTTGTATCAATTCCAAAGACTAATGAGAACTTTCGTCTCCT
TTATGACACAAAGGGGCGATTCCGTCTTCACTCTATCAGGGATGAGGAAGCCAAGTTTAAGCTTTGCAAGGTCCG
ATCTATTCAGTTTGGTACTAAGGGGATTCCTTACCTTAATACTTATGATGGTAGAACAATTCGCTACCCTGATCC
TCTCATCAAGGCCAATGATACCATCAAGTTGGACTTGGAGTCCAATAAGATTGTTGACTTCATCAAGTTTGATGT
TGGAAATGTTGTGATGGTAACTGGTGGTAGAAACAGGGGACGTGTTGGTGTTATTAAGAACAGGGAGAAGCATAA
AGGTAGCTTTGAGACCGTTCACATTCAGGATGCCCTTGGCCATGAATTTGCTACTCGCTTGGGAAATGTTTTCAC
CCTTGGCAAAGGAACAAAGCCATGGGTGTCTCTACCTAAAGGAAAAGGTATCAAGTTGTCCATCATTGAGGAGGC
ACGGAagaGGCTTGCTGCTCAATCAGCTACcacTGCCTGAGTTACCCTGGTTGCTCGTTTCTTCATTTCCATACT
CTTCGAGTATGGAATACTTGTGTTTTACAGTTTTGGACTCGATGTTtctAtttgcttagtggcaatgccttttat
attgtacttgtttgcttggcatattttaaatagattaaaactgtgtctttccgat
```

> SEQ ID NO:567 130744 39247_300206_1
```
tccggctgcaaacatggcaagaggattgaagaagcatctaAAGAGGCTCAATGCTCCTAAGCATTGGATGCTTGA
CAAACTTGGTGGTGCCTTCGCTCCCAAACCATCTTCTGGACCTCACAAGTCGAGGGAGTGTCTTCCTCTTGTCCT
GATCATCAGGAACAGGTTGAAGTATGCTTTGACTTACCTGAAGTTATCTCTATCTTGATGCAAAGGCATATCCA
AGTTGATGGCAAAGTCAGGACTGACAAGACTTACCCTGCTGGTTTCATGGATGTTGTATCCATCCCCAAGACCAA
TGAGAACTTCCGTCTTCTCTACGACACCAAGGGACGTTTCCGTCTCCACTCCATCAAGGATGAGGAAGCAAAGTT
CAAGCTTTGCAAGGTTAGATCTATCCAGTTTGGTCAGAAGGGAATTCCATACCTGAACACTTATGATGGTCGCAC
CATCCGTTACCCTGACCCGCTCATCAAGCCAAATGACACCATCAAGCTGGACCTTGAGGAGAACAAGATTGTTGA
GTTCATCAAGTTTGACGTGGGTAACGTTGTGATGGTGACTGGAGGCAGAAACAGAGGGCGTGTGGGTGTGATTAA
GAACCGTGAAAAGGCAATTCTCGAGC
```

> SEQ ID NO:568 130744 267802_200119_1
```
AAAATTCTTACAGCACCAAAATGGCTAGAGGGTTGAAGAAACATCTGAAGAGGCTCAATGCCCCGAAACATTGGA
TGCTTGATAAGCTCGGTGGAGCATTTGCTCCCAAGCCATCCTCTGGTCCACACAAATCAAGGGAATGCTTGCCCT
TGATCATTATCTTGCGAAACAGGCTGAAGTATGCTCTCACATACAGAGAGGTGATCTCAATTTTGATGCAACGTC
AAGTTATGGTTGACTCCAAAGTTAGGACCGATAAGACTTATCCAGCTGGTTTCATGGATGTGGTTTCAATTCCGA
AGACTAATGAAAACTTCCGCCTCCTTTATGACACCAAGGGCCGATTCCGTCTTCACTCAGTCAGGGACGAGGAAG
CCAAGTTTAAGCTTTGCAAGGTCCGCTCTATTCAGTTTGGCCAGAAGGGAATTCCATACCTGAACACTTATGACG
GAAGAACAATCCGCTATCCTGATCCTCTCATCAAAGCCAATGATACCGTAAAGCTGGACCTGGAATCCAATAAGA
TTGTTGATTTCATCAAGTTCGATGTTGGGAATGTTGTGATGGttaCCggaggTAGAAACAGgggAcgtGTCggTG
ttATCaaGaACAGGGAGaagcataagggTAGCTTCgagaccgtccaCAttcaggatGCAttggggcatgaATTTG
CTAcccgtTtGGGaa
```

> SEQ ID NO:569 130744 255625_301644_1
```
TCGGCACGCTGCGAAGCTGGAGCTGGAGCAGGAGGAATAAGAAGGAGAAGGAGGAGGAGGAGGAGCAGCAGTCCA
GCTATGGCGCGAGGATTGAAGAAGCACTTGAAGCGGCTCAATGCCCCCGCCACTGGATGCTCGACAAACTTTGC
GGTGCCTTCGCCCCCAAGCCCTCAGCAGGTCCCCATAAAGAGAGGGAGTGCCTGCCCCTTTTTGTTCTTCTCAGG
AACAGGTTGAAATATGCACTCACATACCGTGAGGTTGTTGCAATTGTCATGCAACGACTTGTCTCCGTTGACGGA
AAGGTCCGTACTGACAAATGTTACCCTGCTGGATTTATGGATGTCGTTTCAATTGCCCGAACCAACGAGAATTTC
AGACTCTTGTATGACAGCAAGGGGAGGTTCACTGTCCACTCTGTTGGTGTGGAAGAAGCCAGGTACAAGCTCTGT
AAGGTGAAAGCAGTGAGGTTTGGCGATAAAGGAATCCCCTTCCTCACTACCAACGATGGGCGGACGATCCGCTAT
CCTGATCCTCTCATCAAGGCCAATGACACTGTCAAGATCGACCTAGAGACAGGAAAGGTTGTTGACTTCATCAAA
TTTGAC
```

> SEQ ID NO:570 130744 246372_301612_1

Figure 2 continued acgcgtcgcggacgcgtggGGCGATGGCGCGGGGACCGAAGAAGCATCTCAAGGTGCTCAATGCGCCCAAGCATT
GGATGCTCAGCAAGCTCGGCGGTGCCTTTGCTCCAAAGCCATCGTCGGGCCCTCACAAGGAGAGGGAATGCCTGC
CTCTGGTCATTCTTCTGCGGAACAGGCTCAACTACGCCCTGACGTACCGCGAAGTCATGTCCATTGTCATGCAGA
ACCTCATCTCGATTGATGGCAAGGTCCGCACGGATAAGTGTTTCCCTGCTGGATTCATGGATGTCGTGACTATCG
GCAAGGTCAATGAGAACTATCGTCTTCTGTATGACAACAAGGGCCGGTTCACTCTGCATTCCATCTCTGCTGAGG
AGGCTAAGTTCAAGCTCTGCAAGGTCCGTGCTGTCAAGTTCGGCGACAAGGGAATTCCCTTCCTCACGACTTACG
ACGGGAGGACCATCCGCTACCCGGACCCGCTGATCAAGGCCAACGACACCATCAAGATCGACCTTGAGACGGGGA
AGATCAAGGAGTTCATCAAGTTCGACATCGGCAACATCGCGATGGTCACCGGCGGGCGCAACAggggcCGGATTG
GcACCATCCAGCACCGTGAGAAGCACAAGGGATCCTTCGACATCATCCACGTCAaggACGCTGTgggccaggACT
TCGCcacCCGC > SEQ ID NO:571 130744    233020_301275_1
GCGGGGACCGAAAAAACATCTCAAGGTGCTGAATGCACCCCGCCATTGGATGCTCAGCAAGCTGGGCGGTGCCTT
CGCTCCAAAGCCATCGTCGGGTCCTCACAAGGAGAGGGAATGCATCCCCCTGGTAATTCTCCTCCGGAACAGGCT
CAACTATGCTTTGACGTACCGGGAAGTCATCTCTATCGTCATGCAAAACCTCATCTCCATCGATGGCAAAGTTCG
CACAGAAAAATGCTTTCCCGCTGGTTTCATGGATGTGGTGACTATCGGGAAGGTGAATGAGAACTACCGCCTTCT
TTACGATACAAAAGGCCGGTTCACTCTCCAGCCGGTCACCGACGATGAGGCAAAGTACAAGCTTTGCAAGGTTCG
TGCCGTGATGTTCGGATCTAAGGGAATTCCTTTCCTCACGACTTACGACGGGAGGACCATCCGCTACCCCGATCC
TCTGATCAAGGCGAACGACACCATCAAGATCGACTTGGAGACTGGGAAGATCAAAGAGTTCATCAAGTTCGAGGT
TGGCAACATCGCCATGGTCACGGGtggccGCAACAGGGGAAGGAttggaaccGTccAGCAccGcgagaagCatAT
GGGaagctttgatATAATcCACATCaaggacGctgccgGCc > SEQ ID NO:572 130744    226476_300997_1
gccgAAAATGGCCCGAGGACCCAAGAAGCATCTCAAGCGACTCGCAGCTCCCTCCCACTGGATGCTGGACAAGCT
GTCCGGCACCTACGCTCCCCGATCGTCTGCCGGTCCCCACAAGCTGCGAGAGTCTCTGCCTCTCGTCATCTTCCT
GCGAAACCGTCTCAAGTACGCCCTGAACGGCCGAGAGGTTAACGCCATTCTCATGCagCGACTGGTCAAGGTCGA
CGGCAAGGTCCGAACCGACTCCACTTTCCCCGCTGGCTTCATGGATGTCATCCAGCTCGAGAAGACCGGCGAGAA
CTTCCGACTTGTCTACGACGTCAagGGCCGATTTGCCGTCCACCGAATCACCGATGAGGAGGCTGCTTACAAGCT
CGGCAAGGTCAAGCGAGTCCAGGTTGGCAAGAAGGGTATCCCCTACCTCGTCACCCACGACGgCCGAACCATCCG
GTACCCCGACCCTCTCATCAaggtCAACGACACCgtcaagATCGACCTGGCCACCGGCAAGATCACCTCTTTCGT
CAAGTTTGagaACGGTAAcattgTCATGACCACCGGAGGTCGAAACATGgGCCGAgtcggcaccaTC > SEQ ID NO:573 130744    195968_300639_1
cccacgcgtccgaCGCCCAACCTTTCCGTCGTTTTCATCACCGTCGAGAAAACAGCCAGTCGTCACCATGGCCCG
AGGAATCAAGAAGCACCAGAAGCGCCTTAGCGCCCCCTCCCACTGGCTGCTGGACAAGCTGTCCGGTCTCTATGC
CCCCAAGCCTTCTGCCGGTCCTCACAAGCTCCGTGACTGCATGCCCCTGATCGTCTTCATCCGCAACCGTCTCAA
GTATGCCCTCAACTACCGCGAGACCAAGGCCATCATGATGCAGCGCCTGGTCAAGGTTGACGGCAAGGTCCGCAC
CGACATCACCTACCCCGCCGGCTACATGGACGTCATCACCATCGAGAAGACTGGCGAGAACTTCCGTCTCATCTA
CGACACCAAGGGCCGCTTCACCGTCCACCGAATCCAGGCCGAGGAGGCCGAGTACAAGCTGGGCAAGGTCAAGCG
CGTTCAGCTCGGCCGTGGTGGAATCCCATTCTTGGTCACGCACGATGCGAGAACCATCCGTTACCCTGACCCCCT
GATCAAGGTCAACGACACCGTCAAGATCGATCTCGCCACCGGCAAGATCACCGACTTCATCAAGTTCGACACCGG
CGCCATCGCCAtggtcaccgGTGGTCGCAACATGGGTCGTGTCGGCGTCATCACCCACCGTGAGCGCCACGACGG
TGGTTTCAACATCGTCCACATCAaggacGCCATCGACAacaccTCgCCACCCGTGAGagCAACGTCTTCGTCAT
CGgcTCCGAgaagcctgGATCTCCct > SEQ ID NO:574 130744    181880_300657_1
GAATTCGGGGAAGAACGAATACAAAATTAGGGCAAACCTAATTTACAGTCCAAAAACTCAATCATGGCGATGGGG
GGGAAGAAACATCAGAAGAGGCTTAATGCCCCTAAGCATTGGATGCTTGATAAATTGGGTGGTGCTTTTGCCCCT
AAGCCATCATCTGGACCACACAAGGCTAGGGAATGCCTTCCTTTGATTCTTATCCTGCGAAACAGATTGAAGTAT
GCCCTTACATACCGTGAAGTTGTTGCTATTTTGATGCAAAGGCACATTCTTGTTGATGGGAAAGTGCGAACTGAC
CACAAGTATCCATCTGGATTTATGGATGTTGTATCAATCCCCAAGACGAACGAGAACTACCGTCTTTTGTATGAC
ACCAAGGGTCGTTTCCGTCTCCACTCAATCAAGGATGAAGAAGCTAAGTTCAAGCTTTGCAAGGTCAGAAATGTA
CACTTTGGATCTAAGGGTATCCCA > SEQ ID NO:575 130744    175324_300541_1
cCCCCCCCGATCCCTCTCTCCTCTTTGGCGGCGGCGGCGGAAGAGAGCGACGCAGACGGACGGCGTGGTGGTCTC
CCCCTCCGGCGACGTAGCTCGAGCTCGCAACCATGGCGAGGGGATTGAAGAAGCATCTCAAGAGGCTCAATGCGC
CCAAGCACTGGATGCTCGACAAGCTCGGCGGAGCTTTTGCCCCCAAGCCATCGTCTGGACCTCACAAGTCCAGGG
AATGCCTGCCCCTGATCCTCATCATCAGGAACAGGTTGAAGTATGCGCTGACATACCGTGAGGTTATCTCTATCC

Figure 2 continued

TGATGCAGCGGCATGTCTTGGTTGATGGGAAGGTCAGGACTGACAAGACCTACCCTGCTGGTTTCATGGATGTGA
TTTCCATTCCAAAGACTGGTGAGAACTACAGGCTTCTCTATGACACCAAGGGTCGCTTCCGCCTTCAGTCCGTCA
AGGATGAGGATGCCAAGTTCAAGCTTTGCAAAGTTCGGTCTGTCCAGTTTGGACAGAAGGGCATTCCCTATCTGA
ACACCTATGATGGACGCACCATCCGCTACCCGGACCCTTTGATTAAGGCTAACGACACAATCAAGATTGATCTTG
AGACCAACAAGATTGttGACTTCATCAAGTTTGATgtgGGCAATgtcgtTatgGTCACAGGag > SEQ ID NO:576 130744  167372_300546_1
gaattcaagaagaagaaaagcagcgtttagccttagatcactccAAGGCGAATTAACTCAAAATGGCAAGAGGAT
TGAAGAAGCATTTGAAGAGGCTCAATGCTCCTAAGCATTGGATGCTTGACAAACTTGGTGGTGCCTTTGCTCCAA
AACCATCATCTGGTCCACACAAATCTAGGGAGTGTTTACCATTGATCCTTATTCTGCGTAACAGATTGAAGTATG
CTCTCACCTACCGTGAGGTTATTGCTATCTTGATGCAAAGGCATATTCTTGTTGATGGAAAGGTCAGGACTGACA
AGACATACCCTTCTGGGTTCATGGATGTCGTGTCAATTCCCAAGACAAATGAGAACTTCCGTCTCCTTTATGACA
CCAAGGGTCGTTTCAGGCTCCACTCAATCAAGGATGAAGAGGCCAAGTTCAAGCTTTGCAAGGTCCGTAATGTGC
ATTTTGGATCAAAGGGTATCCCATACATCAACACATTCGATGGTCGCACTATCCGCTACCCAGATCCCCTGATCA
AGGCCAACGACACCATCAAGCTTGATCTTGAGAGCAACAAGATTGTCGATTTCATCAAATTTGACATTGGTAACG
TTgcCAtg > SEQ ID NO:577 130744  50136_300169_1
CGGACGCGTGGGGTGGTTCGGAGCTGTTTCTAAGAAAACAACAGGTAGTTCGGATCGGAGCTACGCTTGCAAAAC
TCAAAACATGGCGAGGGGTTTGAAGAAGCATCTGAAGAGGCTTAATGCGCCTAAGCATTGGATGCTTGACAAACT
TGGTGGTGCATTTGCCCCAAAGCCGTCTTCTGGACCACATAAGTCAAGGGAGTGCCTTCCCCTCGTCCTTATCAT
CAGGAACAGGTTGAAGTATGCTCTTACCTACCGTGAAGTGATTTCAATCTTGATGCAAAGGCATA > SEQ ID NO:578 130744  126767_300466_1
gccattacggccggggagggctgttaaggtggctttcacatgagcggagcagcaggtaagcttagttactGCAGA
AAGTGGCGGAGCTGTGACGCTGCTGATTCAAATCTAAAGACCACCAAAATGGCTAGAGGTTTGAAGAAACATTTG
AAGAGGCTCAATGCCCCAAAGCATTGGATGCTTGACAAGCTTGGAGGAGCTTTCGCTCCCAAGCCCTCGTCTGGT
CCGCACAAATCAAGGGAGTGTTTGCCATTGATCATTATCATGAGAAACAGGCTGAAGTATGCCCTGACATATGGC
GAGGTCATTTCAATTTTAATGCAACGACTTGTTATGGTTGATGGGAAAGTTAGGACAGATAAGACTTACCCCGCC
GGCTTTATGGATGTTGTTTCAATTCCTAAGACAAATGAGAACTTCCGCCTCATGTATGACACAAAGGGCCGATTT
CGTCTTCACTCTGTTAGGGATGAGGAAGCGAAGTTTAAGCTGTGCAAGGTCCGATCTGTGCAGTTTGGACAGAAG
GGTATTCCATACCTCAACACTTATGATGGAAGAACAATCCGCTACCCCGATCCTCTCATCAAGGCCAATGATACC
ATCAAACTGGACTTAGAGAACAATAAGATTGTTGACTTCATCAAGTTTGATGTCGGAAATGTTGTCATGGTGACT
GGTGGTAGAAACAgggggCGtgttggTGTTATTaAaaAcaggcaaaAGCATAAGGGTAGtttcgaGACAGTTCac
attcACGATGCCCaagggcATGAG > SEQ ID NO:579 130744  121575_300358_1
ccccccCCCACTCTTGTCATCTCGGCGGCGGCGCGGCGCGGAGCAGAGGAGGACGAAGCAGCAGGCGGCGGCGGC
AGAGCACGGCGACCTAGCCCGACCTCGCAACCATGGCAAGGGGTTTGAAGAAGCATCTGAAGAGGCTCAATGCGC
CCAAGCATTGGATGCTCGACAAGCTTGGTGGAGCTTTTGCCCCAAGCCATCTTCTGGTCCTCACAAGTCCAGGG
AGTGCCTGCCTCTGATCCTCATTATCAGGAACAGGCTCAAGTATGCTCTGACATACCGGGAGGTTATTTCTATCC
TCATGCAGCGCCATGTCTTGGTTGATGGCAAGGTCAGGACTGACAAGACCTACCCAGCTGGTTTCATGGATGTCA
TTTCCATCCCCAAGACTGGTGAGAACTACAGGCTTCTGTACGACACCAAGGGACGTTTCCGCCTTCAGTCTGTCA
AGGATGAGGATGCTAAGTTCAAGCTTTGCAAGGTTCGGTCTGTGCAGTTTGGCcagAAgGGAATCCCCTACCTGA
ACACCTATGATGGgtcGCACCATcCGCTACCCTGACCCGATCATcaaggcaaACGacacaaTCAagatcGATCTg > SEQ ID NO:580 130744  116853_300515_1
ggggtttgaagaagcatctggggaggctcaatgcccccagccattggatgcttgacaagcttggtggagcatttg
cacccAAGCCTTCTTCTGGTCCCCACAAAGCTCGGGAGTGCTTGCCTTTGATCCTTATCCTCAGGAACAGGTTGA
AGTATGCTCTGACCTACCGTGAGGTTATTTCCATCTTGATGCAGCGGCATGTTATGGTTGATGGAAAGGTCAGGA
CTGACAAGACTTATCCGGCTGGATTCATGGACGTTGTGTCAATTGCAAAGACTGGGGAGAATTTCCGCCTTCTGT
ATGACACCAAGGGTCGCTTCCGTCTCCACAGCATCAAGGATGAGGACGCTAAGTTCAAGCTCTGCAAGGTCCGGT
CTGTACAGTTTGGACAGAAGGGTATTCCTTTCCTGAACACCAATGACGGGCGCACGATCCGCTACCCAGACCCAC
TCATCAAGGCCAACGACACCATCAAGATTGACTTGGAGACCAACAAGATCGTGGACTTCATCAAGTTTGATGTTG
GAAACATCGTGATGGTGACCGGTGGGAGGAACACGGGGCGCGTCGGGGTGATCAAGAGCAGGGAGAAGCACAAGG
GCAGCTTTGAGACCATCCATGTCGAGGATGCCCTCGGCCACCAGTTCGCGACTCGCATGGGCAACGTCTTCACCA
TCGGCAAGGAGAGGAAGCCGTGGGTATCTCTCCCCAAGGGCAAGGGCATCAAGCTCAGCATCATTGAGGAGGCGA
GGAAGCGCAATGCCGAGGCTGCCGCTGAGGCTTGATTTCTGAAAATCTCCATGAATGAAACTGTTGATTTgagCA
GTCTATTTATATAGAttATTTAGCTCTTAAGATCATATGTCCATTggaGa

Figure 2 continued

```
> SEQ ID NO:581  131003  129566_300480_1
GAATTCAACTCTCCTGCTATCTTTTACAGAAAGTAGTACTCAGATTGCAGAAGTCTGATCAGACATGGCTGCTGC
TTTCTCAACCGTTGGAGCAGTTAACAGAGCACCTTTGAGCTTGCCAAGCTCTGGCCAAAGCTCTGCCTTCTTGGG
CAGCAGCTTGAAGAAGGTCAATTCTTCTGTTGCACCAAAACCATCATCAAGAAGCTTCAAAGTTGTTGCTGCACA
AGAGGTTGATCCTAAAAAGAATGAGGACAAATGGGCCGGTCTTTACTACGACCAGTCTGATGATCAACAAGACAT
CACCAGAGGAAAGGGAATGGTTGACTCCCTTTTCCAAGCTCCTATGGATACCGGAACTCACAATGCTATCATGAG
TTCTTATGAATACGCCAGCAAGGGACAAAGAACATACGACTTTGACAACACCATGAGTGGATTCTACATTGCTCC
AGCTTTCATGGACAAGCTTGTTGTTCACATTACCAAGAACTTCATGACCCTTCCCAACATCAAGGTTCCTCTAAT
TTTGGGAGTCTGGGGAGGAAAGGGACAAGGAAAATCATTCCAGTGTGAGCTTGTCATGGCCAAGATGGGAATCAA
CCCAATCATGATGAGTGCTGGAGAGCTTGAGAGTGGAAACGCAGGAGAGCCCGCAAAGTTGATCAGGCAACGTTA
CCGTGAAGCAGCTGACATTATCAAGAAGGGAAAAATGTGTTGTTTATTCATCAACGATCTTGATGCAGGAGCTGG
ACGTATGGGTGGAACCACTCAATACACAGTTAACAACCAGATGGTTAACGCCACCCTCATGAACATTGCTGATAA
CCCAACAAATGTCCAGCTCCCCGGTATGTACAACAAGGAGGAGAATCCTCGTGTACCAATCATCTGTACCGGTAA
CGATTTCTCCACTTTGTATGCTCCTCTTATCCGTGATGGACGTATGGAGAAgttCTACTGGGCACCTACTCGTGA
TGACcgtatTggTGTCTGCAAGGGTAtcttcaagaCTGATAACATTtctGATgaagctatcatCAAGATTgttgA
TACCTTCccagggcAATCTA > SEQ ID NO:582  131003  262906_301720_1
TTGGATCTTGCCTTTGCTCATTCCTTTCCCTCCTCTACCCCTATGGCTGCCCTTGAGGCCTCCTGTGTTGCTCA
GAGTCTGTCTGTAGTGAGCTGCCAAGCATCTGGCAATGTCGTCCATCCTCGGCTTTCTTGGGTTTAGGCCTAAA
GAAGGGGGGTCTTCTTCTGGGAATGCAAAGAAGGCTTCATTGCAGAAGATTGCAGCATCGGTAGACGGGGATGA
AACAAAGCAGACGAAAACGGACAAATGGGCCGGTCTGGCCTTCGACACCTCGGACGACCAGCAGGACATCACCCG
AGGGAAGGGTATGGTGGACCCACTCTTCCAAGGTGCTGTGGGTTTGGGCACCCAAGAAGCTGTCATGAGCACCTA
TGACTACATTAGCACCGGTCAGAGGACGTTACAATGGGACAATATGAAAGATGGTTTCTACATTGCCCCTGCATT
CATGGACAAGCTTGTCGTCCACATTACTAAGAATTTCATGAATCTTCCCAACATCAAGGTGCCATTGATCCTTGG
TATCTGGGGAGGCAAAGGTCAAGGGAAATCATTCCA > SEQ ID NO:583  131003  44720_300030_1
gccattacggccgggGAACCAATTTTTGAATATATTgagCAAATCAAGAAAGCTCAATCCTTAGCTTCTTTGATC
AAGTTGTCATCACAGTAGTCAAGATAATGGCTACCTCTGTGTCAACCATTGGAGCTGCCAACAAAGCACCGTTGA
GTTTGAACAACTCAGTTGCTGGAACTTCAGTTCCAAGCACAGCCTTCTTTGGCAAAACATTGAAGAAAGTGTATG
GAAAAGGTGTTTCAAGCCCCAAGGTTACAAACAGGAGCTTGAGGATTGCAGCTGAAAAAAAAGATGCTGATCCCA
AGAAACAGACCGATAGTGACAGATGGAAGGGTCTTGTCCAAGACTTTTCTGATGATCAACAGGACATCACCCGGG
GTAAGGGTATGGTTGACAGTCTTTTCCAGGCTCCAACGGGTACTGGTACTCACCATGCTGTGTTGCAATCCTACG
AATATGTCAGCCAAGGTCTTCGCCAATACAACATGGACAACAAGTTGGACGGATTCTACATCGCTCCTGCTTTCA
TGGACAAGCTTGTTGTTCACATCACCAAGAACTTCTTGAAATTGCCCAACATCAAGGTTCCACTTATCTTGGGTA
TCTGGGGAGGCAAAGGTCAAGGTAAATCTTTCCAGTGTGAGCTTGTCTTCAGAAAGATGGGAATCAACCCCATTA
TGATGAGTGCTGGAGAATTGGAAAGTGGAAATGCAGGAGAGCCTGCAAAATTGATTAGGCAAAGGTACAGAGAGG
CAGCAGAAATCATCAGAAAGGGAAACATGTGTTGCCTCTTCATCAACGATCTCGATGCAGGAGCTGGTAGAATGG
GTGGAACAACTCAATACACTGTCAACAACCAAATGGTGAATGCCACTCTCATGAACATTGCTGACAACCCGACAA
ATGTCCAGCTCCCCGGTATGTACAACAAGCAAGAAAACGCCAGGGTCCCCATTATCGTCACTGGTAACGATTTCT
ccACATTGTATGCTCCACTTATCCGtGATGGTCGTATGg > SEQ ID NO:584  131003  259421_301705_1
GCGCAAGACTAGCTAGCTCTTCGTCCTCGCGGTACATCGCAATGGCGTCGTCTCTCCAGGCGGTCCCCGTTGCTC
AGGCGATGAGCTTGCCAGCAGCACAGAAGTCCTCGTCCAAGGTTTCATGCCTCAACTCCCAGTTCCTGGGCCTCA
ACGTCAAGAGAAAGACCGTGTTCCAAGCTTCTCTGTCCGGTGCCGCTGGACGCGGCCGGGTGGTCTGCGAGAAAG
TTAAGGACACAGAGGACGAGACCAAGCAGACGGCCAAGGATCGCTGGGGAGGCCTGGGCACCGATATCTCGGACG
ACCAGCAAGACATCACCCGTGGTAAGGGAATGGTCGACACCCTTTACCAAGGAGCTATCGGAATGGGAACCCAGC
ATGCCATCATGAGCAGCTATGAGTACATTAGCACTGCCCAGCCCAACTTTGCGTTTGATAACACCAAGGATGGCT
TCTACATCGCACCCGCATTCATGGAAAAACTTATGATCCATATCGCCAAGAACTTCATGACACTTCCAAACATCA
AGGTGCCGCTGATTCTTGGTATCTGGGGAGGCAAAGGTCAAGGAAAATCATTCCAGTGCGAGCTTGTCTTCTCCA
AGCTCGGTGTCAACCCGATCATGATGAGCGCTGGAGAACTCGAGAGCGGAAACGCCGGAGAGCCCGCCAAGCTCA
TCAGGCAGAGGTACCGTGAAGCTgCCGATATCATCAAGAAGAAAGGCAAGATGTGCTGCCTCTTCATCAACGATC
TCGACGCCGGCGCCGGACGAATGGGtggaaCGACGCAATACACGGTTAACAACCAGATGGTGAACGCGACGCTGA
TGAACATCgccGAcaatcccACGaatgtaCAGCTCCCCGGAATCTACAac

> SEQ ID NO:585  131003  191114_300739_1
```

Figure 2 continued

CCCCCCCACTTTGAGCAGCAGCGGCCGGCCATCATCAGTGATCCTCTACAATCATCGACTTTCAGCAAATTAAGA
TGGCTGCTGCCTTCTCCTCCACCGTTGGAGCTCCGGCGTCCACTCCGACCAACTTCCTGGGGAAGAAGCTGAAGA
AGCAGGTGACATCGGCGGTGAACTACCATGGCAAGAGCTCCAACATCAACAGGTTCAAGGTGATGGCCAAGGAGC
TGGACGAGGGCAAGCAGACCGACCAGGACAGGTGGAAGGGTCTCGCCTACGACATCTCCGATGACCAGCAGGACA
TCACCAGGGGGAAGGGTTTCGTCGACTCCCTTTTCCAGGCTCCCACGGGTGATGGCACCCACGAGGCCGTCCTCA
GCTCCTACGAGTACCTCAGCCAGGGTCTCAGAACGTACGACTTCGACAACACCATGGGAGGCTTCTACATCGCCC
CTGCTTTCATGGACAAGCTCGTCGTCCACATCTCCAAGAACTTCATGACCCTCCCCAACATCAAGGTCCCACTCA
TCCTGGGTATCTGGGGAGGCAAGGGTCAGGGAAAATCCTTCCAGTGTGAGCTCGTCTTCGCCAAGATGGGGATCA
ACCCCATCATGATGAGCGCCGGAGAGCTGGAGAGCGGCAACGCCGGAGAGCCGGCGAAGCTGATCAGGCAGCGGT
ACCGTGAGGCGGCAGACATCATCAAGAAGGGGAAGATGTGCTGCCTCTTCATCAACGATCTGGACGCGGGTGCAG
GTCGCATGGGAGGCACCACCCAGTACACGGTGAACAACCAGATGGTGAACGCCACCCTGATGAACATCGCCGACA
ACCCAACCAACGTGCAGCTCCCCGGGATGTACAACAAGGAGGACAACCCCCGTGTCCCCATCATCGTCACCGGCA
ACGACTTCTCCACGCTGTACGCGCCGCTCATCCGTGACGGGCGTATGGAGAAGTTCTACTGGGCTCCCACCCGCG
ACGACCGTGTCGGCGTCTGCAAGGGTATCTTCCGCACCGACAACGTCCCCGACGAGGACATCGTCAAGATCGTCG
ACAGCTTCCCAGGCCAATCCATCGATTTCTTCGGCGCTCTTCGTGccCGTgtttacgaCGACGAGGTGCGCaAGT
GGGTGtcggACaCgggtgtggAGaaCAttggc > SEQ ID NO:586  131003  255661_301644_1
ATTGGATAGTCAGCTCAGCTCAAGAGGAAGACATGGCCATGGCTACCACACTCCTCGAGGCTTCGTGTGCTACTT
TGGGATCTCCTCTAGGTGGTCAACCAGTTGCGAGTTCTAAGTCTGGTGGCCCTGTGTCTCTGTTTTTGGGGGCGG
GTCTGAGGAAGTGCTGCAGCGTGCACATGCGCAGAAGCAGGAGCAGTGAAGGTTGTGGCGTTGGAGGATG
AGACGAAGCAGACAAAGACAGACCGATGGGCGGGGCTTGCGACGGACATATCGGATGACCAGCAGGACATTGCAC
GAGGGAAGGGCATGGTGGACGCACTCTTCCAGGGCCCCAGTGGTGAAGGCACCCAGCATGCCGTCATGAGTTCCT
ATGAGTACATTAGCTCTGCTCAACGCACGCTTAACTGGGACAACATTAAAGATGGATACTACATCTCACCATCCT
TCATGGACAAGCTGGTTGTTCATGTCACTAAAAACTTCCTTACACTTCCGAACATTAAGGTTCCTTTGATTCTGG
GTGTATGGGAGGGAAAGGGCAAGGGAAGTCTTTCCAGTGCGAGCTGGTCTTCGCTAAGCTCGGAATTACGCCCA
TAATGATGAGTGCTGGAGAATTGGAGAG > SEQ ID NO:587  131003  248955_301588_1
TGTTTGTATGTCCTGTTCGATCAGTCTATGGCGGCATCGTCAATGCAGCTCCTAACCCAGGCCTCCGCCCATCCG
ATCGGCGCGAGATCGTCGCTGGCATCGGCATTCTTGGGGAGCGGCATCCATCAGCACGAATCCAGTGCGCGAGCT
GGAAACCTCCGGGCTAGATGCCGGGTAGTGTGTGAATTGGAGGAATCCTCGAAGAAGGTCGATCGATGGCAGTCT
CTGGGGACCGATACGTCGGACGATCAACAAGATATTACCAGGGGAAAGGGAATGGTGGATAATCTGTATCAAGGG
CCTCAAGGGGGAGGAACACAGACTGCCGTTATGTCGAGTCTAGAGTATATCAACACTGCCCAGCGCATGTACTCT
ATGGACAACACCAAAGATGGATTTTACATCGCCCCAGCGTTCATGGAGAAGCTAGTTATTCACATATCAAAAAAT
TTCATGACACTTCCAAATGTAAAGGTTCCTCTTATACTTGGTGTCTGGGGTGGCAAAGGTCAAGGAAAGTCGTTC
CAGTGCGAATTGGTGTCCTCCAAGCTGGGAATT > SEQ ID NO:588  131272  111712_300059_1
ctctCTCTCTCTTTATCCGTCCTCCGGCGACCCTTTTACTCCGGTCAAACTCCGCCGGAAAATCTTAAATTCTTG
TTTTATTGACGGCTTACTTGCTTGTACCTTCATCTCGCTTCACCGATCTTGCACTTCACATTAATCATCATGAAT
CCCGAATACGACTATCTTTTCAAGCTTTTGCTTATTGGAGATTCTGGTGTTGGCAAATCGTGTCTCCTCTTAAGA
TTTGCTGATGACTCATATCTTGAGAGTTACATTAGTACTATTGGTGTGGACTTTAAAATCCGCACAGTTGAGCAG
GATGGGAAAACCATTAAACTTCAAATTTGGGATACTGCTGGTCAAGAACGTTTTAGGACAATTACCAGCAGCTAC
TATCGCGGTGCTCACGGCATAATTGTTGTCTATGACGTAACTGATCAAGATAGTTTCAATAACGTCAAGCAATGG
TTGAGTGAAATTGATCGATATGCAAGTGATAATGTGAACAAACTTCTTGTCGGAAATAAGTGCGATCTCACAGCG
CAGAagTAGTTTCCACAGAGACAGCTCaggCTTTTGCTGATGAGATCGGCATTCCTTTCATGGAAACTAGTGCG
AAAAATGCCACCAATGTGGAACaggCTTTCATG > SEQ ID NO:589  131272  254328_301632_1
GAACTGTCAAGCCTCTGCCTGCTCTCACCAGATCTGAAGATTTCCGTCTTACCTTCATTATGAATCCTGAATATG
ACTACCTTTTCAAGATTTTATTGGTTGGTGACTCTGGTGTGGGGAAATCATGTCTCCTCCTCCGATTTGCGGATG
ATAATTATGTGGAGAGCTATATAAGCACCATTGGTGTGGATTTTAAAATCCGAACTGTGGAACTCGATGGAAAGA
CTCTGAAACTTCAGATTTGGGATACAGCAGGGCAGGAGCGCTTCCGAACCATTACTAGCAGCTACTACAGAGGAG
CGCATGGCATTATTATTGTTTATGATGTGACAAACCAGGCAAGCTTCAATAACGTGAAGAGATGGTTGAATGAGA
TACAGCGATATGCAAGTGACAGTGTGAACAAATTGTTGGTAGGGAATAAGTGCGATATGACCGAAAAGAAAGCCG
TAGATACCGAAACGGCAAAGGCATTTGCTGATGAGATNGGCATTCCATTTCTGGAAACAAGTGCAAAGAGCGCGA
CAAATGTTCAAGAGGCTTTCATCACAATGGCGACTGAGATAATGAAAAGGATGGCAAGTCAACCCTCAGTAACTA
GTACAAAGCCCAAATTTGTCCAGATTCAAGGGAAACCGGTTAACCAAAAAAGAGGCTGCTGCTCTTAATGCAA

Figure 2 continued

> SEQ ID NO:590 131272 247337_301619_1
AAGAAGACCGAGTTAGAGAAGAACAGGGTAGAGAAAGAAGAAGAGTTGGAGAAGATGTCGTCAGCAGTGAGGCCG
GGACCCGGCGCAGACCACGACTACCGCATCAAGCTGCTGCTCATCGGCGACAGCGGCGTTGGCAAGAGCTGCGTG
CTGCTCCGCTTCTCGGACGACTCGTTCACGACGAGCTTCATCACCACCATCGGCATCGACTTCAAGATCCGCACC
ATCGAGCTCGACGGCCGCCGCGTCAAGCTCCAGGTGTGGGACACCGCCGGCCAGGAGCGCTTCCGGACCATCACC
ACCGCCTACTACCGCGGCGCCATGGGCATCATCCTCGTCTACGACGTGACCGACGAGTCGTCCTTCAACAACATC
CGCAACTGGATCAAGAACATCGAGCAGAACGCGTCGGAGAACGTCTCCCGCATCCTGGTCGGGAACAAGGCCGAC

> SEQ ID NO:591 131272 247081_301616_1
tTTGCGGGAGAGCTCTCGCCGAAGGCCTGATCTGTGCTGGGATCTACACCAGGAGCTCAAGCATGGCATCCAGGA
AGCGAACTCTCCTCAAGGCGATCATTCTCGGCGACAGCGGCGTCGGCAAGACATCGCTCATGAATCAATACGTGA
ACAAGAAATTTAGCAACCAGTACAAGGCGACCATTGGAGCTGATTTTCTCACCAAGGAAGTCCAAGTGGAGGATA
GGCTAGTGACGATGCAGATATGGGATACAGCCGGTCAGGAGCGATTCCAAAGCCTTGGTGTGGCCTTCTATCGAG
GGGCTGATTGCTGTGTGTTGGTATACGACGTGAATGTGATGAAGTCGTTCGATAATCTGGACAACTGGCGCGACG
AGTTTCTTATCCAGGCAAGTCCTTCTGATCCAGAGAACTTCCCTTTTatTGTTCTTGGCAACAAGGTCGATGTAG
ACGGGGGGAACAGCAGAGTGGTATCCGAGAAGAAAGCCAAGGCCTGGTGCGCGTCGAAGGGCAACATTCCATACT
TTGAGACATCTGCCAAAGAAGACTACAACGTtGAGGCTgCtttTcAATGTATAGCGAaGAATGCcttgagGAGTg
aAcccGaAGAAGACTTCTACcTTCCGGACAcgaatgaccTCGcaaacaACAACAGAGTGAcGAGATCATCTGGGT
Gt > SEQ ID NO:592 131272 242891_301333_1
gcgcgatccgcgtagATAGATCTGGAGCTGCTCCTTGGATGTGGAATGCCGTGGTCCAAGCTTTTGGGGAATAGG
TCGTGAGCGGCAGCGCGGCAAAATAGGTCTTGATCGAGAGTGATTTGCGAGAAATGGGTGTGCCAACCGCGACGG
TGTCGCCGCTCGCCAAGTACAAGCTTGTGTTCTTGGGCGATCAATCGGTGGGAAGACGAGCATCATCACGCGTT
TCATGTATGATAAGTTTGACAACACGTACCAGGCAACCATTGGGATCGACTTCTTGTCGAAGACCATGTACCTGG
AAGATCGCACTGTTCGCTTACAGCTCTGGGATACTGCTGGCCAGGAACGTTTTCGCAGCCTAATTCCCAGCTACA
TACGGGATTCGTCCGTGGCGGTGGTCGTGTACGATGTTGCGAATCGCCAGTCGTTCCTAAACACGGCCAGATGGG
TGGAAGAAGTCCGCACCGAGCGTGGTAGCGATGTGATCATCGTTCTCGTCGGGAACAAGACCGACTTGGTTGACA
AAAGGCAAGTCTCGATCGAGGAGGGGGATGCCAAAGCCCGGGAATTTgGAGTCATGTACATCGAAACCAGTGCCA
AGGCCGGATTCAACATCAAGGCTCTCTtcagaaaaaTCgctgCCGCA > SEQ ID NO:593 131272 238083_301291_2
GATCGATCGATAGAATCGACTCTAGGGTTTAGCAGCAGCAGCAGCTCGTCGATTCTTTCCTCCTTCTTGATTGAT
CATGGCGCGGCGGCCGGATGAGGACTACGACTACCTCTTCAAGGTGGTGCTCATCGGCGACTCGGGCGTCGGGAA
ATCCAACCTGCTCTCCAGATTCACGCGCAACGAGTTCTGCCTCGAGTCCAAATCCACCATCGGGGTCGAGTTCGC
GACCCGCACGATCCAAGTGGACGGCAAGACGATCAAGGCTCAGATCTGGGACACGGCCGGGCAGGAGCGTTACCG
CGCCATTACCAGCGCCTACTACCGCGGCGCCGTCGGCGCTCTCCTCCTCTACGACATCACCAAGCAGGCGACGTA
CGAGAACGTGGAGCGGTGGCTCAAGGAGCTGCGCGACCACGCCGACTCCAACATCGTCATCATGCTGGTGGGCAA
CAAGTCGGACCTTCGCCACCTCCGCGGCGTGACGACGGAGGACGCGCAGGCCTTCTCCGAGAGGGAGGGCTGTC
GTTCATCGAGACGTCGGCCCTGGAGGCGACCAACGTGGACAAGGCGTTCCAGAGCATCCTGGGCGAGATCTACCG
GATAGTGAGCAAGAAAGCGCTGGCGACGGCGGACGAGCTGTCGTATGTGGCTCCGGGCGAAGGCAGGCCATCCAC
GTCGGGCCCGAGCAGGATGGCGGCGCCGTCAAGAAGAAGGCGTGC > SEQ ID NO:594 131272 218476_300966_1
gagccaaccatccgcttcgattgccactttgaccaaacctgcacctctttcaactctcaagccttccgcttctat
ttcTCCCGTTCCAACACAAACACCAACAACCGCCATCATGAACCCCGAATACGACTATCTCTTCAAGCTCCTCCT
CATCGGTGATTCCGGTGTTGGAAAGTCTTGCTTGCTGCTGCGATTTGCCGATGACACCTACACCGAGTCTTACAT
CTCCACCATCGGTGTCGATTTCAAGATCCGAACGATAGAACTCGATGGCAAGACCGTGAAGCTGCAGATCTGGGA
TACCGCCGGCCAGGAGCGTTTCCGAACCATCACCTCGTCTTACTACCGCGGTGCTCACGGCATCTGCGTCGTCTA
CGATGTCACTGATATGGACTCCTTCAACAACGTCAAGCAGTGGCTCCAGGAGATTGACCGGTATGCCACCGAGGG
CGTCAACAAGTTGCTCGTAGGCAACAAGAGCGATATGTCCGATAAGAAGGTTGTCGAGTACACCGTTGCCAAGGA
ATTCGCTGACAGCCTGGGCATCCCATTCCTCGAGACTTCCGCCAAGAACGCCAGCAACGTTGAGCAGGCTTTCCT
CACCATGGCTCGCCAGATCAAGGAGCGCATGGGCACCACGACTGCCAACAACACGAAACCCAGCGTGCACGTTGg
cccagGGCCAGgGTGTCGGCAACTCTTCCAACAGCAGCTGCTGTTAAATGtattcctCTTTGATGGTttcgTGTG
GTtcgctttTGTCGtg

> SEQ ID NO:595 131272 194381_300762_1

Figure 2 continued

CCCCCGCCAGTGTCTCCCCACTCCATAGTGACACTGCGCCGGGCTGCGAGATCCAAAATCCGACCAGCCAGCGTT
AGCTCGGAGAGGCGAGGCGAGAATGTCGGCCGCGGCGGGCGGGTACAGGGCGGAGGACGACTACGACTACCTGTT
CAAGGTGGTGCTCATCGGCGACTCCGGCGTCGGCAAGTCCAACCTCCTCTCCCGCTTCACCAAGAACGAGTTCAG
CCTCGAGTCCAAGTCCACCATCGGCGTCGAGTTCGCCACCCGCAGCCTCCAGGTCGACGGCAAGGTCATCAAGGC
CCAGATTTGGGACACCGCCGGCCAGGAGAGGTATCGTGCTATCACTAGTGCCTATTACCGGGGAGCTGTGGGAGC
ATTGCTCGTCTACGATGTCACCCGTCGTGCTACATTCGACAACGTGGGACGCTGGCTAAGGGAGCTTAGAGACCA
CACTGATCCTAGCATTGTCTGCATGCTGATTGGCAACAAATCCGATCTCCGCCACTTGGTGGCTGTCTCAACCGA
GGACGGCAAAGAGTTTGCTGAAGCCGAATCAATGTACTTCATGGAAACTTCTGCGCTCGACGCTACCAACGTCGA
C

> SEQ ID NO:596 131272 157355_301737_1
gAACAATTTGCTAAGCGCACGCAGCACAAAGTGCGCAGAATAGCCAATTGAGGTGTGTGTGTCTGTGTGTGCAAA
TCATATACGAATTGATTATTCAATGGCAGCACCACCGGCAAGAGCTAGAGCGGACTATGATTACCTCATAAAGCT
TCTTTTGATCGGCGATAGTGGTGTTGGTAAGAGTTGCCTTCTTTTACGTTTCTCTGATGGGTCCTTCACCACAAG
CTTTATAACAACCATTGGAATCGACTTTAAAATTCGGACCATTGAGCTTGATGGAAAAAGGATCAAGCTTCAGAT
ATGGGATACAGCTGGTCAGGAACGGTTTCGGACTATCACTACTGCTTACTATCGTGGAGCCATGGGTATATTGTT
GGTGTATGATGTTACTGACGAATCCTCCTTTAACAACATTAGGAACTGGATTCGTAACATTGAGCAGCATGCCTC
agaCAATGTCAACAAAATACTTGTAGGGAACAAGGCTGACATGGATGAAAGCaagaggGCTgtTccTACGTCAAA
gggccaagcACTTGCagaTGAgtATGGgAttaaG > SEQ ID NO:597 131272 157256_301736_1
CCCAACTCTCTCTCTCTCTAGATCACCATTTCCACTTTCTGCCTCTTCCCCCGAAGACTCTTACACTTTTCACAA
CTTCAAAAATGGATTCATCAGATGATGAAAGTGGTGAGGAATATCTTTTCAAGATTGTAATAATTGGTGATTCAG
CAGTTGGAAAATCAAATTTGTTAACACGTTATGCAAGAAATGAATTCAATTTGCATTCAAAAGCAACAATTGGTG
TTGAGTTTCAGACCCAAACTCTTGAAATTGATGGTAAAGAAGTAAAAGCTCAGATTTGGGATACAGCTGGTCAAG
AAAGATTTAGAGCTGTTACTTCTGCTTATTATCGTGGTGCTTTTGGTGCTCTGGTTGTTTATGATATTACTAGAC
GTACCACTTTTGATAGCATCCCTCGTTGGCTTGATGAGCTCAAGACTCATTCTGATACCACGGTTGCAAGGATGC
TCGTGGGAAACAAATGCGATTTGGATAACATAAGAGCTGTGAGCGTAGAACAAGGCAAAAGCCTGGCGGAATCAG
AAGGGATGTTCTTCATGGAAACATCTGGCCTCGATGCAACGAACGTAAAC > SEQ ID NO:598 131272 142035_300431_1
CCCCCGAGCAGCGCTCGTGTTCGGTCAAAAGCCTCGCCGCGGCGAGCTCGAGCTCATGGGCATTCCGGAGGGGAG
GGAGGGATGGGGACGAGTCGGAGGGGGAGACGGAGGAGTACCTGTTCAAGGTGGTGATCATCGGGGACAGCGCG
GTGGGGAAGAGCAACCTGCTGTCCCGCTACGCCCGCAACGAGTTCAATCTCCACTCCAAGGCCACCATCGGCGTC
GAGTTCCAGACGCAGAGCATGGACATCAACGGCAAGGACGTCAAGGCCCAGATCTGGGACACCGCCGGCCAGGAG
CGCTTCCGCGCCGTCACCTCCGCCTACTACCGCGGCGCCTTCGGCGCCCTCCTCGTCTACGACATCTCCCGCCGC
TCCACCCTTCGACAACGTCGGTCGCTGGCTCCAAGAACTCAACACACATTCGGACACGACTGTAGCCAAGATGTTG
GTGGGCAACAAGTGTGATCTGGATAATATCCGTGAAGTGCCGGTAGAGGAAGGCAAAGCACTTGCTGAAGCTGAA
GGGCTGTTCTTCATGGAGACCTCTGCTCTGGACTCGACAAACGTGAGGACAGCTTTCGAGATCGTAATCAAGGAG
ATCTACAGCAACGTGAGCAGGAAGATCTTGAATTCGGACTCCTACAA > SEQ ID NO:599 131272 182235_300659_1
GAATTCGAAGACCGGATGAAGAGTATGATTATCTATTCAAGATCGTTTTAATTGGTGATTCAGGTGTTGGTAAAT
CCAATCTTCTCTCCCGTTTCACTCGTAATGAGTTTTGTTTGGAATCTAAATCTACCATTGGAGTTGAATTCGCTA
CTCGTACTCTTCAGGTTGAAGGCAAGACAATCAAAGCACAAATATGGGATACAGCTGGGCAAGAGCGATACAGAG
CAATTACCAGTGCCTATTACAGAGGTGCACTAGGTGCTCTTCTAGTCTATGATGTGACAAAACCAACAACATTTG
AGAATGTAACTCGGTGGCTCAAGGAACTGCGTGATCATGCTGACTCCAACATTGTGATAATGCTCATTGGAAACA
AAACTGATCTGAAGCACCTCCGTGCAGTTGCAACAGAAGATGCTCAGAGTTTTGCTGAGAAGGAAGGGCTTTCAT
TCATCGAGACCTCTGCCCTTGAAGCAATAAATGTTGAGAAGGCTTTCCAAACAATCCTTGGAGAGATATATCGTA
TAATTAGTAAGAAATCCCTTGCGTCAGAGGAGTCTGCACCGTCTAGCATTAAGGAAGGCCAAACAATTGATGTCT
CAGGATCAGATGGCAATTCAAAGAAATCATGCTGTTCTACTTAAGGGGTGATTTCTTCCATTCTTTATCCTTTCT
GGTGACTAATGTTCTATAGGTCTCAAGTCTTTCAACTATG > SEQ ID NO:600 131272 144467_200135_1
gatcgaagcccccaaaaacatgcgcagaaaaggtcggttgtccagataagggagtagtacatattatgctcaataa
caactACTGGGCATCAATCATCAATTCTACTGGAAACGTCTAAAATTGCCAACTGTCTGTCTTCCTCACGCCACA
CACACACACACATACCGGCGCGGAGTTTTCTGAATTTAGTCTCGTTTTGTCAGATCGAAGTCCGCCGAAGATGCC
TTCACGCCGGCGAACTCTTTTGAAAGTCATCATCCTCGGTGATAGCGGGGTTGGGAAGACCTCGTTGATGAATCA
ATATGTAAATAAGAAGTTCAGCAACCAGTACAAAGCAACTATTGGGGCTGATTTCTTGACAAAGGAAGTGCAGTT

Figure 2 continued

```
TGAAGATCGGCTCTTTACATTACAGATTTGGGACACAGCTGGCCAAGAGAGATTTCAAAGTCTTGGTGTTGCGTT
CTACCGTGGTGCTGATTGCTGCGTCCTTGTGTATGATGTAAATTCAATGAAGTCATTTGAAAACTTAAACAATTG
GAGAGAAGAGTTTCTAATTCAGgCAAGCCCATCGGATCCAGaAAACTTTcCATTTGTTGTGCtGGGGaacaaagt
tGATGTTGATGgTggaaataqTagagtqqtGTCGqAqaaaaaagctcqqqC
```

> SEQ ID NO:601  131272   155093_301352_1
```
TTCTTGACGTCAACCATCCTCTTCCTTTTTTCAAGTCCTAATTCTAATCAAAACCCTAATCGAACGATCACAAAA
ATCTCCATCACGACCAAATAATCATTTCTCTTCTGCAAATTTCGATCAATTAACAACTATGGCAACCGGTGGAAA
CAAGAATATGAACGCCAAATTGGTGCTTCTTGGAGATGTTGGAGCTGGAAAATCTAGTCTAGTTCTGCGTTTTGT
TAAAGGACAATTTATTGAATTTCAGGAATCAACTATTGGTGCTGCATTTTTCTCCCAAACAGTAGCAGTGAATGA
TGCAACTGTAAAATTTGAAATATGGGACACAGCAGGCCAAGAGAGATACCACAGTCTTGCTCCAATGTACTATAG
AGGAGCTGCGGCTGCTATAATTGTTTTTGATATCACAAATCAAGCATCATTTGATAGGGCACAAAAGTGGGTTCA
GGAGCTTCAGGCACAAGGTAATCCAAATATGGTGATGGCACTTGCCGGGAATAAGGCAGATTTGTTAGATGCAAG
AAAAGTGGCTGCAGAGGAAGCCCAAACATATGCCCAGGAGAATGGCCTTTTCTTCATGGAAACATCTGCAAAAAC
TGCATCTAATGTTCATGACATTTTCTATGACATAGCAAAGAGA
```

> SEQ ID NO:602  131272   138754_300727_1
```
AAAGATCCCTCCAAAAAAAAACGCCTTTTTTTTCTTGAGCACACAAGAGACGCCAATCCCAAAGCAAAGAGAAG
CGCAAAGATCATCTCTTTGCTTCTCGCCTTCTCCTCCTCCTCCTCTTCTCCCTCCTCGTGCTCCGCCCGATCCGT
CCGCCGCCTCCAGATCCGCGCCCATGGCGTCGCGCAGGCGAATGCTCCTCAAGGTCATCATCCTCGGTGACAGCG
GGGTCGGGAAGACGTCTCTGATGAACCAGTACGTGAACAAGAAGTTCAGCAATCAGTACAAAGCGACGATCGGCG
CGGATTTCCTGACCAAGGAGGTGCAGATCGACGACCGGCTCTTCACATTGCAGATTTGGGACACAGCGGGACAGG
AGCGATTTCAGAGTCTTGGTGTGGCATTTTACCGGGGAGCTGACTGCTGTGTTCTTGTATATGATGTCAATGTTA
CCAAGTCATTTGAAAGGCTCAACAGCTGGCGTGAGGAATTCCTAATTCAAGCTAGCCCATCAGATCCAGAGAATT
TCCCTTTTGTTGTACTTGGAAACAAAATTGATGTTGATGGTGGTAATAGCCGGACTGTTTCTGAGAAGAAAGCTA
AAGCTTGGTGTGCTTCTAAGGGAAACATCCCTTATTTTGAGACATCTGCTAAAGA
```

> SEQ ID NO:603  135281   127764_300472_1
```
ttactttactCTCTCTGTATTTGTTCTTCTTAAAAATCCCTTTTACAGAAAACCCAAAAGTAGTGCAAAAATTG
AGAATTAATGGCAAATCTAGGAGGAATTCGTGAGGCAGGAGGATCTGAGAACAGCCTTGAGATCAATGATCTTGC
TCGCTTTGCTGTTGATGAACACAACAAGAAACAGAATGCACTTCTGGAGTTCGGAAAGGTTGTTAATGTGAAGGA
ACAAGTGGTTGCTGGAACCATGTACTACATAACACTGGAGGCAACTGAAGGTGGTAAGAAGAAAGCATACGAAGC
CAAGGTCTGGGTGAAGCCGTGGCAGAACTTCAAGCAATTGGAAGACTTCAAGCTTATTGGGGATGCCGCTAGTGC
TTAACAAGTGCTAAATGAATGCATCTTATGCTTGTGAAAATAAAGGTAACATAGTTTCGCTTGCGAGTATTTGAA
TATCGTAAAGTAAGCTTTAAACTATGTCGTAGTGtTAAGTTACAAGTAACTGTAACTTTACAATGTTCCATATTT
CATATTATATGGTCCTCCATATGATAGTtCTATGAT
```

> SEQ ID NO:604  135281   317344_301481_1
```
ttcgcattattatgcAtgtcgaGCGACGGAGGGCCGGTGCTTGGCGGCCtCGAGCCGGTGGGGAACGAGAACGAC
CTCCACCTCGTCGACCTCGCCCGCTTCGCCGTCACCGAGCACAACAAGAAGGCCAATTCTCTGCTGGAGTTCGAG
AAGCTTGTGAGTGTGAAGCAGCAAGTTGTCGCTGGCACTTTGTACTATTTCACAATTGAGGTGAAGGAAGGGGAT
GCCAAGAAGCTCTATGAAGCTAAGGTCTGGGAGAAACCATGGATGGACTTCAAGGAGCTCCAGGAGTTCAAGCCT
GTCGATGCCAGTGCAAATGCCGCGGCCGCTTATCCGTATGATGTTCCGGATTATGCCGAGCTCTACAAACAGCTG
TTGAATTTTGATTTGCTGAAGTTGGCGGGTGACGTGGAATCTAACCCTGGTCCTAGGTCTAGAATGGCTACTTTC
TCTTGTGTGTGTTGTGGTACCTTAACTACAAGTACTTACTGTGGTAAGAGATGTGAGCGAAAGCATGTATATTCT
GAAACAAGAAATAAGAGATTGGAACTTTACAAGAAGTATCTATTGGAACCGCAAAAATGCGCC
```

> SEQ ID NO:605  135281   145322_301059_1
```
GAAACCGGAGGAGGATTTTGCGGTGAAGAGGAAGAGAAAGGAAATAATCTGATTGAGATGGCTACTCTTGGTGGG
GTTCGTGATTCGCATGCTTCGTCCCAGAACAACGACGAGATCCATAACCTTGCCAAATTTGCAGTCGATGAGCAC
AACAAGAAGGAGAATGCGATGATTGAATTGGCCAGAGTTGTGAAGGCGCAAGAGCAAGTTGTTGCTGGTACACTG
CACCATCTGACTCTTGAGGTCATAGATGCTGGAAAAAAGAAACTCTATGAGGCTAAGGTCTGGGTCAAACCATGG
TTGAATTTCAAGGAACTTCAAGAGTTCACTCATGTTGAAGATGTTCCTACCTTAACTTCTTCAGATCTAGGTGTT
AAGCAAGAAGAGGAAGGCTCTGGATTGAAGTCAGTGCCTGTGCATGATCCGGTGGTTCAGGAAGCTGCAGAGCAT
GCAATTAAGACCATCCAGCAGAGATCCAACTCGCTACTTCTGTATGAACTCCAAGAGATTGTTCATGCAAATGCT
GAGGTCATTGGGGAGGACAATATGAAGCTTCATATGCTCATCAAAACTAGCCGGGGAGGGAAGCGAGAAAAGTTC
AAAGTTCAAGTGCACCATA
```

> SEQ ID NO:606  135281   138595_300774_1

Figure 2 continued

```
cccccccccgatcgagtcgCCGGATTGGTAGCCGCCCTGCTCGTGCTGCATTCGCTAGCCACGCCGTCCGCTCAG
GCCGAGGCGCATCGCGCAGGGGGAGAAGGGGAGGAGAAGATGTCGAGCGACGGAGGGCCGGTGCTTGGCGGCGTC
GAGCCGGTGGGGAACGAGAACGACCTCCACCTCGTCGACCTCGCCCGCTTCGCCGTCACCGAGCACAACAAGAAG
GCCAATTCTCTGCTGGAGTTCGAGAAGCTTGTGAGTGTGAAGCAGCAAGTTGTCGCTGGCACTTTGTACTATTTC
ACAATTGAGGTGAAGGAAGGGGATGCCAAGAAGCTCTATGAAGCTAAGGTCTGGGAGAAACCATGGATGGACTTC
AAGGAGCTCCAGGAGTTCAAGCCTGTCGATGCCAGTGCAAATGCCTAAGGCCCATCTCGTATCCTATGTGTATCA
AGTTATCAAGAAGATGGGGAATAATATGGTGTGGATATAGCTATTGGACATGTTAATTATCCACATGATAATATG
GCTTGGATATAAGGATCTCACACGATAATATGGCTTGGATATATAGCTATTAAAGATTTTACCTATGGCATATTT
CAATGTGTATTAGTACTAAGTAAGAATGATTGCAAGGTGTATTAACTACAAATATTGCAATAAAAGTCCCTgttA
CTAc > SEQ ID NO:607 135357 251319_301656_1
AGCGCTACTGCCGCGTTGATGTCTTTGCTGTGTGCAGCGGCATCGAGCGCTAGGGTGTCTTTGCGGTGCTTGGCG
ACGAAGGGCCAGGGCGAGCAGCTACCGATGGCGCAGCTCAAAGAAATCGCCAAGAACAAGATGTTTGATGGATTT
AATCGCCGGTTCCAGCACCAGAGCAGCTCCTGTGGTTGTAACATGAATTTCACGGTCTATTTCCCTCCAGCTGCG
GATCATAAAAAAGTTCCAGTTCTTTACTGGCTTTCGGGACTTACATGCACAGATGATAACTTTATCCAAAAATCT
GGAGCACAGCGTGTTGCTGCTGCCGAGGGAGTAGCAATTGTTTGTCCTGATACTTCTCCTCGTGGATTAGGAGTT
CCAGGAGAAAGTGATAGCTGGGATTTTGGTGTACGAGCCGGTTTTTATCTCAATGCAACTCAAGAGAAATGGAAG
AACTGGCGAATGTACGACTACTGCACCAAGGAGCTTCCGGAACTCCTCAGCGCCAATTTCGATCAGCTTGACACC
AAGAAGGCGTCAATTTTCGGGCACTCAATGGGAGGTCACGGGCCTTAACTATCTTCTTGAAGAACCCG > SEQ ID NO:608 136729 175449_300542_1
CCCCCCGAACCTTCCAGAAGCTCCAGATTCCAAACCAGCAGGAGTCGCCTCGCCTCCTCCTTCATCCTCCTCGTC
GTCGCCGCGGGGGTCGCCTGAGATCACATTAACAATGGTGAAGGCTGTTGTTGTGCTTGGTAGCAGTGAGATTGT
TAAGGGCACTATCCACTTTGTCCAAGAGGGAGATGGTCCCACCACTGTGACTGGAAGTGTCTCTGGCCTCAAGCC
TGGTCTCCATGGGTTCCATATTCATGCACTTGGTGACACCACCAATGGTTGCATGTCAACTGGGCCACACTACAA
TCCTGCCGGAAAGGAGCATGGAGCACCAGAAGATGAGACCCGCCATGCTGGTGATCTTGGAAATGTCACCGCTGG
AGAAGATGGTGTTGCTAATATCCATGTTGTTGACAGTCAGATTCCACTTACTGGACCAAATTCAATCATTGGCAG
AGCCGTCGTTGTGCATGCCGATCCTGATGATCTTGGAAAGGGTGGGCACGAGCTGAGCAAGACCACCGGAAACGC
TGGTGGCCGTGTTGCTTGCGGGATCATCGGACTTCAAGGCTGAAACCTGGAGGTGTGAACTCACCTTCCATCTCC
CAGCACCAGAAGCCTGAAACTCTACGAGCTCTTAGCCGTTTCGTCTTTACCTGAGTGGCTACtctAGATtctAcA
ATAAGCACCTGATCTCTGcGCATGGTTTTTGGTGTACCATTCTGTCGCCCGCATCGTTggcgcccaatgaactat
gtgttttgtgttaaaccttaagctgaagggtaccatttgtagactcgatgttgctctcttcct > SEQ ID NO:609 136729 3771_300325_1
CTTGATTCTTTCCAAAGGGGTTTCCTGAGATCACAAAGGCCAAGTAACAATGGCGAAAGGAGTTGCAGTTTTGAA
CAGCAGTGAGGGTGTTACGGGGACTATCTTTTTCACCCAGGAAGGCGATGGTGTGACCACTGTGAGTGGAACAGT
TTCTGGCCTTAAGCCTGGTCTTCATGGTTTCCATGTCCATGCTCTTGGTGACACCACTAACGGTTGCATGTCTAC
TGgTCCACATTTCAACCCCGATGGTAAAACACACGGTgCCCCTGAGGATGCTAATCGACATGCTGGTGATCTAGG
AAACATCACTGTTGGAGATGATGGAACTGcCACCTTCACAATCACTGATTgccaGATTcctcttaCTggaccaAa
CtcTA > SEQ ID NO:610 136729 240682_301316_1
TCAGTCGTGTCTGTCATTATTATCGACCACGCGTCGCAATGGCTGGAATTTGTGTAGACGCGCCAGTGCTGTCCA
GAGTTAGGGTTTATCCGGGAGAGCGCAGGCTGGGACGCAGCGCATTCGCAGGGGCGCGAATTGCGCCGGGTAAGA
GGCAGTGGCAGTGCGTCCGTGTCGCCGCTGCAAGGGGAATTGGTGTCACGGCGGAGCTGAAGAAGGCCGTCGCCG
TGCTCAAGGGCTCTGTGGATGGAGTCGTCCAGTTGGAACAGGATGGAGACGGTCCAACGACAGTGAAGGTGAAAA
TCTCCGGACTTACTCCAGGCAAGCATGGCTTTCACATGCATGAATTCGGGGACACAACTAATGGCTGCCTATCTA
CGGGCGCGCATTTCAATCCCAAGAGTATGACGCATGGCGCACCAAATGCCTCGGTCAGGCACGCTGGAGATCTTG
GACACGTTGTTGCGGATGAAAAAGGCAATGTGGACGAAGTTATCGTCGATTCTCAGATCCCATTGTCGGGTCCGA
ACTCGGTCATCGGAAGAGCACTCGTAGTTCACGAGCTGGAGGACGACCTCGGGAAAGGCGGACACGAACTTAGTC
TGTCGACTGGAAACGCGGGAGGTCGTCTCGCATGCGGTGTTGTTGGTTTAACTCCTTGAAAAGAGAGACACAGA
AAGAGAGAGAAGAGA > SEQ ID NO:611 136729 200385_300758_1
GTCATCAGTAGCTCTCCGTTGAACGAAGCAATTGTAAACACCACCGCCAAAATGGTCAAAGCCGTCACTGTCCTC
CGAGGAGACGCCAAGGTCTCCGGCACCGTCATCTTCGAGCAGGCCTCGGAGGGTGCCCCTACCACCATCACCTAC
GACATCACCGGCAACGACGCCAACGCAAAGCGTGGCTTCCACATCCACACCTTTGGTGACAACACCAACGGCTGC
ACCTCTGCCGGCCCTCACTTCAACCCCCTTCAACAAGACTCACGGCTCTCCTTCTGATGAGGCCCGTCACGTTGGT
```

Figure 2 continued

```
GACCTTGGTAACATCGAGACCGATGCTCAGGGTAACGCCAAGGGTACCATCACCGACTCTCTTGTCCAGCTGATT
GGCCCCAACAGCGTCATTGGCCGCACCGTTGTTGTCCACGCCGGCACCGACGATCTCGGCAAGGGTGACAACGAG
GAGTCCCTCAAGACTGGCAACGCTGGCCCTCGTCCTGCTTGCGGTGTTATCGGTATCTCTGCTTAACCTCGTCAA
ATGCACTGTAGCTATGCTTGACCTAAGCTCCTTGCAGATTgAGACAAAATCTATAGAGCGACTGAATTTATGCAG
CTCGGGTCGACataggtTCTaggTACATGTAGTTATAGCAAACAAACAAAtaaacAATTc
```

> SEQ ID NO:612  137131  105469_300368_1

```
CAATTCCTGAAAAGTCCAAAAGATGGCACAATGTGAGAAAAATTTGGAAGCAGAACTGGAAGTACTGAGAGAGAC
ATTTAAATCTGAGAAAACAAGAGAAGAATGTTGGAGAAGATCACAGTTACAAAATTTGCTCAGACTTCTTGAAGA
GAAAGAAGATGATATATACAAAGCCCTTAAACAAGACTTGGGAAAACACCACGTTGAAGCTTACAGAGATGAGAT
TGGAACATTAATAAAATCTGTGAATTATGCACTGGATGGCTTAAAGCAATGGATGTGTGGCAAGAAGGCCAAATT
GCCAATTGCTGCATTTCCTGCTTCAGCGGAGTTGGTTCCTGAGCCTCTTGGTCTAGTCCTCATTATTTCCTCTTG
GAATTTTCCTTTTGGGATATCATTGGAACCACTAATTGGAGCAATAGCAGCTGGAAATGTGGTTGTTTTGAAACC
CTCAGAACAGGCTCCTGCATCATCATCAGTGTTAGCTAAGACAATCTCCACTTACTTGGATAATAAAGCTATTAA
AGTCATTGAAGGTGATAATTCCGTTGGTGACAAACTGTTGCAACAAAAATGGGACAAGATTTTCTTTACAGGGAG
TACAA
```

> SEQ ID NO:613  137131  196522_300704_1

```
gattcacctcatgttctgcttgcaaagtttcaatacactggagTGAGTCAGTGAGGTTGGTGAAGCAGAGTGAGG
AAAGGAGGATGGGAAGGGTGGCGCCTAGCGTCGAGGAGGTCGGGGGCGAGCAGCCGCCGCCCGCGCTTGGGCCCG
GCGAGACCGTGAGCGGGACGGTGGCCGAGCTGAGGGCGGCGTACGAGAGCGGCAGGACGCGGAGCCTGGAGTGGA
GGCAGTCGCAGCTCCGGGGGCTCCTCCGGCTCTTGGCGGAGGAGGAGGCCGCCGCGTTCCGGGCGCTCCGCGAGG
ACCTCGGCAAGCACCAAGCCGAGGCCTACAGAGACGAGATCGGCGTGCTTGTCAAGTCGGCGAACGCCGCGCTGC
GTGAGGTCGGGAAATGGATGGCGCCGGAGAAGGTCTGGGTGCCGCTAATCGCGTTCCCGGCAAGGGCGCAGCTGG
AGCCGCAGCCGCTCGGGGTCATCCTCGTCTTCTCTTGCTGGAATGTCCCGTTGGGCCTCTCTCTGGAGCCTCTCG
TTGGAGCATTGGCGGCCGGCAATGCGGTCGCGCTGAAGCCATCGGAGCTGGCGCCGGCCACCGCTAAGTTCCTCG
GCGACAACGTCGGCAAATACATGGACGCCACGGCCGTGAAGGTCATCCAGGGCGGGCCGGAGGttggcgagcagc
tcatggaacacagatgggacaaggtccttttcaccgggagcccgcgcatcgcgcgcgtcgtgatggcc
```

> SEQ ID NO:614  139377  183150_300619_1

```
ccccgactcacacacacactcctcaTCCCAGAGCAAGAAGCTCAGCTCCTCCTCCTCTCGCATGGCAGCCATGGC
CACCACCGCGTCCAGCCTCCTCAAGACCTCCTTCGCCGGCGTGCGCCTCCCCGCCGCCGCCCGCAACCCCACCGT
CTCCGTCGCGCCGCGCACCGGCGGCGCCATCTGCAACTCCATCTCGTCGTCGTCGTCCACTCCCCCCTACGACCT
CAACGCCATCAGGTTCAGCCCCATCAAGGAGTCCATCGTGTCCCGCGAGATGACCCGGCGGTACATGACCGACAT
GATCACCTACGCCGACACCGACGTCGTCGTCGTCGGCGCCGGCTCCGCGGGGCTCTCCTGCGCGTACGAGCTCTC
CAAGGACCCCTCCGTCAGCGTCGCCGTCATCGAGCAGTCGGTGTCCCCCGGCGGCGGCGCGTGGCTCGGCGGGCA
GCTGTTCTCCGCCATGGTGGTGCGCAAGCCGGCGCACCTGTTCCTCGACGAGCTCGGCGTCGCGTACGACGAGCA
GGAGGACTACGTCGTCATCAAGCACGCCGCGCTCTTCACCTCCACCGTCATGAGCCGCCTCCTGGCGCGCCCCAA
CGTGAAGCTGTTCAACGCCGTCGCCGTCGAGGACCTCATCGTCAAGGAGGGCCGCGTCGGCGGCGTGGTCACCAA
CTGGGCGCTGGTGTCGATGAACCACGACACGCAGTCGTGCATGGACCCCAACGTGATGGAGTCCAGGGTGGTGGT
GAGCTCCTGCGGCCACGACGGGCCGTTCGGCGCCACGGGCGTCAAGCGGCTGCAGGACATCGGCATGATCGACGC
CGTGCCCGGCCATGCGCGCCCTCGACATGAACACCGCCGAGGACGAGATCGTCCGCCTCACCCGCGAGGTCGTCCC
CGGCATGATCGTCACCGGCATGGAGGTCGCCGAGATCGACGGCGCCCCGAGAATGGGCCCGACGTTCGGAGCCAT
GATGATCTCCGGCCAGAAGGCGGCGCACCTGGCGCTGAAGGCGCTCGGCCGGCCGAACGCCATCGACGGCACGAT
CAAGAAGGCGGCGGCGGCGGCGGCGGCGCACCCGGAGCTGATCCTGGCGTCGAAGGACGACGGCGAGATCGTGGA
CGCCTGAGCGAATAGAACAGGGTAAAAAAAAAATCCGCAAGACGTGGTGGTGACACGGAGGCGTTGGGGACGAGAA
GAAGATGTGGACTTTCCCCTGTGTTTTTTTTTCGGGATTTGCTTTGATCCCCTTGTTTGTTTTAGCTCTGGATG
TTGATTAGCGTCTTGTTCATAGCAATTCCACTGCCACCGTGTGTGTGTGCTCTGCTTGCCTGATGAGGGCAAGAA
AACTTCCATGGATCCGTCTCTCTGGGAGGAATGAATAAAAAGGATGAGGAAATAAAAATGATTCAGTGCCATT
```

> SEQ ID NO:615  167904  181183_300654_1

```
gaattctcagaaaccctaaaagctttctcctccaagaatcgaaaccccaaaatttctaatccccaatgtaaggttt
ccgagAATACGTGCAGAATCGCAAACAGTTGACCAAGCAGCTCCATTAACAGGTAATAAACCTTCTTCCTCTAAC
GATGCAATCGATAAATTTCTTAAAAGAGATTATAAATGGGGATTTGTATCGGATATTGAATCTTTTTCAATACCT
AAAGGGTTATCAGAAGAAACAGTTAGaTtTATATCTGCGAAAAAACAAGAGCCTGAATGGATGCTTGAATTTAGG
TTAAAATCTTATGAAAAGTTTTTGAAGATGAAAGAACCTAATTGGTCTGATAATAGGTATCCAAAAATTGATTTT
CAGAATATGTGTTATTATTCAGAACCAAAGAAGAAACCCACTTTGAAAAGTTTAGAAGAAGCTGATCCTGAGCTT
CTTAAATATTTCGAAAGGTTAGGGGTTCCATTAACTGAGCAGAATAGGTTAGCTAATGTTGCTGTTGATGCAGTA
TTTGATAGTGTTTCCATTGCAACCACGCATAGGAAAACTTTAGAAGCTAAAGGTGTAATTTTTTGTTCAATATCT
```

Figure 2 continued

GAagcACTTAGAGAATACCCAGATTTAGTCAAGAAATATTTAGGTAAAGTTGTTCCTTCTGaggATAATTACTAT
GCTGCACTGAATTCTGCTGTGTTTantGATGGATCATTTTGTTATATcccgaagaatACAGTTTGCCCAAtgcCA
ATTTCAACTTATTTTCGAATAAACGCTATGGagaCcggACAATTTg > SEQ ID NO:616    168371    142215_300433_1
CCCTGGGGGGAAGAAATCAAGAACGGAGAGGAGGGACCGGACATGGCTGCACCGGGCGAGGAGGAGCAGGAGCAG
GGGAGGAAAGGCATCCCGTCTCTGCTCTCCTCCAGGGAGGAGAACATCGCCTCTAACATCACTCAGCTGATTGGA
TGGACACCGCTTGTTGAGATGAAGAACATCGCGAAGAACGAAGGCGTACAGGCTCGATTGGTTGGGAAGATGGAA
GCATACCAGCCACTCTGCTCTGTCAAGGACAGGAGTGCCCTCAGAATGATTGAAGATGCAGAGGAGAAAGGGTTG
ATCACACCTGGTGTTACCACGCTGATTGAGCCAACGAGTGGTAATCTCGGTATCGGTTTGGTGCTGGTTGCTGTT
CAAAAAGGCTACAGGTTTATTGCTGTCATGCCTGCTAAATATTCGCTTGACAAGCAGATGCTACTGAGGTTTTTG
GGTGCTGAATTGATATTGACAGATCCTGCAATTGGGTTTAATGGTATGATGGACAAGGTGGAAGAGCTCATGAAG
AGCATACCAAATTCTCATTGTCTCAATCAAGTAACAAACCCAGCAAATCCAGAGGCACACTTTATGTGGACTGGA
CCTGAAATATGGAAAGACACAGC > SEQ ID NO:617    168371    230788_301071_1
CCACGCGTCGAAGAAAAGAATGGCGACTGGCGCTGCTGCCGCGGGTGGAATCAGCGTGGTTCTGGGAAATGCCGG
GTGCGGCAGGAGAGAGCCAGCGATCGCGGTGGCGATGCAGCGCCGGATGGTCCCGTCAATGCTCCGGATCCAGCG
AGGGAAGATTGTGACGTCGCCCAGGGCGAGGATTGCGATCTCGGCTGTCTCTACAGAGGTCCAGCAATAGGCTGG
CGATGCTGAGCCGGAAGAGGGGCTCAACATCGCGGAAGACGTGACTCAGCTCATCGGGAAGACGCCTATGGTCTA
CTTGAACAGTGTCGTCGATGGTTGTGTTGCGAAACGTCGCTGCCAAAGCTGGAAATCATTGGAGCCATGCTGTAG
CGTGAAAGATCGGATAGGATACAGCATGATCTCTGATGCCGAAGAGAAGGGAGCAATCACTCCCGGCAAGAGTGT
ACTGGTAGAGCCTACCAGTGGCAACACGGGAATTGGACTGGCATTCATAGCTGCGGCGAAAGGTTACAGCTCATT
CTAACCATGCCTGCGTCCATGAGTCTCGAGAGGCGTATTTTACTGAAGGCATTTGGTGCTGAGCTTGTCC > SEQ ID NO:618    168371    246525_301614_1
GTCTGGAAAGAAAAACTCGCCATGGCTAATCCATTCTTCTCGATTGGGGAATGCGATGGAAAGGAGAGGATCCTT
GGCAGTGCTGCTGAGCTTATTGGATGGACTCCTCTGGTGGAAACGAAGAGGATCTCTGCCAGGGAAGGAGCTCTT
GCGAGAATTATCGTCAAGTTGGAAGGATATCAACCTGGATGCTCTGTCAAAGATCGCATAGCTCTCTCGATGATT
GTCGATGCCGAGAACAAAGGAATTCTCGTCCCCGGTGTCTCCACCATCGTGGAGCCGACGAGCGGCAACACCGGA
ATCGCTCTGGCACTCGTCGCCGCGCTACGAGGATACAAAGTCATCGCACTCATGCCTTCGACCTACTCGATGGAG
CGCCGAATGATCCTCAAAGCCTTTGGAGCTCAGATTATCCTCACAGATCCTTCTCTAGGATTACCTTACCTGTTC
GGCAAAGCTCGGGAGATGTCCACAACACTTCCAAACGCTTGCATGCTGGATCAAACTCAGAATCCATGCAATCCT
CAAGCTCACTTCGTCAGCACAGGTCCGGAGATCTGGCAAGACACCGCAGGCAAAGTTGATATCTTCGTCTCTGGC
TGCGGAACGG > SEQ ID NO:619    168371    272277_200042_1
TTAATGGCGGCTTTAAGCAGATTGTTGAAGAGATCAAGATACTGTAATAGTAATGTTGGTTTATCACCGAATGTT
TTCTACTCAGTCTTTAGTTCCTACTCCCAAATTACAACTTCCTCTTACTCACATCAAGACTCAAGTTTCTCAACT
AATTGGAAAAACACCAATGGTTTATCTTAACAAAGTGACAGAAGGATGTGGAGCTCACATAGCTGTGAAACAAGA
GATGTTTCAACCTACTTCTAGCATCAAAGACAGACCAGCGTTGGCAATGATGAATGATGCAGAAAAGAAAGGCTT
AATATCGCCTGAAAAAACGACATTGATTGAGCCAACATCGGGAAATATGGGGATCATTATGGCATTTATGGCAGC
AATGAAAGGCTACAAAATGGTTTTGACAATGCCCTCATACACAAGCTTGGAGAGGAGAGTGACAATGAGAGCATT
TGGAGCCGATTTAGTCCTCACTGATCCAACCAAAGGAATGGGAGGCACTGTTAAGAAAGCTTATGACCTTTTGGA
ATCTACACCTAATGCCTTCATGCTTCAACAGTTNTCTAATCCTGCAAACACTCAGATTCATTTTGAGACGACTGG
TCCTGAGATATGGGAGGAAACACAGGGTAATGTCGACAT > SEQ ID NO:620    168371    265560_200112_1
gcgcccacgcgtgcggcgggagaaaagaatggaattgcgaaggatgtaactgaattgatcggaaacactcctttg
gtgtaCCTGAATAATGttgagGATGGGTGtgttgcTCgCGTTGCTGccAagctcgaAAGCATGGaGcCATGCTct
aGtgttaaggATaggataggTtATAGTATGATTACAGATGCTGAGGAGAATGGCCTGATCAAACCTGGCGAGAGT
GTCCTCATTGAACCTACAAGTggaAACACTGGAGTAGGATTGGCATTTATGGCTGCTGCTAAAGGATACAAACTC
ATCATAACGATGCCTTCTTCAATGAGTCTTGAGAGGAGAATTATTTTGCGTGCTTTTGGTGCTGAGTTGGTGCTT
ACTGATCCAGCAAAAGGGATGAAAGGTTCTATTCAGAAGGCTGAAGAGATTAAGGCCAAAACACCTAACTCCTTT
ATTCTTCAGCAATTTGAAAACCCTGCAAACCCAAAGGTACACTATGAGACAACTGGTCCTGAGATCTGGAAAGGC
TCAAACGGGAAAGTAGATGCTCTCGTCTCTGGAATTGGAACAGGAGGCACAATAACAGgttCAGGCAAGTATTTA
AGagagcagAACCCCCATAAAGCTCTATGgtgtgGAACcagttGAAAgtgCTATTCTTTCTGgaggaAatcctgg
tccgCATa

Figure 2 continued

> SEQ ID NO:621  168371  233267_301088_1
tcaagAGGTTGCCAAGGGTCACGAATTCCAGTCCATGGACGCTGGGCTCAAGTCGCTGGGCATGGATGGCGCCGC
CAAGCCCGGGGTTTTGCGCCGCCGCGCATCGCCCGAGCTTCGATCGGACTTCTCGGGAGGTAAGCTCAGCGCCGG
GCTGGCCAAAGATCCGGCGCTCAAGGATGGCGAATTGTCTGGCGTCAATATCGCTGAGGATGTCACACAGTTGAT
TGGAAAAACTCCAATGGTCTATCTCAACAGCGTGGTGGAAGGATGTGTCGCAAACATTGCTGCGAAGCTGGAGAC
CATGGAGCCATGCTGCAGCGTGAAAGATCGTATTGGCTTGAGCATGATCGCCGACGCCGAGGCCAAAGGAGCCAT
TTCTCCTGGAAAGAGCGTCCTCGTGGAGCCTACGAGCGGCAACACTGGAATTGGTTTGGCATTCATCGCTGCTGC
CAAGGGCTACAAGCTGATCCTCACCATGCCGGCGTCCATGAGCATGGAACGTCGAGTTCTACTCCGCGCCTTCGG
TGCCGAGCTCGTCGTCACCGATCCTGCCAAAGGAATGAAAGGAGCCGTTTCCAAGGCCGAAGAGATCGTCAACAA
GACACCAAACGCATACATGCTTCAGCAATTCGAGAATCCTGCTAATCCGAAAATCCATTTCGAGACCACTGGACC
CGAGATCTGGGAAGATACACGCGGAAAAATCGATATCCTTGTTTCAGGAATTGGAACCGGTGGTACCGTGACTGG
TGCCGGACGGTTCCTCAAGAGCAAGAACCCGAATATCAAGCTTGTTGGTGTGGAGCCGACTGAGAGCAATGTCtT
GTCCGGCGGGAAACcaggggcTCACAAGATTcaaggAATGGGAGCTGGATTCATACCCGGCATCTTGGACGTCGg
aattcttGACGAGGTGGTGGAGATATCCAGCAACGAggcagtaGagatggcgaagCAGCTCGCgctccaggaagg
ccTGcttgttggcATCTcgTCGGGagctgcT > SEQ ID NO:622  168371  145530_301060_1
attgtatctagcctgaaaaagagggaagaTAGAGATAGCTTGAGCAAATAGCAATGGCGACTTTCATCAACAATC
CCTTGACTTCACTCTGTTCCAACACCAACAAGTCTGAAGCTAATCTCTTCAGAATTTGCCCTTTAAGGGCTCAGA
CTTTGGGGATTTCCAAGTTTATCCCCAACAGAAAGGTTACTTTCCCTTCTATTGTTTGCAAAGCAGTGTCTGTGC
AACCAAAATCAGCCACTGAAGTTGAAGGACTTAACATCGCTGAGGATGTTACTCAGCTTATTGGGAACACACCAA
TGGTTTACCTTAATACAATCGTTAAAGGTTGTGTTGCAAACATTGCTGCTAAACTTGAGATTATGGAGCCATGCT
GCAGTGTCAAGGACAGGATAGGGTTCAGTATGATATCTGATGCTGAGGAAAAGGGACTTATATCTCCGGGGAAGA
CTGTTCTAGTGGAACCTACGAGTGGAAACACAGGCATTGGGCTTGCCTTCATTGCTGCTTCCAGAGGATACAAGC
TCATCTTAACGATGCCTGCTTCAATGAGTCTTGAAAGAAGGGTTCTTTTGAAAGCTTTTGGAGCTGAACTTGTTT
TAACTGACCCAGCCAAAGGGATGAAAGGAGCTGTTTCAAAGGCTGAAGAAATATTGAATAACACACCAGATGCCT
ATATCCTTCAACAATTTGACAATCCCGCAAACCCCAagaTACACTATGAAACAACGGgCccagagatctggGaag
atacaaaaggcaagatagacatACTtGttGC > SEQ ID NO:623  168371  182417_300710_1
GAATTCAGAGAAAGGAAGAATCGCTAAAGATGTTACTGAATTAATCGGAAACACCCCATTGGTCTACCTCAACAA
TATTGTTGATGGATGTGTGGCCAGAGTTGCTGCGAAGCTGGAGATGATGGAACCTTGCTCCAGTGTTAAAGACAG
GATTGGGTACAGTATGATCACTGATGCAGAAGAGAAAGGCCTTATTACCCCTGGGCAGAGTGTCCTCGTTGAGCC
AACCAGTGGTAACACTGGCATAGGGTTAGCCTTCATGGCTGCTGCTAAGGGTTACAGGCTCATCATTACCATGCC
AGCTTCAATGAGTCTTGAGAGAAGGATCATCCTCCGAGGTTTTGGTGCTGAGCTGGTCCTTACTGACCCAGCAAG
GGGTATGAAAGGTGCAGTCCATAAGGCCGAAAAGATAATGGCAAAAACCCCTAATTCATATATTCTTCAGCAGTT
TGAAAACCCAGCCAACCCAAAGATTCACTATGACACAACTGGACCAGAGATCTGGAAAGGCTCTGGAGGCAAATT
TGATGCCTTCGTGTCTGGAGTTGGAACTGGCGGGACCATAACAGGTGCAGGGAGATACCTCAAAGAGCAGAAGCC
TGAAATCAAGCTTA > SEQ ID NO:624  171278  103467_300026_1
TGGTATCAACGCAGAGGGCATTACGGCCGGGGAGCTTATAGCTCCTTTTACTTGTTATTCTATCACAAATCAAAT
CACAAAATACCCTGTTCGGTTGCAAGGCATCGATCACTCTAGATCGATGCCTGAAATCGAACAATTTTCCGAGGC
CACGGCCCCTTCAGAGAGTTGCCTATTTGGTAAATATGAGCTCGGAAAGTTACTTGGGTGTGGTGCATTTGCCAA
AGTGTACCACGCTAGAGACATCAGAAATGGCCAAAGCGTTGCAGTCAAAGTTATCAACAAGAAGAGAATTGCCAA
TCCGACTTTGATTACAAACGTCAAACGTGAAATCTATATTATGCGTCGATTAAGTCACCCCCATATAGTCAAACT
GTTCGAAGTTCTTGCGACAAAAACAAAGATCTATTTCATCATGGAGTTTGTCAAAGGAGGTGAATTATTCAGCAA
AATTTCCAAGCTGGGTCGGTTCAACGAAGATCTGAGCCGCAAATATTTCCAGCAACTCATATCAGCCGTACGATA
TTGTCATTCTCGTGGGGTGTACCATCGTGATTTGAAACC > SEQ ID NO:625  171278  284694_200100_1
GTTAAAGGGGGTGAATTATTTGCAAAAATAGCCAAAGGCAAGTTGAGGGAAGATGTGGCTAGAGGCTATTTCCAG
CAATTAATCTCGGCGATTGATTTCTGTCATAGCCGTGGTGTTTATCACAGAGATCTAAAGCCTGAAAATTTGTTG
TTGGATGAAGAAGGAAATCTTAAGGTAACAGATTTTGGGCTAAGTGCATTTACTGACCATTTAAGACAAGATGGG
CTATTACATACTACATGTGGAACTCCTGCTTATGTTGCTCCTGAAGTGATTGGTAAAAAGGCTATGATGGTGCA
AAAGCTGATATTTGGTCATGTGGTGTAATTCTTTATGTCCTTTTAGCTGGGTTTTTACCATTTCAAGATGAAAAT
ATTATGGCTATGTATAAAAAAATTTATAGGGGTGATTTCAAATGTCCACCTTGGTTTTCATCAGAGGCTAGAAGA
TTAATCACCAAGATGTTGGATCCGAATCCAAATTCAAGAATCACTACTTCTAAGATTATGGAGTCAACTTGGTTT
AAAAAAATCACTGCCAAAGATTTTAAGAACCAAAGAGGAGGAAGAATTTTCTATAGGAGATGATATAAATTGTGTC

Figure 2 continued

GAAAAGGCTAAAGATCTCGAGACATTAAATGCGTTTCATATCATTTCTTTATCAGAAGGTTTCGATTTATCGCCA
TTATTTGAAGAGAAGAAG

> SEQ ID NO:626 171278 284568_200099_1
AAAAATTCAGTAAGTCAATATACTCAAGACTTGTCTGAATTCTGAAGAATCTGAGATTAAACCCCTTTTCCCTTG
ATTATGGAGCGTTATGAGATAGTAAAGGAGTTGGGTTCTGGTAATTTTGGGGTAGCCAAGCTTGTTAGTGACAAG
AAATCCAAAGAGCTCTTTGCTGTCAAGTTTATTGAAAGAGGCCACAAGATAGATGAACATGTGCAAAGAGAAATT
ATGAATCACAGATCATTGAAACATCCAAATATAGTCAGATTTAAAGAGGTCTTGCTGACACCTACTCATCTAGCT
ATTGTAATGGAGTATGCTTCCGGAGGAGAACTCTTTGCCAGGATCTGTAGTGCTGGAAAATTTAATGAAGATGAG
GCAAGGTTCTTCTTTCAACAACTGATATCAGGGGTTAGCTACTGCCATTTCATGCAAATCTGTCATAGAGATCTC
AAACTGGAAAATACTTTACTAGACGGAAGTGCTGCACCGCGTGTCAAAATATGTGATTTTGGATACTCCAAGTCA
ACTATCTTTCATTCTCAACCTAAGTCCACTGTAGGGACGCCTGCTTATGTAGCACCAGAAATCCTAACAAAGAAA
GAATATGATGGGAAGCTTGCAGATGTTTGGTCATGTGGAGTCACATTATATGTAATGTTAGTTGGAGCTTATCCA
TTTCA

> SEQ ID NO:627 171278 280969_200070_1
GAAAAATACCATTGATTCTCTGGTTTTTTCCTGTAAACCCTAGCTAAAAAATACCTTAATTCTCTTTCGGGAATG
CAGAGAGATGAGAGGTTATCGGTTTTCTGATTCCCTTTTGACTGCCGGAGAAATCCAAAAACCAGTCGCCGGCGG
CAGGAATTGCCACCGGAAACACGTAGAAGACGGGTGAACCAATCACCCGTTTTCCCCCCTTTCTGTCAACCATTT
CCATTTTTCTTTACAGAAACAGACACCCTTTTTAATCTTTAGCCTCTTTTTTTACAAATTCAACCAAAATCTTTC
TCTGTTCCAAAAAATGGCACCTGAGGAAAAATGCATGGCTTTGTACGGTAAATACGAGCTCGGCCGCCTTTTAGG
CCATGAACTTTTGCTAAAGTTTACCATGCACGTAACGTGCAAAATGGCAAAAGTGTGGCTATGAAAGTTGTGGG
CAAAGAAAAAGTGATTAAAGTTGGTATGATGGATCAAATCAAACGAGAAATCTCGGTTATGAAAATGGTAAAACA
CCCAAATATCGTTGAGCTTAACGAAGTCATGGCGAGTAAAACAAAGATTTACTTTGCCATGGAGTTC

> SEQ ID NO:628 171278 270976_200129_1
ctcaaacatagcctttcgtattcagcttctcatatactcttcgatctgaatagtttattataatatttgagttct
ctttaATCTTTTTTAATCTTTTTATTTTGGAAAAGTTTAAGATGAGTGTATCCAAGTCCCAGGTTTGGCAACCTT
GTAAAAGAAGAGGATTTAGCTTAAGGCTTAATCCAGAAGTAAAAAAAATAAAAGAAGATTTTTTTATAGGGAAG
AAAAAAAAGAGGATGGTCTTTGTATTGATTTAGGGTAGGGATTTAATAAGATTGTAGGATCTGTAAGAAATAGAA
AGTTTGGAGATAGATGGGTTCAAGATCAAATAATGGAAGTGGGAGGACTacaGTGGGAAGGTATGAGATAGGGAG
GACAGTTGGGGAGGGTACTTTTGCAAAGGTCAAATTTGCAAGGAATGTTGAGACTGGTGATAATGTTGCCATTAA
GATTCTTGATAAAGAGAAGGTCATGAAGCACAAGATGATCGGCCAGATTAAACGGGAAATATCAACGATGAAACT
TATAAGACACCCCAATGTTATCCGAATGTATGAGGTCATGGCCAGCAAGACaaAGATATATATTGTTTTGGAATT
TggtACTGgtgGcgAACTGTTTGACAAAATTTCTAGTAGAGGTAGGCTCAAAGAAGATGAAGCAAGAAAATACTT
TCAGCAACTTATAAATGCAGTTGACTACTGTCATAgtaGAGGTGTATTCCACAGAGATCTCAAGCCTGAAAACTT
GTTGCTGGATGCGAATGGTGTTCTTAAAGTTTCagATTTTGGACTGagTGCGCTACCctcagcaagttCGCgAaGA
TGGACTACTACATACAACATGTGGAACACCAAATTaTgTGGCCCCCGAggTGATCAACAATAAAGGTTATGATGG
AGCTAaggCtGACCTGTGgtcatGTggtgtaATCCTTTTt > SEQ ID NO:629 171278 255867_301645_1
GTAAAACGTAGAAAGGTGCTGTAGCATAGTCTGTGCTTTCCCCTCTTTTCCCTTCCTTCCTTCCTTCCTTCCAAG
TGCGAAGAACGGAGAAGGAGTTTGCCTTTCATCTTGGTGAAAACCCGGTGCTGTAAGAACAACGAGTGATGAGTC
TGCAGAGTGTGCGGACGAGGGTTGGGAAGTATGAGCTGGGGCGAACCCTGGGGAGGGGACCTTCGCAAAGGTCA
AGTTTGCACGGAATATGGAGACAGACGAAAGTGTGGCCATCAAGGTCATTCTCAAGGATAAGATCCTCAAACACA
AGATTGCCGAACAGATAAAGCGTGAAATATCAATCATGAAGCTGATAAACCATCCAAATGTTGTTAATTTGCACG
AGGTGATGGCGAGTAAAACAAAAATCTATATTGTTCTTGAGTTTGTTAATGGAGGCGAATTGTTCGATAAAATTG
TCCATCAAGGGAAACTCAAAGAAGATGAAGCCAGAAGGTATTTCCAACAACTTATAAATGCGGTGGATTTTTGCC
ACAGCAGAGGAGTTTGTCATAGAGATTTGAAGCCAGAAAACCTGCTTCTAGATGCACGAGGCACTCTTAAGATTT
CAGACTTTGGT > SEQ ID NO:630 171278 255757_301643_1
TAGATATAGTAGTACTGTGGGAATACCCATCTTCTCTCATAAAGTGAACCTGAACCTGAAGGCCATAGTTGGACC
CTGTGCTAAGTAAGGAAGCATGGATCGTTATGAGGCAGTGAGAGATATCGGGGTTGGTAATTTTGGTGTTGCTAG
ATTGGTAAGAAATAAGAAGACAAAGGAGCTTCTTGCTGTCAAGTACATCGAGCGAGGCCCCAAGATTGATGAAAA
TGTCCAGCGTGAGATCATCAACCATCGCTTGCTCCGCCATCCCAACATTATTCGCTTCAAAGAGGTTTGCTTGAC
TGCCACTCATTTGGCCATCGTTATGGAATATGCAGCGGGTGGTGAGCTTTTTGAACGCATTTGTGATGCTGGGAG
GTTCAATGAAGATGAGGCTAGGTTTTTCTTCCAGCAGTTGATATCAGGGGTTAGCTATTGCCATGATATGCAAAT
ATGTCATCGGGATTTGAAACTTGAGAATACTCTACTGGATGGGAGTCCTGCTCCTCGGCTGAAGATATGCGACTT

Figure 2 continued

TGGCTACTCAAAGTCGGCACTCTTGCATTCTATGCCAAAGTCCACGGTTGGAACACCGGCCTATATTGCCCCAGA
AGTTCTTTCTAGAAAAGAATACGATGGCAAGCTTGCAGATGT

> SEQ ID NO:631 171278 248233_301581_1
gggtagtaGCGGGAATGTGCTGGATCGTTTAGCTGGGGCTTGGAGAGGCGATGGATCAGGAGCAGCAGCTGGCGC
AGCAGCAGCCGGCCAGGAGGAATGAATTCCTGCACTACAAGCTCGGCAAAACTCTGGGCATTGGATCGTTTGGCA
AGGTGAAGATCGCGGAGCATATACTCACCGGGCACAAGGTCGCGATCAAGATCCTCAACCGCAGGAAGATCAAAG
CCATGGAAATGGAAGAGAAAGTTCGCAGAGAGATTAAAATCCTGAGGTTGTTTATGCATCCACACATCATAAGGT
TGTATGAAGTTGTGGAGACGAGCACAGACATTTACGTGGTCATGGAGTACGTCAAGTCGGGAGAGCTCTTCGACT
ACATTGTTGAGAATGGTCGGCTTCATGAAGATCAAGCTCGACGTTTCTTTCAGCAGATTATATCAGGCGTCGAGT
ACTGCCATAGAAACATGGTAGTTCATCGTGATCTCAAGCCGGAAAATCTGCTCCTCGACTCCAAATGGAACGTAA
AGATTGCGGACTTTGGCTTAAGCAACATTATGCGAGACGGACATTTCCTTAAAACTAGCTGTGGAAGTCCAAACT
ATGCTGCTCCAGAGGTTATCTCTGGCAAGCTCTATGCTGGACCAGAGGTTGACGTATGGAGTTGCGGCGTTATTT
TGTATGCACTTCTTTGCGGCAGCCTTCCATTTGACGATGAAAACATTCCAAACCTTTTCAAGAAAATTAAGGGTG
GCATCTACACTCTACCAAGTCATCTCTCTGCCGGTGCAAAAGATTTAATCCCGCGtaTGCTAGTggttgatCCCA
TGAAACGGATGACTATAGCGGAGATTCGTGAGCATccttggtTCCAAGTCAATCTTCCTCGGTATCTtgcgGTTc
cgccctggacaccgccgaGCAAGCGAAGCGGATCGATGAAGAT > SEQ ID NO:632 171278 245936_301573_1
ggagctaggggaacgatcacaacTTTGAAGAGATGAGCTTCCAAAGCAAAGTGATGAGAACTCGCGTCGGGAAGT
ACGAGCTGGGAAGAACTCTTGGAGAGGGGACGTTTGGCAAAGTTAAGTATGCCAGGAACTTTGAGAGCAACGAGA
GTTTTGCGATCAAGATTCTGGACAAGGAGAAGATCTTGAAGCACAAGATGGTCGAGCAGATCAAGCGAGAAATCT
CCACTATGAAGCTGGTGAAACATCCCAACGTCATCCAGCTCTTTGAGGTCATAGGCAGCAAAACGAAAATTTATA
TGGTGATGGAGTATGTCACAGGTGGAGAAATGTTTGACAAAATTGCACGCGAGGGAAAGCTAGATGAACATAAAG
CTCGAAAGTATTTCCAGCAATTGATTGATGCCGTGGATTATTGTCACAGCAGAGGTGTTTGTCACCGTGACTTAA
AGCCGGAGAATTTGCTCTTGGATTCAGATGGAAATCTGAAAATCTCGGACTTCGGATTGAGTGCTCTTCCTGAGC
AGTGCCGAAAAGACGGCCTTCTTCATACAACTTGTGGAACACCGAATTATGTAGCACCCGAGGTCGTCAGTGACA
AAGGCTACGACGGTTTCAAAGCGGATATCTGGTCTTgcgGCATCGtcttgtaCGttatcctGGCTGGATAtttgc
catttgacGagccTAAtctggttgcattgtacaaaaagatgcatcgAg > SEQ ID NO:633 171278 238006_301291_2
GAAGTCTGTGGGGAAGAAATCTAGGGTTAGAAGGCCGTGCGCCAGGAAGCGGCCCAAGGGTAGTTAGAACCAGCA
CTTCGCGGCGCACCACTGACGAGTTCTTCGCGACTTTTTTGGTAGCGTATTGGAATTTGGGGCGATTCTAGTTCT
GGCAATGGCGGCAACGCCCAGTGGCCTCCAGACCAGGGTCGGGAAGTATGAGCTGGGAAAGACGATTGGCGAGGG
CAATTTCGCCAAGGTTCGGCGAGCCAGGAATCTCGACACTGGCGAGATCGTGGCGATCAAGGTCCTCAACAAAGA
GGAGGTGATGAAGCACAAAATGGTCGAGCAGCTCAAGCGGGAGATTTCGACCATGAAGCTAGTAAAGCATCCAAA
CATTGTCCAGCTCCACGAGGTTCTGGCCAGCAAAACTAAAGTTTACATCGTTTTAGAGTACGTCACTGGTGGAGA
ACTTTTTGACAAGATCGTGAAACAAACCCGCTTGAAAGAAGACGAAGCAAGGAAGTATTTCCAGCAACTCATCAA
TGCAGTTGACTATTGCCACAGCAGGGGTGTGTATCACCGCGACTTGAAGCCGGAGAATTTGCTTCTCGATAAAAA
TGGAAACTTGAAGATCTCTGACTTCGGTTTGAGTGCGCTTCCGCAACATCTTCGGCCGGATGGTCTACTTCACAC
TA > SEQ ID NO:634 171278 233073_301275_1
AGTTAGAGCTAGAGCTAGAGCTAGGGTAATCGCGGCAGCGGCTAGCTGGGCTTCGCCGGATCCACCGGGTGATGG
CGCTGGACAGGGCGATTTAGGGTTTTATCGGATTGGGCGAAGAACGCGCTGCGATTTCAGGGTAATCGGCCTTGT
TCGTCGCCATGGTGGAAGCTCCGGAGGGGGAAGAGAGAGCTGTTCCGGAGGAGAGGCGATGGAAGCTGGCGGATT
TCGACATCGGCAAGCCGCTAGGTCGCGGCAAGTTTGGCAACGTCTATCTCGCGAGAGAGAAGAGGAGCAAGTATG
TGGTGGCGCTCAAGGTGTTGTTTAAGAACCAGTTACAGCAGTCCCAAGTCGAGCACCAGCTACGCCGCGAGATCG
AGATCCAAAGCCACTTGAGGCATCCAAACATCCTTCGGCTGTATGGATACTTCTATGATCAGAATAGAGTGTACC
TTATTCTAGAGTATGCCGCTAAAGGCGAGCTGTACAAGGAGCTCCAACGGTGCAAAGTTTTCTCTGAGAGGAGAG
CAGCCACTTACATTGCCTCATTGGCGAGGGCGTTAATGTACTGCCACGAAAAACACGTTATTCACAGGGACATAA
AGCCAGAGAATCTTCTAATCGGAATGAAGGGAGAGCTGAAAATCGCAGACTTTGGATGGTCAGTACATACGTTTA
ACCGGAGGCGGAC > SEQ ID NO:635 171278 187385_300676_1
CCCACGCGTCCGGTCAATGGAGGCGAGCTCTTTGACAAGATTGCCGTAAAGGAAAACTCTCTGAACATGAAGGA
AGGAGACTTTTCCAGCAGTTAATCGATGCTGTGAGCTATTGCCATGATAAAGGTGTCTACCACAGAGACCTTAAG
CCCGAAAATGTTCTTGTGGATCGAAGAGGAAATATCAAGATCTCTGACTTTGGCCTAAGTGCTTTGCCTCAACAT
CTTGGGAATGATGGATTGCTGCACACAACATGTGGCAGCCCCAATTATATTGCTCCTGAGGTTTTGCAGAACCGA

Figure 2 continued

```
GGTTACGATGGCTCATTGTCAGATATCTGGTCTTGTGGAGTAATTCTCTATGTAATGCTCGTCGGATACCTTCCC
TTTGATGACCGAAATCTTGTTGTCCTGTACCAGAAGATTTTCAAGGGGGACACTCAAATCCCAAAGTGGCTTTCA
CCTAGTGCACGGGATCTTCTTCGAAGGATTCTTGAACCGAACCCGATGAAGAGAATCAACATAGCAGGGATCAAA
GAGCATGAGTGGTTTCAGAAGGATTACACTCCTGTTGTTCCATATGACGACGATGATGACAATTATCTTGACTCA
GTTCTTCCAATCAAAGAGCAAATTGATGAAGCAAAGCAGGAAAAGCCTACTCATATCAATGCTT
```

> SEQ ID NO:636  171278  186819_300667_1
```
GTTCAACAAAGTTCAGAGAGGAAGACTAAAGGAAGATGCAGCAAGGAAGTACTTCCAACAACTGATTTGCGCTGT
TGACTTTTGCCACAGCAGGGGTGTTTATCACCGTGATTTGAAGCCAGAAAATCTTCTTCTTGATGAGAACAGCAA
TCTGAAGGTTTCAGATTTTGGCCTAAGTGCTCTTGCTGATTGCAAAAGACAGGATGGGCTGCTCCACACAACCTG
TGGCACACCTGCTTATGTTGCTCCAGAAGTGATCAACAGAAGAGGCTATGACGGTGCTAAGGCTGACATATGGTC
TTGTGGAGTGATACTCTTTGTGCTATTGGCCGGCTATCTACCTTTCCATGATAAGAACTTGATGGATATGTATAA
GAAGATTGGGAAAGCAGAATTCAAATGTCCAAGTTGGTTTAATACCGATGTTCGAAGGCTCTTGCTCAGGATACT
TGATCCTAACCCAAGTACAAGGATCTCAATGGACAAAATCATGGAAAATCCTTGGTTTAGGAAGGGTCTCGATGC
AAAGCTGCTCAGATATAATCTACAACCAAAGGATGCAATTCCTGTTGATATGAGCACAGATTTTGACTCCTTCAA
TAGCGCTCCA
```

> SEQ ID NO:637  171278  157349_301737_1
```
AAAGAAAAAAGCCAAAATCTTGTTCGTCAAGCCCAATATGCTTTCCTGAAAAACCAGAAAAGGAAAAATAATGGG
TTGAAGAAATTTGGAAGAAGAAGAAGAAGAAGAAGAAAAACGGTGTCGTGTTTGGTAGGAAAGATGGTGATAAGG
AAATTAGGCAAGTATGAAGTAGGGAGGACAATAGGGGAAGGAACATTTGCCAAAGTTAAATTTGCACAGAATACG
GAAACTGGTGAAAGTGTTGCAATGAAAGTCCTCGATCGTAGTACTATCATCAAACACAAGATGGTTGACCAGATA
AAGCGGGAGATATCGATAATGAAGCTTGTTAGACATCCATATGTAGTTCGATTACACGAGGTTATAGCAACCCGC
ACTAAGATCTATATTATCTTGGAATTTATTACAGGCGGTGAACTGTTTGATAAAATAGTTCACCTTGGGCGATTA
AGTGAAGCCGAGTCCCGTAGATACTTTCAGCAATTGATTGATGGAGTGGATTATTGTCACATCAAAGGAGTCTAT
CATAGAGATTTGAAGCCTGAAAATCTTCTGCTAGATTCCCAAGGAGATCTGAAAATATCA
```

> SEQ ID NO:638  171278  142793_300445_1
```
CCCACGCGTCCGGAAAGACCGTACCTCTATAGATGACTTTGAGATAATAAAACCAATTAGTCGTGGTGCATTTGG
CCGTGTTTTCTTGGCAAAAAAGAGAGCAACTGGAGATTTCTTTGCAATTAAGGTTTTGAAGAAGGCAGATATGAT
ACGCAAAAATGCCGTTGAGAGTATCTTGGCGGAACGAAATATTTTAATATCGGTTCGCAATCCCTTTGTGGTTCG
CTTCTTCTACTCTTTTACTTGCCGTGAAAACTTGTACCTTGTGATGGAATACCTGAATGGGGGGGACCTGTACTC
ATTGTTGAGGAATCTTGGTTGCTTGGATGAAGACGTTGCTCGTGTATATGTCGCTGAAGTAGTGCTTGCTCTGGA
ATATCTGCACTCTTTGCGAGTGGTTCATCGTGATTTAAAGCCAGACAATTTGTTGATTGCTCATGATGGTCATAT
CAAGTTGACGGACTTTGGGCTTTCTAAAGTTGGTCTTATCAATAGCACGGATGACTTGTCTGGTCCGGCAGTCAG
TGGAGCATCCATGATGGAAGATGATGAATCTCAGTTATTGGCACCTGAG
```

> SEQ ID NO:639  171278  130002_300484_1
```
GAATTCAAGAACATCACCAGCATAATTCTTCGGGTCAAAAAGCAGTTTCGTCGGTTTCACAAAACAGATAAATAT
TGATAGATTTGAGATATAAATATAGATTTATTGTGAGATTTACTAAAAACATACAGTTGAGAGATAGAGATTTAG
AGAAACAGAAAAAAAAAACAGAGGATAATTAATACAGTTTCATTATTGTTAGAGAGACAGAGAGTCCGAGAGAAG
GAAGGAAAACAGAGGTAGAAGAGAGTATCTTGATGGTGAAAGAAGTGGAGAAATTGGGAATGCGACTTGGAAAAT
ACGAGCTTGGTAAAACTCTTGGTGAAGGAAATTTCGCGAAAGTTAAATACGCTCAGAATCTTGAATCTGGACAGA
TTTTTGCTGTCAAGATTTTGGAGAAGAAGAAAATCATTAACCTCAAAGTTAACGATCAGATTAAGAATGAGATTG
GAACATTGAAACTGTTGAAGCATCCAAATGTTGTCAGATTACATGAAGTCTTAGCAAGTAAGACAAAGATATACA
TGGTGCTTGAATATGTAGGAGGAGGTGAATTGTTTGACAGAATTGCAACAAAAGGGAGGGTTTCGGAAGCTGTTG
GTCGGAAGCTTTTCCAACAGTTGATTGATGGTGTGAGTTACTGTCATA
```

> SEQ ID NO:640  175126  252370_301670_1
```
GACCCACGCGTCGATTTGATTCAAGCTCTAGGCGTTTAAGTAGATGGATGCGTGATTGATTGAATGGAAGCGATA
GACAAGCTAGATCTAGCTTGATCTTCACTGATAGAGGAAGAGGAGGAAGGGAAGATCAAGGATGGCTCCTGACGA
AGAATCGGCGCTCTTGGGGACAAATAGCGATCATCACAGCAAGCGCAAATTCCGGCGCAAAGTCGTCGCTACAAG
CTGTGTTCTTGGGATCTTTCTCGTTCTCACTACTGTTTGGTTCCTTGACCGTGGCGGCTTCTTAGAATTCTACGC
TGGTCAGGCGATAGAATCGTCGAATCCTCTGGTCTCGCCGGTCGATCGTGTAGCTCCAGTGAACTTCTTAGCGAT
AGGGGATTGGGGACGACATGGATTGTATAACCAAACGTTGGTTGCTTCCCAGATGGGAAAGTTGGCGAGGAGCT
CGGCATAGATTTCGTGGTCTCGGTGGGAGATAATTTTTATAAGAATGGATTGACTGGCGTGGACGACATTGCGTT
TGATCAATCCTTCTCGAACATCTACACTGCTCCAGGCCTTCAAAAGCCATGGCATGCAGTGCTGGGAAACCATGA
CTATCATGGAGTTGTTCTCGCACAGCTTGATCACCGGCTAGCTTTGCGTGATTGGAGATGGCACTGCGTCAGAGG
TGGACAAATTATTTATGATCTGAGCTCATCTCTTTCTCGAGGAT
```

Figure 2 continued

> SEQ ID NO:641 175126 39129_300207_1
CCCACGCGTCCGAAAGAACAGAATGAGTTCTAAGTTTGATATCGGCTCCTTAAGCATAGTAATGACTCTGCTTAT
TTGCTTCTTATTATTATCTTTGGCTCCAAAACTTGAGGCTGAGCTCGCAACGGTCCAACATGCTCCAAACCCCGA
TGGCTCTATCAGTTTTCTGGTGATTGGAGATTGGGGTAGGCATGGACTCTACAACCAATCCCAAGTTGCCCTCCA
GATGGGGAGAATCGGGGAGGAGATGGATATCAATTTTGtggtATCGACGGGTGATAACATCTACGATAACGGGAT
GAAAAGTATCGATGATc > SEQ ID NO:642 175159 116486_300068_1
gcggcgacgtggtccccaaggacgtgaacgccgcggtggccaccatcaagacgaaGCGCACCATCCAGTTCGTGG
ACTGGTGCCCCACGGGGTTCAAGTGCGGCATCAACTACCAGCCGCCCAGCGTCGTCCCGGGGGGAGACCTGGCCA
AGGTGCAGAGGGCCGTGTGCATGATCTCCAACTCCACCAGCGTCGTCGAGGTGTTCTCCCGCATCGACATCAAGT
TCGACCTCATGTACTCCAAGCGCGCCTTCGTCCACTGGTACGTCGGCGAGGGCATGGAGGAGGGGGAGTTCTCCG
AGGCCCGCGAGGACCTCGCCGCGCTGGAGAAGGACTACGAGGAGGTCGGCTCCGAGTTCGACGATGGTGACGAGG
GTGATGAGGGTGACGAGTACTAGAGAGGTTCAGGGTTCTTGCCTGGTGCCTTGGCAATGCTTGATTACTGCTGCT
ATCCTATGATCTGTCCGTGTGGCTTCTATCTATCAGTTTGTGTGTCTGGTTTTGAAAAACATTTGCTTTTCGAT
TATGCAGGGTTTGCTTGTAGCTTTCGCTGCTGTGACCTGTGTTGTTTATGTGAACCTTCTTTGTGGCATCTTTAA
TATCCAA > SEQ ID NO:643 175378 190816_300736_1
CCCCCCGGTGGACACCCTGCGCTGCAGCCGAACGACCGAGCTACCGAGCCAATCCAGCCATGGCCTCCACCGCGC
TCTCCACCGCCTCCAACCCTACTCAGCTGTGCAGGTCTCGCGCCTCGCTGGGCAAGCCCGTCAAGGGCCTGGGCT
TCGGCCGGGAGCGCGTGCCGAGGACGGCGACGACCATCACATGCCAGGCCGCGAGCAGCATCCCGGCCGACCGCG
TCCCGGACATGGGCAAGCGCCAGCTGATGAACCTCCTCCTGCTCGGCGCCATCTCGCTCCCCACCGTCGGCATGC
TCGTCCCCTACGGCGCCTTCTTCATCCCCGCCGGGTCCGGGAACGCCGGCGGCGGGCAGGTCGCCAAGGACAAGC
TCGGCAACGACGTGCTCGCCGAGGAGTGGCTCAAGACACACGGCCCCAACGACCGCACCCTCACCCAGGGGCTCA
AGGGTGACCCGACGTACCTCGTCGTGGAGGCCGACAAGACGCTGGCCACGTACGGGATCAACGCCGTGTGCACGC
ACCTTGGGTGCGTCGTGCCGTGGAACGCCGCCGAGAACAAGTTCATCTGCCCCTGCCACGGCTCGCAGTACAACA
ACCAGGGCAGGGTCGTccgtggaccTGCTCCCCTGTCGCTgGCA > SEQ ID NO:644 175378 44145_300443_1
gccattacggccggggattcagaaatggcttcttctactctttctcacgtaactcagctatgctcgagcaagagc
ggtTTGTCTTCGGTTTCACAATGTTTGCTACTGAAACCAATGAAGATTAACAGTCATGGATTGGGAAAGGACAAG
AAGATGAAAGTGAAATGCATGGCTACAAGTATTCCAGCAGATGATAGAGTGCCTGATATGGAAAAGAGGAATCTC
ATGAATTTGCTTCTTTTGGGTGCGCTTTCTCTACCCACTGCTGGGATGTTGGTACCTTATGCTACTTTCTTTGCA
CCACCTGGGTCAGGGGGTGGTGGGGTGGAACCCCTGCCAAGGATGCATTAGGTAATGATGTCGTTGCATCTGAA
TGGCTGAAAACTCATCCACCTGGTAACCGAACTCTCACGCAAGGACTAAAGGGAGACCCTACTTACCTTGTTGTG
GAGAATGATGGAACACTTGCAACCTATGGTATTAATGCTGTCTGTACTCACCTTGGTTGTGTTGTGCCATTTAAT
GCTGCTGAGAACAAGTTTATTTGCCCGTGCCATGGATCTCAATACAACAACCAAGgaaGAGTTGTTAGggACCT
GCTCCTTTGTCCTTGGCTTTGGCTCATGCTGATATTGATGATGGgaaggtggTGTTTGTcccATGGGTTGAAaCa
g > SEQ ID NO:645 175378 47389_300170_1
ttgagaccataaccttttagcgtttcggctaaagctttcgctgactactacaacaatggcgtcctcatcccttt
ccccTGCTACTCAGCTTGGTTCTAGCAGAAGTGCTTTGATGGCGATGTCAAGTGGGTTGTTTGTGAAGCCAACGA
AGATGAATCATCAAATGGTTAGAAAAGAGAAGATTGGATTGAGAATTTCTTGTCAAGCGTCGAGTATTCCAGCAG
ACAGAGTTCCAGATATGGAAAAGAGGAAGACTTTGAATCTTCTTCTTCTTGGGGCTCTTTCTCCACCTACTGGCT
ACATGCTTGTCCCTTACGCTACCTTCTTTGTTCCTCCTGGAACCGGAGGTGGAGGTGGTGGTACTCcAgCcaagg
ATGCCCTTGGAAACGATGtagttgcaGCGgaat > SEQ ID NO:646 175706 107833_300526_1
GTTAATATAATCATATATTCTTATTAAAATAAAATCATGCATAGGGGAGTCTTATTCAATTCTCACAACATATAT
ATGTAAGCTTCCCAACAATGGAGCAATTAATAATTAAAATCTTTGGTTATTCTTCAATTCAACTTCTTTAATTAC
TTGGGGTCCTAACAAGGGAGATTATCCCCAGTCTCCACACCTAGTTGTTGACAATACTCAGTATAATACTCAACC
CTTCTGGCAACAGTCTGAGGGTTGCCGTTGTCACATTCAATCCGGCCATTAATGGCTCGAATGGTTGGGCCAAAA
CCTTGGCCAAAAGTGATGAAAGAATGGCAATTGTTCATCCAATACCACAGGGCAGTCTTGAAGGAAATAACTGCA
TCTTTAGCCACAATGTCCGGGTCATTTAGGCCATCGAATCCTATGGATTTTCCAGCAGGTCCATAGTTGAAGTTC
CATGATAGTTGGATGGGTCCTCGACCGTAGTACTTTTTGCCTGAGACACAAGGGTACTCTGGGTTTTCCTCATCA
CAATAGTCGCCTGAAGGACCATTTATCTCATTTATGAAGCACATGTGTCCAGTTTCATGGGTGACATGAGCAA

Figure 2 continued

> SEQ ID NO:647 175706 246948_301615_1
acgcgtcgaTCTTCAGCTCCGAGTTCTCTTCCTCCTGCTCGCGATCTTAGCTGCCGCTGCCGAAGACTGCGGACG
ACAAGGCGGCGGAAGAAGTTGTCCGCCTGGAAACTGCTGCAGCAGGTGGGGATGGTGCGGTGACACTCCCGACCA
CTGCCGGCGAAGGCTGCCAGAGTCAGTGCGGTGGAGTAACACCGCCGCCTGGTGACGGTGTCGGATCTATCATCAC
GAGTTCCATCTTCGAGAGCCTGCTCAAGCACCGCAGAGACTCGGGATGTGCCGGTGGCTTCTACACGTACAGTGC
GTTCCTCACGGCTGCCAGATCTTTCCCGCTGTTTGGAAACGAAGGCTCGTTGGAGCAGAGGAAGCGAGAGCTCGC
TGCCTTCCTGGCACAGACATCCAAGGAGACCACAGGTGGATGGCCGACTGCTCCTGACGGGCCTTATCGATGGGG
CTATTGCTTCGTTGAGGAACAAAATAAGGACATCTACTGCAGCGCTTCGGCGACATGGCCATGTAATGGCAGCAA
AAGATACTTTGGTCGTGGTCCCATTCAGCTTACATGGAACTACAACTATGGCCTGGCAGGATCACAAGTCGGCTT
CGACGGCATCAACGATCCGGACATCGTTTCGCGAGACGCGGTGGTGTCGTTCAAGACAGCGATCTGGTTCTGGAT
GACGCCACAGAACCCGAAGCCTTCGTGTCACGACGTAATTCTGGGGAAATGGaggccatccagtgccgacttagc
agcGggaaggACTGCGAGctat > SEQ ID NO:648 175706 242217_301327_1
ATATTGCAAAGCTCTCAATCCTTTCACTTGTGCTGCTCCCTCTTGTTCTAACTCTGGTCGCAGCAACCCACTGTA
ACTGCGGAGAAAGAGGACGACAAGGCGGCCACGACACTACTCTGCCAGCACCGTCTATCAGCGCCAACATTGGAA
CCATAGTGACGAATTCCCTGTTTGATCATTTTGCTCGACAAGACCAAGCTCGGACTCGGCTGTGCCGGTGGATCC
TTCTACACTCACGATTCCTTCATGGCTGCCGCAAAGGCGTACCCGAAGTATGGCTGCACCGGGTCCGAGGAGCAG
CGCAAGACGGAGATCGCTTCCTTCTTTGCGCAGACGTCTGCGCAGACCGCTGGAGGTGGATTGCAACTCCACTGG
ATATTGTTTGGTTGAATAACCAGAAAGGAACCACTACTGTAAGCCATCAGCTGCTTGGTCTTGTGCCCCAGGAAA
GAGCTACCATGGTCGAGGACCTCTGCAGCTCAAATGGAACTATAACTATGGACCTTGTGGACATGCACTTGGCTT
TGATGGCG > SEQ ID NO:649 175706 21621_300070_1
cccacgcgtccgcaaaacatgGCTTTCACAAAAATCTCCTTAGTCCTTCTTCTCTGCCTCTTAGGTTTCTTTTCT
GAAACTGTCAAGTCTCAAAACTGCGGTTGCGCTCCAAACCTCTGTTGCAGTCAGTTCGGTTACTGTGGTACCGAC
GATGCATACTGCGGTGTTGGATGCCGATCAGGTCCTTGTAGAGGTAGTGGAACCCCGACCGGAGGGTCGGTCGGT
AGCATTGTGACACAAGGTTTCTTTAACAATATTATCAACCAaGCTGGTAATGGTTGCGCGGGGAAAAGATTCTAC
ACCCGTGACTCTTTCGTTAACGCCGCTAATACTTTCCCCAACTTTGCCAATTCTGTTACCagACGTGAAATTGCT
ACCATGTTTGCTCATTTCACTCAcgagACCGGACATTTCTGCTACATAgaagaGaTTAACGGAgaaACACGTAAC
TACTGCCatAgcagcAACACACAATACCCATGTGCACCGGGAAAAGGCTACTTcggTCGTGGTCCGATCCAACTA
TCATGGAACTACAACTACGGAGCGTGTGGTCAAAgtctcggtCTTGACCTTCTAcgcCaGcCctaACTTGTGggt
AGCaacCCAACTgtagcTtTCaggacgggtTTGTGGTTTTGGAtgaat > SEQ ID NO:650 175706 114442_300008_1
AAAAAGGTCAAAATGAGACTTTTGGAGTTCACAGCTCTGTCTTCTCTACTAGTCTTGTTTCTGCTCCTGCCTGTC
TCGGCAGAGCAATGCGGTAGACAGGCGGGAGGTGCACGTTGTCCCTCGGGAATGTGCTGCAGCAACTTTGGATGG
TGCGGAAACACTCAAGACTATTGTGGTCCGGGGAAGTGTCAAAGCCAGTGTCCTTCTGGCCCTGGACCTACCCCA
AGACCACCCACCCCTCCTGGTCCTAGTACTGGGGACATATCCAACATCATCAGCAGTTCCATGTTTAATCAGATG
CTCAAGCATCGCAATGACAATGCATGCCAAGGGAAGGGCTTTTACACTTACAATGCCTTTATCACTGCAGCAAGA
TCATTTCGTGGCTTCGGCACCACGGGTGACACCACCAGGCGTAAAAGGGAGGTTGCTGCTTTCTTTGCCCAAACC
TCTCATGAAACTACTGGAGGATGGGATACAGCACCGGATGGGAGATACGCATGGGGTTACTGCTACCTTAGGGAA
CAAGGCAACCCTCCTAGCTACTGTGTTCAAAGTTCTCAGTGGCCATGTGCTCCTGGCCAAAAATATTACGGAAGA
GGCCCCATCCAAATTTCATAC > SEQ ID NO:651 175904 107718_300258_1
cttccatttTccaccgttcgggcaagataataaaaactacaagtatatagcagtaacgtttcttcttcttcttct
tcctTTGTGAAGCAAGAAATACTTAATAGTAGAAGAGTATGGCTCTGAGAATGTGGGTTTCTTCAACAGCCAACG
CACTAAGAATCTCCAGAACCAATCTAATTGCCCCCTCTTTTTCTTTCTCCAGATGCTTTTCAACTGTTCTTGATG
GGCTGAAGTATGCATCTTCACATGAATGGGTGAAGCATGACGGTTCAGTTGCCACTGTTGGCATCACTGATCATG
CTCAGGACCATCTTGGAGAAGTAGTGTTTGTGGATCTGCCAGAAACAGGTGGTTCTGTTTCCCAAGGAAGCAGCT
TTGGAGCTGTTGAGAGTGTCAAAGCCACCAGTGACATTAACTGTCCTATCTCGGGTGAGATTGTTGAGGTCAACA
CAAAGCTTACTGAAACGCCTGGCTTGGTAAATTCAAGCCCATATGAAGATGGATGGATGATTAAAGTGAAGCCAA
GCAGTCCATCAGAATTGGAGTCTTTGATGGGTTCCAAAGAGTACACAAAATTCTGTGAAGAAGAGGATAGTCATT
GACACCTGAATGTACTTCTTGGTCCAATTTGGATTAACTGGGGTGCTTAAGGTTGCTATTGTTATAGAAATTTCC
AGTCAATAAATAAAATTGTTCAAGCATAAAAAAATTATCTtccacttGTCTCATAACATCTtTGccTATGCaGtTC
TgtgattTGat

Figure 2 continued

> SEQ ID NO:652 175904 47667_300191_1
CACCAATCTCAGGTGAAATCATTGAGGTTAACAAGAAGCTCACAGAATCACCTGGCTTGATCAACTCAAGCCCCT
ATGAAGATGGTTGGATGATCAAAGTGAAACCAAGTAGCCCCGCGGAGTTGGAATCTTTGATGGGTCCAAAGGAAT
ACACCAAGTTCTGCGAGGAGGAAGATGCTGCTCACTAggAGGGTTTCTCTCtgtCTTTTATGTTCGAAGTTCTAT
CAATTCTCATGCTTgttTTCTAAATTTGCATACACtctATGACCAACTTCACAAAATaaGAGTTCaaGAAGATGA
AACAGAGACCtaacAAACACATTaaGATTT > SEQ ID NO:653 175904 245702_301571_1
AGCGTCGATTCTCTGCCCTAATAATCTGTCTTGCTGCTTACTACGATGGCTCTACGCACCATGGCGACGCAAGCT
GCGACGCTGCTGAGAATTCGGTGCCAGCCGAACTACCTCGCGCAGGCGCTGGCAATTCGTGGATTTGCAACTGAA
GCCGCAGCTACCGTTCCAATTCCCCAAGATTTGAAGTTCCTCGAGTCGCATGAATGGGTGAAAGTGGAGGATGGA
ACTGGCACCGTAGGAATCAGTGACCATGCTCAGCATGAGCTTGGAGACGTTGTGTTTGCGGACTTGCCCGAGGTG
GGGTCGTCGGTGAGCAAAGGCAAGAACTTTGGCGTGGTGGAGAGCGTCAAGGCTTGCAGCGACATCTACAGCCCC
GTCTCTGGCGAAGTCGTCGAAGTGAACGAAGAGGTCAAGGCAACGCCAGCTCTGGTGAACAAGAGTGCATTCGGC
GATGGATGGCTCATCAAAGTAAAGCTGTCCAGCGTGTCGGACCTCGACGGCCTAATGGATTCAGCAGCATACGAA
GAGCACGTCAAGAGTGAGGCTCACTAGCCGAGCACAAAGCGCAAAGCACAAATCACAGTATGTTTCGAAAAGCTC
TACTAGCAAGAAGGATAATTTTCTTTCCAAAGTCC > SEQ ID NO:654 175904 14368_300244_1
CCCACGCGTCCGGAAAACTCAAAACAAAGTAAACAAACAAACCAGAAAAAGGAATGGCACTGAGAATGTGGGCTT
CCTCTACAGCAAATGCTCTCAAGCTCTCTTCTTCTGCCTCCAAATCTCATCTCTTGCCAGCTTTCTCCATCTCCA
GATGCTTCTCCTCAGTGTTGGAAGGACTTAAGTATGCAAATTCACATGAGTGGGTGAAACATGAAGGCTCAGTTG
CTACAATTGGTATCACTGACCATGCGCAGGACCATTTAGGAGAAGTTGTGTTTGTGGAGCTGCCTGAAGCAAACA
GTTCAGTGAGCAAAGAAAAAAGCTTTGGAGCT > SEQ ID NO:655 175904 138902_300728_1
GGAGAGAGAGAGACAGACAGAGTGCGGCGCCGAGGAGGAGAGGAGCAATAATCCAATTCCAATCCATTCCTCCGC
GACCTCGTCGTCCGATCATGGCCATGGCCGCCTCCAGGTTGCTGTGGGCTTCCCGCGCCGCCTCCTACCTCAAGA
TCTCCACTTTCCCCAGGGCCTTCTCCACCGTGCTGAAGGATCTGAAGTATGCTGACACTCATGAATGGGTTAAGG
TTGAGGGTGATTCGGCAACCGTTGGAATTACAGACCATGCCCAGCACCATTTGGGTGATGTTGTGTATGTGGAGC
TTCCAGAAGTTGGCAGCAGTGTATCCCAGGGAAAGAACTTTGGTGCTGTTGAAAGTGTGAAGGCAACCAGCGATA
TCTACTCTCCAGTATCTGGAGAGGTGGTTGCAGTGAACGATGGACTAGGCGATGAACCTGGATTGGTTAATACAA
GTCCATACGAGAGTGGGTGGATCATCAAGGTCAAGGTTAGTGATTCAGGTGAGCTCAATTCATTGATGGATGACG
CGAAATACTCGAAATTCTGCGAGGAAGAAGATAGCAAGCATTGAACAAATACCAGTGACTTGTGATCTGCAAAGA
ATGCGCCTTGACCCTTTTGTCAATGCTTGTGATGTGCTATCGAGCACTTATCTTTACCACCGGCTGCTCCTGAAA > SEQ ID NO:656 175904 135404_300414_1
cccacgcgtccGGAAAAAAGAAGAACGCAGATACTTTGGTAACAAGCAAGAAATTGGCACAGAAATGGCTCTGAG
GCTGTGGGCTAGCTCAGCTGCCAATGCCCTCAAGATCTCATGCAGTGGAGCCACCAGGGCTGCACCTGCCTACTC
AATCTCCAGATACTTCTCCACTGTTCTTGATGGGTTGAAGTACAGCTCCTCTCATGAGTGGGTCAAGAATGATGG
CTCTGTGGCCACAATTGGAATTACAGACCATGCTCAGGGCCATCTGGGAGAGGTGGTGTTCGTGGAGCTGCCGGA
GGCGGGGGCGAAGGTGAGCCAGGGAGGTGCATTCGGCAACGTGGAGAGTGTGAAGGCCACCAGCGACATCAACTC
CCCCATCTCCGGTGAGGTCGTCGAGGTTAACGACAAGCTCTCTGAGACACCCGGCCTGATTAACTCAAGCCCGTA
CGAGGACGGGTGGATGATCAAGGTGAAGCCGAGCAGCCCGTCGGAGCTGGACGCCCTGCTGGACCCGGCCAAGTA
CACCAAGCACTGCGAGGAGGAAGACGCTCACTAGGCTCTTCCTCTCTgtTTTTTCTCTCCCATTTTGTCACTCC
GACCTAATTTCTCCCTGTTGCAACAACTgctCTGTATCcGTATACGATTAATAACTGAATCttcaggCTTtgcca
tgtGTTc > SEQ ID NO:657 175904 11914_300070_1
cattACTAGAGAGAAAAATGGCTTTGAGAATGTGGGCTTCTTCAACAGCCAATGCATTGAGAATTTCCACTGCCT
CAAGAGCTAATCTTTCCCCTGCTTATTCACTCTCTAGATGCTTTTCCACTGTTCTTGATGGGCTGAAGTATGCAT
CTTCACATGAATGGGTGAAACATGAGGGTTCAGTGGCAACAGTTGGAATCACTGATCATGCTCAGGATCATCTTG
GAGAAGTAGTATTCGTAGATCTACCAGAAACTGGTGCTGCTGTTTCACAAGGAAGCAGTTTTGGTGCTGTTGAAA
GTGTGAAAGCTACCAGTGACATTAACTGTCCAATCTCGGGCGAGATCGTTGAGGTCAACACAAAGCTCACTGGAA
CACCTGGTTTGGTTAACTCGAGTCCATATGAAGACGGGTGGATGATTAAGGTGAAGCCGAGCAGTCCATCCGAGC
TAGAATCTTTGATGGGTCCAAAGAGTACACAAAATTCTGTGAAGAAGAGGATAGTCACTAAAACTTGAAGGTGT
TTTGTTTATTCAACTTGGACTAACTTTGCCTGGTTAAGGCTGATACTGTGATGAAACTTCCTGTCACTTGTTAAA
ATTCTACAAAAATCAAAACAACATCCACTTTTCTGGTgttaaAAAAAa

Figure 2 continued

> SEQ ID NO:658  176385   283648_200094_1
TGAATTCAGTATAGGGACATTGGAAGTAAAAGCAATCATCATGCTGTATATAATAGGATTGGGACTAGGGGATGA
AAAAGACATAACACTGAAAGGTCTAGAAGCTGTTAAAAAATGCAGCAAAGTGTATATGGAAGCTTACACTTCACT
TCTCTCTTTTGGCCTTTCTCCCAATGGCCTTTCCAATCTGGAAAATCTATACGGAAGATCAATTGCAATTGCAGA
TAGGGAAATGGTAGAGGAAAAAGCTGATGAGATCCTCAATGAAGCTCAATCTTCTGACGTGGCATTTCTTGTTGT
TGGTGATCCTTTTGGAGCCACAACCCACACTGATCTTGTTGTCCGTGCTAAGAAGTTGGGTGTGGAGGTTAAGGT
GGTACACAATGCATCAGTAATGAATGCTGTTGGAGTGTGTGGCTTACAGCTCTATCATTATGGAGAGACAGTTTC
CATACCTTTCTTCACTGAGACCTGGAGGCCTGATAGTTTCTATGAGAAGATCAGGGAAAACCGAAAGCTTGGACT
CCATACACTCTGCTTATTGGATATACGAGTGAAAGAACCCACCATTGAGTC

> SEQ ID NO:659  180809   104214_300060_1
cttcactctgtcttcacactctctgcttttgccgtaggacagaatcgtcgagtttagtgacgaagactgtaatca
atggcATCAGCTACAGCTTCTCACTCTTTGTGCGGCATCCCCGCCACCTCATCCTCTACTACCAACAAGTCTATT
GCCCCTTCATCTGCTCGCTTCCTCTCTAAAACTCCTCTCCGCCGCCTCGGCTTCGCTGGCGCCGCCGCTGATTCT
CTCTTCACCAACCACGTGGCAACCAAGCTCCGATCCCTCAAGAGCTCCTCCAAGCCTGTTAGGGGCGTTGCTTCT
ATGGCCAAGAAAAGCGTCGGAGACCTCACCGCTGCCGAGTTGAAGGGCAAGAAAGTCTTCGTCAGGGCCGATTTG
AATGTCCCACTTGATGATAGCCAGAACATTACTGATGACACTAGAATTAGAGCTGCCGTCCCTACTATCAAGCAC
TTGATGGCCAATGGTGCTAAAGTTATTCTCTCCACTCACCTGGGACGGCCAAAAGGAGTCACTCCTAAATACAGC
TTGGCACCCCTAGTCCCCagGCTATCCGAACTGCTTGGAATCCaggTTGTgAaggctgaggaCTGCATtggttcc
ggaagtTGAgaagttggttgCTTCACttcc > SEQ ID NO:660  180809   131349_300513_1
gaattcgAAAACAAAAACAACAATGGCTTCAACAGCTTCACACACTACTCTATCTCTACTCAGAACAACAGCATC
ATCTTCATCTGCTCGCAACAACCGTGTATCATCAACATTACAAGTTGCAGCAGCATCTCGATTGAGAAACATCGG
ATTACAAGTTAGAAACCCAAAAAGTCTTGGGTTTTCTGGTGTTGCAGTAGATCCTCTTCTTTCATCACACGTTTC
TTCACAAATTGGAGCTGTTAATGGTAAAGGGGTGAGAGGTGTTGTTTCAATGGCTAAGAAAAGTGTTGGGGATTT
GAGTGCATCTGAATTGAAAGGTAAAAGGGTTTTTGTTAGGGCTGATTTGAATGTCCCGTTGGATGACAATCAGAA
CATTACTGATGATACTAGAATCCGTGCTGCTATTCCAACTATCAAACATTTGATGGCCAATGGTGCTAAAGTCAT
TCTTACCAGTCATTTGGGAAGACCAAAGGGTGTTACTCCAAAATTCAGCTTGGCCCCTCTTGTCCCTAGGCTCTC
CGAGCTTCTTGGCATCACTGTTGAGAAAGCTGATGATTGTATTGGCCCTGACGTTGAGAAATTGGTTGCTGCACT
ACCAGAAGGTGGTGTTCTCCTTCTTGAAAATGTGAGATTCTACAAAGAGGAAGAGAAGAACGAACCAGAATTCGC
AAAGAAACTTGCTTCCCTCGCAGACCTATATGTCAACGATGCCTTTGGAACAGCACACAGAGCTCATGCTTCAAC
TGAGGGAGTTACCAAATACTTAAAGCCATCTGTTGCTGGTTTCCTCTTGCAGAAGGAACTGGACTATCTTGTTGG
GGCAGTTTCATCCCCAAAGAGACCATTTGCTGCcATCGTTGGTGGTtccaaggTGTCATCTAagattggTGTGAT
TGAgtcgtTGCTagagaagTGTGATattcTaCTtttgggtgGaggtaTGATCTTCACAttCTA > SEQ ID NO:661  180809   244588_301559_1
GTTCTATCGATCGATCGATCCATCAGCCATGGCCGCCGGCAACAGCCGCCGCATCGTCGCAGCTCCTCTCGCCGGC
GGCGTCGCTGGGCTCGGCGGCGTCGCCGTCGTCGTCGTCGCCTTCCGGCAATCGCGCCGGGTTCAGGTCATT
GGGGAGGCAATGCTTCGCGGGACTCGTCGCGGGGCGCCGGGAGGTGCGGCGGCTGGGGGATTTCGAGCGGCAGCA
GCCGGATTTCGCGGCGGCAGTGGCGGCGGCGGTGAGGTCGTCGGGGGGCAATGGGCGCGGCAGCCGCGGCGTGGT
GTGCATGGCCAAGAAGAGTGTGGGGGATCTCAAGGAGGCGGACTTGAAAGGCAAGCGTGTCTTTGTCAGGGCTGA
TCTCAACGTTCCACTGGATGCCGATCTAAACATCACCGACGATACGAGGATTCGTGCTGCCGTGCCGACGATCCA
GTATCTCATTGGCAATGGGGCTAAGGTCATCCTCAGCAGCCATCTGGGG > SEQ ID NO:662  180809   51093_300115_1
CCAAAGTTGAATCGGTGCGTGGGAAGGGAAGCAGAGGAGTGGTTTCTATGGCGAAGAAGAGCGTCGGAGATCTGA
CCTGAGCTGATTTGAAGGGGAAGAAGGTTTTCGTGAGAGCTGATCTCAATGTACCTCTCGATGATAATCAGACTA
TCACTGACGATACCAGAAT > SEQ ID NO:663  180809   143314_200009_1
atttatacgatcctcgatccttccaattagtcacagacatcgttccgttcatcgtatcGATTTTTCCGACGGAAA
AAACTATAGAGAAATGGCGGTGAAGAAGAGTGTGGGATCACTGAAAGAAGCAGATCTGAAGGGGAAGAGAGTATT
CGTGAGAGTTGATCTGAACGTTCCATTGGATGACAGCTTCAATATTACTGATGACACCAGAATCCGAGCTGCTGT
TCCTACCATTAAGTATTTGATGCAACATGGATCTCATGTTATTCTTGCCTCTCATCTTGGTCGTCCAAAGGTGT
CACTCCAAAATACAGCTTGAAGCCACTTGTACCAAGACTGTCAGAGCTATTGGGACTTGAGGTCAAGATGGCAGA
TGATTGCATTGGTCCAGAAGTTGAGAAGTTGGTTGTCGAAATACCAGAAGGAGGAGTTCTGCTCGTGGAAAATGT
GAGATTCTATAAAGAAGAGGAGAAGAATGAGCCCGAGTTTGCAAAGAAGCTGGCGTCTCTTGCAGATTTGTATGT
CAATGATGCCTTTGGGACTGCACACAGAGCACATGCTTCCACAGAAGGGGTTGCTAAGTACTTGAAACCGGCAGT

Figure 2 continued

TGCTGGATTCCTTATGCAAAAGGAACTTGACTATCTTGTCGgagCtgtATCAAATCCACAgaagccATTTGCTgc
cATTgttggTggtTCAAaggtTTcaagtaagAt > SEQ ID NO:664   183214   225332_300986_1
ATGGCGCCGAATCCGCGCTGCTACATGGACATCACCATTGGAGGCGAGCTGGAGGGGCGGATCGTCGTGGAGCTC
TTCGCGGATGTCGTGCCGCGGACTGCGGATAATTTCCGGGCGTTGTGTACTGGCGAGAAGGGCGCTGGCTCCACT
GGATGCCCGCTGCATNATTTTGGCGTGACTTTCCATCGCGTGATCAAAGGTTTCATGATCCAGGGAGGCGACTTC
ACCGCCGGCGATGGAACCGGCGGCGAGTCCATCTACGGCCTCAAGTTCGACGACGAGAACTTCAAGCTCAAGCAC
GAACGCAAAGGCCTGCTGTCCATGGCCAACTCCGGGCCCAACACGAACGGCTCCCAGTTCTTCATCACCACCGCT
AGAGCGTCACATCTCGACGGCAAGCACGTCGTCTTCGGGAAAGTCCTCAAAGGCATGGGTGTGGTTCGTAGCATG
GAGCATGCCATCACCGACGACAAGGACCGGCCCGTGAATCCGCTGGTGGTGGCCGACTGTGGAGAGCTTCCACAA
GGAGCTGACGATGGTGTGTCGCTCTTCTGGAAGGATGGCGATGTGCTTCCGGACTGGCCGGCTGACTTGCCCGAG
CAGCCGGAGGA > SEQ ID NO:665   183214   258224_301690_1
GAAGCCGGCAGCACTGCTGCAGCAAAGCAAGCGCAAGAAGGGACCGTCGCGGCTCAGCCTCCCCACCATCGTCTC
CTGCAACCTCATCGTCGTCCTCCTCTTCTTCTCCATCCTAGCGCTCCACAGGCACAATCGTAGTAGCGGCAATTG
GAATGCCCAGGTCGCTGGACGAAAGGAGAAAATGGGACTTCTTCCCAAGTATGTGTTGATGAACACAACCAAGGG
GGTAATTGTTTTGGAGCTCTTTGGCGATGAAGTTCCGAAGGCCGTGGAGAACTTCGCGGTGCATGGGCAGAAAGG
ATACTACGACGGCGTCAAGTTCCACAGAGTGATCAAGGACTTTATGATCCAAGCTGGTGATCCCACCGGTGACGG
ACGAGGAGGCGACTCCATCTGGGGTGGATCCTTCAAAGACGAGTTCAGACCAAACTTGAAGCACGAAGCATTTAC
GTTATCCATGGCGAATTCTGGCCCGGATTCCAATCGGTCCCAGTTCTTCATCACAACTGTGGAGACACCACACCT
GGATGGCAAGCACACGGTGTTTGGACGCGTTGTGCGTGGTCAAGAAGTTGTAAAGGAAATAGAAAGCCAAGAAAC
TAATGTG > SEQ ID NO:666   183214   239225_301302_1
AGCTATGTCGTCCGTGTACGTGCTTGAGCCCCCGACGAAGGGGAAGGTCGTCCTTCACACCTCGTCTGGGCCTCT
GGACATCGAGCTATGGGCCAAGGAAGCCCCACAAGCTGCCAGGAATTTCGTCCAGCTCTGTATGGAAGGCTACTA
CAACAATACATTGTTCCATAGAGTCATTCCAGGATTTTTGATTCAAGGTGGTGATCCTACAGGCACTGGGAAAGG
TGGAGAGAGCATCTATGGAGAGCCTTTCCCCGACGAGATCCACACAAGGTTGAAGTTTAGACATCGAGGTTTTGT
TGCCTGTGCTAATGAGGGAAGGCCAAACTCGAACGGGAGCCAGTTCTTCATCACTTTGGATCGCAGCGATTGGAT
CAATGGCAAACACTCGATTTTTGGAAAGGTAACTGGAGATACAATATACAATCTGATCAAGCTTGCAGAGTGTGA
TGTTGGCGAAGATGATCGGCCTACAGATCCTCAGACTGTGCTGTCTACAGAGGTTATCTGGAATCCTTTTGATGA
TATCGTTCCGAGGAAATCGA > SEQ ID NO:667   183214   268479_200120_1
AAGAGGGCCTCCAGAGGTCACTCTAGAAACTTCATGGGTTCTTTTACACTCGAGATGTATTACAAGCATGCACCA
AGAACGTGTCGGAATTTCATAGAGCTTGCTCGTAGAGGGTACTATGATAATGTCAAGTTTCATAGAATTATCAAG
GATTTTATTGTTCAAGGTGGAGATCCAACTGGTACTGGAAGAGGTGGAGAATCTATTTACGGCGCGAAGTTTGAT
GATGAGATAAACCAACAGTTAAAGCATACAGGAGCAGGTATCATATCCATGGCTAATGCTGGGCCGAATACAAAT
GGAAGTCAATTCTTCATCACCTTGGCACCTGCTCAATCACTTGATGGGAAACATACCATTTTTGGAAGAGTTTGT
CGGGGAATGGAAATTATCAAGAGACTTGGCAGTGTTCAAACTGATAATACTGACAGACCAATCCATGATGTGAAG
ATACTGAGGACCACAGTGAAAGATTAATGTCCTGCAATTTCAAAGCAATTGTTACCATGCGCTAGAGGTGTTGTT
CTAGCGTTGTCAATTGTCATCACAGCCAAGACACATGCTACCTTCGGCTTTTGATTCTGCTTTCGAAGTTATTGA
AACTGATCTAGTCCTGTCTGTGGGGATGCGGAT > SEQ ID NO:668   183295   127269_300469_1
AACAGTGCCCATGGCTACTCAACGAAGGGCAAACCCTAGCTCTCTCCATCTAATTACTGTATTCTCTCTGCTTGT
CGCTGTCGTCTCCGCTGAGGTCTTCTTCGAGGAGAGTTTCAACGATGGTTGGGAAAGCAGGTGGGTGAAATCTGA
ATGGAAGAAAGATGAAAACATGGCTGGAGAGTGGAATCACACATCTGGCAAGTGGAATGGAGACACTAATGACAA
AGGTATCCAAACCAGTGAAGACTACAGGTTCTATGCCATTTCAGCTGAGTTCCCTGAATTTAGCAACAAGGGAAA
AAACTTAGTGTTCCAGTTCTCTGTGAAGCATGAGCAGAAGCTTGACTGTGGTGGTGGGTACATGAAGTTGCTTAG
TGGGGATGTTGACCAAAAGAAATTCGGTGGTGACACTCCCTACAGCATCATGTTTGGCCCAGACATCTGTGGCTA
CAGCACCAAGAAGGTCCATGCTATTCTCACTTATAATGACACAAACCACTTGATCAAGAAGGAAGTACCTTGTGA
GACTGATCAACTGACCCATGTTTACACTTTCATCCTCCACCCTGATGCTACATACAGCATTCTCATTGATAATGT
GGAGAAACAGTCTGGTAGCTTGTACTCTGACTGGGACCTTCTCCCACCAAAGACAATCAAGGATCCAAGTGCCAA
GAAGCCTGAAGATTGGGATGAGAAGGAATTCATTGATGATCCTGAGGATAAGAAGCCAGAGGGCTATGATGACAT
TCCAGAAGAGATAACTGATCCTGATGCCAAGAAGCCAGAGGACTGGGATGATGAagaagATGGTGAATGGACAGC
CCCAACCATTCCCAACCCCGAGTACAAGGGCCCATGGAAGCCAAAGAAAATTAAGAACCCCAACTACAAGGGGAA

Figure 2 continued

GTGGAAGGCTCCTTTGATTGACAACCCagaCttcAAGGATGACCCagaTCTCTATGTTTTCCCAAATCTGaagta
tgtGGGagtTGAACTgtggcAAGTGAAATCt > SEQ ID NO:669  183295  193693_300741_1
cccccggatACGGGAGATTGGATCGGAAGCTTCTAGAAGTTTCCGTGGGCGATGGCGATCCGCGCGAGGTCCTCC
TCCTACGCCGCCGCGGCGGTCGCGCTGGCGCTCGCGCTGGCGTCCGTCGCCGCTGTCGCCGGCGAGGTCTTCTTC
CAGGAGAAGTTCGAAGATGGATGGGAAAGTCGGTGGGTCAAGTCAGAATGGAAGAAGGATGAGAACATGGCTGGT
GAATGGAACCACACATCTGGGAAGTGGAATGGAGATCCTGAGGACAAAGGTATCCAAACCTCTGAGGACTACAGG
TTCTACGCTATTTCAGCGGAGTACCCAGAATTCAGCAACAAGGATAAAACCCTGGTGCTGCAGTTCTCTGTAAAG
CATGAGCAAAAGCTTGACTGTCGTGGTGGATATGTCAAGTTGCTTGGTGGTGATGTTGACCAGAAGAAATTTGGT
GGGGACACACCGTACAGCATTATGTTTGGACCAGACATCTGTGGGTACAGCACCAAGAAGGTCCATACTATCTTT
ACTAAGAATGACAAGAACCATTTGATCAAGAAGGATGTCCCCTGTGAGACTGATCAGCTGTCCCATGTGTACACT
TTGATCATCCATCCTGATGCTACATACACCATACTCATTGACAATGTTGAGAAGCAATCTGGCAGCATCTACGAG
CACTGGGATATTCTGCCTCCGAAGCAAATCAAGGACCCAGAAGCTAAGAAGCCAGAGGACTGGGATGACAAGGAG
TACATTCCTGACCCTGAGGACAAGAAGCCTGAGGGATAcGaTGATATTCCCAAGGAAATCCCTGACCCTGATGCT
AagaAGCCTGAGGACTGGGATGATGAGgaacatGGTGAGTGGACTgcaCCAACCATTCCTAACCCTGAGTACAAg
gGAcCATGGAaGCAAAAgaAAATCAAGAAcCCTAACTAccAaggcaAATGGAaggcaccGATGATCGACAACCCA
GACTTCAaggatGATcCATACATCTATGCttTTgacAgcctgaagtacAttgg > SEQ ID NO:670  183295  257150_301679_1
GTCTCCTCGACGGTTATCGATCGATCTCTCGCGGTTGATCGATCTCTCACATCGATCGCCTCGATCTGATGCGTT
GCTGGCTGCATTCCAGGTTAATCCGGCGGATCGATGAGGATTTCCGCGATCGCCGCGGCAGTTCTCGCGGCGATT
CTCGCGCTGGCTCTTTCTGGAGCTGCGGAGATCTTCTTCGAGGAGCGATTCGACGATGGTTGGGAACATAGCTGG
GTCCAGTCCGATTGGAAGCGATCCGACGGTCTAGCGGGGAGCTGGCGACACACAGCAGGGAAATGGCATGGTGAT
CCAGATGATAAAGGCATCCAGACTTATCCCGATGCTCGTTACTTCGCCATCTCCGCGCAGTTCCCCGAGCTCAAC
ACCAAAGGAAAGACCCTCGTAATTCAGTACTCTGTGAAGCACGAACAAAAGATCGAGTGTGGTGGCGGCTATATC
AAGCTACTCAGTGGTTACGTGAATCAGAAACGGTTCAGTGGGGATACGCCTTACAGTATCATGTTTGGTCCGGAC
ATTTGTGGAACTCAGACCAAGAAGGTCCACGCGATTTTGCAGTATAAGAGCCAGAACTATCCAATACGGAAGGAA
GTTACTTGCGAGACGGACCAG > SEQ ID NO:671  183295  50068_300166_1
CGATCTGAGTTTTTTTTAGCAATGGCGAAAATGATTCCTAGCCTCGGGTCTCTGATTCTTATCGGTCTTGTTGCG
ATCGCCTCCGCCGCAGTTATTTTCGAGGAGCGCTTTGATGATGGCTGGGAGAACAGATGGGTTAAATCTGAGTGG
AAGAAGGATGATAACACTGCTGGGGAGTGGAAGCACACTGCGGGAAATTGGTCTGGTGACGCTAACGATAAAGGT
ATCCAGACCAGTGAAGACTACAGATTCTACGCCATTTCAGCTGAGTTCCCTGAATTCAGTAACAAGGACAAGACC
TTAGTCTTCCAATTCTCAGTCAAGCACGAGCAAAAGCTTGACT > SEQ ID NO:672  183295  284326_200097_1
TAAAACTAGTCTTCTCAGCTGAATCATTTCTACTAGTTTTGTTACTTTTCTCACTTCTCAGCTCTTCATTCTCTG
AGATCTTTTTTGCAGAACAGTTCGATGATGATTGGCGGAGCAGATGGGTGAAGTCTGACTGGAAAAGGAGTGAAG
GGAAAGCAGGTTCATTTAAGCATACAGCTGGAAAATGGGCTGGTGATCCTGATGATAAAGGTATTCAGACATCAA
GCGATGCCAAACATTTCGCCATTTCTGCTAAGGTACCAGAATTTAGCAACAAGAACAGAACTTTCGTTGTACAAT
ATTCTATAAAGTTTGAGCAAGACATTGAGTGTGGTGGAGGTTACATAAAGCTTCTCTCTGGATATGTCAACCAGA
AGAAATTTGGGGGAGACACCCCTTACAGTATGATGTTTGGACCGGATATCTGTGGTACACAGACAAAGAAACTTC
ATGTTATGCTTTCCTATCAAGGCCAGAATTATCCCATCAAAAAGGATCTACAATGTGAAACAGACAAATTAACCC
ATTTCTACACATTCATTCTTAGACCTGATGCATCATACAGCATCTGGATTGATGGTCGAGAAAGGGATTCTGGAA
GCATGTATA > SEQ ID NO:673  183295  254642_301634_1
GGCTAGAGATGGCTAGTCTAACCCTAAGTTGCCTTCTCTTGGTACTCTTCCCCTTGGCCTCTTTCGCCCACGTTT
TCTTCGAAGAACGCTTCAATGATGGATGGGAGAACGGATGGGTGAAATCGGATTGGAAAAGGATGAAGGTGCTG
CAGGAGACTGGGTACACACGGCAGGGAAATGGAGTGGTGACTCCAAGACAATTGGGATTCAAACCAGTCCAGAC
TTACGATTTTTTGCCATATCAGCTGAGTTTCCTGAATTTAGCAACAAGGGCAAGGATTTGGTTGTCCAGTTTTCT
GTAAAGCATGAACAGGATCTTGATTGTGGTGGAGGTTATATCAAGCTTTTAAGTGGTGATGTGGATCAGAAAAAG
TTTAGTGGTGATACCCCGTACAGCATCATGTTTGGGCCTGACTTCTGTGGCTATAGCACAAAGAAAGTCCATGTT
ATTTTGAACTACAATGACAAGAATCACCCCATTGAGAAGGAAATTTCTTGTGAAAAGGATCAACTGACACATGTC
TACACTCTTGTGATAAGACCTAACAACACCTACAGTGTTCTAATTGATAATGAAGAGAAACAAAACGGCAGTCTG
TACAAGGAC

Figure 2 continued

> SEQ ID NO:674 183350 127587_300470_1
cccccgattttccattatttcctaactcctgagTATCACAGACATATTTGACTTCTATCTTCCTCTCTTTCTCT
CTCTAGCCATTCAAGGGGTTCCCTGAGACTCTTGTATCATAATTTTCTAGATCACACATACAAAAATGGTGAAAG
CCGTTGCCGTCCTTAGCAGCAGTGAAGGTGTTAGTGGCACCATCTTCTTCACTCAGGATGGAGATGCACCAACCA
CAGTTACTGGAAATGTCTCTGGCCTAAAACCCGGATTTCATGGCTTCCACGTCCATGCCCTTGGTGATACCACAA
ATGGCTGCATGTCAACAGGACCACATTACAATCCTGCTGGTAAGGAGCATGGTGCTCCTGAAGATGAGGTGCGTC
ATGCTGGTGATCTTGGTAACATCACAGTTGGGGAAGATGGTACTGCATCTTTTACCATTACTGACAAGCAGATTC
CTCTTGCTGGTCCACAATCCATCATTGGAAGAGCTGTAGTTGTTCATGCTGATCCTGATGACCTTGGAAAGGGAG
GACACGAGCTCAGTAAAACCACTGGAAATGCTGGTGGAAGGGTTGCTTGTGGTATCATCGGCCTCCAGGGTTAAT
TACTCATGTACCATGAAGATTCTCAGCTACTACTAGTGGAGGGATCTTTGAATAAGGTTTCATTGGAGCTATTGA
GCATTGTTTTCTATGTTTCATGTGATGCTTTTTGTTTTTGAGGTGAaCCaaTCATACATGATGTAGATCTAATTT
CcAGTGTGTGAGTTGTACT > SEQ ID NO:675 183350 284676_200100_1
ccgcccacacaatcttcactaccaccaccaGCACTACCAATTCTTTGTTATTCCCAGTCGCTGCCCCTAACACCA
ACCCCTCCCCTTCACTTCACTCTTCTTTCCACGGTGTTTCCCTCAATCTCAAGTCAAAGACTCCTCAATCTTTAA
CACTTTCTGCTGCCACTGCTCCTAAACGTCTCACTGTTTTTGCTGCTACTAAGAAAGCTGTTGCTGTCCTTAAGG
GCAATTCCAATGTTGAGGGCGTTGTCACTCTCTCCCAAGATGATGATGGTCCAACCACTGTGAAAGTGCGCATAA
CTGGACTTACACCTGGACTTCATGGATTCCATTTGCACGAGTTCGGTGACACTACAAACGGGTGTATGTCTACAG
GACCCCATTTCAATCCTGATGGCAAGACACATGGAGCTCCTGAAGATGAAATCCGTCATGCGGGTGACCTGGGAA
ACATAGTGGCCAATGCCGATGGTGTGGCTGAAGCAACAATTGTAGATAATCAGATACCATTGTATGGTCCAAACT
CAGTTGtTGGAAGAGCGCTTGTGGTTCACGAGCTTGAGGAtGACcttgggAAGGGTAGGCATGAACTCAGCCTTA
CCACTGGGAATGcTGGTGGACGATTGGCATGTGGCATACTTGGTTTGACTCCAATATGAAGTAATCAAgattgaT
CCAGGAATAGAATATCAATAGCAAGCTGACTGCGGCTTCATTGATTCAAGTTGAACTAttaTGCTGAAgtttcGA
AACTTCAGCTAGTACGACTATAGGACAAAAACTTCAGCTTatttAGTTCTGAAGttttacAAATGAACTAAATAA
CTtcaacttCTTCTgctaAtg > SEQ ID NO:676 183350 264941_301440_2
ACTTTAAGGTGCttgATGCTTTGGATAAGGCTTTAGTGGATAGATATCGATCCCCTTATAGTGCTATTTCTGCTT
TGGTTTCTTTATGTTATCATATCTTTGACTTTAATAAGTTTAAGTTGCTGTTTAATTGTGAAGGGAAATTTGTGG
ATAAGAAGCTGAGAAAAGACTTCGAGTGGTGAACTCTAGGTCCTGATGTTTAAATCTACTGTATTTACCTTCGCA
TTAATTAAGCATGGTGAAGGCTGTTGCTGTGCTTGCTAGCAGTGAGGGTGTCAAGGGCACCATCTTTTTCTCCCA
AGAGGGAGATGGTCCGACCTCTGTGACGGGAAGTGTCTCTGGGCTCAAGCCAGGGCTCCATGGATTCCATGTGCA
CGCGCTCGGTGACACCACTAATGGCTGCATGTCAACTGGACCACACTTCAATCCTACTGGGAAGGAACATGGGGC
ACCACAAGATGAGAACCGCCATGCCGGTGATCTTGGAAATATAACAGCTGGAGCAGATGGTGTTGCTAATGTCAA
TGTCTCTGACAGCCAGATCCCCCTTACTGGAGCACACTCCATCATTGGCCGAGCTGTTGTTGTCCATGCTGATCC
TGATGATCTTGGCAAGGGTGGACATGAGCTTAGCAAGACCACTGGAAATGCTGGGGGCCGAGTTGCTTGCGGAAT
CATCGGACTCCAGGGTGCGGCCGCTTATCCGTATGATGTTCCGGATTATGCCGAGCTCTACAAACAGCTGTTGAA
TTTTGATTTGCTGAAGTTGGCGGGTGACGTGGAATCTAACCCTGGTCCTAGGTCTAGAATGGCTACTTTCTCTTG
TGTGTGTTGTGGTACCTTAACTACAAGTACTTACTGTGGTAAGAGATGTGAGCGAAAGCATGTATATTCTGAAAC
AAGAAATAAgagattggAACTt > SEQ ID NO:677 183350 133747_300417_1
caggcacttcaccaaccctctggctcccttccgccgccctccgccgccgcatgcaagccaacctcgccgctgcca
tggccGCCCAGACCCTCTTGTTCTCCGCCACCGCCCCTCCCGCCTCCCTTTTCCAGTCCCCTTCCTCTGCCCGCC
CTTTCCACTCGCTCCGCCTCGCCGCCGGCCCCGGGGGCGCCGCCGCTGCCAGGGCGCTCGTCGTCGCCGACGCCA
CCAAGAAGGCCGTCGCCGTGCTCAAGGGCACCTCCCAGGTTGAGGGAGTCGTCACCCTCACCCAGGATGACCAAG
GTCCTACAACAGTGAATGTCCGTGTGACGGGACTTCCTCCTGGACTTCACGGCTTCCACCTCCACGAGTTTGGCG
ATACTACGAATGGGTGCATATCAACAGGACCACATTTTAACCCAAACAATTTGACGCACGGTGCACCAGAAGATG
AAGTCCGTCATGCGGGTGACCTGGGAAACATTGTTGCCAATGCTGAAGGTGTAGCTGAGGCAACCATTGTTGATA
AGCAGATTCCTCTGAGTGGCCCAAATTCTGTTGTTGGGAGAGCATTCGTTGTTCATGAGCTTGAAGATGATTTGG
GGAAGGGTGGCCATGAGCTTAGTCTCAGTACTGGAAATGCTGGTGGGCGACTTGCATGCGGTGTTGTTGGGCTGA
CCCCGTTGTAGGTCGCTGCAAGTTGCAGCTGAAGTGTCAGTATCGCATCCATGTCACCCTTTTGTCATCTTCGA
GCCTGAGGCaGTCGTTCTTGTATCACATGGATTTCGCAACATGGATGCTTAaTaGTATCTGttGATCGTTCGTCT
CACAGTAATAAAATtTAGTTGAGCAAATaagtgtcgTcacatccctgttctccaccctgtcaaactATAAAttg
tgAaaCATGagcTgttctgggtATACaaCGCATa

> SEQ ID NO:678 188835 196016_300708_1

Figure 2 continued

```
ctattagcttaagtttccataagcaagtacaaatagctatggcgagttccgtttctctcggttttctatataca
tttgtGTTCTTCTATTATGCCATGGTTCTATGGCACAGCTATTTAATCCCAGCACAAACCCATGGCATAGTCCTC
GGCAAGGAAGTTTTAGGGAGTGTAGATTTGATAGACTACAAGCATTTGAGCCACTTCGGAAAGTGAGGTCAGAAG
CTGGGGTGACTGAGTACTTCGATGAGAAGAATGAATTATTCCAGTGCACGGGTACTTTTGTGATCCGACGTGTCA
TTCAGCCTCAAGGCCTTTTGGTACCTCGATACACAAATACTCCTGGCGTGGTCTACATCATCCAAGGGAGAGGTT
CTATGGGTTTAACCTTCCCCGGTTGCCCTGCGACTTACCAGCAACAATTCCAACAATTTTCATCTCAAGGCCAAA
GTCAGAGCCAAAAGTTTAGGGATGAGCACCAAAAGATTCATCAATTTTAGGCAAGGAGACATTGTTGCACTCCCAG
CTGGTGTTGCACATTGGTTCTACAATGATGGTGATGCACCTGTTGTTGCCGTATATGTTTATGACGTAAACAACA
ACGCCAATCAGCTTGAACCCAGGCAAAAGGAGTTCCTATTAGCCGGCAACAACAATCGGGCTCAACAACAAGTAT
ATGGTAGCTCAATTGAGCAACACTCTGGGCAAAACATATTCAGCGGATTTGGTGTTGAGATGCTAAGTGAGGCTT
TAGGCATCAACGCAGTAGCAGCAAAGAGGCTACAGAGCCAAAATGATCAAAGAGGAGAGATCATACATGTGAAGA
AtggcctTCaattGtTGaaaCCGACTTTGACACaacaagcAagaACAAGcacaagCACAAGATCAATATCaacaa
gtncaaTACAGTGAACGACAGCAAACATCTTCTCgaTGGAACGGATTGGAGGAGAACTTTTGCACGATCAagGCG
AGAGTaaAcATTGAAAATCCTAGTCGTGCTGATTCATACAaCCCACGTGCCGGAAGGATaaCAAGTGTCAATAGT
CAGAAGTTCcCCATCCTTAaCcTCATCCAAATGAGCGCTACCAGagtaaaccTATACCAGAATGCTattctcTcg
cCGTTCTGGAACgtcaatgctcat > SEQ ID NO:679  188835  197293_300700_1
GCTGCCTGGTTGTCCAGAGACGTTCCAGTCAGTTAGGTCTCCCTTTGAGCAAGAGGTGGCAACAGCTGGTGAGGC
TCAATCATCAATCCAAAAAATGAGAGACGAGCACCAGCAACTTCACCAATTCCACCAAGGTGATGTAATCGCAGT
GCCAGCTGGAGTAGCCCACTGGCTATATAACAATGGTGATTCTCCTGTGGTTGCTTTCACTGTCATCGACACCAG
CAACAATGCCAACCAGCTCGATCCTAAAAGAAGGGAGTTTTTCTTGGCTGGAAAGCCTAGAAGTAGCTGGCAGCA
GCAATCGTACTCATACCAGACAGAACAACTGAGCAGAAATCAGAACATCTTTGCTGGGTTCAGCCCAGATTTACT
TTCTGAAGCCCTGAGTGTGAGCAAGCAAACTGTGTTGAGGCTCCAAGGCCTGAGTGACCCAAGGAGGTGCCATCAT
TAGAGTTGAAAATGGGCTCCAGGCACT > SEQ ID NO:680  188835  197856_300701_1
accagcccaagtttccaataacatcctcaaatagctatggcgaccatagctttctctcggttatctatctactt
tgtgtTCTTCTCCTATGCCATGGCTCTATGGCCCAGCTATTTGGTCCGAACGTAAATCCATGGCACAACCCTCGG
CAAGGAGGTTTTAGGGAGTGTAGATTTGATAGACTACAAGCATTTGAACCACTTCGGAGAGTGAGGTCAGAAGCC
GGGGTTACAGAGTACTTTGATGAGAAGAATGAACAATTCCAGTGCACAGGTACATTTGTCATCCGACGTGTCATT
GAGCCTCAAGGCCTTCTGGTACCTCGATACAGCAATACTCCTGGCATGGTCTACATCATCCAAGGGAGAGGTTCT
ATGGGATTAACTTTCCCCGGCTGCCCAGCAACCTACCAACAACAATTCCAACAATTCTTGCCTGAAGGCCAAAGC
CAGAGCCAAAAATTTAGGGATGAGCACCAAAAGATCCACCAATTTAGACAAGGAGATATCGTTGCACTGCCAGCT
GGTGTTGCGCATTGGTTCTACAATGAAGGCGATGCACCAGTTGTTGCTCTATATGTCTTCGACTTAAACAACAAC
GCTAATCAGCTTGAAC > SEQ ID NO:681  188835  284944_200102_1
GGGCGGACGCGTGGGATTGCGTTCTCTTCTTCCTCTTGCCCTTTGCTTTTTTCTCCTCTTTAATGGTTGTTTTGC
TCAAATAGAGCAACAGCAACGATTCTTATGGCAGAAACTTCAGCAACAGCAACAACACAGTCGTGGCCGAGCTAG
AACTGAGTGTCGGATCCAGAGCCTTAACGCTCGGGAACCGACTTATAAATTTGAATCGGAGGCTGGAACCACTGA
GTTTTGGGACCGTAATAATGAGGAATTCGAATGTGCTGGAGTTGCTGCTGTTAGAAATGTTATTCAACCTCAAGG
CTTGCTCTTGCCTCATTACAATAATGCTCCTCAACTCCTCTACATTGTCCAAGGGAGTGGACTTCTGGGTACTGT
AATACCTGGATGTGCTGAAACATATGAATCACCACGAAGAGAGAGAGGCATGATGGGAGAAGATAGCATAGAGGG
AGAAAGCCAGTTCAGAAGTGGTGGTGATCAACATCAGAAAGTCAGGCAATTTAGACAAGGTGATGTATTAGCATT
ACCAGCAGGTCTTACT > SEQ ID NO:682  188835  279411_200062_1
ccgtccgcTTCTCTACACAACAATAATAATCATGGGTTCTAGCTGGCTCTCTTTCTCCTTGAGTTTCCTACTGGT
GTTGCACGGTACCTTTGCTCAGCAGAGATACCAGCAGCGGCAAGGCGAATGCCAACTCAATAGACTTAGCCCTCA
GGAACCCACCACCCGCATTCAAGCCGAAGCTGGAGTCACCGAGTTGTGGGACCAAAACAACCAGCAGTTCCAATG
TGCTGGCGTCTCGCTAATTCGCCACGTCATCCAGTCTAGAGGCATGCTGTTGCCTTCTTATGTCAACACTCCCCT
ACTTGCCTATGTTGAACGAGGTCGGGGATTTTATGGCATCATGCAATCTGGATGCCCTGAAACATTCCAGTCGTC
CTTGCAAATGCAGCAAGGTGAAAGGGGTGCAGGCTCAAGATTCCAAGATCGCCATCAGAGGATTGGACAGTTCAG
ACAGGGTGACATTATTGCCTTCCCTGCTGGAGCTGCTCACTGGGCCTATAACGAAGGAAATGAGGAGCTTGTTCT
TGTTTGTTTAGAAGACAGCAGTAACAATGCCAACCAACTTGGTCAATTTTCAAGGAGATTCTTCATAGCTGGAAA
CCCACAACAAGGACAGCAACAACAGGGACAATACGGTGGCAAAAGCTTGCGCAGGGAACGATTCGAATCTGGAAA
TGTTTTCAATGGCTTTGACGTagaggtCTTGgccGAggCATTTGGTGTAgACAGGGAGATAGCAAggAGACttca
aggACAGGACGACcagcGAggCCACATTGtaaACATTGAGCaaggACTCAGAGttgtga
```

Figure 2 continued

> SEQ ID NO:683 188835 196591_300704_1
GCATCCATAAATCGCCCCATAGTTTTCTTCACAGTTTGCTTGTTCCTCTTGTGCAATGGCTCTCTAGCCCAGCAG
CTATTAGGCCAGAGCACTAGTCAATGGCAGAGTTCTCGTCGTGGAAGTCCAAGAGAATGCAGGTTCGATAGGTTG
CAAGCATTTGAGCCAATTCGGAGTGTGAGGTCTCAAGCTGGCACAACTGAGTTCTTCGATGTCTCTAATGAGCAA
TTTCAATGTACCGGAGTATCTGTTGTCCGTCGAGTTATTGAACCTAGAGGCCTTCTACTACCCCATTACACTAAT
GGTGCATCTCTAGTATATATCATCCAAGGGAGAGGTATAACAGGGCCAACTTTCCCAGGCTGTCCTGAGTCCTAC
CAACAACAGTTCCAACAATCAGGCCAAGCCCAATTGACCGAAAGTCAAAGCCAAAGTCAAAAGTTCAAGGATGAA
CATCAAAAGATCCACCGTTTCAGACAAGGAGATGTAATTGCATTGCCTGCTGGTGTAGCTCATTGGTGCTACAAT
GATGGTGAAGTgccaGTTGTTGCCATATATGTCACTGATCTCAACAACGGTGCTAATCAACTTGACCCTaggCAA
AGGGAttTCTTGTTAGCTGgaAAtaagAGaAACcCTCaAGCATACAGGCGTGAGGTTGAGgagcggTCACAGaaC
a > SEQ ID NO:684 188836 196117_300724_1
CTACATTTACACCATCTAGTAATCTTGTTAAGCATCTCCCATACGCTGTCAACAATGGCATCATACAAGATCTTG
GTTGTCTTTGCTTTGCTAGCTCTTTCTGCAAGTGCAGCTACCGCAATCACCACCACTATACCATACTTCCCATCA
ACACTAGCAATGGGCACCATGAATCCCTGTAAGCTGTACATGATGCAAACTTTGGGCATGGGTAGCTACGCAACC
ATGTTCATGTCACAACCAATTGCTCTCCTGCAACAACAATGTTGCATGCAACTACAAGGCATGATACCACAAGTG
CCTTTGTGGTGCTAGTTGTCAAATGATGCAGAACATGCAAAATGCTATTTGTGGTGGACTCGGGCAACAACAAAT
GATGATGAAGATGGTGATGCAACTGCCATATGTGTGCAACATGGCACCCGCCAACTTTCAAACTCTTTCCTTATG
GTTGTTGTTGATCGAATTTCAATTACTTTGTATAGTCAAATAACAAGTGTATGATGCATACTATCGTGTGCATCT
CACACTGGTGGAGAAACCGTTTGTAGTCCCGGTTGATAACCCCCCTTTAGTCCCGGTTTCCAACCGGGACTACGA
ATCCGGGACTAAAGATCGCTAT > SEQ ID NO:685 188836 264911_301440_2
gAAcTgATGTGAGAGATGTAGAagttttgaGTGAGATTTATATCTCTATCAaTGACAATtacgaatCTTACAAAG
ACTTTAAGGTGCTTGATGCTTTGGATAAGGCTTTAGTGGATAGATATCGATCCCCTTATAGTGCTATTTCTGCTT
TGGTTTCTTTATGTTATCATATCTTTGACTTTAATAAGTTTAAGTTGCTGTTTAATTGTGAAGGGAAATTTGTGG
ATAAGAAGCTGAGAAAAGACTTCGAGTGGTGAACTCTAGGTCCTGATGTTTAAATCTACTGTATTTACCTTCGCA
TTAATTAAGCATGGCAGCATACACCAGCAAGATCTTTGCCCTGTTTGCCTTAATTGCTCTTTCTGCAAGTGCCAC
TACTGCAATCACCACTATGCAGTATTTCCCACCAACATTAGCCATGGGCACCATGGATCCGTGTAGGCAGTACAT
GATGCAAACGTTGGGCATGGGTAGCTCCACAGCCATGTTCATGTCGCAGCCAATGGCGCTCCTGCAGCAGCAATG
TTGCATGCAGCTACAAGGCATGATGCCTCAGTGCCACTGTGGCACCAGTTGCCAGATGATGCAGAGCATGCAACA
AGTTATTTGTGCTGGACTCGGGCAGCAGCAGATGATGAAGATGGCGATGCAGATGCCATACATGTGCAACATGGC
CCCTGTCAACTTCCAACTCTCTTCCTGTGGTTGTTGTGCGGCCGCTTATCCGTATGATGTTCCGGATTATGCCGA
GCTCTACAAACAGCTGTTGAATTTTGATTTGCTGAAGTTGGCGGGTGACGTGGAATCTAACCCTGGTCCTAGGTC
TAGAATGGCTACTTTCTCTTGTGTGTGTTGTGGTACCTTAACTACAAGTACTTACTGTGGTAAGAGATGTGAGCG
AAAGCATGTATATTCTGAAACAAGAAATAAGAGATTGGAACTTTACAAGAAGTATCTAtnggaaccgcaaaaatg
cgcc > SEQ ID NO:686 188836 197809_300701_1
AGCATAATAACACTGTAGTGCCAACAATGGCAGCATACAAGATCTTGGCCCTCTTTGCGTTACTTGCTCTTTCTG
CAAGCGCCGCTACTACAATCACCACCATGCCATATCTCCAACCAACAATAGCAATGGGCAATATGGATCCGAGTA
CGCAGTACATGATGCAAACGACGGGCACAGATAGCTACGCAACAATGTTCATGCCACAACCAATTGCTCTCCTGC
AACAATAGTGTTGCATGCAGCTACAAGGCATGATGCCACAGTGCCAGTGTGGGTATGGTACTAGTTGCCAGATGA
TACAGAACATGCAATATGCTATCTGTGGTGGCACTTGGCCAACAACAAATGATGATGAAGATGGCGATGCAACTT
CCAAACATGTGTATCATGGCCCCTGCCTACTTCCAGCTCTCTCCCTATGGTTGTTG > SEQ ID NO:687 188877 136901_300440_1
AAAAAAAGGAAAAAAAAAAACCAAAACACACCAAGCCAAATAAAAGCGACAATGGGATCGCTCACCACCAACAT
CGTCCTCGCCGTCGCCGTGGTGGCCGCGCTGGTCGGCGGCGGGTCGTGCGGCCCGCCCAAGGTGCCACCCGGCCC
GAACATCACGACCAACTACAACGCCCGTGGCTCCCCGCCAGGGCCACCTGGTACGGCCAGTCCTACGGCTCCGG
CCCCGCTGACAATGGTGGCGCGTGCGGGATCAAGAACGTCAACCTGCCTCCCTACAACGGCATGATCTCCTGCGG
CAACGTCCCAATCTTCAAGGACGGCAGGGGATGCGGCTCATGCTACGAGGTGAAGTGTGAGCAGCCGGCGGCGTG
CTCGAAGCAGCCGGTGACGGTGTTCATCACGGACATGAACTACGAGCCCATCTCGGCGTACCACTTCGACTTCTC
CGGCAAGGCGTTCGGCGCCATGGCTTGCCCGGGGAAGGAGACCGAGCTCCGCAAGGCCGGCATCATCGACATGCA
GTTCAGGAGGGTGCGCTGCAAGTACCCCGGCGGCCAGAAGGTCACCTTCCACGTCGAGAAGGGCTCCAACCCCAA
CTACCTCGCCGTGCTCGTcaagtTCGTCGCc

Figure 2 continued

> SEQ ID NO:688 188877 197255_300700_1
ctaagtaacacccatcagcaaCAATGGCATCCTCTTGTCTCCTTCTGGCCTGTGTCGTGGCAGCGGCCATGGTGT
CTGCAGTGTCATGTGGGCCGCCCAAGGTGCCGCCTGGCCCCAACATCACTGCGGCCTACGGCAAACAGTTGCTGG
AAGCTAGGGGTACCTGGTACGGCAAGCCAAAGGGTGCCGGCCCCGACGACAACGGCGGCGCTTGTGGGTACAAGG
ACATTGACAAGGCTCCCTTCCTCGGCATGAACTCATGTGGCAATGACCCTATCTTCAAGGATGGCAAGGGCTGCG
GCTCCTGCTTTGAGGTCAAGTGTTCCAAGCCAGAGGCCTGCTCCGACAAGCCCGTCATCATCCACATCACCGACA
TGAACACTGAGCCTATCGCCGCCTACCACTTCGACCTCTCCGGCCATGCTTTTGGTGCCATGGCTAAGGAAGGCA
AGGATGAGGAACTCCGCAAGGCGGGAATTATCGATATGCAGTTTCGTCGCGTCCGCTGCAAGTACCCTGGTGAGA
CTAAGGTCACCTTCCACGTTGAGAAGGGCTCCAACCCCAACTACTTTGCAGTGCTTGTCAAGTACGTCGGTGGTG
ACGGTGATGTCGTGAAGGTGGAACTTAAGGAGAAAGGCTCTGAGGAGTGGAAGCCACTCAACGAGTCATGGGGTG
CTATCTGGAGGATAGACaCT > SEQ ID NO:689 188877 144425_200135_1
caaccgatagccaaagagctgagaacTCTGGCAATGGCTACCCACTGCTCTTCCTCTTCGTTAATGTTCACTTCC
ACTTCACCAAAATCCTTTTCTTTTTCCCCAAAGAAAACCCCATTTCTGGGTTTCTCAATGGCAGCCTTATCGAAG
CCGTCGTTTCAGTTATCACCCCTCGCCAAGACCAATCGGACGGCCCAAATTCGTTGCCAAGATAAAGCTGCCGCC
TACATTCCTCTTGACCAACGATGGATGTTCGTAGAGTCTGAAATTGACGGCCCTGACATTTGGAACGAGACATGG
TATCCCAAGGCTTCTGACCATGTGAACACAGACAAACCATGGTATATTGTTGATGCCTCTGATTTAATTCTTGGA
AGAATGGCATCAACTATAGCGATACATATGAGAGGGAAGAATCTGGCCACATACACTCCAAGTGTTGACATGGGT
GCATTTGTCATAGTGgtTaATGCTGAgaacgtTGCTGTATCTGGGAaGaagacgacCcAaaaactctataggaga
CACTCTGgcaCACCtggtgggATGAAagtGGAGACTtttgatcaactgcaacagaGAattccTGAAAGaatcAtt
GAgcatgcTG > SEQ ID NO:690 188877 146185_200014_1
AAAAGTTGCTTACTTTTCAGTGCCTCCGCCCTTCAGTCTGGTGCGTGTGGTTATGGAGATTTAGCAATAGGCTTT
AATGGGGGTCGACTTGCTGCTGCTATTCCTAGCCTTTACAAAGAAGGAGCTGGTTGTGGTGCTTGTTATCAGATT
AGATGCAAAGACTCAACACTCTGTTCGAAAGAGGGCACAACTGTAATTGTAACTGATCTAAATACCAATAACCAG
ACGGATTTTGTGATCAGTAGCCGAGCTTTTATGGCCATGGCCAATAAGGGAAAAGCTAAAGACGTTCTCAAATTG
GGAATTGCTGATGTTGAATATAAAAGAGTTCCATGTGATTACAAAAGCAAGAATTTGGCCATTCGTGTGGAAGAA
TCAAGTCAAAAACCAAATTATCTAGCAATCAGCTTCTTGTACCAAGGTGGTCAAACTGAAATTGTCGCTGTCGAC
GTAG > SEQ ID NO:691 188877 209275_300813_1
CGCCACCTCTCTCATCGGATCCCTGCAGAGGAGGAGAGGGCAGTGGCGGCGAAAGGCGACATGGGCTCGCTGTCC
TCTCTCGCCGCCGCGGCGGTGTTTCTCTCCCTCCTCGCCGTCGGCCACTGCCGCCGCCGCCGACTTCAACGCCACC
GACGCCGACGCCGACTTCGCCGGCAACGGCGTGGACTTCAACTCCAGCGACGCCGCCGTCTACTGGGGCCCCTGG
ACCAAGGCCAGGGCCACCTGGTACGGCCAGCCCAACGGCGCCGGCCCCGACGACAACGGCGGCGCGTGCGGGTTC
AAGCACACCAACCAGTACCCGTTCATGTCGATGACCTCCTGCGGCAACCAGCCATTGTTCAAGGACGGCAAGGGA
TGCGGCTCTTGCTACAAGATCAGATGCACCAAGGACCAGTCGTGCTCCGGCAGGTCGGAGACGGTGATCATCACC
GACATGAACTACTACCCGGTGGCTCCGTTCCACTTCGACCTCAGCGGCACGGCGTTCGGCAGGCTCGCCAAGCCT
GGCCTCAACGACAAGCTGCGCCACTCCGGCATCATCGACATCGAGTTCACCAGGGTGCCATGCGAGTTCCCGGGG
CTCAAGATCGGGTTCCACGTG > SEQ ID NO:692 188877 201317_300715_1
CCCACGCGTCCGATTATATTGCAGCAATGGCATCCTCCTCCCTTCTACTCGCCTGTGTTGTGGTGGGGGCTATGG
TGTCCGCCGTCTCCTGCGGGCCACCCAAGGTGCCACCGGGCCCCAACATCACGACAAGCTACGGCGACAAGTGGC
TGGAAGCCAAGGCCACCTGGTATGGTGCGCCCAAGGGTGCTGGCCCCAAGGACAACGGCGGCGCCTGCGGGTACA
AGGATGTCGACAAGGCTCCCTTCCTCGGCATGAACTCCTGCGGCAACGACCCCATCTTCAAGGACGGCAAGGGCT
GCGGCTCATGCTTCGAGATCAAGTGCTCCAAGCCGGAGGCCTGCTCCGACAAGCCCGCCCTTATCCACGTCACCG
ACATGAACGACGAGCCCATCGCTGCCTACCACTTTGACCTCTCCGGCCTTGCCTTCGGCGCCATGGCTAAGGATG
GCAAGGACGAAGAGCTCCGTAAGGCCGGCATCATCGACACGCAGTTCCGCCGCGTCAAGTGCAAGTATCCTGCCG
ACACCAAGATCACCTTCCACATCGAGAAGGCCTCCAACCCCAACTACCTTGCGCTGCTAGTCAAGTACGTCGCTG
GTGATGGTGACGTCGTGGAGGTGGAAATCAAGGAG > SEQ ID NO:693 188877 181650_300626_1
GATCCGGCGTTACCATACGCTTCGTCATCGGCGATGACCTCAACATTATCAACAACCAACAACAAAACCCCATTT
CTGGGTTTCACATTTGCCTCTGCAAAACCTTCTTTTTTAGTTAAAACCTTAAATAACAATAATTCTAAGCAGCAA
TCTCTTTCGATTCGTTGTCAAAACCTAACCGCTGTACCTAAAGATGAACGATGGATGTTTGAAGATTCTGAAATC
GGCGGACCAGACATTTGGAACAAGACCTGGTATCCTAAAGCTGCTGATCACATAAACACAGAGAAGAAATGGTAT

Figure 2 continued

```
GTGGTTGATGCGACTGACTTAATTTTGGGCAGAATGGCATCAACCATCGCCATTCACATTCGTGGGAAGAATCTC
GCAACCTATACTCCCAGTGTTGACATGGGGGCTTTTGTAATTGTGGTTAATGCAGAAAAAGTTGCTGTATCTGGG
AAGAAAAGATTGCAAAAGCTAPATAGGAGACATTCTGGAAGACCAGGTGGTATGAAGGTAGAGACTTTTGATCAG
CTCCAACAGAGAATTCCTGAAAGAATAATCGAGCATGCTGTCCGCGGAATGCTTCCGAAAGGAAGACTGGGTAGA
GCGTTATTCAACCATCTCAAGGTATACAAGGGTGGGGAGCATCCACATGAGGCCCAAATGCCTGTTGATCTTCCA
ATAAGAGACAAAAGGATACGAATTCAGAAATAGGCATACCACATGAAGTATGGAGTTAGTTGGGGTTTTAACACT
TCTGAAGATTGTGGTCATGAGCCTAGGCTTTCTTGAATATGTACAACTTATTATTGTGTATGATTTTGTATGAAT
CTAGTGGATATCAAGtaaatttcattttgagttttgtagaatctatatccgactttgagttctcatgtaatgcaa
ggaatttcataaaaaaaaaa
```

> SEQ ID NO:694 188877 196523_300704_1
```
gaatcctacctgactagtactaccactactagctagtagcgagctactctctctggtcatcaagctttgagtggt
tggagTGGTGGCAGCTATGGCTTTTTCCATCTCCAAGAAGGCTGCAGTTGCTGCACTCTTCTCCTTCCTTGTTGT
CACCTGCGTCGCCGGCGCCAGGCCGGGGAACTTCAGCGCCTCCGACTTCACCGCCGATCCCAACTGGGAAGTCGC
CAgggccaCCTGGTACGGCGCTCCCACCGGCGCCGGCCCTGACGACGATGGCGGTGCTTGCGGGTTCAAGAACAC
CAACCAGTACCCGTTCTCGTCGATGACCTCCTGCGGCAACGAGCCTATCTTCAAGGACGGGAAGGGCTGTGGCTC
ATGCTACCAGATAAGATGCGTCAACCACCCTGCCTGCTCCGGCAACCCGGAGACGGTGATCATCACCGACATGAA
CTACTACCCCGTTTCCAAGTACCACTTCGACCTGAGCGGCACGGCGTTCGGCGCCATGGCCAAGCCGGGGCAGAA
CGACCAGCTCCGCCACGCCGGCATCATCGACATCCAGTTCAAGAGGGTGCCGTGCAACTTCCCTGGGCTGAAGGT
GACGTTCCACGTGGAGGAGGGGTCGAACCCGGTGTACTTCGCGGTGCTGGTTGAGTACGAGGACGGCGACGGCGA
CGTGGTGCAGGTGGATCTCATGGAGGCCAACTCCCAGTCGTGGACGCCGATGCGCGAGTCGTGGGGCTCCATCTG
GAGGCTCGACTCCAACCACCGCCTCACGGCGCCCTTCTCGCTCCGCATCACCAACGAGTCCGGCAAGCAGCTCGT
CGCCAGCCAGGTCATCCCGGCCAACTGGGCCCCCATGGCCGTCTACCGTTCTTTCGTCCAGTACAGCAGCTAAGC
CAATGATCAAGAACAAGCATAATTCATGCCTACTATAGCAGCAGCAGAAGCAGCATTAGCTACTATACATACCTC
TACGTACGACATTTGAGATCGATCGTTTGGCCATTTTTATCTGCTCGGGTATTGATTAGCTCTCCCTCGGTATTg
taTGGATTTGCATGGATG
```

> SEQ ID NO:695 188959 146155_200014_1
```
GCCGAAAACCCAAAGAAATCAAAACCAGGGAAAGTTCTCTTTTTCAACTGGATAATTCAAAGAATTATTCTGCTG
ATTCCAAAATCAAAATTGAGTAGAAGATCAGAAAAAGATGGGGATCAGATTCGTATTAATGGTAAATAAGCAAGG
GCAAACTCGGCTGGCTCAGTACTATGAGTACCTCACTTTAGAAGAAAGGCGTGCTCTTGAGGGTGAAATTGTGCG
TAAATGCCTTGCTCGCAATGAACAGCAGTGTTCATTTGTGGAGCATCGTAATTACAAAATCGTGTACAGGCGGTA
TGCGTCACTCTTTTTCCTGGTTGGAGTTGATAATGAAGAAAATGAACTTGCTATTTTGAATTCATTCACCTGTT
AGTTGAAACCATGGATCGTCATTTTGGCAATGTGTGCGAGCTGGATATAATGTTTCATCTTGAAAAAGCACACTT
CATGCTGGAGGAGATGGTAATGAATGGGTGTGTTGTTGAGACAAGCAAGGCAAACATCCTGGCTCCAATTCAGCT
AATGGAAAAGGCATCATAAGTAGTACACTCTGATCCATGGAATTCGTAATAAACCGATTTGCTTGTGTAGTGTTT
ACGTTTTGGGATTTGTGCT
```

> SEQ ID NO:696 188959 8156_300316_1
```
TTCTGGAGATCTCTTCTGGGAATCGAGCTTCACTGTTAAAGATTTTCCTTCAATCGGCTAAAAATGATACATTTC
GTGTTACTAGTCAGTCGACAAGGGAAAGTAAGGCTCACCAAGTGGTATTCGCCGTATACGCAGAAGGAAAGATCT
AAGGTCATACGTGAACTCAGTGGAGTGATTCTGAACCGAGGTCCCAAGCTCTGCAATTTTATTGAATGGAGAGGA
TACAAGGTTGTCTACAAAAGATATGCAAGCTTGTACTTCTGCATGTGCATTGATGAGGCGGATAACGAGTTAGAG
GTACTGGAGATAATTCATCACTACGTCGAGATTCTTGACCGCTACTTTGGCA
```

> SEQ ID NO:697 188959 257918_301687_1
```
GCGATCTCGACGAGATGATCAGATTTATTCTGCTGCAAAATCGGCAGGGAAAGACTCGTCTCGCCAAGTACTACG
TCCCACTCGAAGACTCTGAGAAGCAAAAGCTCCAGTATGAGGTCCACAGGCTCGTTGTCAATCGGGATCCAAAAT
TCACGAACTTTGTCGAGTTTCGCACACACAAGGTGATCTATCGACGCTATGCCGGGCTCTTCCTTTCAATGTGTG
TGGACATCACCGATAACGAGCTGGCCTATCTGGAGAGCATCCACCTCTTTGTGGAAATTCTAGACCATTTCTTCA
GCAACGTCTGCGAGCTTGATCTGGTTTTCAAACTTCCACAAGGTTTACTTGATCCTCGACGAGTTCATTCTCGCT
GGCGAGTTACAAGAAACCAGCAAAAAGGCAATAATCGAGCGCATGGCAGAGCTAGAGCGGCAGGAATAAGCATAC
TCGATCGTCTCAGTTTTTCAAAACGCGATAGGCAGCCTCCGGGCACGCACAAAGGCATCGAGTNTATCCCAAAAC
TCGAGAACTGCCGTTCGGTCCTGGTGCCTCTTGTGCTTGCTCAGCTGTTTAAGCAAACAAAGAAGTGTAAGAAGT
CATTCGAATTC
```

> SEQ ID NO:698 188959 233995_301095_1
```
GGGGGAGATTATGGCGATTCGATTCGTGTTGCTGGTGAACAAGCAAGGTCAGACGCGATTGGCGCAGTACTACGA
GCAGCTGACGATCGACGAGCGCCGGGCGCTGGAGGGCGAGATCGTGAGGAAATGCCTGGCGAGGACGGAAAATCA
```

Figure 2 continued

```
GTGCTCGTTTGTAGAGCACCGGAATTACAAGGTCGTGTATCGGCGCTACGCTTCTCTCTTCTTCCTCGTTGGAGT
AGACAGCGAAGAGAATGAGCTAGCGATACTGGAATTCATCCATTGCGTCGTGGAGACAATGGATCGCTACTTTGG
CAATGTGTGCGAGCTGGATATAATGTACCATTTGGAGAAGGCCCATTTTATCCTGGAAGAGATGGTGATGAATGG
CTGCATTCTAGAGACCAACAAGAGTAATATTCTGGGGCCTATACAGCTTATGGACAAATCGTCCTAGTAACAAAG
TACGTGTCGTCCCCAAGGTAGATTTCTGACGACCTGGATTTGGAAATCTCGACGAGCTATGGCTGGAAATAAAGG
AGACTTTG

> SEQ ID NO:699  188959   217634_300910_1
TCCTGCACACACGCACAACTGCAGCCATGCTCTCTTTTATCCTCATCCAGAACAGACAGGGCAAGACCCGTCTCG
CCAAATGGTACGCCCCCTACAGCGACGACGAAAAGATCAAGCTCAAGGGCGAGGTCCACCGCCTCGTCGCCCCC
GCGACCAAAAGTACCAGTCCAACTTCGTCGAGTTCCGCAACAACAAGATCGTCTACCGCCGCTACGCAGGGCTCT
TCTTCTGCGCCTGCGTCGACACAAACGACAACGAGCTCGCCTTCCTCGAGGCTATCCACTTCTTCGTCGAGGTCC
TCGACGCCTTCTTCGGAAACGTCTGCGAGCTCGACCTCGTCTTCAACTTTTACAAGGTGTATGCTATTCTTGACG
AGGTCTTTCTTGCGGGCGAGATTGAGGAGACGAGTAAACAGGTTGTTTTGACGCGGCTGGAGCATCTGGATAAGC
TGGAATAGTAGCGCGTGGGAGGGACGCGTCTTTTTTTTTACAAAAACCCTTTTTTTTCTGGCGTTATATATTCTC
CCCCCTTACACTTCTTCCTTTGTCCTCTTTAATGAAGAGAAG

> SEQ ID NO:700  189013   170328_300532_1
CCCCCGAGCAAGCAAAGGAAAGAACTTCCCTTGCACCACCACCTGATCAGAGAAGTAGCTAGCTGCAGGAGAGAA
ACCGACCAACAATGGCGGAGTACTACTCCAGCACCGTGGACGAGTGCTACGAGACCACCGGCAGGCAGCACGGCC
ACGGGCACGGCCACGGTCACGGGCACGGGCACGGGCATGGTGGCATGAGGGTGGAGTCCCACACCGACGACTACT
ACAGCGAGGGCGGCGAGATCGACCGTGGAGGAGGAACAACTCCATGCACTCGCAGGAGTACCTGATGAGGCAGC
AGAGCGGCCATGGCGGCTACGGCTACGGCGGCGGCCAGCAGCAGGAGTACTACAAGCGGGAGGAGCGCGAGCACA
AGCAGCGCGAGCGCGTCGGCGAGATCGGCGCCCTCGCCAGCGGCGCCTTCGCTCTCTATGAGGGGCACCAGGCGA
AGAAGGACCCGGCGAACGCGCAGAGGCACAGGATCGAGCAGGGCGTGGCGGCGGTGGCGGCGGTGGGCGCCGGCG
GCTACGCCTACCACGAGCACCGCGAGCAGAAGCAGGCCAGCTACGGCGCCAAGGAGCAGCAGTACGGCTACGCCA
GGATGCCGCAGCAGCAGGGCTACTACTGCAACTGATTAATTATTAATCACCCCCCAAATTATTAATAATCCATGC
GTACGTACGTACCACTAAATAAATACTGGCTACTACGTACGTATATATACGGTACAATAAGATGAGCAAGGATGT
ACGTACGTACACGTATATACGTTGCTCACCCACAATTTCGCCGCC

> SEQ ID NO:701  189013   202437_300784_1
CCCCCCCCGGAGGCCCAAACTAATGTTATTAGCAAGTAGCTGATGCTAGCCGCTCCTTGCTATAAATACATGTGC
TTTGCTAGTTAGCTTTTGCACAGATCAACACCGGCAACCGACTAACTCTGTCTGAAGGAAGCTAAGATTATTAAT
CAGTGAGTAGCTAGCCATGGCTGAGGAGAAGAAGCACCACCACCTGTTCCACCACAAGAAGGACGGGGAGGAGGA
GAGCTCCGGCGTGGTGGACTACGACAAGGAGAAGAAGCACCACAAGCACCTCGAGCAGCTCGGCGGCCTCGGCGC
CATCGCCGCCGGCGCCTACGCTCTCCACGAGAAGCACCAGGCGAAGAAGGACACGGAGAACGCGCACGGGCACAA
GGTGAAGGAGGAGGTGGCGGCGGTGGCCGCGCTGGGCGCCGCGGGGTTCGCCTTCCACGAGCACCACGAGAAGAA
GGACGCCAAGAAGCACGCCGCCGACCAATACTAGATCGATCCCGATCGAATGAACGCAAGAACGAACGGTTTATA
TGCTTAATTACTTTCTCCCCATAATTACATGTATGCATGTGGTTGATGGCTTAATTTGCTTCTTCTTGTTCGTCG
TCATA

> SEQ ID NO:702  189013   188970_300611_1
GATAAACATTAAACAAGCTGTGTGAACTTCTTTTTTCGTGACAAGTTTAATTCTTTCTCGATCGATCGTCGTGAT
GGCTGACGAGTACGGCCGCGGCGTACGGCAGGTCCGGCGCCGGCGCCGGCGACGACTACGAGAGCGGCGGCTA
CAACAGGTCCAGCTCCGGCGGCGCCGACGAGTACGGCCGCGGCCGGGAGGCGGTGCCGGTGGCTACAACAAGCC
CGGTGGCACCGACGACTACGACAGCGGCTACAACAAGTCCGCCGGCGGCGACGACGACTACGCCGCCGCACCGG
CGGCGGCGGTACAACAAGTCCGGCACCGACGACGACTACGACAGCGGCTACAACAACAGGTCAGGGCTAACGA
GAAGTACGGCCGCAACAAGTCCGGCGACGACGAGTACAGCGGCGGCGGCGGCGCCGAAGCCGACGAGGAGTACGT
CGACGGGTTGTCGTCCCGGGACGACCCGGAGAAGTACAGGAAGGAGGAGAAGGAGCACAAGAACAAGGAGCGCCT
CGGCGAGGTGGGCGCCCTCGCCGCCGGCGCCTTCGCCATGTACGAGAGGCACCAGGCGAAGAAGGACCCGGAGAA
CGCGCAGCGGCACAGGAT

> SEQ ID NO:703  189013   228311_301020_1
CCCACGCGTCCGCTTATTGTCACTTCCATCTCATTCTCCTAATTGTCATCACTAGCTTCTAGCTAGCTTAATTAA
TTAATTAGCCATGGCGGAGGAGAAGCACCACCACCACCTGTTCCACCACAAGAAGGACGACGAGCCGGCCACCGG
AGTAGACTCCTACGGCGAGGGCGTCTACACGTCGGAGACGGTGACCACCGAGGTGGTCGCCGGCGGCCAGGACGA
GTACGAGAGGTACAAGAAGGAGGAGAAGCAGCACAAGCACAAGCAGCACCTCGGCGAGGCCGGCGCCCTCGCCGC
CGGCGCCTTCGCCCTGTATGAGAAGCACGAGGCGAAGAAGGACCCGGAGAACGCGCACAGGCACAAGATCACGGA
GGAGATCGCGGCCACGGCGGCGGTCGGCGCCGGCGGCTACGCCTTCCACGAGCACCACGAGAAGAAGAAGGACCA
```

Figure 2 continued

```
CAAGAGCGCCGAGGAGTCCACCGGCGAGAAGAAGCACCACCTCTTCGGCTGATCGACCTCATCACAACGTCGCCG
GCGGCGGCGACGACCTCGCCGTACGTCGCCGGCCGCCGTGTCGTCGATTTGTGTGTGTAATAATTTGTCTTCTTC
TGCATGCGTGGTGTTGCTGTTTTTCACAAGAGTCTCCGGCCTCGACCAGTGAGAGGCTGACAGGTGGGGCCGTGA
GTTCAGCTTGTGTTGCTTGATTTTCTCTGCAGCCTTGCCCTCTGTGTGTCCAAATAAGTGGTGTGCATGGCTCTC
TCCGTGTCATGTATCAATGTATTTTTATCTGTACTTTGTACAAGTGAAGCAATATTTATCGAACCTTGACTTTCT
CCATTCTAtgggAaaaaCc > SEQ ID NO:704  189037  188984_300611_1
cacCACAATTCAAATATTATAGTTGAAGCATAGTAGTAGAATCCAACAACAATGAAGATCATTTTCGTATTTGCT
CTCCTTGCTATTGTTGCATGCAATGCCTCTGCGCGGTTTGATCCTCTTAGTCAAAGTTATAGGCAATATCAACTA
CAGTCGCATCTCCTACTACAGCAACAAGTGCTCAGCCCATGCAGTGAGTTCGTAAGGCAACAGTATAGCATAGTG
GCAACCCCCTTCTGGCAACCAGCTACGTTTCAATTGATAAACAACCAAGTCATGCAGCAGCAGTGTTGCCAACAG
CTCAGGCTGGTAGCACAACAATCTCACTACCAGGCCATTAGTATTGTTCAAGCGATTGTGCAACAGCTACAACTG
CAGCAATTTAGTGGTGTCTACTTTGATCAGACTCAAGCTCAAGCCCAAACTCTGTTGACCTTCAACTTGCCATCC
ATATGTGGTATCTACCCTAACTACTATAGTGCTCCCAGGAGCATTGCCACTGTTGGTGGTGTCTGGTACTGAATT
GTAACAATATAATAGTTCGTATGTTAAAAATAAAGTCATACATCATCATGTGTGACTGTTGAAACTTAGGGTCAT
ATAAATCTAAATAAAATCATCTTACCTAAAAAAAaa > SEQ ID NO:705  189037  196601_300729_1
CAAACATTATAGTTGAAGCATAGTAGTAGAATCCTACAAAAATGAAGATCATTTTCGTATTTGCTCTCCTTGCTA
TTGTTGCATGCAACGCTTCTGCACGGTTTGATGCTCTTAGTCAAAGTTATAGACAATATCAACTACAATCGCATC
TCCTGCTACAGCAACAAGTGCTCAGCCCATGCAGTGAGTTCGTAAGGCAACAGCATAGCATAGTGGCAACCCCCT
TCTGGCAACCAGCTACGTTTCAATTGATAAACAACCAAGTCATGCAGCAACAGTGTTGCCAACAGCTCAGGCTGG
TAGCGCAACAATCTCACTACCAGGCCATTAGTAGCGTTCAGGCGATTGTGCAGCAACTACAGCTGCAGCAGGTCG
GTGTTGTCTACTTTGATCAGACTCAAGCTCAAGCTCAAGCTTTGCTGGCCTTAAACTTGCCATCCATATGTGGTA
TCTATCCTAACTACTACATTGCTCCGAGGAGCATTCCCACCGTTGGTGGTGTCTGGTACTGAATTGTAATAGTAT
AATGGTTCAAATGTTAAAAATAAAGTCATGCATCATCATGCGTGACAGTTGAAACTTGATGTCATATAAATCTAA
ATAAAATCACCTATTTAAATAGCAaa > SEQ ID NO:706  189037  197266_300700_1
cccacgcgtccgccttactgaaaaatcacaaacatcaaaacgttataagagttctCTAGCATCCATCACATAGCC
ATGAAGATCTTTGTCATCCTCTCTCCTCGCCCTCGCAGCGAGCAGCGCCTCGGCACAGTTTGATGCTTGCACC
TATGGGCAATGCCAGCAGCAGCCGTTTATGCAACCGATCATGAACCCGTGCAATGAGTTCGTGAGGCAACAGTGC
AGCCCGATGAGCCTACCTTGGGAGCAGTCACGCAGGCTACAACTGAGCAGCTGCCAGGTGATGCGGCAGCAATGC
TGTCAGCAGATGAGGTTGATGGCGCAACAATATCATTGCCAGGCTATTTGCACCATGGTGCAGTCTATCATGCAG
CAAGTGCAGTTTGATGCTGGCTTTGTTGGCGAGCCCCAAGCTCAGgCCCAGGCCCAGGTGGCTCTCAATTTGCCC
TCCATGTGTGGAGTCTACCCTaGGTACTGCAGCACTCCATGCAAAGTTGCTACTGGTCATTGCGGTTCTTGGTAG
TGTGTACCATCATATATATATAGTTGGATAAATAAAGTGTCACACATCATCGTGTGTGTCATgt > SEQ ID NO:707  189037  197218_300700_1
aTCACAACTCAAACATTACAGCGAAAGCATAACAACTAGAATCCCACCACAATGAAGATCATTTTCTTCTTTGCT
CTCCTTGCTATTGCTGCATGTAGCGCCTCTGCGCAGTTTGATGCTGTTACTCAAGTTTACAGGCAATATCAGCTG
CAGCCGCATCTCATGCTGCAGCAACAGATGCTTAGCCCATGCGGTGAGTTCGTAAGGCAGCAGTGCAGCACAGTG
GCAACCCCCTTCTTCCAATCACCCGTGTTTCAACTGAGAAACTGCCAAGTCATGCAGCAGCAGTGCTGCCAACAG
CTCAGGATGATCGCGCAACAGTCTCACTGCCAGGCCATTAGCAGTGTTCAGGCGATTGTGCAGCAGCTACAGCTA
CAACAGTTTGCTGGCGTCTACTTCGATCAGGCTCAAGCTCAAGCCCAAGCTATGTTGGCCCTAAACTTGCCGTCA
ATATGCGGTATCTACCCAAGCTACAACACTGCTCCCTGTAGCATTCCTACCGTCGGTGGTATCTGGTATTGAATT
GTAGCAGTATAGTAGTACAGGACACAAAAATAAAGTCATGCATCATCGTGTGTGACAAGTTGAAACATCGGGGTG
ATACAAATCTGAATAAAAATGTCATGCAAGTTTAAAcataatgCCTCTGt > SEQ ID NO:708  189037  196092_300708_1
ggacccacgcgtccgcaaaaaaagaaagatctagtgtcccgtagcaATGAAGATCATTTTCGTCTTTGCTCTTCT
TGCTATTGCTGCTTGCAGCGCCTCTGCGCAGTTTGATGTTTAGGTCAAAGTTATAGGCAATATCAGCTGCAGTC
GCCTCTCCTGCTACAGCAACAGGTTCTTAGCCCATATAATGAGTTCGTAAGGCAGGAGTATGGCATAGCGGCAAG
CCCCTTATTGCAATCAGCTGCGTTTCAACTGAGAAACAACCAAGTCTGGCAACAGCTCAGGCTGGTGGCGCAACA
GTCTCACTATCAGGATATTAAAATTGTTCAGGCCATAGCGCAGCAGCTGCAACTCCAGCAGTTTGATGATCTCTA
CTTTGATCGGAATCTGGCTCAAGCTCAAGCTCAAGCTCTGTTGGCTTTGAACTTGCCATCTAGATATGGTATCTA
CCATAGGTACTATAGTGCACCTAGTAGCATTACCACCCCTTGGCAGTGTATTGTACTGAGTTTTAACAATATAGTG
```

Figure 2 continued

GTTCGGAAGTTGAAAATAGGCTCAGATATCATCATATTCGACATGTGGAACTcaggttgaTATATCCTAGTACAT
CATCGTAACTAATTACCATCGTTGGTACTCT > SEQ ID NO:709 189037 264916_301440_2
agAActgatgTGAGAgatgtagaagttTTgaGtGAGATTTATATCtCTatcaatgacaattacaaATCTtACAAA
gactttaaGGTGCTTGATgctttgGATAAGGCTTTAGTGGATAGATATCGATCCCCTTATAGTGCTATTTCTGCT
TTGGTTTCTTTATGTTATCATATCTTTGACTTTAATAAGTTTAAGTTGCTGTTTAATTGTGAAGGGAAATTTGTG
GATAAGAAGCTGAGAAAAGACTTCGAGTGGTGAACTCTAGGTCCTGATGTTTAAATCTACTGTATTTACCTTCGC
ATTAATTAAGCATGAAGATCATTTTCGTCTTTGCTCTCCTTGCTATTGCTGCATGCAGCGCCTCTGCGCAGTTTG
ATGTTTTAGGTCAAAGTTATAGGCAATATCAGCTGCAGTCGCCTGTCCTGCTACAGCAACAGGTGCTTAGCCCAT
ATAATGAGTTCGTAAGGCAGCAGTATGGCATAGCGGCAAGCCCCTTCTTGCAATCAGCTGCGTTTCAATTGAGAA
ACAACCAAGTCTGGCAACAACTCGGGCTGGTGGTGCAACAATCTCACTATCAGGACATTAACATTGTTCAGGCCA
TAGCACAACAGCTACAACTCCAGCAGTTTGGTGATCTCTACTTTGATCGGAATCTGGCTCAAGCTCAAGCTCTGT
TGGCTTTTAACGTGCCATCTAGATATGGTATCTACCCTAGGTACTATGGTGCACCCAGTACCATTACCACCCTTG
GCGGTGTCTTGTAATGAGTTTTAACAGTATAGTGGTTCGGAAGTTAAAAATAAGCTCAGATATCATCATATGTGA
CATGTGAAACTTTGGGTGATATAAATAGAAATAAAGTTGTCTTTCATATTtaaaaaaaaaaAAGaa > SEQ ID NO:710 212333 212305_300848_1
AGCTGGAGAATCGGAACCGCATGGCTCTCAGGTAACACTCGGGTGGTCCAGTGCATCAACTACTAAGATATCGAA
AATGTGGTGGCCCTTGCATCTAGCCATATCTGAGAGGTTCGGCAGGCCCAGTGCAGCTTAGAAGGGAATGCAGTT
ACCTACGTAAATTACATTCATCCAGTGTTCGGTATTACTTGCGATGCGGGATGCTGAATCGGCATTTCCCTGACT
AAGGGACTCTCGCTGGACAGTACAATGAATGATCAAGCTACAAAGGCATATATTTTTAGACGGCCAAAGTCTTAC
ATTCAGAGACATGTAGCCGTTGTTCCCCTACATAGGTTTCAGCTGTAAGGGCTTTTGTTATGAAGCCGGCATCCC
GAGTTCTCCTCCTTACATCTCGTGCTTTTTCATATAGTGGCATAGTAATCAGGTACTTGCACACCATCTTAATTA
ACGATAGTGATTTCTAAAaaaagaaacacaagg > SEQ ID NO:711 212363 205432_300798_1
CAAGAAACAAACAACCTTCTTCATCAATTCTACTACAACGACCTTCCTACTTAAACAATCTCTCGATACCAACTC
CCCAAGATGAAGTTCACTCTCGTCCTTGCTACCTTTGCCGCCGTCGTCTACGGTCAAACCATCGATGACATTCCC
GCATGTGCTCGTACTTGCATTGAGAACGCCGTTCTAGCCGCTGGTTGCTCGTCTGGAACTGACGTCGCATGCGCT
TGCGCACATTTCACTGCTGTTCAGAATGGCTCTACTAGCTGTGTCATTGCTGCTTGTGGCGTTTCTGTCGCCATT
AACCAAGTTCTGCCTGCCACCCAGGCTCTTTGTGCCAACCAGTGAACTCATCCATCGAGAGGGAGAAAATGACAT
GGGAGAAAATCAGGTACTCTTGTACATTGACAAACAAGTACATAGCTGAATGGTGTGAATGAATAAAACGCATTG
CTGCTGGACACCGCTCTGTTCATTTCtgcaAAAa > SEQ ID NO:712 212363 220353_300954_1
AAACAACCTTCTTCATCAATTCTACTACAACGACCTTCCTACTTAAACAATCTCTCGATACCAACTCCCCAAGAT
GAAGTTCACTCTCGTCCTTGCTACCTTTGCCGCCGTCGTCTACGGTCAAACCATCGATGACATTCCCGCATGTGC
TCGTACTTGCATTGAGAACGCCGTTCTAGCCGCTGGTTGCTCGTCTGGAACTGACGTCGCATGCGCTTGCGCACA
TTTCACTGCTGTTCAGAATGGCTCTACTAGCTGTGTCATTGCTGCTTGTGGCGTTTCTGTCGCCATTAGTATGTG
CTCCCCTCTCATTTTGGTCGAGGATATTTACGTCTCAAATGCTTATGTATATTTATAGACCAAGTTCTGCCTGCC
ACCCAGGCTCTTTGTGCCAACCAGTGAACTCATCCATCGAGAGGGAGAAAATGACATGGGAGAAAATCAGGTACT
CTTGTACATTGACAAACAAGTACATAGCTGAATGGTGTGAATGAATAAAACGCATTGCTGCTGGACACCGCTCTG
TTCATTTCTGTAtttCAATGAGTAttCATGCGATATGTAGCTTGA > SEQ ID NO:713 212363 208329_300959_1
GCGCTTGCGCACATTGCATTGCTGTTCAGAATGGCTCTACTACCTGTGTCATTGCTGCTTGTGGCGTATCTGTCG
CCAT > SEQ ID NO:714 212375 218875_300925_1
AaGAGGGACTGTACTGTACAGTAACTGTACCTTATGCAATTGTGCAGGATTATGTCTCTGCTGTAATGTATCTGC
GGACGTATCTGCGGATGCCGGGGATGGACTCCGGTGTACTTGGCACGGCTCGCTTCCGTTTGACATAAAAATGCA
GTGTAACAGGTAGATGGACGTACATGTAGATGTAAATGCGGTACT > SEQ ID NO:715 212426 212416_300849_1
ACCGAGACTCGGGCCACGATCTGCCAATTGGCGGAGCTAGACGGAGTATGGCATAGCGCCAATTGCTCAGAGCAG
CTGAGCTTGCGCAATTGGCCCTCATCACAAGGATTCAGCCCTCCCTCTGGAGGTTCAGCTTCATTGATATTGCGA
GGTGGTGTCTACTGTACATACTATACAATATTCAGCACAGGAGCTTTCGGTACCAAAACCCTTCAACACCG

Figure 2 continued

> SEQ ID NO:716 212492 200281_300757_1
GTTTCGGAGGCTGATTGAGTCGGAGGGGCTGCCTTATTGCGGCAGAGGAATAGTGACGTCATGACTATCAAGGAC
CCTGGAGGTTACCTAAAAGAAAAGCATCTGGACGAGTGTTAGAGTGTGCGAATGGATCTCATTGTTTGAATTGAT
GAATCTCGGAAGATCTGAGCTAGCTGCAAGATGCCTCAAGCCATGCGCAAGGCACGTGTGGATGGAGGCAAGATT
GGATGGAGATTTACTGTAAATCTTCCAACTTTAACTATAGAAGGGAAAGGGGGAAAGAGGCGATCGCTATACCGC
TGGTTGGATTCAGCTCCagggacaGATTTCATCAAAACAAGCGATGAACTGTGTGGTGACATATATATACGAGTA
CGGGTTTGATCAT > SEQ ID NO:717 212511 206025_300804_1
cgaccacgcgtcGTGATATCTGATATATATCAAACAGCCCAGCACACCATTCCAAAAACTTCAAGACCCTCGAGT
CTACATCAACAACTCTTACATCTTAAACAAACTGCTTCAAAAGCACATACACAAACCGGTTTCCCCCAGTTTCAC
CCCCAAATACCTTCTGAGTGGCAATGTCCCCTTCTGCTATCAGCAACTCCCCAGAGCAGCGACCTGCAAACAACG
GCACCACCCCCGACAACTTCGCTATCCAGCCTCCCGCCGACTTCACCGGCTATGACCACGTAACGTGGTGGGTTG
GCAACGCCAAGCA > SEQ ID NO:718 212639 208015_300831_1
TCTCATCCACCTCGTCCATCTCATCCTTTTGCTTCCAGCAGCTATCAAGACTTGACTTAAAAAAACCAGTCCTCA
TAAAGACATCTACAATCAGTCACCATGCAGATCACCAAGAGCCTCATCGCTACCCTCTTTGCCGCTTCGACCGCC
TTTGCGGCTCCCACTCCTGCGGACAAGTCCATGATGGCCGCTGTCCCTGAGTGGACAATCACCAACCTGAAGAGA
GTGTGCAACTCCGGCAATACCTCCTGCACATGGACCTTTGGCGTCGATACACATCTCGCCACTGCCACCTCATGC
ACATACACCGTCAAGGCTACCGCCAACGCTTCTCAGGCCACCGGCGGCCCCGTTACTTGCGGCCCTTACACTATC
ACATCCAGCTGGAGCGGCCAGTTTGGCCCTAACAACGGCTTCACTACCTTTGCTGTTACCGACTTTTCGAAGAAG
CTCATCACCTGGCCTGCCTATACCGATGTTCAAGTTCAGGGCGGCAAGGTTGTTTCGCCCAACCAGAGCTACGCC
CCGACCAACCTGCCATAGATGGAATGAATTTGCTTGGAATTACTATACGCAAGGTCAATTTACTCCCAAAGGAAC
AGCTGGTGATAATTGGAAACGACAATGAATCAGGCGAGGGGGGATACGTACCACAAAATTTAATGTAATAGATGA
TTGACTATGATAATACACTATTGATTAATGCGTCTc > SEQ ID NO:719 212708 212746_300843_1
GAATCCAAAGTCGTACAAATCTCAATGAATTGAAAGCTTCCGGCCTACAGCTTGCCAGGGTCCCGCTGGAACCAC
TAGAATTATTTAGGTTCTGATGGCCACTCCAGGGGGGGGGCACCACTCCGATCCACTACGCAGAAGCAAAAATA
GCCGCATGACGCAACTCATGATGTGTGGAGTGGCCTGACTTTTTTGAGCAGCTGAATGCAAAAGCAAAAACCCTT
GTGATCAAAAACCGCATAATGCAGGTTTGCGGGCGAGACACGCGCGTGCAACGCATCAAGACATTTGTCGTTTGT
GTCGAGGTGAGGGCGAAAATGGCTCGGATGAGGTGCACACGTGCCTCACAGACTGCGCGTTAAAGCGAATACGAA
GGAGTCCAGCGACACTTCATATTGCCTGGTTGGGGGCCCCTTGCATATGCAGAGATGCGTGCGATTCCCACTTTG
GGCCTATTTCTCGGGATCTATCTCGTAGTAATCGTATAGTCTATGGAGTCTTATTCCAGAAAACCAAATAGTAGT
AGTAATTTCACTGAC > SEQ ID NO:720 212785 205828_300802_1
cggacgcgtgggcAAACATCGACGAATTCGAATCGCCCACGATGTTTGCCGCCCGACAGGTTACCCGCAACGCCC
CGCGCTTTGCTGCGCAGCTGCGCACTCCCATGCAGCGCCGCTTCGCCAGCACCGCCGAGAACGAGTTCATCGCTG
AGCGCCAGCACATCAAGGAACACGCCAAGGGCACCACTGAGCTTTGGAAGAAGATTTCCATCTACGCCGTTGTTC
CTGCGCTGGCTATCGCCGGTGCCAATGCCTACTGGCTGTGGACTGAGCACTGGGAGCACTGGAGCCATCTTCCTC
CTCTGCCCGAGCGCACCGAGTACCCCTACCAGAACATCCGCACCAAGAACTACCAGTGGGGTGATGGTGACAAGA
CTATCTTCTGGAACGACAACGTCAACTACCACAACAAGGACAAGACCAAATAAGCTGGAACAATGGCTCCCGGAG
GAAAACTGCTGGTATTTGTAGATTACCCTTTTTGGGACCCCTCTGTATATTTCCCTTGGAGCTTCAATCGATTAC
ACTGTGGCTGAGGAGAGACTTCCATGCTGTGTGTGACATGGCGACTGAGCTTGAACCGTTTTTTCAATGTACAtT
ATTCcccTgtgtCcctaccttagta > SEQ ID NO:721 212945 212968_300845_1
GACACGCTCTGAAAGGCTGCGCTCTAAAGTGGCCACATTGATTCTCGGTTTTTTATTATCATTTTTTTACATGGA
TCTATGGCTTCTCGCATGGCCTCTCCTCTCCGCGGCACAGTATCGTTGCAATCGCAGCCCTTGTACACCCACCCC
CTTCCACCCGAATGCTTCCCTCCCCCTGCCAAAAGTCGGGACTCGTCCGCAGAACATGCCGAGCAAAGTGCTCTG
CTCTACTGTACGAGCATCTTCGTCCTTGCTCTCTATTTGTCTTGCTCGAGTTTGTCCCCCCAGTGCAAAAAAAAA
ACTTTACTTTTTCTTCATTTTATCCGGTCAGCTGATTTCCTTTTAACATACTGTACCTTGTGCATCGGCCCTCAC
TCGCTCCGGGCAAGGGGTGCACTACGCACCGCCATCACCTCGATTCGGTGAGATTTCTGAATATGACAGGCTGCC
TGATAAATACTACTCGTATCCCTACCCAAAATGCCggaaTTCTCTGtttaatATCCATATGCATATAcAgTATGC
agTAGcCCGtaaatGgGCCaaTGAAAGgAtacATCATGTC

> SEQ ID NO:722 212954 212967_300845_1

Figure 2 continued cccacgcgtccgATCGAACCGATGTTCGGTGGCCTCGGTTCGGTTTGAGTCGGAGATGCTGCGTTGCTCGTTTGG
GATGTTGATCTACAGGCTGTGCCGCCGTGGCTGAAAGCTGGAGAAGGAAATGGAGTTTAGTTGTGAATATAGAAC
GGACTAGTTCGTGGAAATGCATGTGAAATCTTGAGGGGCTTCGTATAAAAATCGACTTTTGATCACGGTAGGAGG
ATTTAGCCAGCCCCGCATTCCTATGATATAAGGCACAATACATCTCATGTTCACAGAGCAAAAAAAAAAG > SEQ ID NO:723  212959  208338_300834_1
AAAAGGTAGGGCACACGACAAACTTGGCCCCGTCAGCAACCAGCGCACGGCATGCCTCAGGGAAGGCCAAGTCCC
AGCAGATGATGAGTCCGACACGACCCCAGGGAGTATCAAACGCCCTGTGCGGCGTCAATCCATCGGCTGTCAGAT
GATCTCTCTCGGGGTGCCACAAGTTCTTCTTCTGGTAGCGTCCCAGAACGGCGCCGTCCGGACCGATAAAGTACG
CCGCATTCGCAATTCCTTCANNGTCATGGAGGCATTTGCCCTTTCCCTCCCGGCAAGGGGAATGGGGGGGGGCTC
TAGGATCGTGCCCGGAGCAATGGCGATGCCGAGCTCCTTGGCAATGGCCTGATATTTTGCAAGATACGGCGTCTG
CTCCTTGGCCGTTGCGAGGAGGATCTTGGAGTCGGGCTTCCATGAGCCGAGATGGTACTCAGGAAGGACGACCAG
GTTCGCGCCCTGGGAGGCGGCCTTGCGGATGTATGACTCTGCGCGAGCAAAGTTGCCAGCTACATCGAGCGGCTA
GAGTTGGTGAACAATTAGGAGACAAGATCAGCCTTCATAATTGCTTCAGCTGCAGCAGGGGTTGTTGGTGGCACA
CG > SEQ ID NO:724  212959  212985_300845_1
AATCATCTTACAAAAGCTTCCCAAAATGGCCCCGGTATTAAAGATTGCACTTATTCAGTTTCAGGCCAAGCCTCT
TTGTGTGCAAGAAAACTTTGACAAAGCGGTTTCAGAAATCCGATCCGCTGCCTCTCAAGGAAGCCATTTAGTTGT
ATTGCCAGAATATCACCTCACATCATGGGTTCCAGAGGACCCTTCCTTTGCTACAGCCTGTGCAGCTTCCACGCA
ATATCTTTCACAGTATCAAAAGCTAGCTAGGGAGTTAAATGTTCACATCGTTCCAGGTACCATTGTTGAACCTGT
TACTATCCAACCATCAAATGTCGTTGCTACTTCTCATGCAGAGCAAGACGTACTTGCAGGTGATCTCATAGTGGA
GCTACACAACAAGACATACTTCATCGCTGCAACTTCTGGAGATATCCTAGGAACATACCAAAAGAAAACTTGTG
GCACGTCGAGCGCGGCGTTTTGACCGCTGATAGGCGAACGCCGCACAAGGCGTTTGATGTTCCACTCCCCGGTGG
CCATATCGTGCGAGTCGGTCTGCTTATATGCTGGGATCTCGCCTTTCCGGAAGCCTTGAGacaattagcTgcgGA
TGgTGcaaagattgtcGtTAttcctgcctACtg > SEQ ID NO:725  213011  205666_300800_1
gtgccttgttgcagcatcccgtaacccctgcaggataccgccctaagccgcccaatttctcgtcactggctctag
cttttTGCTGTTTATCCCGAAATGGGCATCGAATGGCTTCTGTTCCCTCCCCCCCTATGATGTGTGGCTTGACCA
GTCgatGACGCAAACATGGAAGCCGGCTTCCTTTCTCCTTCttggtcGGAATGCCTgggaaGGGCCAAgatgACG
AGCCACGGcaATAAATAGTACAAGCTTCGCAGAAACCTTCTTGTCCGCTCTTCTCCCTTttgTGTCTcacACAGC
TTTTCTTCATCTTTACTCCGCGATCTTCTTGATCTTCACCAAAACAACATCATTGCGCCCTTGAAGCCCTCTTAG
CAAATATTCGATATACCCAAAAGGCATTGAGCCCTTGAGCCTTACGAGAAACACATATATCCAACATGCCTTTCA
CCGCTAGCGATATCTGCAAGATTATTCTTGCCATCATTCTGCCACCCGTCGGTGTCTTCCTCGAGCGAGGCTGCG
GTGCAGACCTCTTGATCAACATCCTCCTCACAATCCTGGGTTACTTCCCTGGTATCATCCACGCTCTGTACATCA
TATTGAAATACTAAGCCCGCCTTCCGCTCCCGTATCCCGCCGGATTCAAAGCGTCATGTCGTCGCACCGCATCAT
GTTGTGCAGACACCAATTACTCCCACGTTTGACCGGCAATTGTCGTTTTAGAATGGATGCGTCAGTGGAGGAGTG
AAGGTTACGGTCGCCGGCTCACCACGTGGCCGGTCATAGACGCCATAATGACAGTGGGCTTTCCTTTATGGCTTT
TCTTTTGTTTTTTCTTTTCCTCTCTTGTTGGCTGGAGGCAGATGCACCCTATTTGAAAGGGGGCGTCAGGTTTGG
CTATTGTTAATGAATTGATACCCGACTTCCTCAAATCACAAATACCTACCTTTATTCAGTCTCTaaa > SEQ ID NO:726  213059  206719_300825_1
AACGGGCCTCCATCGACTCCAGACCATCCACGACCTACACGGAAGTGGCAAGAGATCGAAATCGTCTGCAGCTTA
CCCCTGCAACGGCCTTAACAAGCTCCCGACTCGGCGGGAAGCTATAGCGATCCAAGCCGCTCTTGTCTCGTATAT
AACCAAGAGCTAGACTTCGCATTAGATAGTTCTTCGTCCTTGTGTCTGAGGACAACTCCCTTCTTCATTACATAC
AATTGATTCAACCTGACCACAATGGCTGACGTTCAGTCCATTCGGGCATTCGGCAAAGCCCGCTCCACCATCGAG
GGCAAGCCCCTGTCTGACGAAGAAATCAAGCAATACAATGATTATTTCAAAGCCAGCTGCTACCTTTCTCTGGGT
ATGATCTACCTGCGAGAGAACCCTCTCCTTCGCGAGCCCCTCAAGAAGGAGCACTTGAAATCTCGTCTTCTTGGA
CACTTTGGTTCAGCTCCCGGACAAATCTTCACATATATGCACTTCAACCGTCTCATCAAAAAGTACGATCTGGAT
GCCTATTTCGTGTCCGGCCCCGGTCACGGTGCCCCCGCCGTTCTTTCGCAGTCTTATCTCGaagGTGTCTATTCG
GAAGTCTACCcagacaaGTCACAAGATATCCAAGGCCTCCagaaATTCTTcaagtatttcTcctttC > SEQ ID NO:727  213072  208951_300810_1
ATCTCAATATATATCCACAATGAATCGAAAACATTCCGAGACTGGCATCACCGACGAGGCGGCTATTGAAGGCCA
TGACCTCATTCACAACGCCGAGATTGAGGAGCAGAGGGTATATTTCAACCACTAATGTCGTATCTTGGGTTACAC
GATTCTAATAATGTTTTAAAGGCTCATGGCGACCAGGCATTGACGCAGCCAGACGAGGGAGATGCGCCGCTCAAC
GCAACGAAGCAGTCCGAGCCCGCCATGGCGGGACAAACCGGACGCCGCCATTCAGCGATGGACAAGATAAAGGAG
ACACTGCATCTCAAGAAATAAATGAGAGATGAAAAAGATGAGGTCGGAAATAATTACAAAAAAAATGGTCAAACTG

Figure 2 continued

ATGATACCTGGCGGATGGGCAGTCTGGATGGTGGGACGAAAACAAAAGAAAACCACAAATAAAGAGGAAGGGCAC
GTGTGTGTCACGTTTCGTCAAAGTGTATTATATGAATTCCCCACATCCGCCCTCGAATTTCGTTGTCTGATTCGG
TCGCCGCAGTAGGATATTTATCTTTTTCTCAATACATGAATTATtATTATTTTTa

> SEQ ID NO:728    213072    220385_300954_1
gggtGACAGCTCAACTGAACAATCTCAATATATATCCACAATGAATCGAAAACATTCCGAGACTGGCATCACCGA
CGAGGCGGCTATTGAAGGCCATGACCTCATTCACAACGCCGAGATTGAGGAGCAGAGGGCTCATGGCGACCAGGC
ATTGACGCAGCCAGACGAGGGAGATGCGCCGCTCAACGCAACGAAGCAGTCCGAGCCCGCCATGGCGGGACAAAC
CGGACGCCGCCATTCAGCGATGGACAAGATAAAGGAGACACTGCATCTCAAGAAATAAATGAGAGATGAAAAAGA
TGAGGTCGGAAATAATTACAAAAAAATGGTCAAACTGATGATACCTGGCGGATGGGCAGTCTGGATGGTGGGACG
AAAACAAAAGAAAACCACAAATAAAGAGGAAGGGCACGTGTGTGTCACGTTTCGTCAAAGTGTATTATATGAATT
CCCCACATCCGCCCTCGAATTTCGTTGTCTGATTCGGTCGCCGCAGTAGGATATTTATCTTTTTCTCAATACATG
AATTATTATTATTTCT > SEQ ID NO:729    213120    220480_300955_1
gGTTTGGCTTGCAGTAAGACCGGCTTATGAGAAAGACCATTGTGAGAGATGTAAGGCTGATCCGGAGCTCTACGT
CATCTGAGACATGACATTGGCATGATGAGGGTCCAGTAACTACCTGATGATTGGGGTAATCGAAAGAGATGCAGA
GAGAAACACGCAACTCTGAGAAAGCGTCCCGTTACACACGGAACACACTGCCTCCGGACAGCGGCTTGTGGCTCA
TTGCTTGAGTCCCTTAATCAGCAATCCCCAGGTTCTCTTGACAGCTCAGCGGTGCAGTTTTGCGGGCACAGCTGA
TCCACCCGTCAACGGGGCGGGACGCCGGGAAGCCGGGACTCCGGGGCTAAAATGACATCGCCATGACATCCGCAC
CGTCCGACCAGAACTGCTACTACTCAAGACGGTAAGCAAGTGCTaGcAAAAGTGAGTTTTACGAGGTAAGCAAGT
AGGAACGTGGCTTATAAAGCCACAGCTagcTTGAGGCGAAGGCTGCTagtaggAACTAAAGTCAGCTtaTACTAt
TTATAAGctcACTGCATGGGCtagtaaTAATAGCTC > SEQ ID NO:730    213364    144866_200137_1
CATTTCTGTCTCACTCTTCGCCGGCGACAATGGTGAACGTTCCTAAGACAAAGAAGACCTACTGTAAGTCAAAGG
AGTGTAAGAAACACACTTTGCATAAGGTCACACAATACAAGAAGGGCAAAGATAGCTTAGCTGCTCAAGGAAAGC
GTCGTTATGATCGCAAGCAGTCTGGATACGGGGGTCAAACAAAGCCCGTCTTCCACAAAAAGGCAAAAACGACAA
AAAAGATTGTGTTGAGATTGCAATGCCAGGGGTGCAAACATGTTTCGCAGCACCCAATCAAGAGGTGCAAGCATT
TTGAGATTGGTGGGACAAGAAAGGAAAGGGAACCTCTCTTTTCTAGATTGCCTGTGAAGCGGAATGTAACAGAT
CTTTCACCCCCTTCTGTTCTGTTACACTGTTCAGATACTTTGGTAATATTTGATGTAGTGCAGGAGTTTCTGTTA
TTGAATCATGTGATCAATTTTGTGATGTCTTAGAGAATCTGATAAGGAGAGAAAATGAATATTTTAAGTTTTTGG
TTTAGTATCTTGTTGCCTAAATCTATTGCAAGAAAGTTATGCTGCTCTACCTCACTTGGCTGCATCAATTTGTAT
GTTGGGATTATATTATAGGTTGTTTTCTCCAAACTAGtGTATAttgaaAcAct > SEQ ID NO:731    213364    176162_300519_1
CCCCCCCGGCCGCCACTCGCCGCAGCGTGTCGGCCAGACAAGGCAGCGCCTCCGAAACCCTAGCTCCCCGCCTTC
CCCTCCGCGGCCGCCAAAATGGTGAACGTTCCCAAGACCAAGAAGACCTACTGCAAGAACAAGGAGTGCAGGAAG
CACACCCTTCACAAGGTCACTCAGTACAAGAAGGGTAAGGACAGCCTGTCTGCCCAGGGAAAGCGCCGTTATGAC
CGTAAGCAGTCAGGATATGGTGGTCAGACCAAGCCTGTTTTCCACAAGAAGGCAAAAACCACCAAGAAGATTGTG
CTGAAGCTGCAATGCCAAAGCTGCAAGCATTACTCCCAGCACCCCATCAAGAGGTGCAAGCATTTCGAGATTGGT
GGAGACAAGAAGGGCAAGGGAACATCTCTTTTCTAAACTACCTACTGGATACTGAAGTTGTGGGTCTATTGTGCT
TCATACTTCAATGTTATTAGGAACTTAATTTAAGCAGACCATATCATGTATTCAAGTATCATCGTCTGACATTTA
CTCTAGCAAGGATTGGCTTTCTGCTGAATCAAGTTTTCTTGCTTAATGCTCGTCGAATCCAATGTGATGCATGTC
TTTAGATGGCACTGCAATTGTGACTTTTGTCTTATGGC > SEQ ID NO:732    213364    50937_300164_1
CGGCAGTGGAAGTACGACGGCACGAGCTTCACCGAAGAGCGAAAATGGTGAACATTCCGAAAACTAAGAACACTT
ACTGCAAGAACAAGGAGTGCAAGAAGCATACCTTGCACAAGGTGACGCAGTATAAGAAAGGTAAAGATAGCCTTG
CTGCCCAAGGAAAGCGTCGTTATGATCGTAAACAATCTGGTTATGGAGGTCAGACCAAGCCCGTCTTCCACAAGA
AGGCTAAGACAACTAAGAAGATTGTGCTGAGGCTTCAATGCCAAAGCTGCAAGCATTTCTCGCAACGCCCGATTA
AGAGGTGCAAGCACTTTGAGATCG > SEQ ID NO:733    213364    229845_301047_1
gcATTTCGGCGGCATCGTCTTCCGGCACAATGGTGAACGTTCCCAAGACGAAGAAATCCTTCTGCCAAGGGAAGA
ACTGCCGCAAGCACACACTGCACAAGGTCACGCAGTACAAGAAGGGCAAGGACAGCCTCTACGTCCAAGGTAAGA
GGCGTTACGACCGCAAGCAATCTGGCTATGGAGGTCAAACCAAGCCCGTGTTTCACAAGAAGGCTAAGACGACCA
AGAAGATCGTGCTCCGGCTCCAGTGCCAGACTTGCAAGCGCGTCTCTCAGCACCCACTAAAGCGGTGCAAGCACT

Figure 2 continued

TTGAAATCGGTGGTGACAAGAAGGGCAAGGGAACGAGCTTGTTCTAAGCACCGGGTCTTTTTTTCCTACTTCGAT
GTTCTCAAATTTTCAAGCAATATCATAACTTCGATACTATACTaA

> SEQ ID NO:734  213364  206087_300804_1
aaacacTCAAGTAACGACACCGCACACCGTCGTCAAAATGGTCAACATTCCCAAGACCCGTAACACCTACTGCAA
GGGCAAGGAGTGCCGCAAGCACACCCAGCACAAGGTCACTCAGTACAAGGCCGGCAAGGCTTCCCTGTTCGCCCA
GGGTAAGAGACGTTATGACCGGAAGCAGAGCGGTTATGGTGGTCAGACCAAGCCCGTCTTCCACAAGAAGGCCAA
GACCACCAAGAAGGTCGTCCTGCGGTTGGAGTGCGTCAAGTGCAAGACCAAGTTGCAGCTGGCCCTGAAGCGATG
CAAGCACTTCGAGCTGGGTGGTGACAAGAAGACAAAGGGTGCTGCTCTGGTGTTCTAAATGCGTTGTTCTCCGGT
ATTATCAATTCTTATGCTTCTCCTGGCGGCATACGGGCATCATGGAACTTGGCGAAGGGGGTACTGGTCCTTGTT
TAGAGGACAGCGGCTCATAGGAAACGAATAAAAAGATTTCTTCATGGACCGCATTCACGCGTTTTTTACTGGGAT
ATGCTTTACAGTGTTATGGTGGAAAAGCCAACCTGGGACAATATTCCAATTCACGATGGCCTGGTGTCTCTGTGC
TAGGCAACTTTAGTTCATGGAGGAGGCTCAGACTAGCTAACATGAAAAGAAGCCGAATTTCACCCTTTT > SEQ ID NO:735  213718  211278_300897_1
CGACCCACGCGTCCGGGCAATGCTCCATAAGGAACGATATGTTTGTAAGATTGGAGAAAAGGGGGCAAATTTACT
TGCCTCTAGCCGCTGAGGGAGGGCTCGATGATTGGAGGTCCATGGGCAATCTATCTGGAGCAGGCAGAGCGTGGG
GTCAATTGCAAGTCGTCAATGGCACTAGGGGTTTGGTTTGGGGACTGCTGAAGGCGGGAGGCGTTTGTGTACAAG
ACTCCCCGATGAGTCGAATGCCAATGGACGGATATATGGATGGATGGATATCATGTAAGGGGAACGAAGCCAAAA
GGGCAGCGTGCTCATCATTTGTCATTACTCACAGCAATGAACGAATGCTCTGCAGCAGTGCTAGCATCAATCCTT
ACAAGGCAAGTAACC > SEQ ID NO:736  213827  199626_300751_1
AAACGAAGTACTGTAATCGTACGTACTCAATTGACGGGCTTTCGACCCCTGTTTTGCATCTGCGGTCGAATAAAC
ACCGACTGCATCTCCATCAGATTGCGCTTGGCGGCCGGGTCTACTGTTGCAGTTGATGCCGCCCAACTCTGGCAA
AACCTGGCGCTGCGGCTGCGGCTGGAGACCGGGGGAGCGATTCTGGCTGCCCAAACGAGAACCGGGGGGATGTC
AATGCACAGTTGCATCGAAATTTGGCGATTAATTTTTTTACGAGGGAGGATTACGATTAGGACTTTGCACGGTAG
G > SEQ ID NO:737  213836  217480_300908_1
tcTAGGTAACCACCAGCACACGCAAACGATACGAAAAACCGAGAACAAGTATACCTTCAGCTCCGCGGACAACAA
TCATCACCGCGGACAACAATCGTCACTGCACGTCTGCCTAGTTGAGAGTTCCAAGTGTAAAAACATCAGCAGTTG
CCTTGCTGCGTGGTTCCCAAGTCCAGATAGTCAACAGATCAAACACAAGACAAACCTGCCTGTTCGATTACTTTG
CCTCCTTGTAGTACAATTCGCAATAGTTCACCAAATCACCAGTCATCATGCCTGTCACTGAGTTTGCCATTATCA
AGCTGAGGCCCAATTTCGACCCCCTCGAGTTTCTCGAGACACTCATGGAGTGTCAAGAGATTCAGGACAATTGGA
TTCGCCGCAATCAGCCATGC > SEQ ID NO:738  213849  210303_300888_1
TCGACCCACGCGTCCGGGAGAAAGCAAGAGAAAAAAAGCTGGAGAGGCGGCGCCCCAAGAAGAGCTTGCAGGGAC
GTTCAAGGGTCGAGGCTCGCCACATGGGCTGGTCCGGGCTGCTGATTCGTCCACTCGCCGGCGACACCATGGGGA
GCACGCGACACTTTTCTCGATGATGCTTGGTCAATTGGAAGAGGCACGTATTCGGCCTTCTTTTTTGCTCGAGTT
ACTTTCTGGTTCGCCCAGCTGGGGGGAGGAGAGAGAGAGGGAGGGGGTTTGTCTTGTCTTCATGTGTTCATTCTC
CTTgTGCCGGACTCATCAGGACAAGGAGGTACTTGTGCTGTACATAGTGAAATATAGCTGAGAGCACCGTCCTTT
CTCTCAGACGCCTCTCATCTCGTCCTCTC > SEQ ID NO:739  213865  200056_300755_1
tcaccactctccatcctctactctactctactctactgcttagcagtcaagcaaacaaacaacaacaacatccat
ccatcCTTCGGCATCACTGACGGAAAATCCTCGTTGCATCCACACCCACCCCACGGTAACGCCCGAAGCACACACA
CACTATACACAATAGCAATCAACAGAAGCCGAGCAAACTCCACCAACCGGTCTTATCAATATATAAACCATCTCA
ACCCCAGATTTCTGGAACAATACTCCATCACACCCATCTACCTCTCTCACACACAAACACATTCACAATGTTCGG
TTCATACAGCTCATACAGCTCTGTGAGCACCATGTCTACCGCCATCGATATCAGCCCCTCCAACCTTCGAACTCG
CGATGCCTCGTGCGCCTTTCCCTCCTGGCCCAGGCGAGAGTCTCTCTCCGAGTTCGACCGCGAGGAGCGAGCCAC
TTCTTTCCTCTCCGACGACGACCTTCTCCTGTCGGACCCCTTCGACAGTGACAGCCACAGCATTGCCAGCTCCAG
CGCCTCGTCCTCTCCCATCATGATGATGCAGTCCCCTCCTCGCTTGACTGACGCCGAGGTCCTGGAGATGCAGCG
AGAGAAGCTTGCTCTGCAGCGCGAGTGCATGCGCCAGATCATGCTTGAGAAGGAGCGCCGCAAGCAGGCCTCAAA
GAAGAAGAGCCGCTCTGCTTCCAGCGCCAAGAAGAGCCCCAAGTCCAAGCTTGTCTCCATGACTCCCATTTCCGA
gtAAAAAACATCTACAACTTACTCTGCGGGTCATGCGCTGGCGCAAACAAAGGGCTCTTTCTTTCTCACTACTAC
TTCCGGctTTCTACGAAagcCTCTAATagaCTTCAACacaccTTTGAAtggtgtAcacgacgattacGACTTTC
TTCTTTc

Figure 2 continued

> SEQ ID NO:740 213882    213839_300861_1
CATGTGGCCACGGGAATGACGCAAAAGGCGCCGAGAGCGGAAATGGAGAGAAAAAAAAACCCAATTGCACCTCGCT
GATGATGCCACTCAAATGTCTGTGGTCGAGCCACTGTGCTTCTACCTACGACTTACATTACCTAACAAGGCAACG
AAACATTTTGCGGCAAGGAGAATTGGATCATTGACTTGGCGAATGGGCTAATGAATGTCGTCAATTGCAGGCCTC
GTGGTTTGGCG

> SEQ ID NO:741 213894    219319_300944_1
ggtacgttattgttttttttgttggccttttcactttggtttgtttttaatttcttcgttttttgttttctgttgca
gaggaGAAGCGTGAAGATAGGAGAGAATAGAGATAGAGAGGCAATTGCACGGAATGTTTAGCCAACAAGTTGCTC
GTGGCGGGCGCCGCATCGGCCAGATGGCTCGAGGCGGCCAATATCCGTCACTCGCTGCGCTCAGAGGAGCTGCTC
AACGACGATGTTATGCTGAGGCTGCACAGGCAGCCCCCAAGGGACGTATCGGTCGAGGCCTCGGGCTGCTCCTGT
ATGGCGTTGCATTTAGCGGCCTCGGAGCAGCAGCAACATTCTATTCGATGGTACAAAAGGGTTTCGCCTCGTTCA
CCGACGCCGAGTCAGCCAAACTGTTTGTCCCAGATAGCGACGAGCTGCAACAAATCGAAGAGACAATCAACAAAC
ACCCGCTCGTCCAAGAGCTTCGATCACGACCAGAGTTCAAGGAGTCACGACCACACCTAAAGATGTCAAGCGAAG
TCCGCAGCCGCACCCTCACCGGCGGCGCTCTACAAGGCGACGGCATGATCATGGTCCCCCCCGTCGCCTTCATCG
AGGACGGCGGCAAGTCCATCGTCAGCGTCACGTACATTGGCGACAAACTATGCGGCCACCCAGGCCTCGTGCACG
GGGGCCTGCTGGCGACGATGCTGGACGAGGGGCTGGCGAGGGGCTGCTTCGACGCGCTGCCGCACAAGATTGCCG
TGACGGCgagcctggagaTCAACtACCGCAAgccgac > SEQ ID NO:742 213923    217184_300905_1
ATCATTGTGTCTACTCCCAGTCATCGTCGACAACTTCTTTGATACAAGATTGCAAGACTCTATCCAAGTATGGCT
ACCCCAGGTACCGACCCCATCGAGGGACAATACAACAAAGAATCCGCGGCCGACGTGCCCACCAACGGGCACTAT
GTTTCCAATGGCATGGGCTCTGGACAGCAATTCCAGCCCCAGCAGTATCAGCAGTATCCGGGCTATGGACAATTT
GTTCCGTTTAGCAACACCCAAGATCCTCGGGCTGGGCCTCACCAGGCCATGATCTCCCAGGTCTACCAACCTACC
CTTGGTAAGATTGGTAACCCAGGTCCTCTTGGTCTGATCGGTTTCGCTTTGACGACCTTCGTGCTCGGACTTTAC
CAGTGCGGTGCTGGTCTCCCTAATTCCAACCCATTGGGCAACGTCGGCCCTGATCAAGCTGTCTTCGGTGTGGCT
GTCTTCTTCGGAGGCATGGCTCAGTTTGTTGCTGGTGTCATGGAATTTGTCCTTGGCAATACCTTCGGTTGTACT
CTCCACTGTTCATACGGGGCTTTCTGGCTTGCCTTTGCCATGTTCTCAGTCCCTACACTGGGCATCCAGGCCgct
TATAACGGAGaTcAACGTGCcTttagcT > SEQ ID NO:743 213991    214674_300863_1
ATTGGTGGCACCATCATTGCATCGCTGCTCTGCATTCTCGCTGCCGTCGGTCTCATCAACGGCCTCCTTACCTGG
TGGGGTCACTACATCAACATCAATCACCCTACCCTGACTCTCCAGACCATTCTGTCCTACGTCTTCTACCCGGTT
GCTTTCTTGCTTGGTGTTCCTCGAGACGGCGATCTCCTCAAGGTTGCCAAGCTCATTGCTGAGAAGGTCATCACC
AACGAGTACAATGCCTTCAACGCCATGGCCACCGACCCATACTACGCCGACATGTCTCCTCGCTCCCAGCTCATC
GCCACCTACGCTCTCTGCGGCTTCGGCAACATTGGCTCCCTGGGTATCCAGATTGGTATTCTGAGCCAGCTGGCC
CCGTCCCGTGGTGGTGACGTCTCCCGACTTGCCCTTTCTGCCCTCATCTCTGGTGTTTTCTCGACCTTGACCTCA
GCCTCCGTCGCTGGTCTTGTCGTTACCACCCAGCTCTCCCACTTTACCCGACCTCCGGCGTCTGGTTAAGTGGAG
TTTTGTGCGTGTTTTTTCATGTGAAAGATTTGTGCCATGTAAGGAGGTTATGTGTGTG > SEQ ID NO:744 214011    206891_300826_1
agcagattggaactctcgggagcgccttatacatcttctacattgacaatctaaacattacacttactcaaaatg
cccatTGATGAGTATTCTCACTTCTTTTCTAATGGAGACGTCAAGATCCATTACCACCTTTACGGACAAGGCCCA
GCCTTGGTGTTCGTCCACGGCCATCCAGACAACGAAATGACCTTTTCCAAGCAAATCGACGAGTTCTCCAAAGAC
CACACTGTAATTCTTCCTACGCTGCGAGGATATCCCCCAAGCGATGTGCCGCTGGACCCAGACGCCTACGATGGC
AATGTTATGGCCGGTGACTTGGTGGCTCTTCTAGATCACTTGAAGATTGAAAAGGCAGTTTTTGCAGGAGGGGAC
GTTGGTGGCATTACTGTACAAAAGCTGGCTTTCCTACACCCTGAGAGGCTATTGGGTTGGTCATCTTCAACACA
CCAATTCTCGGCACCATGATGCATCTCATCCACCACGACAAGGAACAACAGGAGTTGTCCAAGTATTCAATCAAG
TACATCAAACACAATCCAGGAGACGAGTACGACCTGGACCATGTCGTTCGCACCATCACGGATCCcgagtaccgC
GCCGagattaaaGAGTATCTCAAGAactcCCCagaggGTggcatgttttacttttttcCGCaagaactTtcccgcG
cc > SEQ ID NO:745 214019    200320_300758_1
ACTCACACACACAACTCAACCACACTTTCAACTCTCAACTACACCACAACTTACAATCTCATCTCGCGACCAACC
AACTTTCACAATGGAGACTGTCAAGCAAGCCGTCAACTACGTCGCTGAGTCCGTCCAGGGCGCTGCCTCTGGTAT
CAGCAAGGAGACCAACAAGGAGATTGCCAAGGACAGCAACGTCGACGTTTCCACTCGTTTGTCCGCTGGCAAGGA
CGCCCTTGGTGACAAGATCGACGAGACTGGCCACAACAACAAGGCCGAGGCTCACAAGCAGCTGGCTGAGCACAA

Figure 2 continued

CTAGATTGGCATAAGGAGCTTCGATTGCTTCACAGGCGTTGAACCGGATCAGAGCGAAGGGAATATATAGCCTCA
CTAGGCAGGAATTGATGATTTGAATTCGCAC

> SEQ ID NO:746 214019 211605_300901_1
AACAATCTCAGATCTTCATCTCAACTTTCAATCTTCCACACAAGCAAATAACCAACCAACCAACCAATCACAATG
GATTCCATCAAGCAGGGCGCCAACTACGTCGGTGAGAAGGTTCAGCAGGCCACCTCTGGTGCCTCCAAGGAGACC
AACAAGCAGGTCGCCAAGGACTCCGATGCCTCTGTCGGCACTCGTGCCTCCGCTGCCAAGGACGCTCTCGGTGAC
AAGATGGACGAGTCCAAGCACGACGCCAAGGGCGAGGCCCACAAGCAGGCCATCTAAATGGACTGAGTGAGAGGG
AACGATGACAACACTTTTGCTTCTACCCCGTCTTGAGAGACAAATAGTCGATACCCCTATGAGAACTCAATAATA
CAACTTTTTCAGCCTG

> SEQ ID NO:747 214086 135036_300421_1
CGCCGATCTCCATCTGGCGAGCAGAGCAGGGGAGGGGAAGGGAAGGTATCCTGAAAGATGCTTAATCTTATCAAA
ATAAAGGATAAAAAGAAAGAGCAGGCAGCAAGTGCTGCTGGAAAGGCTCCTGTGAAGAAGCAATCTGCTGGAGAG
CTCCGTCTTCACAAAGATATTAGTGAGCTAAACCTACCCAAGAGCACATCAATTTCTTTTCCCAATGGCAAGGAT
GATCTGATGAATTTTGAGATCATCGTCCGACCTGATGAAGGATATTACCTAGGTGGCACTTTCGTCTTTACTTTT
CAAGTCTCTCCCTCTTATCCTCATGAACCTCCAAAGGTGAAGTGCAAGACCAAGGTATACCATCCAAATATTGAT
TTGGAAGGAAATGTATGCCTGAACATTTTGCGTGAAGATTGGAAGCCTGTTCTCAACATCAACACTGTTATTTAT
GGCCTTAACCTTCTTTTTACGCAACCAAACGATGAGGATCCGTTGAACCATGAAGCAGCAGCTGTCCTCCGTGAC
AACCCAAAGCTGTTTGAAGCTAATGTTAAAAGGGCAATGGCCGGAGGCTATGTGGGTCAACACTATTTCCCAAGA
TGTGCATGATATGGTGCTGGGTGCCACAAACATTAGTAAGTTAAG

> SEQ ID NO:748 214086 208615_300807_1
ggcaacGAGCACCGAATCTCCCCGCGGATAAGGCTTCTTTTTTTCCGTCTACAAAACGTCACCTGTGCAACAACT
GAAAGCTCTCTGGCTTCTCCGATTCGGCGGTCCAGGCCTCTCTTTCCACCTCTTCCAACGTTTCTTTCAACCCTC
TCCCTTTGATCAGGCATTTCAGGATACCGCTTCTCGTCCTCACCGGCGATCTCCGACGAGCCAAGATGTTGAACA
TATGGTCTATGAAAAAAAAGCAAAGGAGGCTGAAAATGCCGAAGGTCAGGCTGCTGGAGGGAAGAGGAAGAAGG
TGACGGCGGCACAGCTACGAGTACAAAAAGATTTGTCAGAACTATCTCTCGGCGCAACGATGAAGACTGACTTCC
CTGACCCCGACAATATCCTCAACTTTATCCTGTCGATCGAGCCGGACGAGGGCATGTACCGAGGCGGAAAATTCA
CATTCGACTTTGCCATCAACCAGAACTTCCCGCACGAGCCTCCTAAGGTGCTGTGCagggagAAGATATATCATC
CCAACATTGATCTCGAGGGcaaggTCTGCCTTAACATTCTGCGGGAGGACTGGAAGCCGGTGttgaACTTGAATG
CTGTCATTGTGGGG > SEQ ID NO:749 214086 191128_300739_1
CGGTCTCCTCAGCTGCTTGCGCCAAGACGAGTCGCGGCTCAACAGGGGGAGGGGCGGCGATCTCCATCCATCCGG
CGAGCAGAGCAGGGGAGGGGAGGGGATCCTGGAAAATGCTAAACCTTATTAAGATAAAGGGTCAAAAGAAGGAAG
ATGCAGCCAATGCAAATGGAAAGCCTCCTGCCAAAAAGCAAAGTCCAGGGGAGTTGCGTCTTCACAAAGATATTG
CTGAACTTAACCTTCCTAAGTCGACTAGAATTTCTTTTCCTAATGGCAAGGATGATTTGATGAACTTTGAAGTTA
CTATTCGACCTGATGAGGGATACTATGTAGGTGGTAAATTTATTTTTACTTTCCAAGTTCCTCCTGCCTATCCTC
ATGAACCACCCAAAGTCAAGTGCAAGACTAAGGTCTATCATCCCAATATTGACTTGGAGGGAAATGTCTGCCTTA
ACATTCTGCGTGAAGATTGGAAGCCTGTCCTGAATGTCAACACGATTGTATATGGCTTGAATCTTCTTTTCTCAC
AACCTAATGATGAGGACCCTCTAAATCATG > SEQ ID NO:750 214086 145359_301059_1
gataagagagaagaaaagaacccaTTTGCTGGCTCTTACGCTAACCTGAGATCACACAAATCCTCTTTTTTCTTC
AGCTTTTTTGTGCCTTCTCACTTAAGCAGGGACCATGATTAAGTTGTTTAAAGTAAAAGAAAAGCAGAGAGAGCA
AGCTGAGAATGCAAATGGAAAGCCACCAGTCAAGAAACAAAGTGCAGGAGAGTTGCGTCTTCACAAAGATATAAG
TGAGCTAAATCTACCCAAAACATGTAGCATATCATTTCCCAATGGAAAAGATGACCTCATGAACTTTGAAGTCAC
TATTCGGCCTGATGAAGGATATTATATGGGTGGCACATTTACGTTCTCTTTCAGTATTTCCCCAATGTATCCTCA
TGAAGCCCCAAAGGTGAAGTGCAAGACAAAGGTTTACCACCCTAATATTGACTTAGAAGGAAATGTGTGTCTCAA
CATTCTTCGAGAAGACTGGAAACCTGTGCTCAACATTAACACCATTATCTATGGTCTATATCATCTGTTCACGGA
GCCGAATCACGAGGATCCCCTCAATCATGACGCAGCTGCTGTATTAaGAGACAACCCAAAGTtgttcGAGTccAA
CGtTaGAagggCaatGcA > SEQ ID NO:751 214087 221036_300941_1
ACAACAAACAACGAAACAACCGCCCAATCGCCAATCGCCGCCTCGACATGGTGCTCGGCGACTACGAGGAAGCAC
AATAGGCGGGACGCGAAGCAAACAAGCGCTGGGCGTCTGAGAAGTAGCCCGAGAGTCACAGCTACAGCTACAGCT
ACAGTGAACACGCGATAGAGTGATTCAGGACATCCAGAGACGAGACGAGGCGCCTGAACGAGATACGAAGCAAAC
AGCACGGGAAAGCAGATGCAATGTCGGCAAACGTAACAAAGCCGGCGCCCAATCGGCCGCAGCGGCGCGTAACG

Figure 2 continued

```
GCCGGCCAGATCCTGTCGATGCCGCCGAAATGGCTCGGCATGTACGACGAATTCATCACCAAGAACGCCGGCCAG
GTGTCGCAGATTGAGAGCGCGCTGAGGAGCTTGACGTATATCATTCCAGGCCGCTTTCGCGATGCTGAAATCGCC
TCCGAGTCGATTCACTCGGGCGTCCAGCTGCTGTCGCTCTACCACGACGGCATCCTCTCGCAGGCAGTGTCCAAG
CTGCCCACGCCGCCTGTCCGGTCGGCTCATGCGCGCTACACGCGATACTGGACGCAGAAGAGCAAAACGTACCGC
AGGATAGCCATGGTGCTGCAGATGGTCGTCTACACGGAGCTGCTGTGCGAAATGAGCGCC
```

> SEQ ID NO:752  214107  199476_300749_1
```
GATTAATCACCAGTGGATTCCTCCTCAGTGGATTGCCCTCTCCATATGGTTAATGGAGATATTTACGGTCTTCCT
CCCATGCTGGGAAGTCTTGTGCCATCAAAGCCTCTGCCAAGAGACACTAAACACAATTGAACAGTGGGAGAACAA
CAAGACAGGCCTCGGCAAGGCCATCAGATCATTCAAGTCCAAATCGACAATCATCGACTCCATCAAGACCGGATG
GAGGTCGACCAACAGCTCGATCCAAACATCTTCCGTCGAGTCGATTCTGACGCTGAGTGCTCTCGAATACGTCCT
GGAGAGGAATCCCGAGCCTCTACAACAATTCTCAGCCCTGCGGGATTTTTCCGGCGAGAACATTGCGTTTTTAAC
AAGCGTAGGAGAGTGGAAGTCATCGTTTCCCGCTTCGGTCCGCAGCCGCAGCGGCATTATGTCTGACGATACGAA
GCGGGAGCTGGTGCGAGAGCGATTCAACCGCGCGCTTCGGATCTATACTGAGTACATCAGCGCTAGCGATGCGGC
ATTTCCCATCAATATCTCATCAGTACAGCTGAAGAAACTCGAATCCATCTTTGAGGAACCCGCGCGTTCCATGTA
CGGCGAGAAGCAAGCCATCAATCCTGCAACTCCCTTCAACTACCCCGAATGGAACAAGCCCGCCTCCGTCGCTTC
GTGCTGCGAGACTCCCAAGTCGGTCTCTGagAAAGACAgtgttTCAGgcgACTgggTTCAGTATTGGGGTGATAT
TCCCGGAagacTTCGACCACGgcgttTTTgatGAcGCCGagaAgaGCATAAAGTACCTcgTTTTaACAAACACCTG
GCCCaagtttgttCgtgATCGcCgagAttCCATGGAATCCTTCGagaAcgctGGGAGCAccgaaa
```

> SEQ ID NO:753  214109  218475_300918_1
```
cacgatactcccgcTTGGAGCTTCATTTTGCATTTCCATACTTGGTGTTTGATCGTCTGTTTAATTGTTTATCCA
TTCGCTCATCATGCCGGGAAACGTCACCACTCACCACGATGACTCCACGCCCGAGTCGaGCGACAGTGGCCATCA
TGAACATGAACATCACCATGAAGAACACGAAGAACACGAACACAAAGGCCCTCCCGGTGGCTTTGACAAGACTCC
ACTTCCTGATGCGCCGCAAGGATACACTGTTCGCTTCGTTTTTCATGGCGCGACTAACATCCCGATTGCGGATTT
TCACACCGGATCTTCAGATCCTTTCTTGGTAGCAACTCTCAAGGGAACGCAGCCGAAGCGTCACAAGGAGGATCC
CGACTTAAAGTACAGGACACGAACTCTGCACACAACCACGGAGCCGAAATGGGAAGAGGAATGGGTTGTCTCCAA
TGTGCCCCCTACCGGCTTCACCCTCAAGTGCagaATGTACGACGAGGATGTTGCCGACAAggAcgaCAGActcgG
caaTGTCaCcATc
```

> SEQ ID NO:754  214111  105359_300373_1
```
cgtcgagctaaggtctccggtccgaaattttggttcgatggggattaaagtcattgttcaaagattcgagtttcc
gtcaaAGTCCGGACATATTTGTTTTTCGTTCGAGTTCATCGTTGTTCTGATCCGGTACACAGCTGGTAGACCTTG
TAAGTTGATAACATGAAGCATGAATACGAAGTTGAAGCGGCAGCAGTTTTCAGTCTCAGTTGCATAATTCTGAGC
TTCTTCTCTCCACTCTCTGAAAGATGGCAGCATATGCAGCAATGAAGCCGACCAAGCCAGGTCTAGAGGAGCCAC
AGGAGCAGATTCACAAGATTAGGATCACTCTTTCCTCCAAAAATGTTAAGAATCTCGAGAAAGTGTGTGCTGATT
TGGTTCGTGGTGCCAAGGATAAGAGGCTCAGGGTGAAGGGACCCGTGAGGATGCCCACAAAGGTCCTTAACATTA
CCACTAGAAAGTCTCCTTGTGGTGAAGGTACAAATACATGGACAGATTCGAGCTGCGTGTCCACAAGCGAGTCA
TTGACCTTTTCAGCTCTGCAGATGTTGTCAAACAAATCACCTCAATCACCATTGAACCTGGTGTTGAGGTTGAGG
TCACTATTGCTGATTCTTAGATCCTTTGTCTTACCTAGGTAGATGAGTTACTCTTTATATGCTGTCGTATTTTGC
CCTCCAGACTTTATGTATTACGAGTTTTTTGGAATTACAATTTTGCTGTTAAACTAAGACTTTTGATAAAAGTAA
AGTGTATGGTTTGTTTATTT
```

> SEQ ID NO:755  214111  254827_301639_1
```
ACGCGTCGGGTGTCAACAAGCTTCTGCGCACCTTGTCTCCTTCGATCACCCTCAAGGTAGGAGATAAAACATGGC
GATGGCAATGGGTATGAAGCCCGGAAAGCCTGGCCTCGAGGAGCCTCAAGAAGCCCTCCATCGCATCCGTATCAC
CCTTTCTTCCAAGAGTGTCAAAAACCTCGAAAAAGTGTGTGCGGATTTGGTTCGAGGTGCCAAAGAAAAAAGTT
GAAGGTCAAGGGGCCTGTTAGAATGCCCACAAAGGTGTTGCGCCACACCACCAGGAAGTCCCCTTGTGGAGAAGG
TACCAACACGTGGGATTGTTTTGAGCTGAGGATACACAAGAGAATCATTGATTTGCACAGCTCTTCAGAAGTTGT
GAAGCAGATCACCTCGATTACAATCGAGCCTGGAGTCGAGGTGGAAGTGACAATTGCAGATGTCTGAGTGTAGTC
AATTATTTCTTTTCGACCGGGAAAAGGTTATTGACTTGGTTGAAGAGGGATGACTGGTCTTTCAATTTTAGGTTA
TGTTTCTCCTTACGAATATTTGTTAGGATTTTTGACATTTAATCCTGTGTTAACGGAGAATTGAGCTGGATAGTA
TT
```

> SEQ ID NO:756  214111  211443_300899_1
```
CTTTCCCGGCCTCATCACTTTGCCGATACGAAGATCGTCCCCTTTCAATCCAATTATAACGATCCGTTCGAGTCG
TGAAGCCGTTCAAAATGTCTTACCAGAAGAACGACAAGGATGTTCAGGAGCCGGCTAAAAGCCACAAGATCCGCA
TCACCCTTTCTTCTCGCAAGGTCCAGGTCCTCGAGAAGGTCTGCTCCGAGATCATCGACCGTGCCAAGAACAAGG
ACCTCCGCGCCAAGGGCCCTGTCCGTCTGCCTACCAAGTGCCTGACCGTCACTCCCCGCAAGACCCCTTGCGGTG
```

Figure 2 continued

AGGGTTCCAAGACCTGGGACCGCTTCGAGATGCGCATTCACAAGCGTCTCATCGACCTCCACGCCCCCACTGAGG
TCGTCAAGCAGATCATTGTCAACATCGACGCTGGTGTCGAGGTTGAGGTCACCATCGCTGCTTAAGCGAATCTCC
AATTTCGTAAAGATGTTGGAGtggccgAGACCCTGACGTCGAGGgagATGAAAACAGCCCTCGCAGCAGATAAGC
ACAAAATAAACTggttcaaGACATA > SEQ ID NO:757  214111  6025_300103_-1
ACTGGCCTAGGGTGCGGCCGCCCTTTTTGGGTTTTTTTTTTTGGTTCATTAAGGTCTCTTATAGATGAAAAAAA
TTCGATAGACAAAAACCACCTCAGAACTATCAAAACCCAAGAAACAAGGTTGCAAACAAAAATGTAGGACCAGAA
ACGATAAAATACATTCTTTTGAAGCGGTTTTGGAACAAGTGTCTAAGAGTCAGCAATAGTGACCTCGACCTCAAC
ACCGGGCTCAATGGTGATAGACGTGATTTGCTTAACAACGTCAGGGGAGCTGAAGAGATCGATGACACGCTTGTG
AACCCTGAGCTCAAACCTGTCCCAAGTATTGGTACCTTCACCACAAGGCGCCTTTCTGGTAGTGATCTTAAGAAC
CTTAGTGGGCATTCTCACTGGTCCCTTAACTCTAAGTCTCTTATCCTTAGCTCCACGGACCAAATCAGTGCACAC
TTTTTCCAAG > SEQ ID NO:758  214111  283846_200095_1
TTTTACATCTTCGTCGCATCTCCCTCAGCAAATCAAATCAAATCAAAATATGGCGTATGCAGCAATGAAGGCAAC
AAAACCAGGGCTAGAGGAGCCCCAGGAGCAGATTCACAAGATTAGAATCACTCTTTCTTCCAAAAACGTTAAGAA
TCTTGAGAAAGTGTGTGCTGATCTGGTTCGTGGTGCCAAGGACAAGAGGCTCAGGGTAAAAGGACCTGTGCGAAT
GCCCACTAAGGTTCTCAACATTACCACTAGAAAGTCTCCCTGTGGAGAAGGCACAAATACATGGGACAGGTTTGA
GCTGCGGGTGCACAAACGTGTGATTGACCTTTTCAGTTCCGCAGATGTTGTCAAGCAGATCACCTCAATCACCAT
TGAACCGGGTGTTGAGGTTGAGGTCACCATTGCTGATTCTTAGATTCTTCTCTGTTTTCATTAGGTTGTTGAATT
TTTTTCAAGTACTAGTGGTTTGCAGTTGCTTTCTTGGCCGTCTAAATTATGGGCTTAAGGTTTTCTTTATTCcAA
TTAAAGTTTTGCAGCTAAACCagATACTAATACTATTTGATATTGGGAaGaggattTGTcCg > SEQ ID NO:759  214111  264909_301440_2
tcacaAAATTAGGTAGAACTGATGTGAGAGATGTAGAAGTTTTGAGTGAGATTTATATCTCTATcAaTGACAatt
ACAAATCTTACAAAGACTTTAAGGTGCTTGATGCTTTGGATAAGGCTTTAGTGGATAGATATCGATCCCCTTATA
GTGCTATTTCTGCTTTGGTTTCTTTATGTTATCATATCTTTGACTTTAATAAGTTTAAGTTGCTGTTTAATTGTG
AAGGGAAATTTGTGGATAAGAAGCTGAGAAAAGACTTCGAGTGGTGAACTCTAGGTCCTGATGTTTAAATCTACT
GTATTTACCTTCGCATTAATTAAGCATGGCGGCGGCTGCGGTGTACGGCGCCGGCGGCGCGATGAAGGGCGGGAA
GCTCGGCATGGAGGAGGCGCGGGAGCTGCAGCTCAATCGCATCCGCATCACCCTCTCCTCCAAGAACGTCAAGAA
CCTCGAGAAGGTTTGCGCTGATCTGGTGAAGGGCGCCAAGGACAAGCAGCTGCGCGTCAAGGGCCCCGTCAGGAT
CCCCACCAAGGTGCTCCACATCACCACCCGCAAGTCGCCGTGCGGTGAAGGAACAAACACATGGGATCGTTTCGA
GTTCCGCATCCACAAGCGGGTGATCGATCTCATCAGCTCCCCAGATGTTGTGAAGCAGATCACCTCCATCACCAT
CGAGCCTGGTGTCGAGGTCGAGGTGACGATCGCTGATGTGGCGGCCGCTTATCCGTATGATGTTCCGGATTATGC
CGAGCTCTACAAACAGCTGTTGAATTTTGATTTGCTGAAGTTGGCGGGTGACGTGGAATCTAACCCTGGTCCTAG
GTCTAGAATGGCTACTTTCTCTTGTGTGTGTTGTGGTACCTTAACTACAAGTACTTACTGTGGTAAGAGATGTGA
GCGAAAGCAtgtaTATTCTGAAACAAGAaatAAGagattggaactttacaagAAGTATCTATTGgaa > SEQ ID NO:760  214111  258439_301696_1
gccAAAATGTCATTCAACAAGGATAAGGCCGACGCTGAAGCTCCCCAGCAGCTCCGAAAGATCAGAATCACTCTG
ACTTCCACCAAGATGAAGTCTCTTGAGAACGTCTCCGCTGACATCATCTCTCGAGCTAAGAACTCCAACGTTGGC
GTCAAGGGCCCCGTCCGACTCCCCACCAAGGTTCTTAACATCACCACCCGAAAGACCCCTAACGGTGAGGGTTCC
AAGACCTGGGATCACTTTGAGATGCGAATCCACAAGCGACTCATCGATCTCCACTCCCCTGCTGAGGTTGTCAAG
AAGATCACCTCTATCAACATCGAGCCTGGTGTGGATGTTGAGGTCACCATTGCCGCTTAAGCTTGTTGACCCCAA
AACTTGGTATAAAAAATTGCACATGTATTATTGATGTCT > SEQ ID NO:761  214134  195402_300634_1
gttcctcggacagcaagtttaacCATCCTCCCACAATCGCAGTAGAGACGGAAACAGTGGCGgggattaccgccA
TGATTATTGCGGCGACGTTAATCATTTTCCCAGAGCGTTCGAACTCTCCAGACCTTGAACTGGGACAGACAGAGA
GATCGTTCTTTCGAAGGGCCATTGCTTTAATTGTGCGATGTTAGGACTGCACCATGCTGATGTGGCCAAAAATG
ATCCGTGCTTCGGTCATGCGATGCTCATCAGAGCTTTGCATCAATGTGGCTTCGAAATGCGATGAGCTCTCTTCT
GTTGCTTCGTATCCCTTTATATCATGGCTACGTACGGCTAGAAAAGAACCGTGTTGGGCAGTCCCGACCCCAAAC
AGGCTGCTGGGGCTGAGACCTCGACACGAATTACGCCATGCTTGGATGTTATGCTCACGCCGCTCATGCAAACAA
ACAAATAAACAAACAATCCAGTGAACTCATCTGATTTTTGCTTCAGTTGCATACCGGTAAACTGATCTGATTTTT
GCTTTCGCTGCATTATAGTGTAAATGTACTGTAAATATTACTACTGTATGtgtaaagtattgggAGTcaaaagct
caaacAaagctgTtatAAGTACATAGTTAATtacatttattcattcaaaaaaaaaacacaaa

> SEQ ID NO:762  214148  220733_300938_1

Figure 2 continued

```
TGAGGCGACAAAGCTTGCCCAGCATGACTGCCCAGCACATATCAGGCGGTCAGCCGGATCAGTACGGCGGTCATA
TCACGGACGTACCCTCNCGGCTGGAGTAAGAACTGCCGCAACCGCCGGCCTATATGCACCCAGTAGTGGTCAGGG
TCAGGCCGTTGGTAACGGCAGCTCGAGCGTGTCAACCAGTATTGGGGGCAGCCACACACCCAACACCAGCATCTC
TTCGGTGGCAGTTGGCGGGCCAAATGCAGGTCTCTATGCGCAGGCTGGTGTGCCGGAAACCGGGAAGCCACTGAG
CCCTGGTGGTGTCCAAGGCCACGACGGCTCTGGTGTCGTACGGCAACGATCGCCTAGCCTGTCTCAGCAGCTACA
ACAGCAGCAGATGGGAAGGCGGCAGTCGGAGATGCAGTCTCCTCATGGTGGACAAAACAGGCCTAAGTTGCCTGG
CTTAACTCACCCTGGATACGCCTCGACAGGCTCTCCAGGATTCTCCCACGGCCGGCCGCCAACCGCAACCGCCTC
GAGCGGCGATAGTG
```

> SEQ ID NO:763 214166   210765_300892_1
```
CAATTCGACAAGCAAGGTAGCCAGAAATGGCCCCGACCAACGACAATGAACGGCCTAATGCGAACGAAAAAGTGC
TGCACGTGTGGTCGAAGCCGATAGCAGAGGGCGATCAGGTTCCCGGTCTCCAAGGGCCGGACAAGAATCCAGATG
GGACTCCGAGAGGTTCAAGGTCTGCCTTTGCAGAGGCAGTCTCAATGATCAAGAAGGATGATTTTACGAACGTGG
CAAACACGCCCTGCGCACGGCAAGGACTGCTGACGGGAATTGGGGCGGGAGCTGGCTTGGGCGGCTTGAAATTTG
TGATTCAAGGTAATGCTGTCAAATCTGCCAACTGGGCGGTTGGCTTCTTCCTCTTGGGTAGTATAGCATCGTACG
AGTACTGCCAGTATCAACGGCGGGCCGAGAAGATTCAGATGAAGAGGCACATCGAAGTGGTCACGCAGAACAGAA
AAGAGCACGCAAAGAAACTAGCCGAGGAGAGGAGGGAGCAGTTGAGGATAGAGGAAGAGCAACGAGCTCGAAATA
AGGCCTGGTATAAGTTTTGGTGAAAGCCAAGGCAGATGAGCTGCCATGTACAATTATATGTATGAATAAAGACTC
TATTTTggatgcTT
```

> SEQ ID NO:764 214187   221005_300941_1
```
GCGGCAGGTGATGGCCGCGGTGCAGCAAGTACCAGGCAGGTTGCTTAATTGATCATCCGGTGGCGGGAGGTACCT
TGCCCGACTAATCACAAAAAAGAGACGACACAAAAAAGGGTGCGTGCGAGCGAGCGACTAGCCCCGTGCGCGGGT
TTAGCACGAGCATGTGCTGAGAAGCGCTCGGAGCAAGCGAGGGAACGAGGAATGGAAAGTTTGGGCAAAAAGAAG
GTGAGAGAAGCCGCTCTGCCAGTTTTTATGTGTGTATTCTGTTCGGGACGTTGAGATGCTGTAATGTGGCTTGTC
AGAAGTCAACATGCAACACCACTAGTGCCGCTGAGGCCATTGAATGGTGGGTGCCAAACAATGTGGTGTGGCAAG
TGATGTGCGCAATAAAAGGCAGAAAAAGAAAACAAAATTCTCCTTAG
```

> SEQ ID NO:765 214222   195893_300638_1
```
CAAAATCGCAGCACAACGTATCATCATGCCGTCAGCTTCTGAAAAGGCGAGAGCAAAGCTCGATGCGGTGTTGAA
CGACCCGGGACGATTTGACTGTACCCAACGGTCGAATCGCATAGCGACGACACGATATGCTACAGGCTGTGGCGT
AGTCAACTCTGTTCCGCGTCGCCCCAGCCAGAGTAGCATAGAAAGCGATTCAGGCGGCGTCAGGAACAGACTGAA
ACGCCTCATGTCCTTACCCGCGTACTAAAGCGAAAAAAAAAAGTGACTGGAGAAATATTCTTGATATGGATAACA
ACCTCGATGGTTGTGAACAGTTTCATATGTCCTAGTGTCCCATCGAGCAAAGGTTGCCTGTCTATTGGCACGCTC
GTACTTTATCTCGTGCCTCCTTGGCAAGATTGGAAGATGTACACATCTCTTAACCTGAATTTCTCTCCGAAGAGC
ATTGAGGATCTGTTGTAGTCCATCTCTGTAGCAGACATGTTAGATGCAATGAATTTTTATCCGTGAAAAC
```

> SEQ ID NO:766 214244   214355_300857_1
```
gacgaagcatgtcattcaacaACAGCCAAGGGTAGTTGCTTTAGGGGGCCCAGCAAATCGACAGGGTCGACTCGC
CGCAGATGATATAGCCGGCAGACCAGTGCACTATCGCGGCAACATCGGCACAATCATCTGTCAGGTCTTCGATTT
AACCGTCGGTTTAGCTGGCCTGTCCGTCTCGGCGCTGCGTGACTTGGGACAGGAGCCGCTCTGGGTTACAGTGCA
TCCTCCACACCATGCGAGGTATTATCCTAACGCTCGTCCAATCACGATCAAGACCGCGTTCGAAAAGGGCACAGG
CCGTATTCTGGGGGTGCAGGCAGTGGGAATGGCTGGCGTGGACAAACGCATAGACGTCCTGGCAACAGCGATGCA
AGCTAGGATGACAGTCAATGACCTGGAACATCTCGAACTGAGCTACGCACCACCCTATAGCTCGGCCAAAGATCC
TGTGAACATGGTCGGATTTGTTGGCTCGAACTTGCTCCGCGGGGACTATCAGATCGTACACGCCGAAGACATTAA
CATCAAGAATCTTCATGCCTGGcaaagtCGtggatgttcGcAcacccgaGGagtttgcgactggCCACCTCCCGG
GggcaatcAACTTGCCAATTGcaacactGCGCAATCAGAAaTGGagCTTGACCaatccaTg
```

> SEQ ID NO:767 214259   200377_300816_1
```
aagatcaggacaagacaattCGAGAGTGCCAAAAACAGCAAAAGGGCAGAGAGACGTCATCATGGCTCAGGCCAA
GTTCGCCGTTTATCCCAGCCTCGTCGACCGCACCGTCGTCATCACAGGTGGTGCGCAGGGTATCGCCGCCGACAT
GGTCGAGCAGTTTTCCCTGCAGGGTTCTCAAGTCATATTTTTCGACGTCGAGGACGAGCTTGCCGCTGATTTAGT
CCGAAAAGTGTCTGATCAGGGCGTCAAACACAAGCCCATATACTACCACTGCGATGTCATCAAGATCGACGAGGA
GCTCAAACCCACAGCGGCCAAGATCCTGAAAGACCATCCCAAGATCGACGGACTCATAAACAGTGCCGCGAGGGC
AATGGTGAAGCCCTCGCAGGATATCACGACTGAGTGGTGGGATGAGAGCGTCGCCGTGAACCTGCGGCATCAGTT
CTTCCTGACCCAGGCCTTGCTGCCGGGGCTTCTCCTTGCTGCTGGAAACGCTTCGGTGATTAACATGGGGAGCAT
CAACTGGCTCGTCTCTGCGACGGGTCAGGCGCCTTACACGACGAGCAAGGCCGCCGTTGTGGGACTGACGAGGAC
GCTGGCACATGAGTTTGGAccgca
```

Figure 2 continued

> SEQ ID NO:768 214267 205829_300802_1
TGAGTGCAGTGTAAGACAACATGGAAGACATGTATGTCAGCAATACGGATGTTTCCATACAGTCAAAGCGTTGCA
TCAACCCCGGCATGTCAGGAAGATGCTCTGGATACTAAGCGGGAAAATCTTCCGGATGCTGACCTGGCTGCTTCC
AATTGCCCTGTTGTCGATTCTTAATTTGCGCAGGCGATCAGGCCACATGCCACATGCAAGTCCGAGTGCAGGTCC
AAGCCGAGCCGCAGAGGAGACAATGGGTCCAAATGCAAATGCATACAGGTAGTACTGCCTACGTGCGCTGCTACA
GTACCGCTGGCTGTTCATTTCGTCTTCAGGGACAAAGGGGGATGGATGTACACCGATAGATCGGCCTAGTCGAAT
GTTACTTGGTCCATTCGTTCCTTCTAAGCCATATTAggcaTCCaaGATGCTCGGTACTCGCATGGCCATGTACGG
TCTCAcGgCtcaccgctaggcCTTttttgAATGTCGTTACTTCGTTAcgattatTGGGACAGATGGCGTagagct
accagtgctagtGGTGTaatCgacaaagTTCgCTcctg > SEQ ID NO:769 214278 211348_300957_1
ACAAGCCAAGCACATCACAGACAAAATGGCGCCTGCAGCTGGAGCAAAGAAGCAAAAGAAGAAGTGGTCCAAGGG
CAAGGTCAAGGACAAGGCCCAGCACGCCGTCCTGCTCGACAAGACCATCTCCGAGAAGCTCTACAAGGATGTCCA
GTCTTACCGCCTCGTCACCGTCGCCGTCCTGGTCGACCGAATGAAGATCAACGGCTCCCTCGCCCGCCAGTGCAT
CCGCGACCTCGAGGAGAAGGGCATGATCAAGCCGGTCATCACTCATAGCAAGATGAAGATCTACACCCGTGCCAT
CGGCGAGTAAATTTACCACCATGTTTGAAAGTTAAAGCATTGAGATTTGGCGCCTGGTTGGTCTGAAAGGAAGAA
AATGGGACCATGAGTGAAGAGGATGATACGAGGTATATAAAGCCTTAGTTGGGACGCTTTTCATGCTCGGTGTAG
CATTTCATGGGAACCGGAAACGCTTTAGCAAATGGCAACGGAATGAAGAACTTCAAAAAATGACCAAAACGACGC
GAATACCTA > SEQ ID NO:770 214278 239327_301303_1
GCAAAATCAGACATCATGGCGCCAGCAGCGACCGGAGGCAAGAAGCAAAAGAAGAAGTGGTCCAAGGGAAAGGTC
AAGGACAAGGCCAACCACGCCGTCGTTCTCGACAAGACCACCACCGACAAGCTGTACAAGGATGTCCAGTCGTAC
CGCCTCATCACAGTCGCCGTCCTCGTCGACAGATTAAAGATCAATGGTTCGCTCGCACGCCAGGCCCTCAAGGAC
CTCGAGGAGAAGGGTCAGATCAAGAAGGTCGTTGCCCACAGCAAGATGCAGGTCTACACGAGAGCCGTTGGTGGC
ACTGACTAAGCGCCATCTCATGTTCGACTAATGAAGATATGCAAATCTGCCACACGACAGTCGCGCGGCGGAGCA
TATGCAAGGCTTTGATGATGGGAACGGGTGGCAATGCGCTATCGCGAGTGCACATGTGGAAATCATTCATGGGTC
ACGGAGTCTCGAGCATGTCATATATTCATGGGCAGCCGTAAAGAAATGTGCTTCGGAGCTGAAACCGGGCCGTTT
GTATTGCGCAATAGAAATGCCATTCGATTGCTTCTTGTTG > SEQ ID NO:771 214318 208604_300807_1
tcttgcgtgttttctccttttCTTTTCCTTGTTACGATTGAACCTCCCTTCGCCTGTTGCTCGGAACATGCGGA
TTGCCGGCTGAGCAGTTCAAGCGACCAAGCCAGAGCCGAGCCTCTGAATTTCATGCATCAATCTGACGTCTTTGA
CCGCTGAGCCTCTGGATTTCCGCAAACCGCAGCAGCAATATAACAAT > SEQ ID NO:772 214319 206862_300826_1
TGCCCACGCGTCCGCCCACGCGTCCGCCCACGCGTCGCCACGCGTCGCAATGTCTTTAGTCCGGACCCTTACGGG
GTGACTTACCGCAGCAGGCGCGATCACTGTATCGACAGCTACTGAGGCAAAGCAACGAATTCGGCTCTTACAATT
TCCGGCGAATATGCGAAGCGACGGACCCGAGATGCTTTCCGAGAAAACGCTGCGGTAGAAGACTCGCG > SEQ ID NO:773 214329 210659_300891_1
TGGGCCTCCTGCGCGATCAGAGGTCTCTATGAGGAGATGAGCTATTGATTGCACTCAGCGCTAGATGTTTGATGA
ACCCTCAGGACACAGCATTGGAAGTATTATTGATCAGAGAAAGGCTCTGGGCTATTCACTCCAGAGTTGCGAGAA
CTATGATTCACGTTGACATACGTGTCGGGCCTGCAAGACCGCTGGAAAAAA > SEQ ID NO:774 214333 208006_300831_1
gagaaaaagaaaatagagaaggggggagaaaagaagagagcctcttagaggatgatgctgaatgacgctgtggatg
gtgaaATGTGAGATGAGCAAGGTTTGTGTTACATGTATATTAAGAGGATTTTTTCTTTTTGTGGACGGTTTTTTA
TATGTGATATTATGGAGAAACTAGCAAGGATGGAGAAAAGGGGGAGAAAAGGAACGATAAGTTTATCTCTGTTTG
GGCATGTATGGGTGTTAATATGATTGACTTGTCATATGTGAATGATGAgTagaTGATGTGATCAACACTTGGATG
AgagaCTCACAACCAGATTTACGAGTCATTCATCTATACAGACATAAACGCTGAgaACGTCATCGGAGGTATTGC
TTCACTTCACATCTTGATGCTATATGTAGCTGGCCGCATTTCGTTTGCTGGAAAGAGGTGCACGGATTAAgaTGC
AAGTAGCACATGTACGGTTGAgaAACTCAGGAACACAAAAGATGTACATTAAACTCCCATTCTAGAGAACCTATT
TACAG > SEQ ID NO:775 214348 220388_300954_1
GCTCACATGAAGTGAAGGGAAAAGGGCGACATGGAGCAGATTGAGACGCAGGCATCGGACCT

> SEQ ID NO:776 214371 199945_300754_1

Figure 2 continued cccacgcgtccgggcatacgttccagaagctgtttcgcaataggctcgtccggaccgacttgcgctgaggcgcag
gtttcACACGCTGCAATATGACATCAACCTTGTCTGGTACATGACAAAGTCCTCCGTATCCGTATAAGCTACTGC
TATTATAACCGTAGAAGCCGTAGCGAGACTCGCGGgactccCGACCCccgcaaCCCCGgggcggAACGGGTGgaT
GtcaggaTCGGGAGTGGGAGGATTCAAAGGGGGGTTCCGGCACACCCGGCTACCGAAGTCTGGGAGGATTCCGTA
GTGCCGAGAGTATTCCCACCCAAGTATTGCTGCTCCATCTTGTAATTTGTGCCTGTAAATGATGAGTTTCATCAT
TCGAGTAAATGGGGTAAGATGAGatgAacTGGGCGTGTATTTccgcctGGGCaTTCTAATGGATACTGCGGTATT
TAAGGTCCCCCTgtatCTattaataACTCAGGAGTATTTCCTGgaTGTCGTGTCTCTTATGGAAACAGAATCATt
gcaaCTTTGCACTCTCAATAaa > SEQ ID NO:777 214379 206510_300823_1
CGGACGCGTGGGTCGACCCACGCGTCCGGGAACATGGGGGATATTGATGGAGACATTTTTTTGTTTACTTGGACT
AGTTGCCGGGCGAAGAGGTGCGGGACTCTTTTTTGCTGCATGGAACCAAGCGGGTTGCAGCAGTTCACTGGGGAG
GTGATATGACGTCCTTGTGCAGGTGGGCGTTAGAATTACAAACTCTTTGATTGCCAGATAATCCGGACATCATTC
ACGATGGATAGTGTGGAGATGGAATTATTTGAGGATTTGTCTCAAAGGGAGGGGAAAGCTCAGACAG > SEQ ID NO:778 214380 212045_300873_1
GGAGGGGAGAGAAACCTAACATTAATAAAGCGGACACTTATTTCGGCCGCTACTGTAGTCTACGGATAATTAATA
CCTATCGCATGAGAAACCGTAGAGAGATAGGACATTAACAGAGGAGAGCCGGAACTAGATTGTGGCAATATATGG
GCTACTATGAGGAAACGTCATAACTTGAGGGCCATTTATGTAACACAGATTGATAGTTGCCCTAGATCCGTTTTA
ATCAAAAAAAAAAATCCAAATC > SEQ ID NO:779 214409 215905_300886_1
gTATCTTCACAGTGGCATGAAACGATGGCCGTTGGACAAACGCCACCACCGCTCCCATTTCCCGTTCTCGTTGGC
CGAATGTCAAAAGCTGGCACAGTACGAACGCCGAGACAAGTGAGAGGAGCTGCTCCCCGGCTTTTCCCACCCCGC
ACTATGTGCGCCTTAGGGGGGCAAACCGCGGGAAATCTGGGGtAAATCAGGCCATAAGTCGAGATTTCTTCGGCG
CTAGCTATCTGGCAAAGGTTTTGGAATCCGTTCTAGAGCTCGAGGGCCCTTGCGTGGGCTGGTACGAAAAAGTAA
GACTGCAGCGGTAAGATATCGAAGGGTCGATGGACGTTGTTGGGACAATGGGTTGCATTTTCTGACTGCGCTGCG
CTCGACCTGCATCCCCCGTCAGGCCCCGTACATCGGCCAGCCCTCAACTGGACGGACGGCCTATGTGGGTAATGC
GAGTACGGCGGTCGGGCTAAAATGTCGCGATGCTGGGTTAGGGTTCAAATTTCTTCAGCCAGCGAGCCTCACGTT
GCGGTGATTGCACAGGGAATGTTCTCCCATCTGCCGGAGCAGCCAGTCGCTAGCATCGTTCCCGTACAAGTACTA
GAAGGCAAACCCTTGGTGAGCTAGCACACACAGGTACTCCGTGCCAGCAAATGGACATGGTCATGGATTAGTAGA
TCAACATTGGAACAGAGTCATGGCTACTGTACGAGTACAGGCAGAGCCGGGGTGGGGGGATCTCGTGGCCTACTA
GGGGGGGCGACTAGCGAGCGCAGTGCAAAAAAAAGATGGAAGAAGACAACCGACGTACGTCAATCAAAGTCGGGA
TTGATGACAGCCCCAACGAAAGACGTTGGCGGGTGGAGCAGCCTCGCTCGGATCTGTCCAGTCACAGCGGCGCGG
TGCCTATTAGGGCGTGCGGCGTGCATCAGCAATTTGGGTGTTTTTTCATGCGGCGAGCAAAGGGGGAACAAGAGG
ATTTCCGATGGGCAAGACGAGATACCGTGGGTTGGTACATGTAGGATTGGGGCCATCTCCAGGCGaggATGCGGT
GGTTGCGGccCTTTGCAgccGGCTGCAGCAGGTAccgcgttCGtaccTCTCCGGCGCTGGACGTATGCAGggCTa
aCATGT.

> SEQ ID NO:780 214411 216318_300868_1
GTCGTGGATAGCGGATGGATACTTGCAGGGAGTATGGGGTAAGTGAGTGAGTGAGTGAGTGATATGGATACAGCG
GGATGATGATGATGGTGGTGGTGGTGGTGTTGTCACTGATGTTGTCGAGTGAGTTGTTTGTTTTGTTTACCTTTG
GAATTGATTGAAATGAAATGAAATGAAACAGG

> SEQ ID NO:781 214421 220363_300954_1
ggccagaacCGCGCGAGTATACATCTATCTGCAACATCTCTTACCTCCATCTTCGCAATGGCTTCTGATAAGATG
GACCGCGGCCTCGACGAAATCATTGCAGACAAGCGCAGCAATGGATCTCGAACCCGACGCGGTGGCGACCGCCGT
CGTGACCGTCAAGACTATCCCCGTGATGGGGTGAAAAAGTCTCTCCGCAACGAACCTCGAAACTTGGATAGCGAA
TGGGTACATGATCGATACGAAGAGAACACGTATCGCAATAGAGGCCCTGCACCGCGTCGCAGGCGCGAGTCTCCC
AGCGGGGGAGATGCCCGCGGCGCACGACTCCGAGTCGAAAATATCCACTACGATCTCACCGAGGAGGATCTCGAT
GAACTTTTCCGAAGAATTGGCCCCATCACAAAATTGCAACTGCGTTATGATCGGTCTGGACGGTCCGAAGGTGTA
GCTTTCGTAACGTATGAGAGCAAAGACGATGCCGCAGAGGCTGTGAGACAATTCGATGGTGCCAATGCGAACGGC
CAGCCAATTCGTTTGTCCGTCATGTCAAGTGGGCCTTCTCGAAACCCGTTTGATACTGCTGTGATGCCAGGCAAG
CCTTTGTCCGAACGCATTTCTGCTCCTGGTGGCAGATCTCGATCACTCTCCCCTCGCCGATACGATGAAGAAGat
gccgCTCGCAGAGGCATTGATCGATAtgttccaggcGGAAGTCGCT > SEQ ID NO:782 214433 217769_300911_1
TGCTTCACCGGATGGCCGTGGACGAGTCGGAGTCTGAAGCCTCCGATGTCATGTCCCAGACTTCCTCCTTCTCAG
AGCTGGACCTCTCGGAGAGAACCCAATCTATGAGCACAGTCTACAGCGATCTGCCACCTAGCCCTTCAAGCACCA

Figure 2 continued

CATCTTCGGGCCATAGATCGCCCTTTTCAAAGCACTTCCGGAAAACCTCGAGCAATTTGTCCGACAAGGACAAGG
AGAAGCAAAAGGACGATGCCCTGTCGCGATGGCTGCGGGACGGCACTGTCGTTTACAAGAGCGTGGGAGTGGGCT
TGATGGATCTGGTGGTTGGGACAAAGCTGATTGAGGTTGCCCAGCAGAAGAACATTGGCACGCAGATTGAAGGCT
TTTGATCAAGATGGTACGGAGCAGTGTAGATGTGTTGGCATTTAGTAGCATTCAAGATTCCAAACG

> SEQ ID NO:783 214437 130954_300509_1
GAATTCAAGAAAGAGTTCCACTCGAGATCCCTTCAGCAAAATGTCTTTGGTTGCTAACGAAGATTTTCAACACAT
TCTTCGTGTGTTGAACACTAACGTTGATGGAAAGCAAAAGATTATGTTTGCTATGACCTCTATCAAGGGTATTGG
TAGGAGATTCGCCAATATTGTCTGCAAGAAAGCTGATGTTGACATGAACAAGAGGGCTGGTGAACTATCTGCAGC
GGAGTTGGAGAATTTGATGACAATTGTTGCTAACCCACGTCAATTCAAAATTCCAGACTGGTTTTTGAACAGAAA
GAAGGATTACAAGGATGAAGATACTCACAAGTTGTATCAAATGCTCTTGACATGAAACTCAGAGATGATTTGGA
GCGTTTGAAGAAGATCAGGAACCATCGTGGTTTGAGGCATTACTGGGGTCTCAGAGTCCGTGGACAGCACACCAA
GACTACTGGTCGCAGAGGTAAGACTGTTGGTGTCTCCAAGAAGCGTTGAAGACTGGTTGTTATTCTTTTGATCAA
AGAAGTTCTTGTGGTGAGGAGTTTGTCATTCTGCTTTATAGTTGGAACCTAGAAGGACTTAAATTATGATACTAG
TATAGTTTAGGATTTTGAATATCTCGGAATTTTAATGTCCTCCA

> SEQ ID NO:784 214437 171725_300536_1
TCCGCCCTCTTCTCTTCAACCCGAACAATCGAATCTAACGAGCAGCACGGCAACGTCCCATACAGTTGCCCAGCA
TGTCGCTCGTCACGGGAGAGAAGACGAACTTTCAGTTCATTCTCCGTCTTCTGAACACCAACGTCGATGGAAAGC
AGAAGGTTATGTACGCCTTGACCAAGATCAAGGGTGTCGGTCGCCGATACTCCAACTTGGTCTGCAAGAAGGCCG
ATGTCGACCTGAACAAGCGCGCCGGTGAGCTTACCTCCGAAGAGCTCGAGCGTATCGTCACCATCATCCAAAACC
CTACCCAGTACAAGATCCCCGCCTGGTTCTTGAACAGACAACGCGATATTGTTGACGGCAAGGACTCTCACATCC
TGGCCAACGGTGTCGACTCCAAGCTCCGTGAGGATCTGGAGCGCCTCAAGAAGATCCGTGCCCACCGTGGTCTCC
GACACTACTGGGGTCTCCGTGTCCGTGGTCAGCACACCAAGACTACCGGTCGTCGTGGCCGAACTGTCGGTGTCT
CCAAGAAGAAGGGTGGCTAATGGTTTTACTGTTTTCGGTCTGGGGTGGACAGGCGTGACGGCTGGGTTTTTCATC
ACTGTGATGAGCATTTCCATGGGACTGCTTTCTGGCATACGCAGCTGGAGCTGTACTCTAGATCAGAGTCAAATG
AATTAAAAGCATTTTCAAaGc

> SEQ ID NO:785 214437 254029_301631_1
GCAGGAGAGAGGGAGGGAGAGGGAGAGGGAGAGGGAGAGAGAGAAGTCGAAAACCGGCTAATCTTCTCCTCTAAT
CATGTCGCTGATCGCCAACGAGGATTTCCAGCACATTCTTCGTGTTCTCAACACGAACGTAGATGGGAGGCAGAA
GATCATGTTCGCCCTCACGGCGATCAAGGGTATCGGCCGACGTTTCGCCAATCTCGTCTGCAAGAAGGCAGACGT
CGACGTCAACAAAAGAGCTGGAGAACTCTCTGCTGCAGAGTTGGAAAGCCTTATGGTGATTGTTGCAAATCCTAG
ACAGTTCAAGATCCCCGACTGGTTCCTGAACAGAAAGAAGGACTACAAAGATGGACGCTTCTCTCAAGTTGTGTC
CAATGCTTTGGATATGAAGCTCAGGGATGACCTTGAGAGGCTCAAAAAGATCAGGAATCACCGAGGTCTTCGCCA
CTACTGGGGCCTTCGTGTTCGAGGGCAGCACACAAAGACCACTGGCCGCCGAGGAAGGACTGTTGGTGTCTCTAA
AAAGCGTTAGGGGGGTAATTCTAGTTTCTTGTTGTGGCTGGCATTTTGAAATGTCTCAATTTTATTTAGTTTTGG
AGATGCGGCATGTAACCCATGTCCAGTAGTATTTAGCCACATGGAAACAATCCTTTTCATCATTAGAATGCGAAC
ACAACGGA

> SEQ ID NO:786 214437 252095_301668_1
aCGCGTCGGTTTGTAGGCGGCTCGGCGGCGAAGATGTCTCTGGTGAGCAATGAGGAGTTTCAGCACATTCTTCGT
GTGCTCAACACCAACGTGGATGGGCGGCAGAAGATCATGTTTGCGCTCACCTCCATCAAGGGTATCGGCCGCCGC
TTCGCCAACATTGTCTGCAAGAAGGCCGATGTGGACATGAACAAGAGGGCTGGTGAGCTGACCGCTACCGAGCTC
GAGAACCTGATGCTGATCGTTGCCAACCCGCGGCAGTTCAAGATCCCCGAGTGGTTCCTCAACAGGAAGAAGGAC
TACAAGGACGGGAGGTACTCCCAGGTTGTGGCCAACGCTCTCGACATGAAGCTCAGGGACGACCTGGAGAGGCTC
AAGAAGATCAGAAACCACCGTGGTCTTCGTCACTACTGGGGTCTCCGCGTCCGCGGGCAGCACACCAAGACCACT
GGACGCCGTGGAAGAACTGTGGGAGTGTCCAAGAAGCGATAGATAGCCGCAGCTTTTGTTTGGTCTCTTAATTTC
CAATATGTTTTAAGTGCAAATTTTAAAATTCATtaaGAa > SEQ ID NO:787 214437 155292_301354_1
GCATCTCTTTCAAACTAAAGCAGCCGCAGCCGCAGCCGCACTGTGCCGAAAGCAGTGAAACCCTAGCCATGTCGC
TGGTTGCAAACGAAGAGTTTCAGCACATTCTTCGTGTACAAAACACGAACGTTGATGGAAAGCAGAAGATCATGT
TCGCTATGACCTCTATCAAAGGTATCGGTCGCCGTTTGCTAACATTGCTTGCAAGAAAGCCGATATCGACATGA
ACAAGAGGGCCGGAGAACTCTCTGCTGCAGAGCTTGACAGCTTGATGGTGGTTGTGGCTAATCCTCGCCAATTCA
AAATCCCAGATTGGTTTTTGAACAGGCAGAAGGATTACAAGGATGGCAAGTTTTCTCAAGTTACATCTAATGCAC
TTGATATGAAACTCAGGGATGATCTGGAACGGCTGAAGAAGATCAGGAATCACCGTGGTTAGCGTCACTACTGGG
GCCTTCGTGTACGTGGTCAGCACACAAAGACCACTGGCCGCAGGGGGAAGACTGTTGGTGTCTCCAAGAAGAGAT

Figure 2 continued

AAATCATTTACTTGCCAGTTCCTTTATGTTTTATGCTTCTCTTTGGTATGTGGAGTCCGAACACCCGCAGGAAGT
TT

> SEQ ID NO:788 214441 218691_300920_1
GTCGCAATCGATCAAACAAACACCAGCACAAACCGGCAAAGAAATACCCTGCAGTCCTCGAGACTCGCGATAGAG
CAGAAGTACATCAGTCTTATTTACTAGCGAGCAAGACAGTCAAAATGTCGTGGGCGGGATTCAAGAAGAATGTGA
ACCGCGCGACGACGCAGGTGATGATGAAGACGGGGCATGTGGAAAAGACAAACGATCGCGATTACGAGGTCGAAG
AGAGACGGTTCAAGACGATGGAAACAGCTGCACTGCGGCTGCAGAAAGAATCAAAGGGCTACCTTGACTCTTTGA
GAGCCATGACAGCTTCACAGATGCGAATCGCCGAGACGATAGATGCGTTTTACGGCGACTCCGGTGCGAAGGATG
GCGTGAGCAGGAGCTACAAGCAGGCCGTCGAAGATCTCGACGCCGAAACCATCAAGGCCCTCGACgggcCTTACC
GAATGACGGTGCTCGACCCCATTGGCCGGTTCTGCGCCTACTTCCCCGACGTCAACGAATGCATCAAGAAGCGCT
CGCACAAGCTTCTCGACTACGATGCTCTCCGAGCTAAagtgaagAAg > SEQ ID NO:789 214443 199653_300751_1
CAAAAAGGCTCCAGGCATCGTCTTTGACAAGGAGGACTACACTGCTCGCTACAACTGGTCAATTCCGCTACGTTC
ATACGCGGAAGAAAAAGAACATGTCGCTAACAGCAATCGCAACAACAATGCAGACGGCTCTGCAACGAGCAGAAA
CGATGGATCCCGCCTCTCTAAGCCTTCTCCAGAAAGGCTCTTCCCACAATTCCTCTCCCAACTATGGAGCCTCCG
GAACGGTGACAAGAGGGATATTGCAAGACTATCAGGCGGTACCGACCAGCGATGAAAGCGATGCCACCCGTCCGA
GAAAGGTTTCATACAGCGATGCGGCGAAGAAGGCCGGGAACCATGCGAAGAGCCAGAGCTCTCTGCGGCAACGAA
ACGGAGTCTCCGGCTCGGAGGATACAAGATCGCCAACAAAAGCAAAGTCATCATGGACGAAGGAAACATTTCGAA
AATTTCAGTCCCTTCAGTTGGAAAACAAGGGAAGCGTGGCTAGAGATCACCTGGCTCTCGAACGCACATTTCTAG
CATGGCTTCGAACCTCTCTCGCTTTTGCATCGATTGGCGTCGCCGTGACGCAGCTATTCCGCCTCAACACTGATA
ACGCTTCCGCCTCCGATTTCGACCACACAaggctaCAAAAGAT > SEQ ID NO:790 214443 200546_300853_1
ggcgcaatgcttcaacAGCGTCTCTCGCCACAGTCTGGATCTGCCCGTGCCGCCACTCTGAACTACAATCACGCA
ACCAAACCTTAGTTTAAATGCGCCGCTCTGCGCCCCCACAAGAGCTTGTGCGCATGTGCTGTGGCACTCAGTTCA
AAGTGGTACTGCCGAGTCAAGTGAGACGTGCACCCTGGTCGAGGCCGTGACCATGGCTTCTCACCCTCAGACCAA
CGAGCTTGACGCATCTGCCTCTGCAGTGGCATTGCCGAAGAAGACGCTATCGAGGGCTGACCTGCATCGTCGTCA
GTCGGCAGACGAGCGGATTAACAACATTCTCGAGACGGCTCTGCAACGAGCAGAAACGATGGATCCCGCCTCTCT
AAGCCTTCTCCAGAAAGGCTCTTCCCACAATTCCTCTCCCAACTATGGAGCCTCCGGAACGGTGACAAGAGGGAT
ATTGCAAGACTATCAGGCGGTACCGACCAGCGATGAAAGCGATGCCACCCGTCCGAGAAAGGTTTCATACAGCGA
TGCGGCGAAGAAGGCCGGGAACCATGCGAAGAGCCAGAGCTCTCTGCGGCAACGAAACGGAGTCTCCGGCTCGGA
GGATACAAGATCGCCAACAAAAGCAAAGTCATCATGGACGAAGGAAACATTTCGAAAATTTCAGTCCCTTCAGTT
GGAAAACAAGGGAAGCGTGGCTAGAGATCACCTGGCTCTCGGTATGTCGCATGCGTATACAGCAGCTGAGCTGCA
TGTCTCAAGAGAACCAATTGGCTGACCATTTCATTTCCCCCCCCTTCCAGAACGCACATTTCTAGCATGGCTTCG
AACCTCTCTCGCTTTTGCATCGATTGGCGTCGCCGTGACGCAGCTATTCCGCCTCAACACTGATAACGCTTCCGC
CTCCGATTTCGACCACACAAGGCTACAAAAGATGGGCCGCCGTTGGGTGCGACATTCCTCGCCATTAGTAttGT
GACCTTGCTCCTCGGTTGCAGACGATATTTCCATGCCaggAATGGATCCTTCAGGGCAAgttcccGGCAAGCCG
AGGGAccATCAtTATCATGTCACTGGTGgcattggcccTCATGATTtT > SEQ ID NO:791 214447 200469_300759_1
gcttttcTCCTGGGATTTTCGAGTGCAAACATCTGCCCTTGTTTGCGTCTTTCCGCCTGCGCAAACCAGAACACC
GCACTTCCTCCCGAGACAGAAACGAGTGTTGGTTGCCCCAGACTGTCTTTGATTCTGAGACATTTGGCCTCCCTT
GCAGGTAACTGACGGTGAGAATAAAAGCCGACGGGCCGCCGCCTGCAGCAAACGAAACCAGCGACATACAAAAAG
AAACACAAACAAGCAAATCAATTCCCGAGCAAGAAAAAAAGAAGAAGCCCATCATGAAGATGCTTTCGTTTGCCG
CCCTCTCGGTGCTCGTGTTGGGCGCTTCGGCCCTGGCTGCGCCGCCGGCCCACCCCCCGGCCGACAATGGGTGCT
GCTGCTGCGACATCAACAAGAAGAGAATCGACTGCGACAGGTCGATCCCGGCGTCGGAGTGCATCTGCCCCCAGG
TCATCTGCCCCGCCGGCGCGCCCACGTTCACGCACGGCACGCCGCCGAAAGCCACCCCACCGCCCACGCCGCTGC
CGACTTACAAGCAGTGCTGCTGCTGCAATCCCAACATTAACAAGATTGTGTGCTCGCTGAGGCTCGTGGAGGACT
GTATCTGCTTGGCCGTGATGTGTCCGACGGATGCAAAGACCATCTTTGTCAGGCCAACTGGCGTTCCGACTGTCG
CTTAAGAGTATTCGTTGGCGAGCCGACTTGCCTGAATCCTGGACCGGGGACATGACATGGGGGGAGGGAAAATAC
AGGGCAAGGCATTGCTGATGGTGAATGCACAACACGCGTGGCAGACTGGCCGAAAATTGATGATTTACTGATGGG
CGACTTTGGACTTGAAATGGGGCATGCCGGATGGGTTACTTGACAGTATTTACACCATTTCTATTCAACAATAAA
TGGAATTCTCTag > SEQ ID NO:792 214452 122240_300017_1
agcccttattacagtctaacagccttattaattctagcttgttatacggccacagtgttactatgagcaaacgca
tattgCTCGTCTTATGCATCGTTTGTTTACAGCGACGACTCGTGATTACTCATGAGTAAACCATTTACAGGGTTG

Figure 2 continued

ATTTGAACTAATTAATTAACCCCCCCCCCCCCCCCCCCCCGAAGTCTAATCAGTCGCATTGCATAGAAGAAGAAT
AGAAGCATTTGAAGCCTCCTCCTCCAGGTTGCAGCAAAAGCACAGGAAGCAGCGAGATGGAAGGCAAGAGCCGGC
GACCGGAGATAACCGTCGTGCCGGCGGCAGGCGGCGGCGCCGCCGCCGTTGATGCGGTGAAGGCGGCGAACA
AGGAGCCCATCAGCCCGGGCTCGCCGTCCCTGGCGAGCGGCGCCGGCAAGGAGAGCCTGAGCCGCCATGAGGCCG
CCGTCGTGTCCCTGCCCGCGTGGAAGCTCGACGCGCTCTGCCAGGAGTCCGGCTCGTCGCCGGCGGTGATGAGGG
CGCGCTTCCCCTACTTCTGAATTTCTGAATTTCTGATGAAGCCATGAGCTTTTTGCCATCTTCGTACGTGTGTGT
GTGTGTGTGTGTGTGATTGTAACTGTGTTGTTCATGGCTGAGTAAAGAATTATACTTCCTACAAGCGGCTGTGAT
GTATATGTGAGCTGCTTTAGCTGACGCGTTCATCTTTGGACGCTGTAAAAACTAAAAACTGCCAGTTTTTCATGT
AGCATCATTGGAAAAAAAAAA

> SEQ ID NO:793 214456  217790_300911_1
TTGTAAAGACTCCCCCTCAAGGCCCCAgaaAAGACGAATTCAAATCTACGCCGACTGTCTCTCTGCAATCGAAAG
CTATTCGTGCAACCATTACACGTCAACAAGCCATCGATCTCTTAACAAACCTTTATAGAACTTGCGACAACTTTC
TACCGCCATCATGGGTGTCTGTGCCGCAGTACTAATTGTCATCGTCACCATCTTCTTCCCTCCGCTCGGCGCGTG
GGCTGTGGCAGGATGTGGAATGGACCTACTCATCAACGTATGCTTGACGATACTTGGGTATTTCCCGGGTCACAT
ACATGCGTTCTATCTCGAATACGTGTATTACGACCGTCGGCAACAAGCCCGCGAGGGCCATTATCCGCCGCGTCG
TGCTCCCGGCATCTACTCTGACAAGGTGCAAACGGGTGGACAAGGCCGTCGACAAGGCTATGGAACGATGGCACC
GCCGCCTGCTGGGCAGCCTGCTGGTGCTGGTGCGCCTGTCGCTGGCCCTCCCTATGATAGCCAAGGTTATAACAA
CAACCAAGGCTATGTAAATCAGGGCTATGTCAACCAAggttATAGCAAccaaggtCaaaa > SEQ ID NO:794 214460  219439_300945_1
gcccacgctgtcgcccacgcgtccgatttcactcttcTGCAGACGAGGACGGACCCGATTGACCATGTTGCGACA
ATCCTTCAGAGCCTTTGCCCGCACGGCTGTTGCGAGACCGGCCGCGGCGAGAAGCTACGCTACCTTCAACTGGGA
GGATCCCCTCAATGCGAACAACCTCTTTACCGAGGAAGAGcaggcCATTGCAGAAACCGCAGAGCGATACTGCCA
GGAACGACTACAGCCTAGGGTCTTGcaggCCTACCGAGACGAACACTATGACCCCAAGATCCTcgaagaGATGGG
CGAGCTGGGCCTGctTGGCTCCAGCatcaaggGCTACGGATGCgCTggcgttcttCGGTGGCCggcggcCTGAT
TAcacgagcGGTCGagcGaGtc > SEQ ID NO:795 214471  214490_300858_1
TCATGCGCCTCAAAGAATGGAAGAAAACACAGGCGAATGACGTGAAACGAAAGATAAAAAGACAGGCGCCTTCAT
GCGAGGGTTTCGCCAGTCGCCTCTAGCGTGTTTCGAAGCGCAGGGTTGAAACGCGGCTGCATGATGCCCGGCCGC
CCATCTGAGGCATGGCGGCTACCGGAACAGGACGACATCCGAAGACTTGAGGAGGCTCCGTGTTTGTTCGTTTCG
TTTCGTCTTTCGAGTGAAGGGTTGGTTCTTGTTTTCGGCTGTTGTGTGTTTTGGTTGACTTGTGTTTACGGGTTG
GGGGTGAGTTGAATTGAGTGCGAGACTTGATGCTTCTGTCAACAAGCCAGCCACTTACACTGCGGCTTCACCCTT
TCGTCTCTTTTACCATGTTACGCAACATGGCGAATTTCCTTCTATAGGATCCATATTGCCCAAATTCAGATCCAG
CCCGCAAGGGAGAATTTTATCCGCCT > SEQ ID NO:796 214473  215157_300878_1
GGGAAAATAGACTGCGAGAGAGAGAGCGACGAAAAGAAGGAAATGCTCCGATCACGATTAGGGGCGGAATTGGAA
ATCCGGAGCTCCGACAGAGTGCGAAATGCGAATGCGATAGTTCAAATGTATGATTGATTTACTGTATGAGGCGAC
GATGATGCGATGAAGAAGAACGGAAAATATCCCGAGCTGATGCATACATTGCGGGCTTTCCGGATATCTCGTCAG
CCCTCCTTCCATTATGTCAGAAGCTATTATGCAGTTGGTTTTGATGGATGGGCGAATTTGATGACAAGGTGCAGT
TTACTGGACGGGACCGG > SEQ ID NO:797 214481  208382_300959_1
TGACCATCTCACCCTACGTCACGAAAAGGCAAACACCAAAGAACCCAAAGAGCGTCCAGCTTCTTTCTGCCTTTG
TCCGGCGTCTGCTCCAGTTGCTCCCCATCCTCGAGCCCTTTGCGACTCGAACAGGGACAACGACTCCATTGACCG
ACTGTTGCTATTTGCATCACAACGCATCGCAACATCTTCGCCTTTGTTGGGGGGAAAATATCCATCCACCGCAAC
GTAGCACCAAAGTACTCTGGACTTGAAAAGCTACCCCGCACCCGGTCGCATTTCTACAGCGCTTCCTTCTGCTCT
ACCCCTCCAAACCTCTTTTCTACCTCTTTTCCCGCTTCGGCACACACAAACCACACAAACTCTTCAACAACCGCA
GCCATGGCCGACAACCAGGGAGTAGTCGTGGAAGCCCACGAGATTGAGACTTTCCAGCCTCCTCAGAAGATGTTC
GCAAAGCACCCCGGCAAACCCCACATTGCAAGCCTTGAGGAGTACCAGAAGCTCTACAAGGAGTCCATCACCGAG
CCCAACAAGTTCTGGGGCCGAACAGCTCGCGAGCTGCTTTCCTGGACCCGCGACTTTGagaCCGTCTctgccGgc
agccTCGctgaaggcgatATcaagTGGTTCGTagaGGG > SEQ ID NO:798 214485  210386_300888_1
AAATCCCACACTTCAGACTCAGACTCAGACTCACGCTCAGAAACAGTCGTCACAATGGATCCCTTGGAGAGCATG
TCAACTGGAGGGCCCCTGCCCAAGGACTTCAATGCCGACGATGCGGGCAACATGGAGGATATGGAGAAGCAATTT
GCCGTCAAAGTTGTGCAACACATGGCAACCTACTGGGCCATTCTCGAAAAGGTCAAGGGCTCCGGCCTGCGACTG

Figure 2 continued

```
ACGAAGATCGACGACGAGATCTACGACCACCTCAAGGAGGCCTTTCCCGAGTTTGACCCCGCCGCCACGATCGAC
GAGGACCAGATGAAGAGCAAGACCGGCAAGGAGAGGTGGCGCGCCTTCATGATGAAGTACGAGAAGAAGGTGGAC
GACTACAACTTTGGCACCATGGTGCGGAACAACGCCAAGGCCGAGTACGAGCAGGACACAACCATTTTCGTCCCC
AGGATGCAGTTTTATGCCATTGAGATCGCCCGAAACCGAAGCGGCCTCAACGACTGGATATACGAAAAGGCTCAG
GAAGAGAAGAATAGCTCCAAATAAATACCCCAATACACAAGCCAATTCAAGAGttGTTTTTgttATCAcCgcgtg
cctTTGTCAACTAAAAATAttgaggattcactcaaCgggCGTgGATatggttttgtcAT
```

> SEQ ID NO:799 214491 208402_300960_1
```
GAACTAACTCAAGAAAAGGGAAAAGGACAAAGGGAACGTTCGGCCTTCTTCCCCGGCCTTGGCTTAAGCCCCAGA
GAAGAGCCGCACGTGGTGCGACGTTGACGCCATCAGATCTCACATCACCATCTAGCAGATAGTATGTGCGGATGC
AGCCTATACAATGCCAAGATTCCCACGCATGCCTTTGGCAATGGAATTGCTGGTGTTTTAGCAGTGTGCCTGTGA
TATGAGTCGGGCGACTCCGATGCTTTCGGGGTGCGTCATCGCTGGGCTCGGTGGAGGGAGGCAGCCGAGTTACGA
ACAAGAATGATGCTGTATATAATCACCCTGTTGTAAGATGCTTCATGATGACCCTTTTCATGTTCGTTTTCCGAT
ATGTTGTAGAATATTTGTGTATATCGGCTACAGTTTCTGTATTAGTTGATG
```

> SEQ ID NO:800 214504 208885_300809_1
```
gaaaccgcaatccatctcccggcGGAAATTGCCCTCCAACCGCAACCATGTCGACCCTCCCCAGGACTCTGGGCA
ACCTGCGCAAGATTGGCATCAAGGAATACTTCCGCCAGATGCTGTACATCGGTGACACCAAGTACGGTACTCTCA
TCGGCCAGGATCGCTTCGGCAACAAATACTACGAGAACCTCGAGGAACTGCCCCTCCGAACCCGCTGGGTCGACT
ACGCCAAGCACGACTACGATGCCTCCCACATCGAGCCCGGCTGGCACGCCTGGATCAGCTACTCCGTCGACAAGC
CCCCGACCCAGGACAGCCTCATCGCCACGGGCACCAGACACTTTGAGCCCGCCCTTCCCAAGCCCAACTTTACCG
GAACGCGAGGCGCTTACAAGCCGTATAACACAGTGAAATCGAAGCTTAATGCTTGGGAGCCGGTGGCCAAGGATC
GGGTATGAGTGGTTTTTACGTTTTCTTTTTTAAACCGTGGGAAAATATGGTGTACATATTGAAATCGCGCAACAA
ACGCAAACAAATCAAACAATAGACACAGACATGTG
```

> SEQ ID NO:801 214505 195532_300635_1
```
TTTTTCCTCTCCAATCTCCAATCTCCCGCCTAAAGCTGGCCTTTGCTTCTCAGGCCCCTTTACTCTCACAACAAT
TTGTTACTGCCTGTGTATCTCTGCTGCGATATCAACTTGACCAAACTCACCACTTTTCTCTCTCTTCTTCCTGGC
ACCCGGCAGACCTTCCTTTGCCCGTGCTCTTCATCGGCAAATATATTCCATCGCTACCAGCATCTAGTCTTGCTC
GATCGAGATTCCCTTGAGCCTCATATTCTTGCATGATCATTCTGCAGATTGACATCGCTGCACACTACTTTTGAT
ACAGCTCTGCGAGCCCAAGAGAATTTCTTGCTTTCGCATCATCCAACTTCATCAGCATTTGTTCGTCGACTCAAA
CACACAATACATACCCAGTCAAATACCGACAACATGTCAAGCGGTCAAATTGCTGCGCCTTTTGCTATTAAGCCT
TCCCAGCGGGCTAACATCCGGCTGGCAACGGCTCAGGACCTTTACTCCACGCTGAGCAGTTGTCTCAGCCCGCTA
AAAGGACATCAGCAACCAGCTATTCCTTTTGATACCAAGCAAGGCGACGGCTCCTCAACTCCTGCTCATCGCATC
CTTGAGGATGACTACACCGTTCCAgcg
```

> SEQ ID NO:802 214513 220977_300940_1
```
TCTTCTCTATCCTCTCTTGACTATCATTGTTATACCAAACTCACTCTTAAGTTCACCTCTCCATCATCATCAACA
ACACCAACCAACCAACCAGCAAGCAAACAAACAGACCAACAACTGTGACAATGTCCAGCCAACGCAGCGTC
TATGTTCACCAAACCAGCTCTGGCCCTTCTACCGCCAGCTCTTCCAGCCGCTCCTCCAGCTCATCTGCCCATTAT
GCGGCATCCAACTCCCGCTCTGTCTCCAATGCCCGCGAGTATGATGCCGCAGGCCGTTCTGCTCAAGTGGTCCGA
GGCAGTGCCTCTGTCGTCATCAACCACCACAGACGAGACTACGAGACGGACTCTCCTTCTCCTCGCTACCGTGGT
GGCTACCAGTGATGCGACATCCGTCACGCAGCTTGCAACTACTTACACAACTTCACAACCACATATTGGGACACA
ACCCGCTTCTGGGGAGCCAGCCGGGGCTAGCGGGGATACCCTCTGCTACCGTGGCTCCTCTACACACCCACTCA
TAGAACCGCATGGCGCTGTTGGCGTTCTTTTTTGTGTTACTATTTTTACTCTTCTTTACAACCTTACAACTTTGG
```

> SEQ ID NO:803 214515 224066_300978_1
```
AGCAAAAATGCCCCCTAAAGTGCAGCAGACCAAGGCCGCTAAGGCCGCCGCCGCCATGGCCGGAGGAAAGACCCG
AAAGAAGAAGTGGTCCGCCCAGAAGATGAAGGATAAGGCTCAGCACCACGTTATCCTTGACCAGCCCCTGTACGA
CCGAATCTTCAAGGAGGCTGCTACCTTCAAGCTCGTCTCTGTCTCCGTGCTTGTTGACCGACTCAAGATTGGAGG
TTCTCTCGCCCGAGTTGCTCTCCGAGATCTCGAGGCAAGGGTATCATCAAGCCCGTTGTCAAGCACTCCAAGCA
GTACACTTTCACCCGAACTGCTGCCGAGTAAATTAGTTATTTTATAGCTGAAAAAAATATGTATT
```

> SEQ ID NO:804 214519 195951_300639_1
```
ggGGTGCGATGTGAGGCTGATTTGGGGTGTATGATTCGTGAGCGTGTAAGAGGAGGCAGCCCACGACTTTCTCTC
TGTGTCTGTGCTTGCTCACTTGCTCGCCTCCTTGGATTCGGCCTGTTGATCCGAATCAGAAGTAAATGTGTTTGA
GACTGAGACTTGGTCTGGTCGAGACGATATGAGATGTGGCATGGAATTAGAAACACGTGTTTGGTATGGCGATTG
CGATGCGATGATCCGCAGAAAGCAAGATCTCAGGGCGACTAACACGGATATACGGAGGTTCGACCAAGACACGAG
GAATGATGGGGAAAGTCTCAGTATGTCACTACGGAATTTATGATTACGTAGCAATGTATGAATTATCATTTCAC
```

Figure 2 continued

> SEQ ID NO:805 214519   218772_300936_1
GGGGTGCGATGTGAGGCTGATTTGGGGTGTATGATTCGTGAGCGTGTAAGAGGAGGCAGCC

> SEQ ID NO:806 214533   207606_300827_3
gttgttttttttgttttTCATCTTTCttCTTTGTCACAATCACTTTGCCGTCTTCCACGGACATTTCCGCAGATCT
GCATCACAGAGATCTGCATCAGAGAGGATTTCAAGCTTTTCCTCTTTGTTTGCCTTCCTCTCCTCTTCTCTTCTT
GGATCACAAAACAATCGGCAAAATTGACATCTCGATATTTTCTGCCTCCAATCACAGCCGTCATACCACCTGTGG
CGTCTTTGCCATCAATTCTCTGCTGCGGTGCTACCCGCCCTGCAGCAATTTTTCCCGCTGGCCGTCTGCAGGCTT
GCCTCGGCTGTGGGTTTTTCGTCGACCACTGAGGCTTAGTGCCCATCAGCCACTAAAGCGGCTTGACGTCGATTC
TCAACTTTGAACCCTTTTGAGCTGCCTCTGGCCTCTGCCTCATCTCTCCCACACCCTCACGCGCGCAGTCTTGAA
TCAACACCCCTTCACGCACTCGCCATTGCCGCGCTCCTCGTCACGCTCTGCTCGATTAGCCGTCTCTCGCCCATT
GATTGAACCTGCTCTCGGCCTCTGCAGCCACCCTCACGCAACCTACGCCTGACATCCTCTGCGTCGCTCGGCTGT
CTCCCGGTTTTATCCATCAGCTGAACCTTCACCTTCGCCTTCGCTCTCAAGAGGGAATCCGAGGGCCCGGCCGTT
CTCTGCCATCTATTGTTATTGCCATTAACGCTGCTGCTGCTGCCACTGTCTCCTCTACTCCTGTTTCGCCCTCAT
ATGTCTCAGCCGCCTCGCCGGATGCCTCTACTATCACACCCTAAACACCGTATTAGCATACTTGATCTTACCAAA
CTGCCGTTGCAGTAACGCCGGCTTCATCTTCTTGACAATGCCGTCGAAAACTAACAATGGTGTGGGAGTTCAGGT
CGAGGACACAAAGATATGCGTTGTCATGGTTGGTCTCCCGGCCCGCGGGAAGAGCTACATTGCCCAGTTAGCCCA
GAGATACCTGCAATGGCTGTCGATTCCGGCAGCGACTTTCAATGTCGGCAACTATCGGCGCAATGACGCTCCACA
GCCGACTGCCGACTTCTTTGATTTTAACAATCCCGAAGGAGAGCGGAAGCGCCGTGCGGCTGCCGAGGCCGCCGT
TGCTGACATGCTTGCCTGGTTCCGCACCGGCGGCGTCGTCGGCATCCTTGACGCGACCAATTCTACAAAGGAGCG
CCGTAAATGGGTCATGGACACGTGCACCGCTCACGGCATTGAAGTGCTCTTTGTCGAgaGcAAATGcgatgatga
agaggTCATCAtggccaatatccgTGACGTcaaGCTAACGAGCCcCGACtatcgaggccaagatcccgaggCcGC
GGCGCa > SEQ ID NO:807 214534   195925_300639_1
cccacgcgtccgcccacgcgtccgcgaaaggtagcctctatacggtacatcgcgatatactcgtagcgctcagtt
gcagtTGGTACCACGATCGTGCATCTGTAATTTCAGAAGGAGGGCGTCACACAGACCTCGTCACTCCACCCACCC
CCTGCCATCCAGATCGCAGCTTCTCTTTTGTTGTTAATGACGTTGATCAACCAGATCTGCCAGCTGGCGTGGTGG
CCAGAGCGTCAGTTGTCGGCAAGCACTACATACAAGGTACATTGCAAAGAGGTGGTAGGGCAGTGTCAAGCGAGG
TACCACCAGAGGGACGGCTGTTGCTACTTCCTCACTTCATAAACGCTCTAGGCCCTTCTCCTCTTGCCCAGTGCC
TACCAGGTGACCgcaACTCCTTCTTCTCTCTCTTTCTCCAAGATTCTCCCTCTTCACCTCTTGTCCTCTTGGAGC
TCCCAAACTTCTCCTCGTTCATCACCACCGTTCTCAAGCACAAAATAAACGTCAAGCTCTCCTGGTCGCCTCGCC
ATCGCCAATCGTTGTTTGCGTCGTCTCTCGTTGCATTTCTGTATCTCCCAGAACTCAAGTCGACTTTTTTGACAA
CGTCACCGCCAAGATGAAGTCCGTCGTTATCGCCCTTTGCACCCTGGTTGCGGTTACTgccGCTCAAGGCTCTGC
CAACCTTGCaGCCTgcggcCAAACCTgcgCCACCAACATGTTGAGCGCCGACAAGGCTGAGGAGCTCGGTTGCAA
ACAGAATGACTTGAGGTGTCTCTGTGCCAACAAGAACTTCCTTTATGGCCTCCGAGACTgctCTgcggcTATTTG
CCCGGCTGAGGATGccAGAAAGGTTGTTGACTATGGTATCAGTATCTGTGCTGGAGCTGGTGtTCGATCCAAAC
ATCGGAGGtagcAGCGGTGGTGCTagTCACACTGGaAAGttCTCCCGGAAgtgccaCTGgCAGTGCTACTga > SEQ ID NO:808 214544   200536_300853_1
CCCACGCGTCCGGGACAGGAAGGACGGAGTGCGAGAAGACCGGTACATTCTTGTTCGTACCGTACATGCACGGAG
CCTGCAGTGCAAGGCTGCAAGCAAGAAAAATACCTGGAAACGCCTCAGTCCCCCAGTCGCCCCCTTCAATGCGAT
TCGGCAGGCCGTTGAGCCAACAAGGGCTCGCGTTTGGCACAAAATTTGCAAATTTTATCTGTTGGGCAAGCTCCA
TTGCTAGTCAAGTCCCGTCCCGTTGCGAGTACGAAGGCACCCGGACGGAATCCGCACTGGCGCATTACCTTGGCC
GTACCGTGCTCGTTACGCACAACATACTATAAACGTTTGACGCTGGGCTGCCCGGCAAACCAAACCATGAATAAT
ACATGACGAAAGTACCCGCTACAAGC > SEQ ID NO:809 214545   211475_300899_1
gttcacgattcctcctttcttcccctccatactatttATCCTGCCTCTTCCTCGTCTTCCATCTGTTGCCGGTGT
GACTCTTGCAATTCATTCCCTGCCCGGCTTCCTCGCTTGATTGAATAGCCGTTGCTACTTCCAACTGCAAATCAT
TATAGCTATACCTCCCTAGCTTCATATAAGCTCGGCTCTTCTAGGAACGCGCAAGCAAACATCCTCGGCAGTGAC
CCACGAGCCTTGTCTGGAGATTTTAAATAGGAAAGCTCATCAACGGCACCTGAGCAGCGTCCAATTGCTCTGTTC
AGCTCAATTAAGCTTTCAAGATGCCTAGAGACGGCAGTAAACAACCGCCCTCAGCGGCGACAAACCTCATCGCTG
GTGGTGGCGCCGGTATGATGGAAGCCCTCGCCTGCCACCCTCTAGACACAATCAAAGTGCGAATGCAGCTCTCTC
GCCGTGCACGAATGCCCGGCGCCCCCGCCGCGGCTTCATCAAGACTGGTGTAGAGGTTGTGAAAAAGGAAACTC
CTCTCGCTCTATACAAGGGCCTCGGCGCCGTCTTGACGGGCATTGTCCCTAAAATGGCTATCCGATTCACATCAT
TTGAGTGGTATAAGCAGCTCCTAGCCGATAAAACCACCGGCACCGTCTCAGGCCGAGGAACATTTCTGGCTGGTC
TCGCTGCCGGTGTGACAGAAGCCGTGGCCGTCGTGACACCCATGGAGGTCATCAAAATCCGTCTGCAGGCGCAAC

Figure 2 continued

```
ATCACTCAATGGCCGATCCGCTGGATATTCCCAAATACAGAAACGCCGCGCATGCTCTGTATACCGTCGTCAAGG
AGGAAGGCTTCGGAGCGCTATACCGTGGAGTCAGCTTAACAGCCTTAAGAcaaGGCTCCAACCAGGCTGTCAACT
TCACGGCATACTCTTACTTTAAGCAGTGGCTCAaGGACTACCAGCctcagtatACcgaCGGTaaC
```

> SEQ ID NO:810  214547   218073_300914_1
```
gggttttttttcgggaagtttcagcattagcattacaccagtAACCCTCCAGGGCAGCTAGCGAAGAGAGCAGGC
CCAGTTCCGGGTGACAGGTCGGGCAACGCCGCGACGGCTGCGATTCCGAGCGAACGGCGCTGGCGTTCCAGACGG
CACAGCAGCAAGCACAGCAACAGCACAGCACAGCTACGAACATCGAGGATCCCGCTCCAGGAACCGGTGCTATCC
AGAACAAGGCCCCGGCGCTAGGACCCGCGGTTGGCAGTGGTGGATCGCAAGGCTCCAGTCATGCCATGCAAGCGA
GGGAAAAACGCTTGCATGCTCATGCTTTGCTCTGGCTCTAGATGAGTCTGAATCTCATCCATCCTCGACCTGCTG
CTGTGTCTCCCCGTCCCGCACGAGGCTTCGGTCGGCGAGAGCCGGGATCGAGGCGTTGGGGGATGGCGTCTGTGA
GCCAGACATGACCTGTCACAGCGCTGCGTCGATGATGAAAATGGCCTGATTTCTTGCTCGCGGAGCTATGCCGGG
ACCCTgcaaccgcgaAATgggctgccacCGGCcAcAGAGAaaa
```

> SEQ ID NO:811  214548   216980_300903_1
```
CGAATATCATGCTATCAGCCGCTTCCTTCGTTCCTGGAAATGGTCCATGCTGACCTACCTACCCCTCGCCTTGGC
CCTTCAACTACGCAACCCCAGGCGCATCAACCTCGTCAAGGCCATCACCGGCTCTACCCGATCATCCACTTTTCT
TGCTACCTTTATAACCCTCTTTTACTACGGGGTGTGTCTGGCCCGCACTCGCCTCGGCCCCCGCGTCCTCGGCAA
AGAAATACCGAACCGCCAGCGAATCGACGAGGGCATCTGTGTCGGTACCGGATGCTGCCTTTGCGGATGGAGCGT
CTTCATCGAGACGGCAGGTAGAAGGAAAGACATGGCCTTGTTTGTGGCGCCGCGGGCACTGGCAACGTTGGTCCC
TCGGCGGTATCCCCTGGAGAACGAGTGGCGAGAGAAGTTGATATTCGCAGCGAGCACGGCAGTCGTGTTTACTTG
CGCCCTTGAGAATCCAAAGAGAGTTAGAGGCGTACTAGGGGGGATTTTGGGCATGGTGTTGAAGAAATAAACCGG
GCATATGGGCAAATATGATCTCTTTTAGGGAGTTCTGAGACGTGACATGACTAATTTCTTCTTCTTCTTTGGATG
TCTTTGGAATAAGCTACGGTTTTTAGATGATATACACAAACAACCCTGATGCTATAATTGGTAATAAATACATAA
TATTAATTGTTTATCCAaacaaAAAAaaaaa
```

> SEQ ID NO:812  214549   221082_300941_1
```
gacccacgcgtcgAAAAATGGTTCGCTTTTTATGCGAGCATAGCATGATGTGAGCGAGAGGGATGGGACGCCATG
GCTGGATTGGGTTACCCCGAGGCCGGGATTCCGAGGCATTGGGAGATGGCAAGCATGCTGAGCTGCGAGGGATGG
GGATCTGGAACCCCCTGTGCATTGGGAGCTGTCTACAGTACCTAACCTTGTGAATGCATGTACGAGTATGTGTAT
GTATGTGAGATGGAGGGCTGTATGTTATGTGTGAGAGCACGTCTGTGTGCTGCAGGGGGTTTCAATGCGGACGAG
GGGAAGAGAGTCAAAAGTGAAGAGTGACGagaTAAGCGGGGTATTCTATTCTATTCTGTTCTTTTCATTC
```

> SEQ ID NO:813  214577   214463_300858_1
```
tgtgctgtgctgtGATTTTTGAACGGATATTACAAGGCTGGTCCGAGTTCTTGGAGTTTGAAGCGCTGGCGTTGT
TTCTTCAAGATCGCGACGTCGATCAACTAAAGCCAGAGCTTATACGTCCGGGTGCATATGCATATGCGGACATGA
GCCTGTAAGCTTCAACTGCTTCGCTGCCAAGCCAAAGCGCGCATCCGAACTTCAATTTCTCAACGCCCTGCATAC
GGATTCGATTTCGCG
```

> SEQ ID NO:814  214578   207939_300830_1
```
acgtaatgcgtcccccatgtaatatatacctgcttgcgccccttt cgacgagtcacgatagcctctcctgcggcc
aatgtCTGCTCGCTTGGCTGGCTCGAGACTCCTaggTGCAGCGCTCAGGATGGATTTTGCTGGCGGAAGCACAAA
GGCGGACCACCTCTGCGTCCTGGTTCACGGACTATGGGGTAATCCGAACCACATGAACAATATCGCAAAGACGCT
ACGAGCCCAACATTCCCCTGACGACCTCTACCTCCTGCTGGCCAAGCGAAACAGCGGCAGCTTCACCTACGACGG
CATCGAGCTTGGCGGCGAGCGAGTCTGCGCCGAGATTATAGAGGAGCTCAAGACGATAGAACAGAATGGCGGCAA
GATTAGAAAGCTGAGCGTTGTGGGATACTCTCTCGGCGGCCTGGTATCGCGGTATGCCGTTGGTCTGCTGTATGC
AAAGGGCATCCTGGACTCGGTTGAATGCATGAACTTTGCGACCTTTGCCTCGCCGCATCTGGGCGTACGGACCCC
CCTCAAAGGATGGCACAACCATATGTGGAACGTGTTGGGCGCGAGGACGTTGTCCATGTCCGGGAGCCAattgtt
CACGATTGATAAATTTCCGAGataCcgGCCGGCCCCTCCTATCTGTCATGGCCGATCCCCAgtCGATTTTCATGCT
GGgacTGCagaAgttcagGAGACACACGTTATACAGCAAcAtCgttaatgACCggaGCGCGgtttaCTACACGA
```

> SEQ ID NO:815  214583   215474_300881_1
```
cactgtcgctatcatggcccgcggaaggtcagCGTGATTTGGCGCGCGCAAAAAATCAGAAGAATGCGTCCAAAC
ATGTGAGTCGGTTTTGCATATAAAATCCTCAACAGGAACCAGGGTTGACTAATTCGGTGTCGTGTCTTTGCAGAA
AGGCGGCAATACCGAgaACGGATATGAGCAAGCAAAATCCAAGTTGAGTAACGCCGAGATTATGAGGCAGAAGCA
AGCCAAAGGTCCGAACAACCAAGTCTACCCAATACCTCTTACGAACCAGTCAACTTACCAAGGCAACAGCCAATG
CCGAGAGAGACCTAGCGGCAGCAAAGGCATTACAAGAGAAAGGGACGCAAAGGCGAAGAAACCGACTGAATTGG
GCGCTTCAGCTGTGGAGGTTACTGGACATGCAAATAACCCAAGAGGATAGCAAGAGATGGGAGAAAACACGGCAC
GGCGAAATCAGGCGCTCCTTGAGACTTTCACAATACGGCGCAAATTTGGGACAATCTAGGTGAAGAGGGGGAAGC
```

Figure 2 continued

```
GTTTTTTGGCTTAATACCAGGTATAGCCATGGATAATAGCGAAATGGATATTTTGTTGCGGTAttgctattATTA
TTCTACCAAAAAAAgttcgaccTttgtgtccCTtttttttcccCTCg > SEQ ID NO:816  214584  214978_300876_1
atccagcagctgcctatcgctggtggcggcTCCCAGCCGATGGCATTGGCCTTGCTCGCATGGAGTTTGTCGTTA
GTAACGCTATCCAGGTGCATCCTATGGCTCTCGTCCATTTTGATCAACTCAAAGACGCGGATGCCAAGAAACGCA
TCGCCGAACTCACGGCGGGATATGAGCACAAGCCCAATTATTTTGTGGACAAGCTGTCGCGTGGCTTTGCAGCTC
TTTGCGCTGCCGTTTATCCAAAGCCCGCCATCATTCGATTGAGTGACTTTAAGACGAATGAGTATGCTGGCCTTA
TCGGCGGTGCTGAGTTTGAACCAGATGAGGAAAACCCCATGCTTGGCTTTCGCGGTGCGTCACGATACTATTCGC
CGCGCTACCAAGAGGGGTTTGCGCTCGAGTGTCGAGCCATCAAGCGTTTGCGCGAGGAGATTGGCCTCTCTAACG
CGATAGTCATGATTCCCTTCTGTCGTACAGTTAAAGAGGCACGAAAGGTTCTGGATGTCATGGCTCGCCACGGGC
TTAGACGAGGAGAGAATGgccTACAGGTATATGTCATGTGTGAAATCCCCTCGAATGTGATTTTGGCGGCAGATT
TCACCGAGTACTTTGATGGGTTTTCCATCGGCTCCAACGACCTGACACAATTGACACTTGGGGTCGACCGCGACT
CCGGCGAGCTGGGTGACTTGTTTGACGAGCAAGATGAGGCAGTCAAGTGGATGATTTCGCGAGTCATTTCCATAG
CGCGCGCGAGAGGCTGTAAGATTGGCATCTGTGGACAGGCTCCAAGCGACCACCCAGAGTTTGCCAGATTTCTCG
TTGACGCAGGCATTGATTCCATCTCCGTCAGCCCTGACAGCTTTTTAGCTGCAAAGAAGCAAGTTGTGGCCGCCG
AAAAGGCATTGGGAAAATCGCGCGGCTAATCTAATCAAATCTGGTCTATATTTGTAGTTGACTTTCACGAAAATC
AGGCTGAAATCTTTGAACAGAGAATCGTTTATATGGCCATATGGAAGTAGGTAATGGTGTTCGAAGTGTTGCAGA
TGGCAATGCGGTTTGGCTCATTCAACTGGATTCTGTTGAGAGTTGCGATGCACGCTATTATCTA > SEQ ID NO:817  214585  219641_300947_1
GCTGAGACAGCCCTGTTCAACCTGGCATCGCTATGCTACCATGTGCCCAAGGCGTTGATCTTGTTGGACTCGGAA
CATCCGTGATGCGTGGACTTGCATGGAACGTGCTTGGGCTAGAAGCGCTCTGGAATGTTTGGTCTGGAACGTTGC
ATGCAACCTATTGAGTTTTGCTGAAGCTTGATCTGCGCTCTCAACTGATGCTCCACATATATCGGCAGTCAGTAT
CCATGGACAATAAGGGCGGATGATCTGAAGATAAGCTCTTCATGCAGCTTTGAC > SEQ ID NO:818  214596  207625_300827_3
AGGGGAGAATAAAAGAAGCAGGCGGAAGGCGGGAAGATGGGGAACCAAGCGCCAGGGGGGACCATTGAGAAGAGC
AAGGATGAACCAGGGTCAAACTCTCATCCGCAAAAGTAAACATATATCGTACTACTCCTCCCTTCTCTCCTCCAC
CCAGACACCCAAGCCATTTGTACTCTTTCGTAGAAGAAAAGAAACGGAAAAAAGAACAAGTATCTATACATAAAA
AAC > SEQ ID NO:819  214596  218076_300914_1
TCTCGTACAAGAAAAGAAACGGAAAAAGGAACAAGTATCTATACATAAAAAACAACCCAGCACATCATATCCAAG
AAAGCAAAAAAGACACACAAGACAGCAAGCAACCATGGGCTCTCTCGTTTCCACAATGGGTTCCAAATCCTCAAA
GAGCTCAAAGGCCACCAACCCCGAGGGCGAGCCGCGGTACTGGTTCCGCGACAACTTCTTCCTCACAAACGACAA
GAAATATCTCGAGCCCCAGGCCGTCAACGCCGTCTTTGAATCAGACCTCATGTGGTGGAACGATCCGCTGCCGGA
GTCACAGATGCGCAAAATGCTGTCCAACTGCATGACAATGAGCATATACCACGTACCCGAGTCGGAGAAGCAGAT
GCAGAACAACGGAGCTCCGCGGAGACCATACGGCTCCAATGTAAAACTCGTCGGCCTCGCCCGTGTCGTAACCGA
CTACGTCACATTCGCCTACCTCACCGACGTCTTCATCATCGAGGAGTTCCAGCGCCGCGGCCTCGCCAGCTGGAT
GATGCAAGGCCTCAAGGAAATCGTCGAC > SEQ ID NO:820  214601  215125_300878_1
TCGGAGACTCATGCACAAGTACAACACCTATTTCCCCGACGACGCCACGAATGACACCCTAGTGGCCGAGAGGGA
GAGGCTCCTCAACGAGATGCTGGGCAAGATCGGCACGAACCCCTTCATCGAGACGCCCTTCAACGTCGACTATGG
GTGTAACACGTCGATTGGAGACAACTTTTATGCCAATTTCAATCTGGTGATTCTTGACTGCGGAATGGTCACAAT
CGGTAACCGCGTTCTGTTCGGCCCCAATGTGTCAATATTCGGTGCAACACACGAGACCGGAATCCAATCGCGCCG
CAGCGGAATCGAGTACGGCGGCAGCGTCACCATTGGGGATGATTGTTGGATCGGAGGCAACACCACGATCATGCC
GGGCTTGACGATTGGAAAGGGATGCACAATAGGAGCAGGCAGTGTCGTCACCAGATCGATCCCCGACTTTTCTAT
TGCGATTGGTTCACCAGCCAGGGTTGTCAAGAAAGTTGATCCAGTCCCAGATTTATGATGATTCGAAGCCGAAAA
AAAAAGAGAACTTGCATATATGATAGAGACGACATCTTAACGAGGCaaTGAATAtttccATTaaCAATAga > SEQ ID NO:821  214603  279617_200063_1
AAAGAAATCGACCTTGAAGATGAAAATACTGCTGTACCTCGATCAACTATTGATGACGAATATGCTAATGCAACT
GACAAAGATCCCAAAATTTTGCTTACCACTTCAAGAAATCCTAGTGCTCCTCTTACTCAGTTTGTCAAGGAATTG
AAAATTGTGTTCCCTAATGCTCAGCGGATGAACCGTGGTGGTCAGGTTATATCAGAAATAATTGAAACCTGCCGA
GCTCATGATTTTACAGATGTAATTTTGGTCCATGAGCATCGTGGTGTACCTGATGGTATTATCATTAGCCATCTT
CCGTTTGGTCCAACTGCTTACTTTGGATTGCTCAATGTGGTCACGAGACATGATATAAAGGACAAAAAATCTATT
GGAACCATGCCTGAGGCGTACCCACATCTTATTTTTGACAAATTTTCAACAAAGCTTGGTGAGAGGACAGTTAAC
```

Figure 2 continued

ATCCTAAGGCATTTGTTTCCAGTACCCAAGCCTGATACAAAACGTATTATCACATTTGCTAATCAGTCAGACTAC
ATTTCATTCAGACATCACATCTATGAAAAGCACGGAGGTCCAAAATCAATTGAGCTGAAAGAGGTTGGTCCTCGA
TTTGAACTAC

> SEQ ID NO:822   214604   209082_300811_1
ttattactacagatacccaagcaacagccaatgcctagtagaaaacactgtcatctttattcctcgttctcactc
acacgGCAGACTATTGTCTCAGCTGTTACTCCTCCTgcaGCCTCAATCGTTACCATCGCCAAAACCTGCCATTTT
CGCGGCTATGGGCTGGGGGGCCGCCTCGTTGGCCTCTGCATGGCAACAGGCTTTTCCGAGTGTGACCTTCCCACC
CTTGGAATGGCGCTGATAGCATTGCCGCATGCTGTCTGCTACTTCACAAATATACATGACATATCTATTGAACTG
CATGGACTCCAAGTTATCCATTATCCATCACACAAACGATTTGTTTACAGTATTGATGCTGTACATTAGCTCGTA
CAAGCCGAGCCAACAGCATAGACATACTGCAATATGACTCTGCATGCaGaAGTGCCTTAATTACGGAAACTCCGT
TGTTACATGCAGCCTTGCACATCCCACGCAgaTACTCAATCCCACGACTCAAAAACTGgAATACTGATACCCGTG
GCCTgctTGtACGCACAGATACAGAAGATGTCGAccCCTGgtcaagagtCTGatTCCACATCtgcgTACGATTAC
TTTGgCaaagatGgcattcTTTCTCTCTCTTCCAttTCctaaTTTCcaactgtagatCTATCTTctctcTTCTTC
TCTACATCTACTTa > SEQ ID NO:823   214604   216943_300903_1
AGCTGTTACTCCTCCTGCAGCCTCAATCGTTACCATCGCCAAAACCTGCCATTTTCGCGGCTATGGGCTGGGGGG
CCGCCTCGTTGGCCTCTGCATGGCAACAGGCTTTTCCGAGTGTGACCTTCCCACCCTTGGAATGGCGCTGATAGC
ATTGCCGCATGCTGTCTGCTACTTCACAAATATACATGACATATCTATTGAACTGCATGGACTCCAAGTTATCCA
TTATCCATCACACAAACGATTTGTTTACAGTATTGATGCTGTACATTAGCTCGTACAAGCCGAGCCAACAGCATA
GACATACTGCAATATGACTCTGCATGCAGAAGGTTTGACGAGTACCTGATCACATACAGGAGATATACTTTGTAC
ATCCTCCGAGACAGGGCACCGGGCTTACACCAAACTTGCAGTGCCTTAATTACGGAAACTCCGTTGTTACATGCA
GCCTTGCACATCCCACGCAGATACTCAATCCCACGACTCAAAAACTGGAATACTGATACCCGTGGCCTGCTTGTA
CGCACAGATACAGAAGATGTCGAccCCTGGTCAagagtCTGA > SEQ ID NO:824   214609   195734_300637_1
TCGACCGACGCTCGGCAACAATGGCGACAATTGCAAGCGGCTTGCGGCATGCGAGATGCGCAAGCTCGATTGCTG
CAGCTCAATGGCGGCCGGCAATCTTCCCGCGGTCGAACTTTCAACTCGCCATCCGGTCTATAACCAGCGACTCTC
AAAAGCCTCCCAGTCTTGAACTTGAAGCCGCCGAGTCCGTCCCGATCCCATACCAGGGCGTTACGCATGCGCGAG
TTGTTCCGGCGACACCATCTTATTTCTCAAGAGAACCCCAGTTCAACGATTTATACATTGGAATCTCCAAGCTGC
TCACCAAGTACAACCACCTGCCCACAGTGCCGCCAAGTGAGGCTCCGCAAATGCCATGGACAAAGCTGGAGGAGA
TGCGGGCGCAGATGGGAGAGCCCATCAAGTCATCACACTATGCGAAGGTCATGCGAGTGGCCAAGCGCTTGAACC
TCATCGAGCCCAGCCT > SEQ ID NO:825   214612   199986_300754_1
ACCTTAGCACTGTCACCTCAACCCGAATGTCGCCAATCCGATTAGACGCCCATGTAAACCCAGACCAGCATACGA
CACGGAGCAATACACCGCGAATCAAATATCCCATGTCGAAGCTACGCGACTTCTCGCCATACCAATGCCTATCTG
TATAGAGTGCCGGTATCCTGTCAAAACTCTGTGGACGCAATATTCTGGAGCTGATGATAAGTCCAATGGGCACTT
GATTCGCCTCACTGTCTGCCGAAAATGTGGCCATTTCTGTGATAAATATGTAGAGCACGACTTTGTTGTGCTCTT
TATCGATCTGGTTCTCATCAAACCCCAGGTCTGTCGCCATTTGCTGCACAACACTTTGATGCGGGATGGAGATCG
CTTCGACCCTTCTATCATTCGTTTGGGGTGTTGCTCCTGCTATTCGATGTCTACTTGACATGGCGCCGCATAGA
GAAACAAACCATTCCCTCGTCTGAGAGTAGATTAGGGCCGCTCGCGCAACAGCCGATTGTGATTCAGTACATGTT
CTTTCTGGTCCTATGCGCCTTATCCACAATCGCTTTCCATCTAAGCATCCGATTTTTTACATCATCCCACCTCTC
GCcGCTAAATAtCACAGGCCTGatg > SEQ ID NO:826   214613   108349_300381_1
CACACTCCAATTTCCAATTTCCAATTTCCCAATCTGCAATTTTCTCTTTCCCTTTCAACAAAGAAAAATCTCAGA
GAGAAAAATGGCGGATCAGCTCACCGACGATCAGATCTCTGAGTTCAAAGAAGCCTTTAGTCTCTTTGACAAGGA
CGGAGATGGTTGCATCACAACTAAGGAGCTTGGAACTGTAATGCGGTCATTGGGGCAGAACCCAACCGAGGCTGA
GCTTCAAGACATGATCAATGAAGTTGATGCTGATGGGAATGGACCATTGATTTCCCAGAGTTCCTTAACCTGAT
GGCTCGCAAGATGAAGGACACTGATTCCGAGGAGGAGCTAAAGGAAGCTTTCAGAGTGTTCGACAAGGATCAGAA
CGGATTCATCTCGGCAGCTGAGCTTCGTCATGTCATGACAAACCTAGGCGAGAAGCTTACAGATGAAGAGGTTGA
TGAAATGATCCGTGAAGCTGATGTGGACGGCGATGGGCAAATCAACTACGAGGAGTTTGTCAAGGTCATGATGGC
CAAGTGAGAACTGACGAATCCAACTTTTAATCTTTATTAGAAGTAAAAAATACGAAGAGAAGGAAACAGGGCAGA
TAAGTTTGTTGAGATTCTGTTTCAAATTAGGACATATTTACCTGTCTCAGTGCTTGCCTATTTTCCta

> SEQ ID NO:827   214613   109275_300044_1

Figure 2 continued cccggaaatgaatTGAAAAGACGATTATTTTGTCTGAAATTCCAGAACAATCTTCTCTCTTAAGTTTTCTCTGTT
GTTGAATTGAAGAAGAAAATGGCAGATCAGTTAACCGATGACCAGGTCTCTGAGTTCAAGGAGGCCTTCAGCCTA
TTCGATAAGGACGGAGATGGTTGCATCACGACTAAGGAGCTTGGGACTGTGATGAGGTCGCTCGGACAGAACCCC
ACCGAAGCAGAGCTCCAAGACATGATAAACGAGGTGGATGCAGATGGTAACGGAACCATTGACTTCCCTGAGTTT
CTAAACCTCATGGCCCGGAAAATGAAGGATACTGACTCCGAGGAGGAACTGAAGGAGGCGTTCAGAGTGTTCGAC
AAGGATCAAAATGGCTTCATCTCCGCTGCTGAGCTTCGTCATGTGATGACTAACCTTGGGGAGAAGCTTACTGAT
GAAGAAGTTGATGAGATGATTAGGGAAGCAGATGTCGATGGTGATGGTCAAATTAACTATGAGGAGTTTGTTAAG
GTCATGATGGCTAAGTAATTTCACCATCTCTTATTGAAGTTGAAGTTTAGACTTGTTAAAAATGTGAAAATTCCA
AAAATATTTCATTGGATAGGATTTGCCTAGTGTAATGTGTTCCGTTGTACCATCTTGGATGTATTGGACCTGGAA
TGAATGTAATgcTTTAtTGt > SEQ ID NO:828 214613 270642_200127_1
ATAGGGTTCTTTGAAATCGTGAAAAGAGAGAGAGAGAGAGAAATGGCAGAGCAGCTAACGGAGGAGCAGATCGCT
GAGTTCAAGGAGGCCTTTAGCCTTTTCGACAAGGACGGCGATGGCTGTATTACTACCAAGGAATTGGGAACAGTG
ATGAGATCACTTGGTCAGAATCCCACTGAAGCTGAACTACAGGATATGATCAGCGAGGTTGATGCTGATCAGAAT
GGAACCATTGATTTTCCAGAGTTCTTGAATCTGATGGCACGTAAGATGAAGGACACTGATTCTGAGGAAGAACTC
AAAGAAGCTTTCAAGGTTTTCGATAAAGATCAGAATGGCTTTATTTCTGCAGCTGAGCTTCGTCATGTAATGACA
AACCTTGGAGAGAAGCTGACTGATGAAGAGGTTGATGAGATGATCCGAGAAGCAGATATTGATGGCGATGGGCAA
GTTAATTACGAGGAGTTTGTCCGCATGATGCTTGCCAAGTGACTTTAGATTCTCGTGTATTTTGCGACGGCCACT
TAGTTACCTATAACTTCTAGCTGTCAGTTTATATTCTGTGTTGCTGTTAAGACAAACAAATGTGCCCTATGCTTT
TACTAGTATCTAGACTCCTTTCAGTTTATATG > SEQ ID NO:829 214613 254553_301633_1
CCTCAGGCGATACTGCTTCTGCTCATCTTCTCTCCTTCAATATCTCGTCCTTGGCAGTAGCGCGAATCGAACAGC
GGTGGAATGGCGGAGCAGCTGAGCCCTGAGCAAATCGCTGAGTTCAAAGAGGCCTTTAGCCTCTTCGACAGAGAT
GGAGATGGCTGTATTACAACTCGGGAGCTGGGGGTAGTGATGCGGTCGTTGGGTCAGAACCCAACGGAATCAGAG
CTTGTAGACATGATTAACGAAGTTGATGCTGATGGCAATGGGACCATCGATTTTGCGGAGTTTCTCAACTTGATG
GCCCGCAAGATGAAGGATACTGACTCTGAGGAGGAATTGAGGGAGGCTTTCAAAGTTTTCGATAAGGACCAGAAT
GGCTTTATCTCCGCTTCCGAGCTGCGCCATGTGATGATAAACCTTGGCGAAAAGCTGACTGACGAAGAAGTGAAA
GAGATGATTCGGAGGCTGATACGGACGGGGATGGCCAAGTCAACTACGAGGAGTTTGTGAAGATGATGCTCTCT
AAGTGAGTCGGGAAAGTAAAAGTCAAAAGCGAAAAGTGAAAAGTAAAAAGTAAAAAAATTGGTATGAATTGGGTT
TGGTTATGCATGTCTCTACTGGATTCTCACGGTGTATAAATTT > SEQ ID NO:830 214613 254332_301632_1
GCCACGCGTCCGCCACGCGTCCGCTTCTCTCTCTCTCTCTCTCTCTCTCACTCTGTCCAGCTCCTCCTCCTCC
TCAGCAATGGCAGACCAGCTGACAGAGGAGCAAATCGCAGAGTTCAAGGAAGCCTTCAGCCTCTTTGATAAGGAT
GGAGATGGTTGCATCACAACGAAAGAGCTGGGTACCGTCATGCGTTCCTTAGGGCAAAATCCAACTGAAGCAGAG
CTTCGAGACATGATCAATGAGGTTGATGCTGATGGAAACGGAACAATTGATTTTCCGGAATTCCTGAATTTGATG
GCCCGTAAAATGAAGGACACGGACTCTGAAGAGGAGCTGAAGGAGCATTCAAGGTCTTTGATAAGGATCAAAAT
GGCTATATTTCTGCCGCCGAGTTGCGTCACGTGATGACTAATTTGGGAGAGAAGTTGACGGATGAGGAGGTCGAT
GAGATGATTCGTGAAGCGGACATTGATGGGGACGGCCAGGTTAACTATGAGGAGTTTGTCAGAATGATGCTTGCA
AAATAAAATCCCCCATTCCTTGCACTCAATCTAACACAAATAGGTTGCTAATTTGCTTTTTGGGATAGGTTGTAT
TAAGCTTGCACTCCCTAAGGAATG > SEQ ID NO:831 214613 248465_301583_1
gaaagccctaaatcgatccatcgatccaccgGGCATTTCGTCAAAGAGGAGATGGCTGATCAGCTGACCGAGGAC
CAGATCGCCGAGTTCAAGGAGGCGTTTAGCCTGTTCGACAAGGATGGAGACGGCTGTATCACAACTAAGGAGTTG
GGAACGGTGATGCGATCGCTTGGACAAAACCCGACCGAGGCGGAGCTCCAGGACATGATCAACGAGGTGGACGCC
GACGGCAATGGGACCATCGACTTCCCCGAGTTCCTCAACTTGATGGCGCGCAAGATGAAGGACACTGACTCGGAG
GAGGAGCTCAAGGAGGCGTTCCGCGTCTTCGACAAGGACCAGAACGGCTTCATCTCGGCTGCCGAGCTCCGCCAT
GTAATGACCAACCTCGGCGAGAAGCTCACGGACGACGAGGTGGACGAGATGATCCGCGAGGCTGATGTGGACGGG
GACGGGCAGATCAACTATGAGGAGTTCGTCAAGATGATGCTAGCTAAGTAGTAGAAGATCTGTTTCCTTTTTCTC
TACTTTGTTCCTCGCCTTTCCTCTCTCTGTCTTTTCTCTTTCCTTTTTgTTttggTAAAGTCCTTCTTCCATGTt
agGATGATGATTCCACCAcgtctaaaacctTTtaaatT > SEQ ID NO:832 214613 226347_300996_1
AAAAATATTACAAATGTCGCAAAACTCCAAATCTTTCAAGGACGCCTTTTCCCTGTTCGACAAGAAGGGCACCGG
CAAGATTCCTGCTGAAGCTCTCGGTGATCTTCTCAGAGCTGTGGGCCAGAACCCCACCCTCGCTGAGATTGATGA
TCTGAAGCAGACCATTCCCGCTGAGTTCGACTACGAGACCTTCTCCAAGATCGTCAACCGACCAAGCGGTTTCAA

Figure 2 continued

GTCTCTCGGTGAGCCCGAGGATTACATCCGGGGATTCCAGGTGTTCGACAAGGACTCCACTGGGTTCGTGGGTGT
CGGCGAGATGCGATACATCCTTACCTCGCTGGGCGAGAAGATGTCTGATTCCGAGGTTGATGAGCTCCTTAAGGG
AGTCAACGTTACTCGAGACGGCAACGTCAACTACGTTGACTTCGTCAAGTCCATTCTGGCCCAGTAGATACCTAA
TATATTTTTTATGTTTGAGC

> SEQ ID NO:833 214613 225436_301049_1
GCTCCATCGATCCATCCACCGATCGATCGAGCTCTACATCCTGCGCAAGAACACACGATGGTAGAGGAGCTCACC
GAGGAGCAGATTGCAGAGTTTAAGGAGGCATTCAGCCTCTTCGACAAGGACGGCGATGGCTGCATTACCACCAAA
GAGCTCGGAACGGTGATGCGATCGCTGGGACAGAACCCGACGGAGGCAGAGCTCCAAGACATGATCAATGAGATC
GATGCCGACGGCAGCGGCACGGTCGATTTCCCAGAGTTCTTAAACCTCATGGCCAGGAAGATGAAAGACACCGAC
TCCGAGGAAGAGCTCAAGGAGGCGTTCCGAGTCTTCGACAAGGAACAGAACGGCTTCATCTCCGCGGCGGAGCTG
CGGCACGTCATGACCAACCTCGGCGAGAAGCTCACCGACGACGAGGTTGACGAGATGATCCGCGAGGCAAACGTC
GACGGCGATGGACAGATCAACTACGAAGACTTTGTAAAGATGATGATGTCCAAGTGATCCAGGGAAGTCGCCATT
GATTGCTCTGCTCGCTCTATAGATCAAGGGAATGCGACCACGATGTATTGCTCTGTCTCTATTGTGCAATTCCTT
GCCACCTCTGTCTTGTATGGAATA

> SEQ ID NO:834 214613 201036_300712_1
GTCTCTCCTCCTCCCATCTCCGCTTCCCTTCTTCTTCTTCTTCGTTGATCCACTCACCCGCCGCGCGCAGAGGAG
GCCATGGCGGATCAGCTCACCGACGACCAGATCGCCGAGTTCAAGGAGGCCTTCAGCCTCTTCGACAAGGACGGC
GATGGTTGCATCACAACCAAGGAGTTGGGAACTGTCATGCGTTCACTAGGGCAGAACCCAACGGAAGCTGAGCTC
CAGGACATGATCAACGAGGTTGATGCTGATGGCAATGGAACCATTGATTTTCCTGAGTTTCTCAATCTGATGGCT
CGCAAGATGAAGGACACTGATTCAGAGGAAGAACTCAAGGAGGCCTTCCGGGTGTTTGACAAGGACCAAAATGGC
TTCATCTCCGCTGCTGAGCTCCGCCATGTGATGACAAATCTTGGCGAGAAGCTAACTGACGAGGAGGTGGATGAG
ATGATCCGTGAGGCTGATGTTGATGGTGATGGTCAGATAAACTATGAGGAGTTTGTGAAGgTCATGATGGCcAAG
TGAGCCATGGAACCATACTCTAAGgCaGAGGAGATTGTGTGTTGCATAGTCCTAGTTaAGATGcaaCACTTGTTT
TATCAATTtccagtgaagcaTccTACTAGCT > SEQ ID NO:835 214613 190460_300818_1
CACAGCCCGCGCACCTCCACACCATTAGCCATCAACGACCAGCATCTCGGCTTTGCTCGCCTTCTCGAAGCTTCT
GCTGCCATGGCGGACCAGCTCTCCGAAGAGCAGATTGTAGAGTTCAGGGAGGCCTTCAGCCTCTTCGACAAGGAC
GGCGACGGTTCTATCACCACCAAGGAGCTAGGAACCGTGATGCGAAGTCTGGGGCAGAACCCAACAGAGGCGGAG
CTGCAGGACATGATCAGCGAGGTGGACGCGGACAGCAACGGCAACATCGAATTCAAGGAGTTCCTGGGCCTGATG
GCGCGCAAGCTGAGGGACAAGGACTCCGAGGAGGAGCTGAAGGAGGCGTTCCGCGTCTTCGACAAGGACCAGAAC
GGGTTCATCTCCGCCGCCGAGCTCCGCCACGTGATGGCCAACATCGGGGAGCGGCTCACCGACGAGGAGGTCGGC
GAGATGATCAGCGAGGCCGACGTCGACGGCGACGGGCAGATCAACTACGAGGAGTTCGTCAAGTGCATGATGGCC
A > SEQ ID NO:836 214613 282850_200090_1
CCTTATTTCAAATTTCCAGTAAAATAATCGAAAGAGATTATGGCGGATCAGCTGACTGACGATCAGATCTCTGAG
TTTAAAGAAGCCTTTAGCCTCTTCGACAAGGACGGCGATGGTTGCATCACTACGAAGGAGCTTGGAACCGTGATG
CGGTCACTGGGGCAGAACCCAACCGAGGCTGAGCTTCAAGACATGATCAACGAAGTTGATGCTGATGGGAATGGG
ACCATTGACTTTCCTGAGTTCCTTAACCTGATGGCTCGCAAGATGAAGGACACTGATTCCGAGGAGGAGCTCAAG
GAAGCTTTTAGAGTGTTTGACAAGGATCAGAATGGATTTATCTCTGCAGCTGAGCTTCGCCATGTCATGACAAAC
CTAGGTGAGAAGCTTACAGACGAAGAGGTTGATGAGATGATTCGTGAAGCTGACGTGGATGGCAATGGGCAGATC
AACTATGAGGAATTCGTCAAGGTCATGATGGCCAAGTGAGAATCCAACTTAATCTTTAAAATTAAAGTACAACAA
AAAGGAACGGCGGATAAGTCTGATGAGGTTTCTATTTCTGGttAGGATGTCTTCTTTGGCttattaGc > SEQ ID NO:837 214613 157582_301740_1
TTCAAACTTCAAAGACCAATCTTTTTGTTTCTCCCTTTACGTTCTCTGAATTCCAGAAGCTTCTTCTCCCTCTCT
CAATGGCGGATCAGCTGACCGATGATCAGATCTCTGAGTTTAAGGAGGCTTTCAGCCTATTCGACAAGGACGGCG
ATGGTTGCATTACAACTAAGGAGCTTGGGACTGTGATGAGGTCATTGGGACAGAACCCAACTGAAGCTGAGCTCC
AGGACATGATAAATGAAGTGGATGCTGATGGTAATGGAACCATTGACTTCCCAGAGTTTTTGAACCTCATGGCCA
GGAAGATGAAGGATACAGACTCGGAGGAGGAGCTGAAGGAGCATTCAGAGTTTTTGACAAGGACCAGAATGGTT
TCATTTCTGCTGCTGAGCTCCGTCATGTGATGACCAACCTTGGTGAGAAGCTTACTGATGAAGAAGTTGATGAAA
TGATTAGGGAGGCCGATGTCGATGGTGATGGACAAATTAACTATGATGAGTTTGTTAAGGTCATGATGGCCAAGT
GATTTCCCTCTTCTGCAGTTTACCTTTTTTACACTGAAGAAAGACCAAACATTCATCAGACTGGGTCAGC

> SEQ ID NO:838 214613 147736_301255_1

Figure 2 continued

GCAGATCAGCTCACAGATGATCAGATCTCTGAATTCAAAGAAGCTTTCAGCCTTTTCGATAAGGATGGAGATGGT
TGCATCACCACTAAGGAGCTTGGGACAGTGATGCGGTCATTGGGACAAAATCCAACTGAGGCTGAGCTTCAAGAC
ATGATCAATGAAGTAGATGCTGATGGAAATGGAACCATCGACTTTCCCGAGTTCCTTAACTTGATGGCTCGCAAG
ATGAAAGACACTGATTCTGAGGAGGAGCTCAAGGAAGCTTTCAGAGTGTTCGACAAGGATCAGAATGGATTTATT
TCTGCAGCCGAGCTGCGACATGTCATGACAAACCTAGGCGAGAAGCTTACTGATGAAGAAGTTGATGAGATGATT
CGTGAAGCTGACGTGGATGGTGATGGCCATATCAACTATGAGGAGTTCGTCAAAGTCATGATGGCCAAGTGAGAA
CTGATCAACTTGACTTAATTCTTAGTAGTAAAAAATTACAAAAAAAGaagcTGGCAACGGAGCagaTAAATtgga
TGAGATCTCTATATTtg > SEQ ID NO:839 214613    142414_300435_1
ctctccgggacggtctcGTCTTCCCCACCCCTCGCCTCCTCGCGCGCTCGGTGAGAGAAGCGAAGAAGAAGAAGA
AGAGGAGGAGGAAGAAGCCAGGCTAAGCCCAGCGGCATGGCGGACCAGCTCACCGACGACCAGATCGCCGAGTTC
AAGGAGGCCTTCAGCCTCTTCGACAAGGACGGCGATGGTTGCATCACAACCAAGGAGCTGGGAACCGTGATGCGT
TCGCTGGGGCAGAACCCAACGGAGGCCGAGCTCCAGGACATGATCAACGAGGTCGACGCGGACGGCAACGGCACC
ATCGACTTCCCGGAGTTCCTCAACCTGATGGCACGCAAGATGAAGGACACCGACTCGGAGGAGGAGCTCAAGGAG
GCGTTCAGGGTGTTCGACAAAGACCAGAACGGCTTCATCTCCGCCGCCGAGCTCCGCCACGTCATGACCAACCTC
GGCGAGAAGCTGACCGACGAGGAGGTCGACGAGATGATCCGCGAAGCCGACGTCGACGGTGACGGCCAGATCAAC
TACGAGGAGTTCGTCAAGGTCATGATGGCCAAGGCGGCCGCTTATCCGTATGATGttCCGGATTATGCCGAGCTC
TACAAACAgctGtTGAATTTTGATTTGCTGAagttgGCGGGtGaCGTggAATCTAaccCTggtcctaggtctaga
aTGgCTActttctcTTGTGTGTGttGTggtaccTtaactac > SEQ ID NO:840 214623    220615_300937_1
GCGCGATTGTGAATTCGCGAGCGAATGAAACTCGTCGCATGCTTTGGATCCTGCTTCCGACAAGCTCCCACGACT
TGGCTTGGATAAACCTCTAACCTCCATTTTGGAATCGAGTGTCCTCCATGGCTCGAGAATAAGTCACATATTCAA
TCAACAGTATACATAGTTGTAATCGATACACCAATTTCTACTGGAAACGAGGTTTCCATGGGCTTCATCGAACTT
CTCTTGGAGAAATTCTCCATCACGAGGTTCTTCCTCATCATGGCTGGCGTCTGGACAGCTGTATTCATCGTCGGC
CGCATACGAGAACACCAGAAAATCAAGAGCCTCGGCAGCTACGGCCCTTCTCTAAAGCCTCTTCTTCCATTTGGA
CTGGATTTTATCTACCACGGAGCTCGTGCCACATTCCGCCAACAGACCTTTGCGCTATGGAGGGACGTCCTCTTC
TCCCAATTCTGGACCGTCGAGATGCGCGTCCTCAACGAACGAGTCTGCTTCACCGCTGACCCCGAGAACATCAAC
GCCGTGC > SEQ ID NO:841 214626    107406_300264_1
cggacgcgtgggCTACACCTCACCTTTCTCTCTCTATAGACCaAACCTAACCTCACCATGTCTTCTCGGAGGCTT
CTAGCCTCTCTCCTCCGATCAACCGCCCAACGCGGTGGCGCTATTTCCAGATCGCCATTAGCAAATTCCATTCCC
AGAACTACTTCACGCGCCTCACCGAAAGGATTCCTCTTAAACCGTGCCGTTAAGTACGCTACCTCAGCTGCTGCT
GAAAAGCCGAAGGCGACTCCTCCTAAACCTTCCGGTAATGAACCTACTGGAAAAATCACCGATGAATTCACCGGC
GCGGGTTCGATCGGGAAAGTGTGTCAGGTTATTGGTGCCGTCGTAGATGTGAGATTCGACGAAGGTTTGCCTCCG
ATCCTTACAGCGCTTGAGGTTTTGGATAACCAGATCCGGCTTGTGCTTGAGGTTGCTCAGCATTTGGGTGAGAAT
ATGGTTAGGACTATTGCTATGGATGGTACTGAAGGTCTTGTTCGTGGTCAACGCGTCCTCAATACTGGTTCTCCT
ATCACTGTCCCTGTTGGTAGGGCCACCCTCGGTCGTATTATTAATGTCATTGGAGAGCCTATTGATGAGAGAGGC
GACATTAACACCGATCACTTTTTGCCAATTCACCGTGAAGCTCCTGCCTTTGTTAACAGGCAACTGAACAACAA
ATTCTCGTTACTGGTATTAaggttgttGATCTTCTTGCCCCTTACCAaAggGGAGGAAaGATTGGCTTTTTGGT
GGTGCCggggttgggaagactgtgctTATTATGgaaCTGAttaaCaat > SEQ ID NO:842 214626    120665_300428_1
caaaccctcccccatggcttctcggaggcttctcgcctctttgctccttcaatcggctcaacgtggcggcggtcc
aatttCCCGATCATTAGGAAACTCCATCCCAAAATCCGCTTCACGCGCCTATTCACGCGCATCCCCTAAGGGATT
CCTCTTAAACCGCGCCGTACAGTATGCTACATCCGCAGCAGCACCGGCATCTCAGCCATCAACACCACCCAAGTC
CGGCAGTGGACCGTCCGGAAAAATTACCGATGAGTTCACCGGCGCTGGCTCGATCGGGAAGGTGTGCCAGGTCAT
CGGTGCCGTCGTGGATGTGAGGTTCGATGAAGGTTTGCCACCAATTTTGACCGCTCTCGAAGTGTTGGATAATCA
GATCCGGCTTGTGCTTGAAGTGGCTCAGCATTTGGGTGAGAATATGgttCGGACTATTGCTATGGATGGTACCGA
AGGACTTGTTCGTGGTCAACGTGTCCTCAATACTggttCTCCTATCACGgttCCTgtcggTAGAGCCACACTTGG
CCgtaTCATCAAtgtcATTGGagaGGCAATTGATGAGAGAGGCCCAATTACTACCGATCACTTTTTGCCAATTCA
TCGTGAAGCTCCTGCCTTTGTCGAGCAAGCCACTGAACAACAAATTCTTGTCACTGGTATTAAGGTTGTTGATCT
TCTTGCTCCATAcctatttgaGGAAAAATTGGGCTTTTTGGTGGTGCTGGTGTGGGGAAAACTGTGCTTATTAT
GGAACTGATTAACAATGTTGCAAAAGCTCATGGTGGTTTCTCTGTCTTTGCTGGTGTTGGTGAACGCACTCGCGA
GGGTAATGATTTGTACCGAGAAATGATTGAAAGTGGTGTCATCAAGCTAGGCGAGAAGCAAAGTGAAAGCAAGTG
TGCTCTTGTATATGGTCAAATGAATGAGCCCCCTGGTGCTCGTGCACGTGTTGGACTTACAGGTTTGACCGTGGC
TGAGCACTTCCGAGATGCCGAGGGGCAGGATGTGCTTCTCTTTATTGACAATATTTTCAGGTTTACTCAGgctaa

Figure 2 continued

CTCAGAAGTGTCTGCTTTGCttggTCGTATCCCATCTGCTGTCGgttATCAACCAACtTTGgCtacggATCttgg
AggTCttCaagaacGTatcaccACCACCA > SEQ ID NO:843 214626 204482_300817_1
GCTGATTGCTCTCTGTCATCTGCCAAGATGTTCAAGAGCGGCGTTTCGTCCCTCGCAAGGGCTGCCCGCCCATCA
ATTGCCGCTCGACGAGCTATCCGACCAGCCTTCCCCCGATCCCCCATCGTCAGGCTTGCAAGCACTCAGAGCGTT
GGAGATGGCAAGATCCACCAGGTCATTGGTGCCGTCGTCGACGTCAAGTTCGACACTGCCAAGCTGCCTCCTATC
CTGAACGCCCTGGAGACCACCAACAACAACCAGAAGCTGGTCCTTGAGGTCGCTCAACACTTGGGCGAGAATGTC
GTTCGCTGCATTGCCATGGACGGTACTGAGGGTCTTGTTCGTGGTGCCAAGGCTTCCGACACTGGTGCTCCCATC
ACCATTCCCGTCGGCCCCGCCACTCTCGGTCGTATCCTGAACGTCACTGGTGACCCCATTGATGAGCGTGGACCT
GTCAAGACCGACAAGTTCCTGCCTATCCACGCTGATCCCCCTCTTTCACTGACCAGTCCACCTCTGCCGAGATT
CTGGTTACTGGTATCAAGGTCGTCGATCTGCTCGCTCCCTACGCTCGTGGTGGAAAGATTGGTCTCTTCGGTGGT
GCTGGTGTCGGCAAGACCGtCTTCATtcaggaGCTGATCAACAACATCGCcaa > SEQ ID NO:844 214626 188259_300689_1
gaaaaaaaagtctaaccctagatccaggcccgcgtctccgGCGATCTCCCGGCCATGGCGACTCGCCGGGCCCT
CTCCTCCCTCGTCCGCGCCGCCTCCAGGCTCCGCGGGGCCTCGCCCGCCCCGCGCCCGCGCGGGCCGCTCCACCG
ACCGTCGCCATCGGGGTACCTCTTCAACCGCGCCGCCGCGTACGCCACGGCCGCCGCGGCGAAGGAGGCGGCGCC
TCCCGCGCCCGCGACGGGGAAGGCCACGGGTGGAGGTAAGATCACCGACGAGTTCACCGGCGCCGGCGCCGTCGG
GCAGGTGTGCCAGGTCATCGGCGCCGTCGTCGACGTGCGGTTTGACGAGGGGTTGCCTCCCATCCTCACGGCGCT
CGAGGTGCTCGACCACAACATCCGCCTCGTGCTCGAGGTGGCGCAGCACCTTGGCGAGAACATGGTGCGCACAAT
CGCTATGGACGGGACTGAGGGGCTTGTCCGCGGTCAGCGCGTCCTCAACACCGGCTCCCCAATCACTGTTCCTGT
TGGCagGGCCACGCTTGGACGTATCATGAATGTTATTGGTGAGCCAATTGATGAGAAGGGTGACATAACAACGAA
CCACTTCCTTCCCATCCATC > SEQ ID NO:845 214626 3454_300333_1
CCCACGCGTCCGGAGGGTCTTGTCCGTGGAAGGAAGGTTCTCAACACTGGTGCTCCAATCACTGTACCTGTTGGA
AGAGCTACCCTTGGCCGTATCATGAATGTGCTTGGAGAACCCATTGACGAGAGAGGCGAAATCAAGACCGAGCAT
TACTTACCTATTCACAGAGATGCTCCGGCTTTGGTTGATCTAGCCACTGGGCAAGAGATCCTGGCCACTGGTATT
AAGGTTGTTGATCTTCTTGCTCCTTACCAAAGAGGAGGAAAGATTGGTCTCTTTGGCGGTGCTGGTGTTGGGAAA
ACTGTGCTTATTATGGAGCTGATC > SEQ ID NO:846 214626 241345_301347_1
tgctatggcgtcgaggcgggcgctgggacagctcctccgcgcggcatcgcggacatcttcgtcttctaccaggca
agcctTCCCGGCGGAATTCTCCCGGCATCGCGGCGGGCATCTAGGGATCCCCTGGGCGACGGCCATGCCCTTGC
CGGGATCAGGAGCTTCGCCACTGCCGCTGCCGCGAAGCCGCAGACGGATACCTTGGGCTACATTTCCCAGGTGAT
TGGAGCCGTGGTGGATGTCAAGTTCGACAAGGATCTGCCCAACATTCTAAACGCTCTCGAGGTCCAAGACCATTC
CTTCCGGGTCGTGCTCGAGGTGGCGCAGCATCTGGGCGACATGACCGTCAGGACCATCGCCATGGACACCACCGA
TGGCCTTGTGAGGGGGCAGAAGGTCTTGAACACTGGGGCTCCAATCACTATTCCTGTTGGGAGGTGCACCTTGGG
CCGGATCATGAACGTCATTGGAGAGCCCATCGATGAGCTTGGGGATTTTGtcACCGATCATTTCCTGccGATCCA
TAGGGAAGCTCCGGTTTTCACAGAGCAGTCCACTGAACAGGAGGTTCt > SEQ ID NO:847 214632 216057_300887_1
gattcaatatctTTCTCTCGACGTGGTTCGATTTCGATTCGACGTATCGGTGGGGGGCATGAATAAGGTAATGG
TTGTGTTTAGTTGGGCTCGAAACTAATGTTACCCATCAGTAGTATCACCTATTGCTGACGTCGGCTTGAGGAAGT
GGGTTCAATCGTGATACATTCGGCTCGTACAGTGCAATACAGATAAGATGATGCGATCAGAGAGGCAATTGTTAG
GTCATGATTGACGGAGGATTCGAGCCGATGATGACAAGGCGACAAGAGCTGGGCAATCGACCCCAATTGGATGAT
TCTGGCACCCCAAGCTGTGAATTCGGCTTGACCTTTGAACATCAACTTGCTGTAGGGTAGTGCAACCTTGGACGT
AAAGAGAAGGCAGCGTCAGCATTTGTTAGCGCACAGTACCTACCTGTATGTATGTATGTCCGTCCATACAACTTT
GATGAGACCGAGAcCGAGATAAAAAGTGagCGgcgTCAGTGCCCAACTTGGTATAAAGGCtTgaagAac > SEQ ID NO:848 214633 128866_300478_1
CCCGATCCCTAGCCACTTTACTCCTATTCGCCTCCACCACCTTTTCATTTCCTATCTCCTCCTCTTTTCTCTTCT
GCTCAGTTCCTCTCTTTCACATACACACTCACAAAAAAAATTCGATTATGGCCGGAAGCGGTGTGGTAACACTTT
ACGGAAATGGTGCACTCACCGAGACTACAAAGCAATCCCCTTTCTCAGTGAAAGTGGGTCTCGCTCAGATGCTTC
GCGGCGGCGTTATCATGGACGTCGTCAATCCCGAGCAGGCCCGTATAGCCGAGGAGGCAGGCGCGTGTGCCGTCA
TGGCCCTTGAGCGCGTCCCCGCTGATATACGCGCTCAGGGCGGCGTAGCCCGCATGTCGGATCCCCAGCTTATCA
AAGAAATCAAACAGGCTGTTACCATCCCCGTTATGGCCAAGGCCCGTATCGGTCACTTCGTCGAGGCCCAAATCC
TCGAGGCTATCGGAATCGATTACGTGGATGAATCAGAAGTCCTCACTCTCGCCGACGATGAGAACCACATCAACA

Figure 2 continued

AGCACAATTTCCGCATTCCTTTTGTCTGTGGCTGCCGTAACCTCGGCGAAGCCCTCCGCCGTATCAGGGAGGGAG
CCGCCATGATACGCACCAAGGGGGAAGCCGGTACCGGCAACATCATCG

> SEQ ID NO:849  214633   55801_300130_1
CTCTTGAACGTGTTCCCGCCGATATTCGAGCTCAAGGCGGTGTTGCTCGAATGAGCGATCCAGAGATGATCAAAG
AAATCAAAAACGCCGTGACGATTCCGGTGATGGCGAAAGCTAGAATTGGTCATTTCGTTGAAGCTCAGATCCTGG
AAGCAATCGGAGTTGATTACGTCGACGAGAGTGAAGTTCTCACTCTCGCCGACGAAGATAATCACATCAACAAAC
ATAATTTCAAAATCCCTTTTGTTTGTCGATGTAGGAATCTCGGTGAAGC

> SEQ ID NO:850  214633  156281_301364_1
GCGAAGCTTTGTCGTTTTTGATAAATTGTCACCCAATTTGGTTCAGGCATTTTCATCAACACCTTGCAAATGGAA
GAAGACAGTGCCGTTACAGTGTACAGTGGCAGCGCAATTACCGACACCAAGAAGAATCCGTTCTCAATCAAAGTC
GGGCTGGCCCAAATGCTCCGTGGAGGAGCCATTGCTGAGGTCACCACCGTCGACCAAGCGAAGATCGCCGAATCC
GCCGGCGCCTGCTGCCTCGTAGTATCGGAACCTAAAGGACCCGGAATCTCGCGCATGGCCGACCCATCTGTAATC
AAAGCGATCAAACAGGCCGTCTCAATTCCCGTAATGGCAAAAGCCCGAGTCGGGCATTTTCTGGAAGCCCAGATC
CTTGAAGCTATTGGAGCAGACTATGTAGACGAGAGCGAGGTTTTAGCCTTAGCCGACGAAGATCATTTCATCAAC
AAACACAATTTCCGTGCCCCATTCGTCTGTGGGTGTCGAGATCTCGGAGAAGCATTAAGAAGAGTCCGTGAAGGT
GCTGCGATGATTAGGACCCAAGGAGATCTATTAGGTACAGGTAATATTGTGGACACAGTTCGCAATGTGAGGAAA
GTGATGGGAGATATTAGAGTTCTATCAAACATGGACGAAGATGAGGTTTTCACTTTTTCAAAAAAGATCTCCGCG
CCTTATGATATCGTTGCGCAAACGAAGCAGATGGGTAG

> SEQ ID NO:851  214633  223816_300976_1
ACAACACACACACAACACAATGTCTACCGTCGAGAAGTCTTTTGAGGAGCAGTTCAAGCTGCAGGCCGGTCTGGC
CCAGATGCTCAAGGGTGGCGTCATCATGGACGTTGTCAACGCCGAGCAGGCCAAGATTGCCCAGGAGGCCGGAGC
CGTGGCCGTTATGGCCCTTGAGAAGATCCCCGCCGACATTCGAGCCGACGGAGGAGTCGCCCGAATGTCCGACCC
CGCTATGATCAAGGAGATCATGGCTGCCGTGTCCATCCCCGTTATGGCCAAGTGCCGAATCGGTCACTTTGTCGA
GGCCCAGATCATTGAGGAGATTGGTGTCGACTACATTGACGAGTCTGAGGTTCTGACCCCCGCTGACCAGTTCCA
CCACATCAACAAGCGAGACTTCAAGGTCCCCTTCGTTTGCGGTGCCAAGAACCTGGGTGAGGCTCTCCGACGAAT
CCACGAGGGAGCTGCCTTCATCCGAACCAAGGGTGAGGCCGGTACTGGTGATGTCACCGAGGCCGTCAAGCACAT
GCGAACCATCCAGTCCGAGATCAACAAGACCCGACACATGTCTGAGATTGAGCTCTACACCTACGCCAAGGAGAT
TGGTG

> SEQ ID NO:852  214633  219564_300946_1
ctcaaaTAAACCACTCAATCGATTCCTTGATACCCCTTGGGACAAAtCTACTTGTTCTCTCCAAACTTACCCCTC
CAAATACCATCATCACCATCACCATGACCAACGACGTCTCTACCAACGGCTCTTCTGCCGCTCCTGCGACCACCT
TTGCCCTCAAGGCTGGTCTCGCCCAGATGCTCAAGGGCGGCGTCATCATGGACGTCACCAACGCCGAGCAGGCCC
GCATCGCCGAAGAAGCTGGTGCCTGCGCCGTCATGGCCCTCGAGCGAGTTCCCGCCGATATCCGCAAGGACGGCG
GCGTCGCCCGCATGTCCGACCCGGCTATGATCAAGGAGATCCAGGACGCCGTCACCATCCCCGTCATGGCAAAGG
CCCGTATCGGCCACTTCGTCGAGTGCCAGATCCTCGAGGCTCTTGGTGTCGACTACATTGACGAGTCCGAGGTCC
TGACGCCCGCCGACGACGAGAGCCACGTCGAGAAGAGCCCCTTTGGCGTGCCCTTTGTCTGCGGCTGCCGCAACC
TGGGCGAGGCCCTGCGCCGTATTGCCGAGGGCGCTGCCATGATCCGAACAAAGGGCGAGGCCGGCACCGGTGACG
TTGTCGAGGCCGTCCGCCACATGAAGACTGTCAACAGGGACATTGCGCAGGCCAAGGCTGCTCTTGCCGAGGGCG
GTATTGTTCGTCTCCGCGAGcTTGctCGTAAG > SEQ ID NO:853  214633  181207_300695_1
GAATTCAAGCAGGTGCTTGTGCTGTCATGGCATTAGAACGTGTACCAGCAGATATTCGTGCTCAAGGTGGTGTTG
CTCGTATGAGTGATCCACAGATGATTAAAGAAATCAAACAGGCTGTTACTATTCCTGTCATGGCTAAAGCTCGGA
TTGGTCATTTTGTTGAAGCTCAGATTCTCGAAGCAATTGGTGTTGATTATATCGATGAGAGTGAGGTTTTGACCC
TTGCTGATGAAGAACATCATATTAACAAGCATAATTTCAGGATTCCATTTGTTTGTGGTTGTCGTAATCTTGGTG
AAGCCCTAAGGAGGATTCGGGAAGGTGCGGCTATGATTCGAACAAAGGGTGAAGCTGGAACTGGTAATGTTGTTG
AAGCTGTTAGGCATGTGAGGTCTGTCATGGGTGATATGAGGCTTGTGCGTAATATGGATGATGATGAGGTGTGTT
CATAT > SEQ ID NO:854  214634  199488_300749_1
TTGAACAATCTACCAACATCACAAGCAATTCACCATGTTGAGCTTCCTCGGAAAATCGGTAGCCTTGCTGGCTGC
GCTGCAGGCTACTCTCAGCTCTGCAAGCCCCCTAGCCACAGAAGAGCGCTCTGTTGAGAAGAGAGCCAACGGATA
CGCAAACTCCGTCTATTTCACCAACTGGGGCATTTACGACCGCAACTTCCAGCCTGCCGATTTGGTGGCATCAGA
TGTCACTCATGTCATCTACTCATTCATGAACCTCCAGGCAGACGGCACAGTTGTCTCTGGCGATACCTACGCTGA
TTTCGAGAAGCACTATGCCGATGATTCTTGGAATGATGTCGGCACCAATGCCTACGGCTGTGTCAAGCAGCTGTT

Figure 2 continued

CAAGGTCAAAAAGGCCAACCGAGGCCTCAAGGTTCTGCTCTCCATCGGTGGCTGGACCTGGTCCACCAACTTCCC
CTCTGCAGCAAGCACGGATGCCAACCGAAAGAACTTTGCGAAGACTGCCATTACCTTCATGAAGGATTGGGGTTT
CGATGGCATTGACGTCGATTGGGAGTACCCTGCAGACGCCACCCAGGCCTCCAACATGGTTCTTCTGCTCAAGGA
AGTCCGATCTCAGCTGGATGCTTATGCTGCcCAGTatgccCCtggcTaccACTTccTCCTCACCATTgccGCACC
AGCtggcaaggaTaaCTACTCcaagct > SEQ ID NO:855 214634 208351_300834_1
GCAACCATTTCGTCATCGGACCATAGCACTCCCCAAATACCTCACTCTTCTCGCTGATCTGGTCCTGCTCTTATC
CCTCATTCCCATCATCAACTTTTCCACATCTCGAACAAATATGTCGGGAGACGGCTATCGTTCAGTCGCCTATTT
CGTCAACTGGGCCATCTATGCTAGAAAGCATCGCCCCCAAGATCTCCCCGTTGATAAACTCACTCATATCCTCTA
TGCCTTTGCCAATGTCCGCCAAGATAGCGGGGAAGTACACATGACGGATGGCTGGGCGGACACAGACATCCATTG
GGAGGGCGACTCATGGAACGACACGGGAAACAACATGTATGGATGCCTCAAGCAGCTGAATCTTCTCAAGAAGCG
CAACCGCAATCTCAAGGTTTTGCTGTCCATTGGAGGTTGGACGTACAGCGGCAACTTCAAGGGCCCCGCCAGCAC
TCAGCAGGGCCGTGAGACATTCGCCAAATCTAGTCTCGAGCTGCTCAAAAACTTGGGTTTCGACGGACTTGATAT
CGATTGGGAGTATCCCCAGAATGCAGACGAGGCTAGGAATTTCGTCGAGCTTCTCGCCACCGTCCGCAGAGAGCT
GGATGCCTATTCTGGCTACCTTCCAAACTACAGCCACTTTGAACTGACTGTTGCTTGT > SEQ ID NO:856 214637 215792_300884_1
ggttctcaaagtcttccggtgccgccggcCGTTTGGCTGCGGACCGAAAGGTGGACAGGAATCAACTCGTGATGA
GATCCGGGAAATGGCGGCCTCCGCCGGGATTTGGATTCCATTCTTTCGTTTTTTGTTGGTTTCTAACGTTGATGA
CCATTCAGTGGCGGCGGCTATGAAGGATATGATGAGAGGTGGTGCTTATGCCGGTGTGTATCAAGTAACGAGTCC
GCCTGGTCCAGGCATCATCATACGATCCATCAATCATAATCAaggggAACACAGAGGCAAATCTTCT > SEQ ID NO:857 214656 215015_300877_1
GCGTCTGAAGCTCTTCGCTGACCCGCTATGGCGGGGTCGGTGTCAGCGAAGCCTCGCCTCTGTAGCCTCGCAACA
ATCGCAATCACCATCGCAGTATGGGAAACCGCCCTTTCGCTTTGAGACGGGCATTGGGCTGTTTGCAAAGCGGTC
GCCTCGGCCGTTCCCGCCGCCCTTCTTGTCCCCTCCATCTGTATCCTTCTCAGATCCCCTAAGCACCCATCACCA
GAGTCGGGACCGTCGAGCTCGCGCCTTTGTGAATGGAGAACTCATTAAAGGACTTACGAATGGTGACGATGCCGT
GTATGCTAGCGACTATTTCATATGTGCAAACGATGGCGTAGGCGCGTGGGCAGCTCGCCCCAGAGGTCATGCTGG
GTAATATATCCCTCCCGTGACTTGGAACACGCATGCTGTAGGAATGCGTCCCTGACGTGAGAAACAGGTTGTGGT
CGCGACTGATATTGCACTTCTGGGCGACGGCCATCGAAGAAGAGTCGGCGCAGAACCTATTCCAGCAAAAggccT
ACCAGCCTGACCCCGTTgCGTCTCTGCAGACGGCATTTgagCAAACACAAGAAGCAACCGGTGCTCATGACTGGC
AGGGAACAACGACGGtgtgcggtgctcaactCcattataAAACGttGACAGat > SEQ ID NO:858 214656 218751_300936_1
GCAACGGCCGTGGTCAGCGACCCGACAAGTCGTAGCTTGCTGTACATGGTTGGAATGCGCACATCACCCTCTCCA
TCGTTGGCGACTTTCCTGACATCTCCATCTCCATCGCGTCTGAAGCTCTTCGCTGACCCGCTATGGCGGGGTCGG
TGTCAGCGAAGCCTCGCCTCTGTAGCCTCGCAACAATCGCAATCACCATCGCAGTATGGGAAACCGCCCTTTCGC
TTTGAGACGGGCATTGGGCTGTTTGCAAAGCGGTCGCCTCGGCCGTTCCCGCCGCCCTTCTTGTCCCCTCCATCT
GTATCCTTCTCAGATCCCCTAAGCACCCATCACCAGAGTCGGGACCGTCGAGCTCGCGCCTTTGTGAATGGAGAA
CTCATTAAAGGACTTACGAATGGTGACGATGCCGTGTATGCTAGCGACTATTTCATATGTGCAAACGATGGCGTA
GGCGCGTGGGCAGCTCGCCCCAGAGGTCATGCTGGGTTGTGGTCGCGACTGATATTGCACTTCTGGGCGACGGCC
ATCGAAGAAGAGTCGGCGCAGAACCTATTCCAGCAAAAGGCCTACCAGCCTGACCCCGTTGCGTCTCTGcagacg
gCAtTTGAGCAAACACAAgaagcaaccGGTGctcATGACt > SEQ ID NO:859 214666 211667_300901_1
GACCATTACCATCATACAGCCAACCTCTACATAAGCACAAATACCATTCAAAATGTCTTACGGCGGTGACAACAA
CGACAACTACGGCTCTCGCCGTAATGACGACAACTTTGGCTCCGGAGGAGATTCTTTCGGCTCTGGTGGAAACCA
GCAATATGGCTCCGGAGGAGACTCATTTGGCTCTGGGGGAGATTCATACGGCTCTGGTGGAAATCAATTCGGCTC
CGGCAACCGCCGTAACGATGACAGCTCATTTGGTACCAGTGGCCAGGGCGAGTTCGGCTCTGGAGGTAACTATGG
CAGCTCTGGCGGTGACTCCTATGGGTCTGGAGGAAACACCTATGGCTCCGGCGGCAATGACAACTTTGGCTCTGG
GGGCAATGATACGTACGGCTCGTCCCGTAACCAAGAGTCTTCTTTTGGATCCA > SEQ ID NO:860 214672 220892_300939_1
ACACAATTCCTCGCTGCGTGTGACTCGTGTCTCCAGCAAATACCGCAAAGATGTCTGACGACGGGCTCTCAATAT
ACGATGAGATCGAAATCGAAGATATGACCTTCGACGAGGTTCTTCAAACATACTTCTACCCGTGTCCCTGCGGCG
ATCGTTTCCAGATCGCTATCGATGACCTGCGCGACGAGCAGGATATTGCTGTGTGCCCCAGCTGTAGCTTGATGA
TTAGAGTTATTTTCGACCTTGACG

Figure 2 continued

> SEQ ID NO:861 214678 206379_300821_1
GACAATTTGTTAGTGCAGGGTAATATGTTCCAGGTAGGCACATGTATGGAGAGCCTGTACAAGCCACCAATACGT
TGAAATGAGCTAACCAGTGTGTTACTGTTCCTGGTCACACTAATACTACAGAGTCTATGTCGAAGAGATGACAAC
AATTGTTCTGAAAACCCAGAAATAACTCTTCAACGCATTGAATGTTTGGTCGCGTTTAAGATTATGGTGCCAATC
CCCGGCCGGTGGCTGGTGTTGTTGCCAAGAATCGTCTTCGTATAGCCCGCATAGAGTACACCGTACTTATCGCTA
TACCAGAATCAATACGTGTGTTCTCAGCAATGTATTTGCACCAACAATCTCTTTCTGATGTCTTTCTGGAATCTA
TAACTCGTAC

> SEQ ID NO:862 214680 206059_300804_1
AAGCCCTCACCTCACATAAACACGGGAGAACTACATTCAAGATGGATTTCTCTAAATTCAGCAAGGGTTTCTCTG
ATTTCAGTGCGCAGATTACTCCGTTTGCGTCACGGACCTTCCAGTTTACCAAGGAGCAGTTGGGCCAAGCAGATG
ATCGAACTGAGCTTCCTGCCGATTACATCGACCTCGAGAAAAAGGTCGATGCGCTGAAACAAGCCCACCAGAAGA
TGCTTGCGGTGACTTCGCAATATACCAACGAAGCCTATGACTATCCTCCCAACATCAAGGAGACATTTCAAGATC
TTGGCCGAACCGTGAGTGAGAAGGTCAGCCTTCTATCTTCGGCTACATCTACTTCAGAGGCCCAAGCAGCTCTTG
TGGCTCCAGCATCTGCGAAGCCGCAACCAAAGACTTTCAACCATGCCATCTCTCGTGCGAGCTTATCCAGCAGCC
AGCTCCTGCACCAGCACCACACTGGTGCTGGCGAAGATCCTCTGGCAACAGCTCTCGAGAAATATGCACTCGCGA
TGGAACGAGTGGGCGACGCGCGCCTTGCTCAAGATTCACAAATCCAAAGCCGATTCCTAGCAGGATGGAACACAA
CCCTCAATACCAATCTTACCTTTGCGGCGCGTGCTAgaaagaatgttga > SEQ ID NO:863 214694 210568_300962_1
GGCGGGTTGACGTGATGCTTGACCATGTCCCATATTCCTAGAGCCGATAGCACCCACGCGAGGCGGGCGTGATTG
ATTACGCTTTCGCAGGAGCTGAGCACGCAAAATGGCTTTGTGACCTTTTGCCTCCTTCAGCATGCTCTACTCTCT
GTCTCTATATGGGTATTGTTTGATGGGTTACTGAATCGGTGCTGATAGCAGATATCGGGCTTGATTCGCGATTCG
GAGAAGAAAAAGCTGGAGGCAAGGCTCGGCGAGCACCGATGTCGGATACTACGCATAGACGATTGCTTGGGATGGC
AAACACTTGAAGATCGAAATTTCTCGAGCTTTCATGTTCATGGGGCTGTGATAGTCTTAGGGATTTTGACGACCA
CCGATGCTGACCTTCCCTGTATTTGCTCATTTGATACCCTGCCACTGCGACGAGCCAGCAACGGTGAAATGAGAT
ACAGACTCATGATGCGAAAGGATATATAAGAACCCAAAGTGTCGCTTAATGTCGTTTAATTAGATGGCTATACCG
GACCCGTCCCTGATTGTGTTGCTCAATGGCCTTCTTGTATGCTATATCTGCAGGAGGCGAGAGCAATATCGCCTT
GACATCCCCTGTCATTCGCCTTATTGATTCCGCTTTCAGATATAATTGTTTAATGTGAGATGCCGTATATGTTGG
AATATGTGTCGTGTAATAGCTTTCGACTGGATTCGCATATATCGGGCGCTGATGGCATGCTATACATATGTATGT
CGATACCATAGCTACATATATg > SEQ ID NO:864 214695 218746_300921_1
ACAAATCAGCTCGAATCCATCACCATGGCAGACATCACAGAAGAACCCCAGGCCCTCCCTGTCGATGAGACGCCC
ATCTCTTCCGTCAAGACCAACTCCGCTCGCAAGAACTCTCTTTCCAACTACCTCAAGCACCGACCCGAACGCTCC
GAGCTGGTAGAGAAGAACATTCTCCCAGACTCTACAGCCGCACCCGGCCTCCTCGCTCAGCAAAAAGAGCTTCAG
AAACACATGCTCGGAGACAAGCTCAACGACAAGATTTCACATCGTCCCTCCCCCGACGCCCTCCTCAAGGAAGGT
GTCTTACACGAAGACCCCCGCTCCCCAGAGGAAAAGTACGCCGAGGCCATCGAGGAGGAGTACGCTAAGCGGGAG
GGCGGCGCTTAAGCAGCATTAGAGCTACATGGCGAACACGGATGCTGGGAAATGCGAACTTGTTTTTTCTTTTTT
TTTTTT > SEQ ID NO:865 214708 218082_300914_1
agaaatcgtacCACGTCAATTAGAATAAAGGCCCCAAGCGGCGAATCGATTTGAAGCCGCCGTGCTACATCTCTT
TTTGCTTCTTCTCTTTGTTTTATATGTCGTGCTTCATTCGCATCGATTGATTTCTCAAGCTGCGGTTCCGTCATC
GCTAATGCGCATTCACATGTGCTTGTGCTTATCGCATCACACATGACCCGCGCAAAATGTCATCCTCACCAAGCC
AAACCCCCGGCTCTGGCGACGCCAGCAAGGCCACGCCCTCGGGAGCAGCAGTAAACGCAGATGACAAGCCGCGGC
TCACAGAGGAAGAAAAGAAGCAGAACCACATTGCATCAGAACAAAAGCGCCGTCAGGCCATTCGCGAGGGCTTCG
ATCGGCTGACTGAACTCGTGCCTGGTTTGGAAGGGCAAGGTCGCTCTGAGGGACTGGTTCTGAAGCGTACCGTGG
ATTACATGCGCGACCAGATTGTGCAGAGGCAGGCCTTGATTGAGCGTATCGAGCAGGCAGGCGGCAGCGTTGACC
CCAAGTACAAAAAGGTTTCACAACTGTCAAGACAAGGGCTTGGCCGGTGAGCGGCTTCCCGATGTTTGCGTTGCC
CTCAGCTTGGGGTGAGAGTCGAGGATCGAGCGAGATTGGGCCGCAAAGTCATCATGGAGTCAGTTTGATCTCCCC
ATGACTGCTGCAGAAAGCAGAAGTCGTCGCGGCAGGTCAAGCAGTGCATGATGGGACTACATCGATCATCGTCCA
cgttgcaGCCTGCATGTGCAGTTTGTCATGTCACGACGaacCAAAAAgtatcaACATAtATCctcgaagTCgat
tgttTATTTGAAGATTGGAAACGGGCTTGTGATACCCATCTCGAACCaggggcGGTGGataaaTAATAgaAGGAT
AGAGGTCAATATTTGGCGTGGTTGGATGGGAGTAATAGATGAGAGAGTtgt > SEQ ID NO:866 214710 215336_300880_1
TTCGCATGCAAACAGCAATTCCAAGCCAGGGGCAAATCTCACAATGCTTCGTCAAGTAAAACCCCGTAACGCCCG
CTCCAAGAGAGCCCTCGAGAAGCGCGAGCCCAAGGCCGTCGAGAACCCCAAGACATGCCTCTTCCTCCGCGGCAA

Figure 2 continued

CAACTGCTCCCAGGTCGTCCAGGACGCCATGAACGACCTCTTCTCCATGCGCCAGCCCCTCTCCAAGAAGTTCAC
CAAGAAGAACCCCATCCACCCCTTCGAGGACGCCGCCTCCATCGAGTTCTTCTCCGAGAAGAACGACGCCAGCCT
CTTCGTCTTTGGCAGCACCCAGAAGAAGCGCCCGCACTCGCTGACCTTCATCCGCACTTTTAGCCACAAGGTGCT
CGACATGCTGGAGCTGTACCTCGACAACGAGAGCTACCGCTCCATCTCGCAGTTCAAGACCAAGAAGTTTGCCAT
TGGCATGCGGCCCATGATCCTCTTCGCGGGAAGCGCCTTTGAGAGCCCTGTCCCCAACGAGTACACCCTCGCAAA
GAGCTTCTTCATCGACTTCTTCAAGGGCGAGCCCTCGGACAAGATCGACGT

> SEQ ID NO:867  214715  211778_300870_1
cctacatactcatccttcacgcttcaatcacccttgaataatgaacgaggaaaagctcGGCCACAGTAATCATGA
GGACATTGTGCCTCCAGAATCCTCTACTGGAGATGAATTACAGACACCATCTACGGATTCCAAGGGCAAACAGAA
GGCAGGCCTGGAGTTAGCAGCATCTCAACTTGGGGCCTCTACAAAGCTGGTCGTCAATGCCATCACAACGTTTCG
GGAAATGCCAGCTTTGGCATCAGAATCAAAGTCCTCTCATGGTTCAAGTAGCATGGGCTCGTTTTCATCTATCGC
TGGCGAGTACTCGTCATACAAACCACTCCAGAATCCGTTGCTTGACGAGACTACTCATGAGGGCCAGGATGATTT
GTTTGAGACGTTTATCAAGAGTTCAACGGATGCGTTGGTAAATGATGGCTATCAAGTAGACGTTTCAGGATCCTC
ATTTGCAGATCAAGAAGCATCGGATGGCTTGGCCGTTTTGAATTTCTCTCACAGCCAGGAAATGAATCGATCGA
GACGGCCATTTCTAGGGAAAATGATTTTCAGATCTCAGGCGAGGATGAATCATGGAGTGAAGCTGTGGCTGGAAC
ACTCATCGATGAGAACGACCAACTTGATTTTACTCCTGATTTTaTCACTAaTCCCGAACTGTCTTCTCAAGCAGC
GccGTACCTTggAACAACGAACattgaaGaaACAaGttataCTTGgTtt > SEQ ID NO:868  214724  210440_300889_1
gtcggattcaggcctcagcgctcggatcggcctcttttcctctcttccctctctgctttccatctgcccagcaga
ccgagTTTGGCAGCGCAATGTTGCCTCTATCGGTGCGGCGCGCGGTGGCCGCTGCTCCTCAGGGGGCAAGTGGGC
TGACTTCTCTCGCCGCGTCGGCTCCAAAGATCACAGCCTCGAGCTTCATCCTGAATCGTCCTCAGCGGCGCTACT
CCTCGTCGAAACCCTCAAGATCCGATGAGCCCAACGATATTGCTGCCGGCCAGTCGGTGCCGGCATCTACCTCGC
GCGGAGAGAGCAAAGGCAGCAGGAAACGAAAGAGCAAGGATTCAGCCGACCGAAATGCGGCTTTCAAGAAACTGC
CCAGTGTCCCTAGCACTCACCACATGTCTCAAGAGGCCCTGAGCTTATCGAGCTTCTTCTCACTCCACCGTCCCA
TTTCCATCACCCAGACCATGCCCAGGACTGttACCGAcGAGCACTTTGCATCCATATTTgcgCCTCGATCAAAAT
CGAACAGGATacgagacaCTgtcTCTACaatttctgACACCATTgagcagCtGGaaggccCcAtGGCtcaggtga
caaTaggatcTCa > SEQ ID NO:869  214727  205856_300802_1
CCCACGCGTCCGCAACTACAACTACAACACTACTACAAACACCAACTACTCTCTTACCACATCTTCCAATCTCAA
CTTCACACTCAATAACTCAAATCACCATCAAAATGCAGTCCGCTATCGCCTTCACTGTCTCCCTCCTTGCCCTTG
TTGCCTCGGCAGCTCCCACCACTCGCACCGTTGGCACTGTTCAAGTCCAGTTTGCCAACGATGTCACTGGAGCAA
ACGGCAATGCCCGTATCCCTCTTGACGGATCCAACATAAACCTTGGAGAGGCTTATGGCAACACCAACCTAGAGA
AGGACGGCACCCTCTTTGTCACCAGCCTTCAGTTCACTGCCGACTTCCAGAACGTCCAGTGCGTTGTCCTCAAGG
ACTTCCAGACCAGAGTCGCCTTCATTGCCGACCCTCACCAGGACTTCCAGACCTTCTCTCAGAAGCCCCTGGACT
GGCAGAACAACTTCACCATTGCTTGCAATGTCGCTTCTTCTTAAGCATTCTTCTAAGAATTCTCTTAAGCACTCT
CTTAAGCACTCTCAAGGTCGCGGGGTAGAATGGACAGGTCTTTGGAGGGGCGTCGATTTGGTTTGATTTTTATCT
CCTTTGTCAGGGACGGAAGCGATCGGCTTAGCACAAATGGCCAGAGCGTATCTAGTTGATATATAACTGAGAACT
AcatcatttTagac > SEQ ID NO:870  214756  208223_300833_1
gctcgactctCACTTTCTTCTTTTCATCCCTCACTCTTCTCTCATCTTCTCTCCAATCCCCAATCCTCAATAACC
TACGCCGTGTCAGTCAAGCAGCTGTACATCATCGCATATCGACCGACGACGACCTTGTCCTGCGTCTTCCATCTC
CAATTCTCACCCACCACTTACACCATCACACATCACAATGCCTGCTCCTCAGGTTAACGGCGAGGTCACCAGCCA
TGTCAATTCCGCCTTCCTCCAGCACCTCTTCTCCTATCCTCTAGTTAGCGACGGCATTCACACTGTGACCACCAA
CGAATACGCACAGCGGCCTATCAAGCTGGGCGAATCTGCCTATAAAACTTTTGCCGCCCCTGTTCTTCCCTACTT
TTCCAAGCCCTATGGTATTGTCTCTCCCTACGTCCAGAGGGCCGACTCCTTTGGCGACAAGACCCTGGACCGCAT
TGACGAGCGTTTTCCCATTGTCAAGAAGCCCACTGGTGATCTCTACAACGAGACCCGTGGTCTGATTCTGTTCCC
CTACCAGAAGGGACTCGAGGGCAAGGAGCACGTTTTCAAGATCTATGCTTCCGAGCTTAAGAAGCTTGAGCAGGA
GGGCGTCGTGGCCCAGGGCAAGGCTGCCGTTTCCACCGCCTTCGTCATTAGCAACGAAACGCTGGCCTGGCTGAG
CAGCTGGGTCGCTGTCAAGAAGGCCGACGCCTCTGAGGCTACCAAGGAGAAGATCAACCAGTAGACGATTTCCGG
AGTGGATTACAAGCGAAACAGCGCATCATTTCCTTTCTTGACCGGCCCTCTCTCTCTTCTTTGTCTTTCTCTTCT
TACCCTTTTGTTGGCATTGAGTCGACTTTCTCTGTCACTGGATCTCATTTGCttCtgttGATGCCAGTTCGCTttt
gtgATGAAcAgCACctagagaAaAGGGGGAAGAAGGGCAGGCTGCTTCGTCCGCTgcgaCTAGGCGTCTACGTCT
GGCATCATGATCGCCACTACtagcTaGtGgCCaagCTCTGACGcatctcgttTCgatttcATCTCTCtttgATTc
cttgttTCggcggaCTAtg

Figure 2 continued

> SEQ ID NO:871    214756    211666_300901_1
AATAACCTACGCCGTGTCAGTCAAGcaggTGTACATCATCGCATATCGACCGACGACGACCTTGTCCTGCGTCTT
CCATCTCCAATTCTCACCCACCACTTACACCATCACACATCACAATGCCTGCTCCTCAGGTTAACGGCGAGGTCA
CCAGCCATGTCAATTCCGCCTTCCTCCAGGTATGCATGGATAAAAGAAGAGATTCGCCTTGTCATCACACAATGG
CAAATGCGAATCGAACCGAATCGTGATGGCTTTTGGTCCGGTTATTGATCATATTGGCAGCACCTCTTCTCCTAT
CCTCTAGTTAGCGACGGCATTCACACTGTGACCACCAACGAATACGCACAGCGGCCTATCAAGCTGGGCGAATCT
GCCTATAAAACTTTTGCCGCCCCTGTTCTTCCCTACTTTTCCAAGCCCTATGGTATTGTCTCTCCCTACGTCCAG
AGGGGCCGACTCCTTTGGCGACAAGACCCTGGACCGCATTGACGAGCGTTTTCCCATTGTCAAGAAgCCCACTGGT
GATCTCTACAACGAGAcCCGTGGTCTGATTCTGttCCCCTACCAGAAGGGACTCGAGGGCaaggagCACGTTTTc
aagaTCTATGCtTccgagCTtaagaagCTTGagc > SEQ ID NO:872    215114    221072_300941_1
gaatgaaagggaaaaaaggccagcatggcacgctcgcacccaagaacaaaaaaaggccggagcactaataggca
cggcaTGGGGGCCTCACGCCATCGATTGTGTAATAGGCGTACGACGGTTACGACAGGAACGTGCCACAAAAGGAG
GGGTGGGAAAACGGATGACGGGAACAaggAGGAAAACTGGCTCTTTAAGTTCCAACTTTGTTGCCAATAGCCAGT
CGCTGCTGTCTGTGTTTCTAGTTTCTACGGAGCATGAACCTGTGAGAACAAGCCACATCGGGGAGACGGGAAGAT
GGTGACACGGATGCGTTTGTGGAGGTGGGTAAGCTTTGCGCAACATGTGCCAGCCTTATCTTGATATTGGACGCG
GCGACGGCGAGATGGTTGGAAGGGTGTGTCTATGTGTACCGACAAACGCATGGCTGATGAGACGGTGAATAAAAC
TGCACCAAGAAAGAGATGCATGAGAGATGAATGACCAGTACCTAAGGTCTATGACATGTCGCTTTGCACTCGGTC
GGACTCATTCACATGTAGTAAATACTACATAACACCCACTTGCTCCAGTAATCATCACTTATAATAATACGGCGA
GAAGACAAGTTGACACAGGGCGAAACAGGGCGGAACAAGGGGCGAAGCGAGGTGGAAAATGGTAAACGCAGAGAC
TCTTTCTATGTACTAGCCATCGATCAAAAGGAAGGACAGCTCAGTCTTCGCTGCATGCTAAAGCAGCGGCCGATG
GGATGGGGCTCCAAGGCAAggTGTAATACCGAGtACATGCATATcaaAaaagaaaagacgaaacgtt > SEQ ID NO:873    215167    218693_300935_1
GCACGTTTGGGCAGCATCTTTATGATACAATGATGAACGTCTCCTTCTCTACCGGCCGCGCTGCGCTGCGCCTCA
GCCGCTCGTCCTTCCGCCACCTGTGCGCATCCAGAGTCGCCGGCTTTGCTTACCACTCCTATCCGCTGCCGTCCA
AAATCCCCGAGCCTCCCACAAGCGACAACCTCTCCAAGTCATCCCTTGCCCAGCCAGAGGCCCTTCCTCGCGTCC
ACGAGACACGGCCGCCTCCTCAACACGATGCCGTACCCAAGCCGATGGCCCCACCGCAGGTTGAAGCTCAGTCGC
CTTCTCCAACAACCTCCTCAGTTCCTCCATCTCCCAAAGCCGCCGAGACCGATGCGCAAAAGACACAGCCTGCTC
CCGCTGCTCGACCTCGTTCCAAGCTTCGCGCGCGCAAGGCCGCAATGAAGCTCACACCCGCCGCCGTGGAGCAGC
TGCGCGCACTGCTCAACCAGCCCGACCCGAAGCTCATCAAGGTCGGTGTGCGGAACCGAGGCTGCAGTGGGCTCG
CATACCAGCTGGAATACGTCGATAAGCCGGGCGCTTTCGATGAACTGGTGGAGCAAGACGGCGTCAAGGTCTTGA
TTGACAGCAAGGCACTCTTCAGCATCATTGGCAGCGAAATGGACTGGGCGGAaGATAAACTGAGTCAGAAGTTTG
TGTTTAAGAACCCTAATAttAAGGAGCAATGCGGCTGCGGagAgtcATTTATGGTCTAAGGAGCTTGTGAagcTA
CAAAGGaaCAAGACAAAGGCCATggCACatgagaaTACTACCAaggccgATGTATggagAGAttgtaCgaTgAcg
acTa > SEQ ID NO:874    215174    179991_300565_1
AAGATGCTGCGCTCTATGggtCTACGAGGCAATGCCTTGACGCAGACCACCCGACTGGCTGCATCCAGGGCCATG
TCGAGCCAGGCGCTCTCCAACCCGACCCTGTCCAACATCGAGAAACGCTGGGAGGGAATGCCTCTCCAGGAGCAG
GCCGACCTGTGGATGGCCCTGCGTGACCGCATGAAGGGCAGCTGGAACGACCTGACCCTGCAGGAGAAGAAGGCC
GGTAGGTGGTGCACCTTGAGTTTTTCTTACTGGATCGCCTTCGGCCCTCACGGCCCCGCACCGTTGACGCTCCC
GGAGCCGGTGCCCGTGTTGCCTGGGGAGTTGCCGTTGGCCTTGCCGCCTCTCTCGCTCTCTTCGCTGCCATCCGA
GTTGCCGCCAAGCCTGCGCCTTACACCATGAACAAGGAGTACCAGGAGGCCACTAACGAGCTTCTCAAGGCTCAA
GGTGCTGATCCCCTCACTGGTATCTCTTCTCCCGGCTATACTGGCAAGGGTGTTGTTCAGTCTCCTCCCAAAAAC
TAAAATAAAACACGATAATATCGCTTCAAGCTTCGCACAATTGGGGCGGGCATGGGAGaagttTTATCAAAACGA
CATTTGTACATGTATAGCTtTagtCCTagagagtATGCAagacagggttCTCGc > SEQ ID NO:875    215174    195541_300635_1
cccacgcgtccggggaattaaatcccctcgctgcactaccgcaaccaccgtcaaCCTCGCTGCTACCTCTCAATT
GAACTCGACTCGAGCTCCGTCAATC > SEQ ID NO:876    215181    112371_300001_1
AAGTAACTTAAATACCCATTCTCACCACTAAACATGGTTGTGCAGAAGATGGAGGATAAAAATGCTAGAAGAAAC
AAATATAAAGTAACACAACTCAAAAACTAGCAAAATTACAGCCTGAACAAGGCTCAAGCCAACATAGAAAGTTCC
TTGTTGCATTGAACTTAAATTTTGTTGAAGGCAACAATATCACAGCTCTGCACATATTCATTGATAGGCTCTACT
GTTAATTTTTCCTCAACGAGAGTGTCCACAGAGACAAGGTCATCCACGATGGTAAGCATGATCTGCAATTTCTTA
ATCCCGTAGCCAACTGGGACCAATTTGGATGCTCCCCAAGTAAGCCCTTCTTGCTGAACACTGCGAACAGCCTCC

Figure 2 continued

TCCAGCAGCTTCATATCAGTCTCATCATCCCAAGGCTTAACGTCCAAAAGAATGGATGACTTTCCACTCTCTTTC
TTCTTGGTAGATGCTTTAGTAGCCTCCCTTGCTTCTGCTGCCTTCTTTTCCTCCTCTGTCTCTTCTCCGAAGAGA
TCAATATCATCATCGTCATCATCATCTGCAGCCTTGGCAGCTTCCTTAGCTGGAGC

> SEQ ID NO:877 215181    39338_300198_1
GCAGAGGAGAGGGATGCTGCTAAGAAGGACACCAAGAAGCCTAAAGAGAGTGGAAAGTCTTCTGTGCTCATGGAT
GTTAAGCCATGGGATGATGAAACCGACATGAAGAAACTGGAAGAGGCTGTTCGTGGTGTTGAGATGCCTGGTCTT
TTCTGGGGAGCCTCAAAACTTGTACCAGTTGGTTATGGGATCAAGAAACTCACAATTATGTTCACGATTGTTGAT
GACCTCGTGTCCCCGGACAACCTCATTGAAGACTTCCTCACCTCAGAGCCTAACAACGAGTACATCCAGAGTTGT
GACATTGTCGCTTTCAACAAGATTT

> SEQ ID NO:878 215181    26086_300080_1
actgaattgtcacttttcattaaatatcaaaatggaggagagatggcaggccataacagagtcaaaacaacagtc
tacaaAAACTTGGGAAACTGaATATAGAAGAAGAAGAAGAACCAGACCACATGAACACAGACATTCCTTGAAGCT
TTCTCCATCCTCATATCTTgttGAAGGCAACAATGTCaCagctctGGACATATTCATTGATCGgttcAACAGTGA
GTTGCTCTTCGATCATGGTGTCAATAGAGACAAGGTCGTCAACAATGGTGCACAAAATCTGCAACTTCTTGATAC
CATAACCAACTGGGACAAGCTTTGATGCTCCCCAAAACAAACCTTCCATCTGAATGGACTTCACAGCTTCCTCAA
GCTTCTTCATGTCAGTCTCATCATCCCACGGTTTGATATCAATCAAAACTGAGGACTTTCCAGATTCCTTCTTCT
TTGTAGATGCCTTGACAGAAGCTGCTCTCTCTTCAGCAGCTTTCTTTTCCTCTTCGGTCTCCTCTCCGAAAAGGT
CAACATCATCATCATCTTCTTCATCagccgcagcatccttagaatcagctgc > SEQ ID NO:879 215181    156752_301369_1
gtcttctgtcatcgccagatcgtgaaagacttgtattattatcaagcaatggctgttgcattccagaacctcaac
tctgaTTCTGGTCTCAAAAAGCTTGATGAGTACCTCTTGACCTGCAGTTACATCTCCGGGTACCAAGCCTCGAAG
GATGATATCACTGTGTATTCATATCTAGCAAAAGCCCCATCAGCTGAATATGTGAATGCATCTAGGTGGTATAAG
CACATTGATGCACTTTTGAGAATCTGTGGTGTATCTGGGGAAGGTGCCCGTGTCACCGTAGAGGGATCTGCACCA
ATCACCGAGGAGGCAGTGGCAACTCCTCCTGCTGGTGACACTAAGGCCTCAGCTGCTGAAGAAGATGATGATGAC
GTTGACCTATTTGGTGAGGAAACTGAAGAGGAAAAGAAGGCTGCTGAAGAACGTGCAGCAGCAGTTAAGGCTTCA
GGGAAGAAGAAAGAGTCTGGCAAGTCCTCAGTTCTCTTGGATGTCAAGCCATGGGATGATGAGACTGATATGAAG
AAGCTTGAAGAAGCTATTCGAAGTGTTCAGATGGAAGGATTGACTTATGGAGCATCTAAACTTGTTCCTGTTGGA
TATGGTATTAAGAAGCTGCAAATCATGCTTACCATTGTGGATGACTTGGTCTCTGTGGATGATCTCGTTGAGAaT
TATTTTATGGCTGAACCTATCAATGAGTATGTTCagAGCTGTGATATTgttgctTTcaacaaAaTATGAATTCTA
TTACTCTCTGAAGt > SEQ ID NO:880 215183    213984_300862_1
GCCGAGATATCCGGCTCTTTGGGCGATTTGGGCACCCTGCTTCCCCTGATGATCGCCCTCGCGGCCAAGGGGTAC
ATCGACCTGGGCTCGACGCTCGTCTTTTCCGGCGTCTTCAACGTCCTCACCGGAGTTGTCTTTGGCATCCCCTTG
CCCGTGCAGCCAATGAAGGTATGTCATGTCCAAGTACTACTGCTATTACTACAGTAGCTTGCTGTACTCGTACGA
ATATGTATGCTGTGTGGAGCACTCTTTACCCCCTGGATTTAGACCTCGGTACTCGATACGATACTCCGTATACAT
GCCTACATACAACTACACACATACATGACTGTCTTCTTATCTGCCCAAGGAGCCTTACTTTTTTGCTAATCCTCT
TCCCGCCTCATGTGGGTACTTAGGCCATCGCC > SEQ ID NO:881 215221    205567_300799_1
ACAGAGCCGATCAAATACCGCCAAAATGCCCAAGGAAGTCGCTGACATCAAGAAGTTCATCGAGATCTGCCGTCG
GAAGGACGCTTCCTCCGCGCGGATCAAGAAGAACAAGAAGGCCCACAACATCAAGTTCAAGGTCCGATGCCAGAA
GAACCTCTACACTCTGGTGCTGAAGGACAATGACAAGGCCGAGAAGCTCAAGCAGAGCCTGCCTCCCAACCTGCA
AATCGCAGAGGTCCCCAAGAAGAACTAAGGAAATGAATTGGTGGTAAAATAGGGGTGGCTTTGGGCGTGGGAAGG
GTTTACATGCACAACTGGGCGTCTCGGGATACCTTGCATTTCATGTGCTCAGAACGCACGCTCGCAATAGAGCTC
AAAAAATAACGATTTGAGACACAAAAAGCAACAATCGCACACCAAAATCTGGTGAGCCCGATGTCTTTCTTGTGC
CGGCTATGCTACCTGAAGAAAGGGAGCCCCCCCGGTTACTCGGTGATGCCTATTTACACGACGTGCCTGAAGCGG
CGATGATCTTTCTTGAGGGcGangCTcgccaaTCCTTCCAGTCGTTTCTTCGGAACatcgcCagtccagaataca
atCAAATCTTCCttgtcttcctcaAAAAAaa > SEQ ID NO:882 215255    104012_300058_1
gacctgcaAGATGTTACCGCCAGATCAAGAACAAGCCTTACCCAAAATCACGGTTTTGCCGTGGTGTCCCCGATC
CAAAGATCAGGATCTATGATGTGGGCATGAAGAAAAGGGTGTTGATGAGTTTCCTTTCTGTGTACATTTGGTCA
GTTGGGAGAAGGAGAATGTCTCTAGCGAGGCACTTGAAGCTGCCCGTATTGCTTGCAATAAGTACATGACCAAGT
CTGCTGGGAAGGATGCCTTCCACCTTAGGGTCAGGGTTCATCCGTTTCATGTTTTGCGTATTAACAAGATGTTGT
CATGTGCTGGAGCTGATAGGCTCCAAACTGGCATGAGGGGAGCTTTTGGTAAGCCACAGGGTGTTTGTGCTCGTG

Figure 2 continued

TTGCAATTGGTCAGGTTCTTCTCTCTGTTCGTTGCAAAGATGGAAACAGTAACCATGCACAAGAGGCTCTGCGCC
GTGCAAAGTTTAAGTTCCCTGGCCGACAAAAGATCATCGTCAGCAGAAAGTGGGGGTTCACTAAGTTTAGCCGTA
CCGATTATCTGAAATACAAGTCAGAGAACCGTATTGTCCCAGATGGTGTCAATGCAAAGCTTCTTGGCTgCcATG
GTAGACTTGCTGCACGTCAACcTggaa > SEQ ID NO:883 215255 190729_300779_1
cagccgcacatccccGCCTCTTCCCGCCGCCGTCCGCCGCGCGCACGCCGCCGCCGCCATGGGGAGGAGACCTGC
AAGGTGCTATCGCCAGATCAAGAACAAGCCGTACCCCAAGTCAAGGTACTGCCGTGGTGTCCCTGACCCCAAGAT
CAGGATCTACGATGTCGGGATGAAGAAGAAGGGTGTGGATGAGTTCTCCCACTGTGTGCATCTCGTCTCTTGGGA
GAAGGAGAATGTCACCAGTGAGGCTCTTGAGGCTGCGCGTATCGCGTGCAACAAGTACATGACCAAGTCTGCAGG
AAAGGATGCCTTCCACCTCAGGGTTCGGGTTCACCCGTTCCATGTGCTCCGTATCAACAAGATGCTTTCGTGTGC
CGGGGCAGATAGGCTCCAGACTGGAATGAGGGGTGCTTTTGGGAAGCCACAGGGAACCTGTGCTAGGGTGGATAT
TGGCCAGGTCCTCCTTTCTGTGCGGTGCAAGCCCAACAATGCTGTCCATGCCAGCGAAGCCCTCCGTCGTGCCAA
GTTCAAGTTCCCTGGTCGCCAAAAGATCATTGAGAGTAGAAAGTGGGGTTTCACCAAGTTCAGCCGCGATGAATA
CGTCAGGCTTAAGAGCGAGGGTAGAATCATGCCTGATGGTGTCAaTgCtaaGCTACTTGGTtgccATGGTcgcct
ctctgCtcgTGCCCCCGGga > SEQ ID NO:884 215255 127688_300471_1
cccacgcgtccgcgcaggtCTTAAACGGGGACGAAACCATGGGGAGAAGACCTGCAAGATGTTACCGTCAGATTA
AGAACAAGCCATACCCAAAGTCACGGTTTTGCCGTGGTGTCCCAGATCCAAAAATCAGGATCTATGATGTAGGCA
TGAAGAAGAAAGGAGTCGATGAGTTTCCATTCTGTGTTCACTTGGTCAGTTGGGAGAAGGAGAATGTCTCCAGTG
AGGCGCTTGAAGCTGCCCGTATTGCTTGCAACAAGTACATGACCAAGTCTGCTGGGAAAGATGCTTTCCACTTGA
GGGTTAGAGTTCACCCCTTCCACGTTTTGCGTATTAATAAGATGTTGTCGTGTGCTGGAGCTGATAGGCTCCAAA
CTGGAATGAGGGGAGCTTTTGGAAAGCCCCAGGGTGTTTGTGCTCGTGTTGCTATTGGTCAGGTTCTTCTCTCAG
TTCGCTGCAAAGATGGCAACAGCAACCACGCCCAAGAGGCTCTGCGCCGTGCTAAGTTCAAGTTCCCTGGTCGAC
AAAAGATCATTGTCAGCAGGAAGTGGGGGTTCACCAAGTTCAGCCGTACTGATTATCTGAAATACAAGTCAGAAA
ACCGTATCATcccagaTGgtgTGAATGCtaagcttCtTGGGTgCcAtggTCGACTTGCTGcaCGacaaCCTggaa
gggcTtTTCTTgaagcagtttaggaaTTGgAGCATAtTTACTTTTCTGCATGcgaCTGaATGaa > SEQ ID NO:885 215255 226406_301034_1
ATCAAAAATGGCTCGACGACCCGCTAAGTGTTACCGATACCAGAAGAACAAGCCCTTCCCCAAGTCTCGATACAA
CCGAGCCGTGCCCGACCCCAAGATCCGAATCTACGATCTTGGTCGAAAGCGAGCCCACGTCGACGACTTCCCTCT
GTGTATCCATCTCGTTTCCAACGAGCGAGAGCAGCTGTCTTCCGAGGCTCTTGAGGCTGCCCGAATCTGTGCCAA
CAAGTACATCACCAAGGTGTCCGGACGAGAGGCCTTCCACATGCGAATCCGAGCCCACCCCTTCCACGTTCTGCG
AATCAACAAGGTGCTTTCTTGCGCTGGTGCCGATCGACTTGCTCAGGGTATGCGAGGAGCCTGGGGTAAGCCCGC
CGGTCTTGCTGCCCGAGTTGACATTGGCCAGGTTCTGATTTCCATCCGAACCAAGGACAACAACAAGGCCACCGT
TATCGAGGGTCTGCGACGATGCCGATACAAGTTCCCCGGTCAGCAGAAGATCATCATCTCCAAGAAGTGGGGTTT
CACCAACCTCGACCGAGAGGAGTACATGACCCGACGACAGAACGGAGAGATCAAGGAGGACGGTGccTACGTCAA
Gt > SEQ ID NO:886 215255 228710_301036_1
ATCATCTCCCCTTCTATTCACCATGGGTCGCCGTCCAGCTCGCTGCTATCGTTACTGCAAGAACAAGCCTTACCC
AAAGTCTCGTTACAACCGTGGTGTCCCAGACCCCAAGATTCGTATCTTTGACTTGGGCCGCAAGAGGGCCAACGT
TGACGAATTCCCATTCTGTGCCCACTTAGTCTCCGATGAGTATGAACAACTCTCGTCAGAAGCTCTCGAAGCCGC
CCGTATTTGCGCCAACAAGTACGTCACCAAGACATCGGGCAAGGATTCTTTCCATTTGCGTGTCCGTGCCCACCC
CTTCCATGTCATCCGTATCAACAAGATGTTGAGTTGCGCTGGTGCCGATCGTCTGCAAACTGGCATGCGTGGTGC
ATGGGGTAAGCCCTACGGCACCGTTGCCCGTGTCAACATTGGTCAAGTCATTCTCTCCATCCGTACCAAAGATGC
AAACGCACCCGTTGTCATTGAGGCTCTCCGTCGCGCTCGTTATAAGTTCCCTGGCCGCCAAAAGATTATCATTTC
TAAGAAGTGGGGTTTCACTAATGTCGCCAAGGAGGAGTACTTGA > SEQ ID NO:887 215255 195837_300638_1
gaagtggcgccgggactccttgagttggaattatCTTCCCCCAAACATCATCAAACAAACCTCAAGTACAGTCAA
CGAAACACCGACAAAATGGCTCGCCGTCCTGCTCGTTGCTACCGATACTGCAAGAACAAGCCGTATCCCAAGTCT
CGGTTCAACCGTGGTGTCCCCGACCCCAAGATCCGCATCTTCGATCTGGGCCGAAAGCGCGCCAACGTCGACGAC
TTCCCTCTCTGCATCCACCTCGTCTCCAACGAGTATGAGCAGCTGAGCTCCGAGGCCCTCGAGGCCGCCCGTATT
TGCGCCAACAAGTACCTCGTCAAGCACACCGGTAAGGAGGGTTTCCACCTCCGTGTCCGCGCCCACCCCTTCCAC
GTCGTCCGTATCAACAAGATGTTGTCTTGCGCTGGTGCCGATAGACTGCAGACTGGTATGCGTGGTGCCTGGGGC
AAGCCCAACGGCACTGTTGCCCGTGTCAACATTGGTCAGATCATCATGAGCGTCCGCACTCGTGACTCTAACCGT
GCTCTGGCTCTTGAGGCTCTCCGACGATCCCAGTACAAGTTCCCCGGCCGACAGAAGATCATCATCTCCAAGAAC

Figure 2 continued

```
TGGGGTTTCACTCCTCTCCGCCGCGAGGACTATCTCGAGCGCAAGGCTGCCGGCCGTGTCAAGGTCGACGGTGCT
TACGTTCAGTTCCTCAGCAACCACGGTTCCATTGAGCAGAACATTCGTCGTTTCCCCGACGCTTTCTCGTCCGAG
GCGTAAATAGTTCTCCTTAATGTGGCTTCTGGGTTTTAGGTTGGCGTAATTATGGCATGTCAGATAAGAGATTTC
TCGATTTGAGAATCATCAGTTAGGCAAATCAAACCATTGTGCGTTCAGCACTagA
```

> SEQ ID NO:888 215255 46901_300175_1
```
ataaagagagacgccatgggaagaagacctgcgaggtgttaccGTCAGATCAAGGGTAAGCCATACCCAAAGTCT
CGCTACTGTCGTGGTGTGCCAGATCCAAAAATCAGGATCTACGATGTTGGTATGAAGAGGAAGGGTGTTGATGAG
TTTCCATTCTGTGTCCATTTGGTGTCATGGGAGAAGGAGAATGTGTCAAGTGAAGCACTTGAAGCTGCCCGTATT
GCTTGCAACAAGTACATGGTGAAGTCTGCTGGAAAAGATGCTTTTCATTTGAGGATTagggtTCATccTTtccAT
GTTCTCAggATTAACAAGATGCTTTCGTgTGCTGGAGCTGATa
```

> SEQ ID NO:889 215255 284544_200099_1
```
ccgcagactaatCGCAGAGAGAATTAGCCATGGGAGAAGGCCTGCAAGATGTTATCGCCAGATTAAGAACAAGC
CTTATCCAAAGTCACGGTTTTGCCGTGGTGTGCCAGATCCAAAGATCAGGATCTATGATGTGGGTATGAAGAAAA
AGGGAGTTGATGAATTTCCTTTCTGTGTGCACTTGGTCAGTTGGGAGAAGGAGAATGTTTCAAGTGAGGCACTTG
AAGCTGCTCGTATTGCGTGCAACAAGTACATGACCAAGTCCGCTGGAAAGGATGCTTTCCACCTCAGGGTTAGGG
TCCATCCCTTCCATGTTTTGCGAATTAACAAGATGTTGTCATGTGCTGGGGCTGATAGGCTCCAAACTGGTATGA
GGGGAGCTTTTGGTAAGCCACAGGGAGTCTGTGCTCGTGTTGCTATTGGTCAGGTTCTTCTCTCTGTTCGCTGCA
AAGATGGTAATGCTAACCATGCTCAAGAGGCACTGCGCCGTGCTAAGTTTAAGTTCCCCGGCCGACAAAAGATCA
TCGTCAGCAGGAAGTGGGGGTTCACTAAGTTCAGCCGTACTGATTATCTGAAATACAAGTCAGaGAATCGTATTG
TTCCAGATGGTGTCAATGCCAAGCTTCTCggtTGTCATggccgACttGCTGCAcGTcaacCTggaagagctttTT
TGgAagcagTgGGGAATTGAagtTGcgaacTTAccaaACTGaacct
```

> SEQ ID NO:890 215255 264954_301440_2
```
tTcgcatTAATTAAGCATGGGGAGaaggCcTGCTAGGTGCTACCGCCAGATCAAGAACAAGCCGTACCCCAAGTC
AAGGTACTGCCGTGGTGTCCCTGACCCCAAGATCAGGATCTATGATGTTGGCATGAAGAAGAAGGGCGTGGATGA
GTTCCCCTACTGTGTGCACTTGGTGAGTTGGGAGAAGGAGAATGTCTCCAGTGAAGCTCTTGAGGCTGCCCGCAT
TGCTTGCAACAAGTACATGACCAAGAATGCAGGAAAGGATGCCTTCCACCTAAGGGTCAGGGTCCACCCGTTCCA
TGTCCTTCGTATCAACAAGATGCTCTCGTGTGCTGGGGCTGATAGGCTCCAAACTGGAATGAGGGGTGCTTTTGG
GAAGCCTCAGGGTACCTCTGCTCGCGTGGACATTGGTCAGGTTCTTCTTTCTGTTCGTTGCAAGGAGAGCAATGC
TAAACATGCTGAAGAGGCACTCCGCCGTGCCAAGTTCAAGTTCCCTGGCCGGCAAAAGATCATCCACAGCAGGAA
GTGGGGCTTCACCAAGTTCACCCGTGAGGAGTACGTCAAGTTGAAGGCTGAGGGCAGAATTATGTCTGATGGTGT
CAATGCTAGCTGCTTGGTTCTCATGGTCGTCTTGCGAAGCGTGCCCCTGGGAAGGCGTTTCTGGCTGAGACCAT
TCAACGTTCCGCCGCGGCCGCTTATCCGTATGATGTTCCGGATTATGCCGAGCTCTACAAACAGct
```

> SEQ ID NO:891 215255 231761_301233_2
```
GGCCGGCGAGATGCTACCGCCAGATCAAGAACAAGCCGTACCCGAAATCTCGCTTCTGCCGCGGTGTTCCAGACC
CTAAGATCAGGATCTACGATGTGGGCATGAAGAAGAAGGGCGTGGACGAGTTCCCCTACTGCGTCCATCTGGTGA
GCTGGGAGAAGGAGAATGTCTCGAGCGAAGCCCTTGAGGCGGCTCGAATCGCCTGCAACAAGTACATGGCAAAGT
ACGCCGGCAAGGACGCGTTCCATCTCCGAGTTCGTGTGCACCCCTTCCATGTCCTGCGGATCAACAAGATGCTTT
CGTGCGCTGGCGCTGATCGGCTCCAAACTGGAATGAGGGGAGCTTTCGGCAAGCCGCAGGGAACTTGCGCCCGTG
TTGACATCGGCCAGGTGCTGCTCTCGGTCCGGTGCAAGGACAACAACGGAGTTCACGCGCAGGAAGCGTTGAGGA
GGGCGAAGTTCAAGTTCCCCGGCAGGCAGAAGATCATCGTCAGCCGGAAGTGGGGATTTACGAAGTTCTCTCGCA
CCGACTTCCTCAAGTTCAAGGCGGAGAGCAGGATCGTGAACGATGGCGTGAACGCGaAGCTCCTGACTTGCCACG
GACCACTCTCGTCTCGATCCGcgGAAaccgcTATACTtccgGATGAt
```

> SEQ ID NO:892 215267 113781_300005_1
```
TCCGTGATGCTCAGATCCTCTTAAGTATCGCCTCATCATCCCCTTGGTCAATACCCCCAAAGCAGTTCTAACCTC
TCCTTCCCAACATGGCCGTCGGCAAGAACAAGAGGATTTCCAAGGGAAAGAAGGGAGGAAAGAAGAAGGCGGCGG
ATCCGTATGCCAAGAAGGACTGGTATGACATTAAGGCACCATCAGTTTTTGATATAAAAAACGTTGGCAAAACCC
TTGTTACTAGGACTCAGGGAACTAAGATTGCTTCAGAGGGACTTAAGCATAGAGTTTTTGAAGTGAGTCTGGCTG
ATCTTCAAAAGGATGAGGATCAGGCTTTCAGGAAGATCAGGTTGAGAGCAGAGGATGTGCAAGGAAAGAATGTCC
TCACAAACTTCTGGGGAATGGATTTTACAACTGACAAGTTGAGGTCACTGGTTCGCAAATGGCAGACTTTGATTG
AGGCCCATGTGGATGTCAAAACTACCGACAGCTATACTCTGAGGATGTTCTGCATTGCTTTTACAAAGAAGCGTC
CAAACCAGCAGAAGCGTACCTGTTATGCTCAGAGCAGCCAGATCCGTCAGAT
```

> SEQ ID NO:893 215267 144219_200133_1

Figure 2 continued

```
gttttgcagcattatagcctcagcttcccccttctcccaaaccccccactcctcgtccaaagcAGCTGCAACATCT
CCTTCCCAACATGGCTGTCGGTAAGAACAAGAGGATTTCAAAGGGAAAGAAAGGAGGAAAAAAGAAGGCGGCGGA
TCCGTACGCAAAGAAGGACTGGTATGACATAAAGGCACCATCAGTATTTGATATCAAAAACGTTGGCAAGACCCT
GGTCACTAGGACTCAGGGTACTAAGATTGCTTCGGAAGGACTAAAGCACAGAGTATTTGAAGTCAGTTTGGCTGA
TCTTCAGAAGGATGAGGATCAATCTTTCAGGAAGATCCGCTTGAGGGCAGAAGATGTGCAAGGGAAAAATGTCCT
CACAAACTTCTGGGGAATGGATTTCACAACAGACAAGTTGAGGTCTCTGGTGAAGAAGTGGCAGACATTGATTGA
GGCTCATGTGGATGTCAAGACAACAGATAGCTACACTCTCCGGATGTTCTGCATTGCTTTTACAAAGAAACGTCC
CAACCAGCAGAAGCGGACATGCTATGCTCAGAGCAGCCAGATCCGTCAGATCCGTCGGAAAATGGTTGAGATCAT
GAGAAACCAAGCAAGTTCCTGTGACCTGAAGGAGTTGGTCGCAAAATTTATCCCCGAGTCAATTGGCAGAGAGAT
TGAGAAAGCGACTTCAAGCATCTTCCCACTGCAAAATGTTTATATCCGCAAAGTGAAAATCCTTAAGGCCCCAAA
ATTTGATATTGGCAAGCTGATGGAGGTTCATGGTGACTATTCAGAAGATGTTGGCGTGAAGTTGGATCGACCAGC
TGATGAGAATGTTGCTGAGGCAGAACCCGAAATTCCTGGAGCTTAGACTTGTTTGATTTGGATTCTATCTGAATA
TGGTGCTTGTCTTCTAAATTTATGAATTTCTTTTagtTGaggtGTtaaggcgcgacctatcaaAATATtggatAT
CTTTCtttggcATTCATCag > SEQ ID NO:894 215267    217542_300909_1
GATTCCCATCTCCCCATACGCTGGTAAGGAATCATGGCTGTTGGAAAGTGAGTATCTACGCTGCGAATCTTTGGA
AATGAACGTCGGCCAACAAAAAGAACAGGAACAAGAGACTCTCCAAGGGCAAGAAGGGCCTTAAGAAGAAGACCG
TGGACCCTTTCACCCGAAAGGACTGGTACTCTATCAAGGCTCCTAACCCTTTCAACATCCGAGAGTGAGTCGCAT
TGCAACAGGTTCATAACGAAAAAATGTCGAGAATTTGGACTGACGGATTCTTGCAGTGTTGGCAAGACTCTTGTG
AACCGAACAACCGGTCTCAAGAACGCGAACGATGCTCTGAAGGGCCGCATCGTCGAGGTCTCCCTGGCTGACCTC
CAGAAGGATGAGGACCACTCATTCCGCAAAGTTCGTCTCCGCGTCGACGAGGTCCAGGGCAAGAGCTGCCTGACC
AACTTCCACGGACTTGACTTCACATCCGACAAGCTCCGATCCCTCGTCCGCAAGTGGCAGACTCTCATCGAGGCC
AACATCACCGTCAAGACCACCGATGACTACCTCATCCGCCTCTTCGCCATTGCCTTCACCAAGCGACGCCCCAAC
CAGATCAAGAAGACCACCTACGCTGCTTCTTCCCAGATCCGCGCCATTCGACGCAAGATGACCGACATCATCCAG
CGCGAGGCTTCCAGCTGCACCCTCACCCAGCTGGTTTCCAAGCTGATCCCCGAAGTTATCGGCCGCGAAATCGAG
aagtccACCCagggCATCTACCCCCTgcagaACGtc > SEQ ID NO:895 215267    256071_301646_1
AGGGCGTCGTCGTCGGAGCTCAGTTGCGATGGCCGTCGGGAAGAATAAGCGCATTTCCAAGGGGAAAGAAGGGTGG
CAAGAAGAAAGTGGTTGATCCTTTTTCAAAGAAAGATTGGTATGATATCAAGGCTCCATCAGTCTTCACTATTAG
GACGGTCGGTAAGACCCTTGTTACTCGGACACAGGGTACAAAGATTGCAGCTGATGGCCTGAAGGGGCGTGTTTT
TGAGGTCTCTCTTGCGGACCTCCAAAAGGATGAAGATCAGGCTGCTAGGAAGATCAAGCTTAGGGCCGAAGATGT
GCAAGGAAGGAATGTTCTCACCAATTTCTGGGGGATGAACTTCACTACCGATAAACTCCGCTCTCTTGTAAGGAA
ATGGCAGACTCTTATTGAGGCCCATGTTGATGTGAAGACGACAGATAACTACACTTTGAGAATGTTCTGCATCGC
CTTCACCAAGAAGCGCCCGAATCAGATCAAGAAAACTTGCTACGCACAGTCAAGCCAGATCCGACAGATCCGGAA
GAAAATGACAGAGATCATGGTGAAAGAAGCCGCGTCATGTGACTTGAAAGAGCTTGTTGCAAAGTTCATCCCGGA
AGTAATTGGGAAGGAAATAGAGAAAGCAACTGCTGGAATCTACCCCCTGCAGAACACTTTTATCAGGAAGGT > SEQ ID NO:896 215267    259868_301709_1
AAGCCCTAGCCGCTTCTAGGTTTTTAGGGTTCTTCTCAGCCGGCTGTGCGCCATGGCGGTCGGGAAGAACAAGCG
GATGTCCAAGGGGAAGAAGGGAGGCAAGAAGAAGATCGTCGATCCCTTCTCGAAGAAGGACTGGTACGATGTGAA
GGCGCCGTCCACCTTCAACGTTCGCCAGGTCGGGAAGACACTGGTGACGAGAACACAGGGGACTAAGATTGCCTC
TGATGGTCTTAAAGGCCGTGTTTTCGAAGTGTCATCgggTGATCTGCAAAACAACGACGAGGACCATGCCTTCCG
CAAGATCAAGCTCAGGGCCGAGGATGTCCagggACGCAACGTCCTTACCAACTTCTGGGGAATGGACTTCACGAC
GGACAAGCTCCGGTCCCTCGTCCGCAAGTGGCAGTCGCTCATCGAAGCTCACGTCGATGTGAAGACGACTGACAA
CTACACCTTGAgGCTCTTCTGCATTGGGTtcaccaAGCGCAGGCCCAACCAGGTGAAGCGGACGTGCTATGCGCA
GTCGAGCCAGATCCGCCAgatCCGGaagaagaTGAGGGAGATCATGGTCCGCGAAGCTCagtcgtGcgaccTcAa
ggaccTGGTGGCGAAATTCATCCCGGAGGTGATCGGGAAg > SEQ ID NO:897 215267    253280_301624_1
attAAGACGTGATTAAACACCATGGCTCAGGGAAAGAACAAGCGACTCTCTAAGGGAAAGAAGGGTATCAAGAAG
CGAGTTGTCGACCCCTTCACCAAGAAGGACTGGTACAACATCAAGGCTCCCTCCACCTTTGAGAACCGAGACGTC
GGCAAGACCCTCGTGAACCGATCCACCGGTCTGCGACTCGCCAACGACTACCTCAAGGGCCGAGTGCTCGAGGTG
TCCCTTGCTGATCTGCAGGGCCAGGAGGACCACTCCTTCAAGAAGGTCAAGCTGCGAGTTGACGAGGTCCAGGGC
AAGAACCTGCTCACCAACTTCCACGGCTTTGACTTCACTTCCGACAAGCTGCGATCTCTCGTCCGAAAGTGGCAG
ACTCTGATTGAGGCTAACGTCACCGTCAAGACCTCCGACGACTACTTCCTCCGACTCTTCGTCATCGGTTTCACC
AAGCGACAGGCCAACCAGGTCAAGAAGACCACCTACGCCCAGACCTCTCAGATCAACCAGATCCGAAAGAAGATG
```

Figure 2 continued

ACCGACATTgttgtCCGAGAGGCTTCCAacgTGACTCTtgctcaGCtcaccgcCAAGCTCATCCCCGaGGTtatt
ggccgagAGAttgagaAGGCCACTCAGAACATctaccctCTGCAgaacgtctacATCcgaaaGGtcaa > SEQ ID NO:898  215267  228179_301018_1
GTAGGGCATGAGTTTCACGACCGACAAGCTGAGATCATTGGTCAAGAAATGGCAGACGCTAATAGAGGCTCATGT
GGATGTAAAGACCACTGATAACTACATGCTGCGTCTCTTCTGCATTGGCTTCACCAAGAGGAGGCCAAATCAAGT
CAAACGGACATGCTATGCTCAAGCAAGCCAGATTCGACAGATCCGTCGCAAGATGGTGGAGATCATGGTGAACCA
GGCATCATCCTGTGATCTCAAGGAGCTGGTGTCAAAATTCATTCCTGAGGTGATTGGGAAGGAAATCGAGAAGGC
CACATCAAGCATCTTCCCGCTTCAGAATGTGTTTGTGCGCAAAGTCAAGATCCTCAAGGCCCCAAAATTTGACCT
GGGCAAGCTTATGGAGGTTCATGGAGATTACAAGGAGGACGTTGGGACGAAGCTCGAGAGGCCTGCAGAAGATGA
GGTCGTGGTAGGACAGGAGGTCACTGCCGAGTAGATTTTCACTTATTTTACTGCTATTTTATTCAGACAATATAT
ATATGTATCGCCTATCAAGGTTTTGATCACGAGCAGCAGGCTCGGTTTTTGTGGCTAATTTCCTGAATACTTTCT
TGAGATTACTAGCCAGCATCGTTTTTGTTTTCTGGATGGAAGTTTATTTGTCTAAAGT > SEQ ID NO:899  215267  175611_300543_1
gccgcttccacctcTCTCGCGCCGCCGCCggcGCCGAGCGCCTGGAGCAGCGTCAGCCATGGCCGTAGGTAAGAA
CAAGCGCATCTCCAAGGGGAAGAAGGGATCCAAGAAGAAGACCGTCGATCCCTTTGCTAAGAAGGACTGGTATGA
TATCAAGGCCCCGTCGGTGTTCAATGTGCGGAACATCGGCAAGACCCTCGTGTCCAGGACACAGGGTACAAAGAT
TGCTTCTGAGGGCCTAAAGCATAGAGTGtTTGAGGTCTCCTTAGCTGATCTCCAGAACGATGAGGATCAGGCGTA
CAGGAAGATCAGACTTCGTGCTGAGGATGTGCAAGGGAAGAACGTGCTCACCAACTTTTGGGGCATGTCGTTTAC
TACCGATAAGCTCAGATCACTTGttAaGAAGTGgcaGACACTGAtTgAGGCTCATGTGGATGTCAAAACCACAga
cGgctACATGctgcgTCTgttctgtaTCGGCTTCACCAAGCGgcggcctAACCAGgTgaaGAGgactTgCTATgc
tCaAGCGagTCAGATCAGACAGAttCGTCGcaaGAtggttgAAATCATGgccaaccaGGCTTCAAGCT > SEQ ID NO:900  215267  141956_300430_1
ccCGACCTCTTCTCCCACCTGCGCCGCCGCCACTCACTCCCAAACCCTAACCCCGGAGGAGAGGGAGGAGCAGCC
ATGGCCGTGGGCAAGAACAAGAGGATCTCCAAGGGCAGGAAGGGCAGCAAGAAGAAGACCGTCGATCCCTTTTCC
AAGAAGGATTGGTACGACATCAAGGCGCCGACCGTGTTCTCCGTCCGCAACATCGGCAAGACCCTCGTCTCCAGG
ACCCAGGGGACCAAGATTGCATCTGAGGGTCTCAAGCATCGTGTCTTTGAAGTCTCCTTGGCGGATCTTCAGAAT
GACGAGGATCAGGCTTACAGGAAGGTTAGACTTCGTGCTGAGGATGTTCAGGGGAGGAATGTCCTCACGAATTTC
TGGGGCATGAGTTTTACCACGGACAAACTTAGGTCCTTGGTCAAGAAATGGCAAACATTGATTGAAGCCCATGTG
GATGTTAAGACCACAGATAACTACATGCTCCGCCTGTTTTGCATTGGTTTCACCAAGCGCCGCCCAAATCAGGTG
AAGCGTACCTGTTACGCTCAGgCTAGCCAGATCCGGCAGATCCGCCGGAAGAtggttgaGATCATGGCCAACCAg
gCATCAACATGTGACTTGAAAGAACTggttTCAAAATTCATCCCtgaagTCATTggaaaggagatcGagaagtcA
ACttCaagTATATTccctctccaa > SEQ ID NO:901  215280  111165_300052_1
tcatcgccttcaaatttcTCTCTCAAGGTTTGAGAAAATTTCCTCAATTTCTCGCTTTAGGAGTTCTTTTTTATT
GAATCACCGATTTGGGTGTGTCAAGCCCTAATTTTGAAGTTCATTTTTTCAATTGTTTGTTGTTGATTTTATGTT
ATAACAGATGCAGATCTTCGTAAAAACCCTAACCGGTAAGACCATCACTCTCGAGGTTGAGAGTTCCGACACAAT
CGACAACGTAAAAGCCAAAATCCAGGATAAGGAAGGAATTCCCCCAGATCAGCAAAGGCTTATCTTCGCCGGCAA
GCAGCTTGAGGACGGCCGTACTCTCGCCGATTACAACATCCAGAAGGAATCTACTCTTCACTTGGTCCTCCGTCT
GCGTGGTGGGATGCAGATTTTCGTCAAAACCCTCACCGGCAAAACAATCACCCTTGAGGTGGAAAGTTCTGACAC
CATCGACAATGTCAAGGCTAAAATTCAGGATAAGGAGGGAATTCCACCAGACCAGCAGAGGTTGATCTTCGCTGG
CAAGCAGCTTGAGGATGGTCGTACCCTTGCCGATTACAACATCCAGAAGGAGTCTACCCTTCACCTTGTCCTCCG
TCTCCGTGGTGGTATGCAGATCTTTGTCAAAACGCTCACCGGCAAACCATCACCCTTGAGGTCGAGAGTTCCGA
CACCATCGACAATGTCAAGGCCAAAATTCAGGACAAGGAGGGCATTCCCCCAGACCAGCAGAGGTTGATTTTCGC
TGGCAAGCAGCTCGAGGATGGCCGTACACTAGCTGATTATAACATCCAGAAGGAATCCACCCTTCACCTTGTCCT
CCGTCTCCGTGGTGGTATGCAGATCTTCGTCAAAACACTCACCGGCAAGACCATCACCCTGGAGGTTGAAAGCTC
TGACACCATTGACAATGTTAAGGCCAAGATCCAGGACAAAGAGGGGATTCCCCCAGATCAGCAGAGGTTGATCTT
CGCAGGAAAGCAGTTGGAAGATGGTCGCACCCTTGCGGACTACAACATTCAGAAGGAGTCTACTCTGCACTTGGT
GCTAAGGCTGAGGGGAGGAATGCAGATCTTCGTGAAGACATTGACCGGGAAGACCATCACCTTGGAGGTGGAAAG
CTCTGACACCATCGACAATGTCAAAGCTAAGATCCAGGACAAGGAGGGTATCCCACCGGACCAGCAGAGGTTGAT
CTTTGCTGGTAAGCAGCTTGAGGATGGAAGGACCCTGGCCGACTACAATATCCAGAAAGAGTCAACCCTTCACCT
TGTCCTCCGTCTCCGTGGTGGTTTCTAGGTTGCCTGTTGTTGATGTTGTTGTGTCGTGTTGATTGGCTGTGTCTT
GTTGTGGTCATGATGTGTTTTGTCTACTAAGGTCCCAAAGATGTTCAATTCTGTTTCTGTTCGCCGTTTCTTTCA
TATTTTCTGTTGTGAATAaagacaccagattctgtcctagtgcttaggttttgtgctctctgttggcagtacatg
aactttcctttgttttatccatt

Figure 2 continued

> SEQ ID NO:902 215280 168562_300557_1
gaattcagagctcagacacaattgacaacgttggggctaagattcaagacAAGGAAGGAATTCCTCCAGACCAAC
AACGTTTGATCTTCGCCGGAAAGCAGTTGGAAGATGGAAGAACTTTAGCTGACTACAACATCCAGAAGGAATCAA
CTCTCCATCTTGTCCTTCGTCTTAGAGGTGGTATGCAAATCTTTGTCAAAACCTTGACTGGTAAGACCATCACTT
TGGAAGTCGAGAGCTCTGACACCATTGATAACGTTAAGGCTAAGATTCAAGATAAGGAAGGAATTCCTCCAGACC
AGCAACGTTTGATCTTCGCCGGAAAGCAGTTGGAAGATGGTCGTACTCTTGCCGACTACAACATCCAGAAGGAGT
CTACTCTCCATTTGGTTCTTCGTCTCAGAGGTGGTATGCAGATTTTCGTCAAGACCCTTACTGGAAAGACCATCA
CCTTGGAGGTTGAGAGTTCCGACACCATCGATAATGTCAAGGCTAAGATTCAAGATAAGGAGGGTATCCCCCCAG
ACCAGCAACGTTTGATCTTCGCCGGAAAGCAGCTGGAAGATGGTCGCACTCTTGCCGACTACAACATTCAGAAGG
AGTCTACCCTCCATTTGGTGCTTCGTCTTagaggtggTATGCAAATCTTCGTgaagacCTTGACCgGAaaGACcA
TCACTCt > SEQ ID NO:903 215280 157574_301740_1
AGCGGGTAAACTGAAGAGTGCGCCGCAAAATGCAGATCTTCGTGAAAACCCTAACCGGGAAGACAATCACGCTCG
AGGTTGAATCGAGCGACACCATTGATAATGTCAAGGCTAAGATTCAAGACAAAGAAGGTATTCCACCGGACCAGC
AGCGGTTGATATTCGCCGGAAAGCAGCTCGAAGATGGACGTACTCTTGCTGATTATAACATCCAGAAAGAGTCAA
CTTTGCATTTGGTTTTGAGGCTTCGTGGAGGGATTATTGAGCCTTCTCTGATGGCTTTGGCTAGGAAGTACAACC
AGGATAAGATGATTTGTCGCAAGTGCTATGCTCGCCTGCATCCTCGTGCTGTTAACTGCAGGAAGAAAAAATGTG
GGCACAGCAACCAGCTGAGGCCAAAGAAGAAGATCAAGTAGACGTGATGTCTTTTCTAAGCTTAGATCAATTTTG
CGCGTTGCAGCTATATATTGCCAGTCCGTTGTTTTTACAGTTTTCAGTCCTGCTTCAATTTGATGTCATGGATAA
CAAACATGTCTTAAACATCTAATTATTGGATAAGATATCTTTGTGCACTCAATATATGTCT > SEQ ID NO:904 215280 156472_301366_1
TTCTGCTTTTCCTTCTCTAAGAAGCGTTTGATTCCCAAAAACCGTTTCAAAGATGCAAATCTTTGTAAAGACCCT
CACTGGCAAAACCATCACTCTCGAGGTTGAGAGTTCAGACACTATCGACAATGTTAAGGCAAAGATCCAAGATAA
GGAAGGAATTCCTCCAGATCAGCAAAGGTTGATCTTTGCTGGAAAGCAGTTAGAGGATGGCCGAACTCTTGCTGA
CTACAATATCCAAAAGGAGTCTACCCTCCACCTTGTCCTTCGTCTGCGTGGTGGTATGCAGATCTTTGTAAAAAC
TTTAACAGGGAAGACTATCACTCTCGAGGTTGAGAGCTCGGACACAATTGATAATGTTAAGGCAAAGATTCAGGA
CAAGGAAGGCATTCCTCCGGATCAGCAAAGGTTGATCTTTGCTGGAAAACAACTTGAGGATGGTCGTACCCTTGC
TGACTACAACATCCAAAAGGAGTCCACCCTCCACCTTGTTCTCCGTTTGCGTGGTGGTATGCAGATCTTTGTAAA
AACTTTGACAGGAAAGACTATTACCCTTGAGGTTGAGAGTTCCGATACAATTGACAATGTCAAAGCTAAAATCCA
GGATAAAGAAGGCATTCCTCCAGATCAGCAGAGGttGATCTTCGCTggaaagcaaCTtg > SEQ ID NO:905 215280 155170_301353_1
atTCTCATTATCTCCTCAACTTTTCTCTCTTTATTCAAACGCCTCTCAAGATGCAGATCTTCGTCAAAACCCTAA
CTGGAAAGACGATAACCCTTGAGGTTGAAAGCTCCGACACAATTGACAACGTTAAGGCGAAGATTCAGGACAAGG
AAGGAATTCCACCGGATCAGCAGAGGCTGATCTTCGCCGGAAAGCAGCTCGAAGACGGCAGAACCCTAGCCGACT
ACAACATCCAGAAGGAATCGACTCTTCACTTGGTGCTCCGTCTTCGTGGCGGTATGCAAATCTTCGTCAAAACCC
TAACAGGGAAAACAATCACCCTTGAAGTTGAAAGCTCCGACACTATTGATAACGTTAAGGCGAAAATCCAGGATA
AAGAGGGAATCCCACCAGATCAGCAGAGGTTGATCTTTGCTGGCAAACAGTTGGAAGATGGAAGAACTCTAGCTG
ACTACAACATCCAGAAAGAATCCACTCTCCATCTCGTCCTCCGTCTCAGAGGTGGTATGCAAATATTTGTGAAAA
CCCTCACTGGCAAGACCATTACTTTGGAAGTGGAGAGTTCTGATACCATCGACAATGTCAAGGCCAAGATCCAAG
ATAAGGAAGGTATTCCTCCAGACCAGCAGAGGTTGATTTTTGCTGGGAAGCAGTTGGAAGATGGGCGTACCCTTG
CTGACTACAACATCCAGAAGGAATCCACCCTTCACCTGGTTCTACGACTAAGAGGTGGTATTGCAGATCTTTGTG
AAAACGCTTACTGGAAAGACCATCACCTTAGAAGTTGAGAGTTCAGATACCATTGACAATGTAAAAGCCAAAATT
CAggACAAGgaaggtATTCCTccagaccAGCAACGTTTGA > SEQ ID NO:906 215280 143611_200045_1
actttctctttacttcaaacgcctctcaagagcagatcttcgtcaaaacccttaccGGAAAGACGATAACCCTT
GAGGTTGAAAGCTCCGACACAATTGACAACGTTAAGGCTAAGATTCAGGACAAAGAAGGAATCCCACCGGACCAG
CAAAGGTTGATCTTCGCCGGAAAGCAGCTCGAAGACGGCAGAACCCTAGCTGATTACAACATCCAAAAGGAATCC
ACCCTTCACTTGGTGCTCCGTCTTCGTGGCGGTATGCAAATCTTTGTTAAAACCCTAACCGGGAAAACAATAACC
CTTGAAGTCGAAAGCTCTGACACAATTGACAATGTCAAGGCGAAGATTCAGGACAAGGAGGGAATCCCTCCAGAC
CAGCAAAGGTTGATTTTTGCCGGAAAGCAACTCGAAGACGGCAGAACCCTAGCTGATTACAACATCCAGAAGGAA
TCGACCCTTCACTTGGTCCTTCGTCTTCGTGGTGGGATGCAGATCTTCGTCAAAACCTTAACTGGGAAAACAATC
ACCCTTGAAGTCGAAAGCTCCGACACCATTGACAATGTCAAGGGTAAAATCCAGGATAAGGAGGGAATCCCACCA
GACCAGCAAAGGTTGATTTTTGCTGGTAAGCAATTGGAAGATGGCCGTACCCTAGCTGATTACAACATTCAAAAG
GAGTCGACTTTGCACCTTGTGCTCCGTCTTCGTGGTGGGATGCAGATTTTCGTGAAGACATTGACCGGGAAAACC
ATCACTCTTGAGGTGGAAAGCTCTGACACTATTGACAACGTTAAGGCCAAAATCCAGGATAAGGAGGGAATCCCA

Figure 2 continued

CCAGACCAGCAGAGATTGATTTTTGCTGGTAAGCAGCTGGAGGATGGCCGAACCCTCGCTGATTACAACATTCAG
AAGGAGTCTACCCTTCACTTGGTTCTCCGTCTCCGCGGTGGGATGCAGATCTTCGTCAAAACACTCACTGGGAAG
ACAATCACCCTCGAAGTTGAAAGCTCCGATACTATCGACAATGTTAAGGCTAAGATTCAGGACAAGGAAGGTATT
CCACCGGACCAGCAGAGATTGATTTTTGCTGGTAAGCAGTTGGAAGATGGGAGAACTTTAGCTGATTATAATATC
CAGAAGGAATCCACACTGCATTTGGTGCTCCGTCTTCGTGGTGGGATGCAGATTTTTGTGAAGACGTTGACCGGG
AAAACCATCACTTTGGAGGTAGAGAGTTCTGATACGATCGACAATGTGAAGGCTAAGATTCAGGACAAGGAGGGT
ATCCCGCCAGATCAGCAGAGGCTGATTTTTGCTGGGAAGCAGTTGGAAGATGGAAGGACTCTGGCTGATTATAAT
ATTCAGAAGGAGTCGACTCTGCACCTTGTCCTCCGTCTCCGTGGTGGTTTCTAAAGTGTCCGTCAATAGTGGTGG
TAATGTCTGTGTCTTGGGTCTTGGGTCTGTTCGGTGTTTGTTTGATTCATGATTTAGTAGTTTGTGTAGTTTTTG
TTAGTTGTCATCATGTTATGCCTTCAAAAGAAGGAAGGAGACTTGTCCTCTTTGTCTCTGTTTGCGAATAATAAA
GTTCGAATTATGGTTT

> SEQ ID NO:907 215280 139045_300406_1
ccccgagccaagaggggaaaaaaaaagggaagaaattttttttcttttttttttgttcgcctccgcttcttcctca
cgcagCTCTCGCCTCGCCTCGCCGCCCGCCACTAGAGAGGAGAGGGAGAAGGAGAAGGAGGCGAATCCCAGCAAA
AGAAGATGCAGATCTTCGTGAAGACCCTGACTGGGAAGACCATCACCCTCGAGGTGGAGAGCAGCGACACCATCG
ACAATGTCAAGGCTAAGATCCAGGACAAGGAGGGAATCCCGCCGGACCAGCAGCGGCTGATCTTCGCCGGGAAGC
AGCTGGAGGACGGACGCACCCTGGCTGACTACAACATCCAGAAGGAGTCCACCCTCCACCTCGTCCTCAGGCTCC
GTGGCGGTATCATCGAGCCGTCGCTTCAGGCGCTTGCCCGCAAGTACAACCAGGACAAGATGATCTGCCGCAAAT
GCTATGCGCGCCTGCACCCTAGGGCTGTCAACTGCCGCAAGAAGAAGTGTGGTCACAGCAACCAGCTGAGGCCCA
AGAAGAAGATCAAGAACTAGAGCGTCACTCGCCGGGTTCATGGACTGGTTAAATCAATCGTCATATTAGACTTTT
ATGCTTCCGTTGTTaTCTCCCTGGATGTTGTTGAACCGTGTTTTACTGTGCTGGATGCTtcagCTTCTTGTTTTG
ACGGTCGTGGTATATGGTAAttGgcagcaaaCTATAttggtcatgtcgaAATtGTc > SEQ ID NO:908 215280 138074_300688_1
cGAAAAATTTCTCCCCAATCTCGCGAGGCTCTCGTCGTCGAATCGAATCCTCTCGCGTCCTCAAGATGCAGATCT
TTGTGAAGACATTGACCGGCAAGACTATCACCCTCGAGGTGGAGTCCTCTGACACCATCGATAATGTCAAGGCTA
AGATCCAAGATAAGGAGGGCATCCCCCCGGACCAGCAGCGTCTCATCTTCGCTGGCAAGCAGCTGGAGGATGGCA
GGACCCTTGCTGACTACAACATCCAGAAGGAGTCGACCCTTCACCTTGTCCTCCGCCTCCGTGGTGGCATGCAGA
TCTTTGTCAAGACTCTGACCGGCAAGACTATCACCCTTGAGGTGGAGTCTTCTGACACCATCGACAACGTCAAGG
CCAAGATCCAGGACAAAGAGGGCATCCCCCCAGACCAGCAGCGTCTCATCTTCGCCGGCAAGCAGCTGGAGGATG
GCAGGACCCTTGCTGACTACAACATCCAGAAGGAGTCCACCCTCCACCTTGTCCTCCGCCTCCGTGGTGGCATGC
AGATCTTTGTCAAGACACTGACCGGCAAGACCATCACCCTCGAGGTGGAATCTTCTGACACCATCGACAACGTCA
AGTCCAAGATCCAGGACAAGGAGGGCATTCCCCCGGACCAGCAGCGTCTCATCTTTGCCGGCAAGCAGCTTGAGG
ACGGCAGGACCCTTGCTGACTACAACATCCAGAAGGAGTCAACGCTTCACCTTGTCCTCCGTCTCAGGGGAGGCA
TGCAAATCTTCGTGAAGACTCTGACCGGCAAGACCATCACCCTCGAGGTGGAGTCTTCTGATACCATCGACAATG
TCAAGGCCAAGATCCAGGACAAGGAGGGCATTCCCCCGGACCAGCAGCGCCTCATCTTTGCTGGCAAGCAGCTGG
AGGATGGCAGGACCCTTGCTGACTACAACATCCAGAAGGAGTCCACCCTCCACCTTGTGCTCCGCCTTCGTGGTG
GTATGCAGATCTTTGTCAAGACCCTCACAGGCAAGACCATCACCCTGGAGGTTGAGAGCTCGGACACCATCGACA
ACGTCAAGGCCAAGATCCAGGACAAGGAGGGCATCCCCCCAGACCAGCAGCGTCTCATCTTCGCCGGCAAGCAGC
TCGAGGATGGCCGCACCCTCGCCGACTACAACATCCAGAAGGAGTCTACCCTCCACCTGGTGCTTCGTCTCCGTG
GTGGTATGCAGATCTTCGTGAAGACCTTGACTGGGAAGACCATCACTTTGGAGGTTGAGAGCTCCGACACCATTG
ATAATGTGAAGGCCAAGATCCAGGACAAGGAGGGGATTCCCCCAGACCAGCAGCGTCTGATCTTCGCTGGCAAGC
AGCTGGAGGATGGACGCACCCTCGCCGACTACAACATCCAGAAGGAGTCCACCCTCCACCTGGTGCTCCGCCTCC
GTGGTGGTCAGTAATCAGCCAGTTTGGTGGAGcTgccGATGTGCCTGGTCGTCCCGAGCCTCTGTTCGTCAAGTA
TTTGTGGTGCTGATGTCTACTTGTGTcTGGTTTAATGGACCATCGAGTCCGTATGATATGTTAGTTTTATGAAAC
AGTTTCCTGTGGGACAGCAGTATGCTTTATGAATAAGTtggatTTGAACCTAaAT > SEQ ID NO:909 215280 137679_300726_1
attattactcgaccacgcgtcgaAAAATCTCCCCTCGAAGCGAAGCGTCGAATCGCCTTCTCAAGATGCAGATCT
TTGTGAAGACCCTCACCGGCAAGACCATCACCCTCGAGGTTGAGTCCTCGGACACCATTGACAATGTCAAGGCCA
AGATCCAGGACAAGGAGGGCATCCCCCCGGACCAGCAGCGTCTCATCTTCGCTGGCAAGCAGCTTGAGGATGGCC
GCACCCTGGCCGACTACAACATCCAGAAGGAGTCCACCCTCCACCTTGTCTCAGGCTCAGGGGAGGCATGCAGA
TCTTCGTCAAGACCTTGACTGGCAAGACCATCACCCTTGAGGTCGAGTCGTCTGACACCATTGACAATGTCAAGG
CCAAGATCCAGGACAAGGAGGGCATCCCCCCAGACCAGCAGCGTCTCATCTTCGCCGGCAAGCAGCTGGAGGATG
GCCGCACCCTTGCTGACTACAACATCCAGAAGGAGTCCACCCTCCACCTTGTGCTCAGGCTCAGGGGAGGTATGC
AGATCTTCGTCAAGACCCTGACCGGCAAGACCATCACCCTCGAGGTCGAGTCCTCGGACACGATCGACAACGTGA
AGGCCAAGATCCAGGACAAGGAGGGCATCCCCCCGGACCAGCAGCGTCTCATCTTCGCTGGCAAGCAGCTGGAGG
ATGGCCGCACCCTTGCCGACTACAACATCCAGAAGGAGTCCACCCTCCACCTTGTGCTCAGGCTCAGGGGTGGTA

Figure 2 continued

```
TGCAGATCTTCGTCAAGACCCTGACCGGCAAGACCATCACGCTTGAGGTCGAGTCCTCGGACACGATCGACAACG
TGAAGGCCAAGATCCAGGACAAGGAGGGTATCCCCCCGGACCAGCAGCGTCTCATCTTCGCCGGCAAGCAGCTGG
AGGATGGCCGCACCTTGGCTGACTACAACATCCAGAAGGAGTCCACCCTTCACCTGGTTCTCAGGCTCAGGGGTG
GGATGCAGATCTTCGTGAAGACCCTGACTGGCAAGACCATTACCCTTGAGGTTGAGTCGTCCGACACTATTGACA
ACGTGAAGGCGAAGATCCAGGACAAGGAGGGCATCCCCCCGGACCAGCAGCGTCTGATCTTTGCTGGTAAGCAGC
TTGAGGATGGCCGCACCCTTGCGGATTACAACATCCAGAAGGAGTCCACACTCCACCTGGTGCTCCGCCTCCGTG
GTGGCCAGTAAGTCCTCAGCCATGGAGCTGCTGCTGTTCTAGGGTTCACAAGTCTGCCTATTGTCTTCCCCAATG
GAGCTATGGTTGTCTGGTCTGGTCCTTGGTCGTGTCCCGTTTCATTGTGTACTATTTACCTGTAATGTGTATCCT
TAAGTCTGGTTTGATGGTGTCTGAAACGTTTTGCTGTGGTAGAGCAGCATGGAAGAACTATAATGAATAAGTGAT
CCCTAATCATTGTGTCC
```

> SEQ ID NO:910 215280 132571_300447_1
```
cccacgcgtgcgcggacgcgtgGGCTCTCCTCACCTTGCAATTCTTGGTGCACATAGTTGGCAAGGATGCAGATA
TTCGTGAAGACCCTGACAGGGAAGACTATTACCTTAGAGGTAGAGTCATCCGACACCATTGACAATGTTAAGGCT
AAGATTCAGGACAAGGAAGGCATTCCACCAGACCAGCAGCGGTTGATTTTCGCAGGTAAGCAGCTTGAGGATGGC
CGAACACTAGCCGACTACAACATCCAGAAGGAGTCCACCCTCCACCTTGTCCTTCGCCTCCGTGGTGGTGCCAAG
AAGCGTAAGAAGAAGACTTACACTAAGCCAAAGAAGATTAAGCACAAGAAGAAGAAGGTTAAGCTCGCCGTCCTC
CAGTTTTACAAGGTTGATGATTCTGGTAAGGTTCAGAGGCTCCGCAAGGAGTGTCCCAACGCCGAGTGTGGTGCC
GGGACTTTCATGGCTAACCACTTTGACAGGCACTATTGTGGTAAATGTGGGCTTACCTATGTTTACCAGAAGGCT
GGTGGTGATTAGATGAGTGTTACTTTGCTTATTACTTTTCCCCACATTTCTTGCCTTAAACTCTCCTAATGTCTT
GTTTGTGACAAGATGTAATGAATTTGAATTATGGTATTGTGTAacaGCTTATGaaATTAaGgatttTTgTcAGT
t
```

> SEQ ID NO:911 215280 127155_300468_1
```
AGAAACCCTAGCGCCGCAGTGGTCATCGAGTTCTCTCCTCCAAAGCGAAGATGCAGATCTTCGTGAAAACCCTAA
CAGGTAAAACAATCACCCTTGAGGTTGAATCTTCCGACACAATCGACAATGTGAAAGCCAAGATCCAAGATAAGG
AAGGGATTCCCCCAGATCAGCAGCGTCTGATTTTCGCCGGAAAACAGCTTGAAGACGGCCGTACCCTAGCTGATT
ACAACATCCAGAAGGAGTCGACTCTTCATCTCGTGCTCCGCCTCCGTGGTGGTGCTAAGAAGAGGAAGAAGAAGA
CTTACACCAAGCCTAAGAAGATTAAGCACAAGAAGAAGAAGGTTAAGCTCGCTGTGCTTCAGTTCTACAAGGTGG
ATGATTCTGGTAAAGTCCAGAGGCTGCGTAAGGAGTGTCCTAATGCTGAGTGTGGTGCTGGAACTTTTATGGCTA
ACCACTTTGACCGTCATTACTGTGGTAAGTGTGGGCTCACCTATGTTTACAACAAGGCCGGCGCCGATTGAGGCT
TATGCTTAGCTCTGTTTTAATGCTGTCGTCAATTTTATCCTTTTGTCGAACGGTAATTTAGTATGGATTTTCCTT
TTTAAATGGTGTGGTAACTATGGGAATTTTGAGTTATTTTTAAAgttTTTGCTTATTATTCTtaaagttTtaggt
taTTATCTCaaaTTTTATatccttAaTTATCTACTTTATa
```

> SEQ ID NO:912 215280 46816_300192_1
```
AAAACCCTCACCGGAAAAACCATAACCCTAGAGGTCGAAAGCAGCGACACCATCGACAATGTCAAAGCCAAAATT
CAGGACAAAGAGGGAATACCACCTGATCAACAGAGGTTGATATTTGCTGGTAAGCAGCTTGAAGATGGTAGAACA
TTAGCGGATTACAACATTCAGAAAGAATCGACTCTTCACTTGGTATTGAGGCTTAGGGGTGGGACTATGATTAAG
GTGAAGACTCTCACAGGGAAGGAAATTGAGATTGATATCGAACCAACCGATACTATTGATCGGATTAAGGAACGT
GTTGAGGAGAAAG
```

> SEQ ID NO:913 215280 4655_300310_1
```
aCACCATTGACAACGTGAAGGGCCAAGATCCAGGATAAGGAAGGAATCCCTCCGGACCAGCAGAGGTTGATCTTT
GCCGGAAAACAATTGGAGGATGGTCgTACTTTGGCGGATTACAACATCCAGAAGGAgacgACCCTTCACTTGGTG
TTGCGTCTGCGTGGAGGTATGCAGATCTTCGTCAAGACTTTGACCGGAAAGACCATCACCCTTGAAGTGGAAAGC
TCCGACACCATTGACAACGTCAAggcCAAGATCCAGGACAAGGAAGGTATTCCTCCGGACCAGCAGCGtctCata
ttcGctGgaAAGCAGCTTGAGGATGGACGTACTTTGGCCGaatacAACATCCAGAAGGAgtctACtcttCACTTG
GTCCTGCGTCTTCGTGGTGGtttctaaAtctCgTctCTGTTATGCTTAAGAAGTTCaaTGTTTCGTTTCATGTAA
AACTTTGGTGGTTTGTGTTTTGGGGCCTTGTATAATCCctgATGAataagtgttctactatgtttccgttcctgt
tatctccctctttctaatgacaagtcgaacttcttcttacaaaaaaaag
```

> SEQ ID NO:914 215280 39255_300206_1
```
CCCACGCGTCCGCTCAAAATCTTAAAAACTTTCTCTCAATTCTCTCTACCGTGATCAAGATGCAGATCTTTGTTA
AGACTCTCACCGGAAAGACAATCACCCTCGAGGTGGAAAGCTCCGACACCATCGACAACGTTAAGGCCAAGATCC
AGGATAAGGAGGGCATTCCTCCGGATCAGCAGAGGCTTATTTTCGCCGGCAAGCAGCTAGAGGATGGCCGTACGT
TGGCTGATTACAATATCCAGAAGGAATCCACCCTCCACTTGGTCCTCAGGCTCCGTGGTGGTATGCAGATTTTCG
TTAAAACCCTAACGGGAAAGACGATTACTCTTGAGGTGGAGAGCtCTGAcacCATTGACAtCGTCAAGGCCAAGA
TCCAAGATAAGGAGGGTATTCCTCCGGACCAGCAGAGGTTGATCTTCGCCGGAAAGCAACTTGAGGACGGCAGAA
```

Figure 2 continued

CTTTGGCGGATTACAACATCCAGAAGGAGTCTACGCTTCATTTGGTCTTGCGTCTGCGTGGAGGTATGCAGATCT
TCGTAAAGACTTTGACCGGAAAGACCATCACTCTTGAAGTTGAGAGCTCCGACACCATTGATAACGTGAAGGCTA
AGATCCAGGACAAGGAAGGCATTCCTCCGGACCAGCAGCGTCTCATCTTCGCTGGAAAGCAGCTTGAGGATGGAC
GTACTTTGGCCGACTACAACATCCAGAAGGAGTCTACTCTTCACTTGGTCCTCCGTCTCCGTGGTGGTTTCTAAA
CCTTGTCTCTCTCTCTTATGGTTACTGAACCAAGTTCATGTATCGTTTCATCTAGTACTTTGGTGGTTTATGTTT
TGGGGCCATGTAcAGCCTCTGATAAATAATTGATCGACTATGTTTCCGTTA

> SEQ ID NO:915 215280  251290_301655_1
gtatTCTCTAGCAGCCACGATGCAGATCTTCGTCAAGACCCTGACCGGCAAGACCATCACCCTCGAGGTGGAGAG
CTCCGACACGGATTGACAACGTTAAGACGAAGATCCAGGACAAGGAAGGGATCCCTCCTGACCAGCAGCGCCTCAT
CTTCGCCGGCAAGCAGCTCGAGGATGGACGAACTCTCGCCGACTACAACATCCAGAAGGAATCCACCCTTCACCT
GGTGCTGCGTCTCCGCGGAGGCATGCAAATCTTCGTCAAGACCCTGACCGGCaAGACCATCACTCTGGAGGTGGA
GAGCTCGGATACCATCgacaaCGTgaagaCgaacatCcatgaCAaggaacggATCCCCCCTGacCAgcagaggCT
CATCTTCgccggGaagcaactcgaggATGGcaggaCTCTGgct > SEQ ID NO:916 215280  248863_301587_1
tcatcaattaggtttcttcgatagcaagtagcgatgcagatcttcgtcaagactctcaccggcaagactatcacc
tTGGAGGTGGAGAGCTCCGACACCATCGACAACGTCAAGACCAAGATCCAGGACAAGGAAGGGATCCCTCCGGAT
CAGCAGCGGTTGATCTTTGCCGGCAAGCAGCTTGAGGACGGGCGTACCCTCGCCGACTACAACATCCAGAAGGAG
TCTACGCTGCATCTTGTTCTTCGGCTGCGAGGAGGTATGCAAATATTCGTCAAGACCCTAACGGGTAAGACGATC
ACTCTGGAGGTCGAGAGCTCCGACACCATCGACAACGTCAAGACCAAGATCCAGGACAAGGAAGGGATCCCGCCG
GATCAGCAGCGTCTGATCTTCGCTGGCAAGCAGCTCGAGGATGGCCGTACCCTGGCCGACTACAACATCCAGAAG
GAGTCGACCCTTCATCTTGTGCTGCGTCTGCGAGGAGGCATGCAGATCTTCGTTAAGACCCTCACTGGTAAGACG
ATCACCCTGGAAGTCGAGAGCTCGGACACCATCGACAACGTTAAGACTAAGATCCAGGACAAGGAAGGGATCCCG
CCGGATCAGCAGCGTCTGATCTTCGCTGGCAAGCAGCTCGAGGATGGCCGTACCCTGGCCGACTACAACATTCAG
AAGGAGTCTACACTCCATTTGGTGCTGCGTCTGCGAGGAGGCATGCAGATCTTCGTCAAGACCCTCACTGGTAAG
ACGATCACCCTGGAAGTCGAGAGCTCGGACACGATCGACAACGTGAAGACCAAGATCCAGGACAAGGAGGGAATT
CCTCCGGACCAGCAGCGGttGATCTTCGCGGGTAAGCAGCTCGAGGATGGGCGCACTCTTGCCGACTACAACATT
CAGAAGGAGTCTACACTCCATTTGGTGCTGCGTCTTCGCGGAGGCATGCAGATCTTCGTCAAGACCCTCACGGGT
AAGACGATCACCCTGGAAGTCGAGAGCTCAGACACCATCGACAACGTGAAGACCAAgAtCCagga > SEQ ID NO:917 215280  248264_301581_1
gttggtCGAGGCGAGGAGAGCGGCGGCGAAGAAGGACAAGTCTGGAGCCATGCAGATCTTCGTCAAGACATTGAC
TGGGAAGACAATCACCCTCGAGGTTGAGTCGTCGGACACGATCGACAATGTGAAGACCAAGATCCAGGACAAGGA
AGGGATCCCTCCCGACCAGCAGCGGCTGATCTTCGCGGGCAAGCAGCTGGAAGATGGCCGGACGCTGGCGGACTA
CAACATCCAGAAGGAGTCGACCCTCCACCTTGTTCTTCGCCTCCGGGGTGGCGGCAAGAAGAGGAAGAAGAAGAC
GTACACCAAGCCCAAGAAGATCAAGCACAAGAAGAAGAAGGTGAAGCTGGCGGTGCTCCAGTACTACAAGGTGGA
CGATTCGGGCAAGGTGAACAGGCTGCGCAAAGAGTGCCCGAATCCAGAGTGCGGTGCCGGGACGTTCATGGCGAA
CCACTTTGATCGGCACTACTGCGGCAAGTGTGGACTCACCTACGTCTACCAGAGAGCTGAAGCTTAGAGAGGATG
ACGAGCTTTGCTCTCTTGTGTTTCTATCCAATTTTCTTTGAACGAAAGTATAATCTTTTCTtttgtttc > SEQ ID NO:918 215280  229245_301041_1
GGGAGAATCAACGTTTCTTGGTAAGTCATAGCTATGGCGCTTATAGAATTTTGGGGCTTCTTGTAATTCTTGGAT
AATGACATGGGTATGACTGTTTGTAGATGATTTTCCGCTAGATGTTCTATATTAGGGTGTCGTTGTCCTTATGTT
GATTCCTTTGTCTATCCTAGCAGCAACGATGCAGATCTTCGTCAAGACCCTGACCGGTAAGACCATCACTCTGGA
GGTCGACAGCTCTGATACTATCGACAATGTAAAGACCAAGATCCATGACAAGGAAGGGATCCCCCCGGACCAGCA
CAGGCTCATCTTTGCCGGTAAGCAGCTCGAGGATGGACGGACTCTGGCCGACTACAACATCCAGAAGGAGTCGAC
TCTCCATCTCGTCCTACGTCTTCGCGGAGGTATGCAGATCTTCGTCAAGACCCTCACCGGCCAAGACCATCACGCT
CGAGGTGGAGAGCTCCGACACGATCGACAACGTAAAGACCAACATCCACGACAAGGAAGGTATCCCCCCGGACCA
GCATCGACTCATCTTTGCCGGGAAGCAGTTCGAGGATGGACGAACGCTCGCCGACTACAACATCC > SEQ ID NO:919 215280  228048_301033_1
AATCGACCGAAGGGGAGGGGAGCGAAGCTTTGCGTTCTCTAATCGCCTCGTCAAGATGCAGATATTCGTTAAGA
CCCTCACTGGCAAGACCATCACCTTGGAGGTTGAGTCCTCCGATACGATTGACAATGTGAAGGCTAAGATTCAGG
ACAAGGAGGGCATCCCTCCGGACCAGCAACGCCTTATCTTCGCTGGCAAGCAGCTTGAGGATGGGCGTACTCTCG
CGGATTATAACATCCAGAAGGAGTCCACCTTGCACCTTGTCCTCCGCCTTCGTGGAGGCATGCAAATATTCGTGA
AGACCCTCACCGGCAAGACCATTACCCTGGAGGTCGAGTCCTCCGACACGATCGATAATGTGAAGGCCAAGATCC
AGGACAAGGAGGGAATCCCACCAGACCAGCAGCGTCTCATCTTTGCTGGGAAGCAGCTCGAGGATGGCCGCACCC
TTGCAGACTACAACATCCAAAAGGAATCCACCCTGCACCTTGTCCTGCGCCTCCGGGGCGGTATGCAGATCTTTG

Figure 2 continued

TGAAGACCCTTACTGGCAAGACGATCACCTTGGAGGTTGAGTCCTCTGACACGATCGACAATGTGAAGGCCAAGA
TCCAGGACAAGGAGGGTATTCCACCAGAcCAGCAgcgCCTCATCTTCGCTGGCAAGCA > SEQ ID NO:920  215280  224458_300972_1
ggcatactactggtgatttctaaacatgcagatcTTTGTGAAGACCTTGACCGGCAAGACTATCACCCTCGAGGT
GGAGAGCTCGGATACCATCGACAACGTTAAGACCAAGATCCAGGACAAGGAAGGGATCCCACCTGACCAGCAACG
ATTGATCTTCGCCGGGAAGCAGCTTGAGGACGGACGGACCCTTGCGGACTACAACATCCAGAAGGAATCCACGCT
TCACCTGGTTCTTCGTCTCCGCGGTGGCATGCAGATATTTGTGAAGACCTTGACCGGCAAGACCATCACCCTCGA
GGTGGAGAGCTCGGATACCATCGACAATGTCAAGACCAAGATCCAGGATAAGGAGGGGATTCCTCCGGACCAGCA
GCGACTTATCTTCGCCGGGAAGCAACTCGAGGACGGACGGACCCTTGCCGACTATAACATCCAGAAGGAGTCGAC
TCTCCACTTGGTTCTTCGTCTCCGCGGTGGCATGCagaTAtttgtgAAGACACTGACCGGCAAGACCATCACCCT
CGaGgtggagAGCTCGGATACcaTCGACAATGTCaagaccaagATCCaggataaggagGGgatcctCCggaccag
cagcgttTGATCTTCGCTGGGaagcaGCT > SEQ ID NO:921  215280  194361_300762_1
ctcgccgccgcagccgcggaggcgaccccctccccgccgccgccAAGATGCAGATCTTCGTGAAGACCCTGACGG
GGAAGACCATCACGCTGGAGGTGGAGTCCTCGGACACCATCGACAACGTGAAGGCCAAGATCCAGGACAAGGAAG
GCATCCCTCCGGACCAGCAGCGCCTCATCTTCGCCGGCAAGCAGCTGGAGGATGGCCGCACCCTGGCCGACTACA
ACATCCAGAAGGAGTCCACGCTCCACCTCGTCCTCCGCCTCCGCGGTGGCATCATCGAGCCCTCCCTCCAGGCCC
TCGCCCGCAAGTACAATCAGGACAAGATGATCTGCCGCAAGTGCTATGCTCGGCTGCACCCCAGGGCTGTCAACT
GCCGCAAGAAGAAGTGCGGCCACAGCAACCAGCTGAGGCCCAAGAAGAAGATCAAGAACTAGAGTTTGAGATATC
ATTTCCGCGGATCATTGAAATCAACAGGAAGATCAGAGTTTAAGTTTTTTTGTAGTGTAATGCCTCATGTTGTAT
GCCGAACTTTCTGTTTATCCTGTTGTATGTTAACCTTGGTTACGCTGGAGAGTACTCCAGCTTATTTTGATGACA
TAATTGACTAcaaAGTcaaggttATATGGtccggCCTtaaTTTTTGtcCCCTtCG > SEQ ID NO:922  215290  205820_300802_1
ATCAACCACTCTCAAGCAACAATAACAACCTTTACCCAACTTCAAAGACTTTCAGTCTCTCAACTCAACACCTTC
AAGATGTCTCCCTGGTGAGTCTTCTGAGGACCATTGGTCCATCACTTGCTCGGGAGTTCCTCTTTGCTTTACCTT
CAGCGTTCCACTACCTGATCTATGATACCTTCTTTCCCACCACCGAGCAAAGCACTCATTAGACATGTCACTAAC
GATTTTCTTTCAATAGCGCATGCAACTCCTGTGGATGCAAGGACAACTGCTCCAGCTGCTCCTGCACCAGCTGCA
GCGTAAGTCCTGCTTCTCTCCCCTGCTTTGGGCATTGAGAAACTTTTCCACCAGAAAGCTAACAGATGGGAACAT
ATAGCACTAAATCATCGTGCTCTTTTTCCTTCGCTGGATCTATACTCTCTCGGAATGACAGCTTGAGGGCTCGGA
TGTGCTTAAGACGCCATGGGAAGGGCAAGGCATTTGGGCGAATAGACCTCCATCATGTGGGATATAGCAGAATAG
GAATTTGAAGATTTTGCCCTAACACACATATAATTTGCTTGTGAAg > SEQ ID NO:923  215290  218793_300921_1
gggacaagcagcccgagtctttcttctccgagagcgctgtttcttgaatctttgtttccgccacatcctccgtga
agcccGAGAAAAAAACATCTCTAGCATCAGAAGATCCTATAAAAGATAAAAAAGACTTATACAAAAAATCCTTCC
TCGCAAGGGAAGCGCCGGAGCAACAACATGCCCATAGCACTGTCCCCTCCCTTCCGGCCAAGAAATGGCTTGACC
AAGTTCACCAACTGCCGCCTCCTGCGCGGCGATAAGCTGGTCGAGGAGGATCTCTGGGTCAGCTCGCTGTCTGGC
AAGGTTGTCAACAGCCAGGCTGCCTTTTTCGATGACCTCGTTCTCCCTGACCAGACCATCGACCTCGACGGCCGC
ATCATCTCGCCGGGCATGATTGATGTGCAGCTCAACGGCGCGTTCGGCTTCAACTTCTCGACGCTGCTCGATGAC
ATGTCACAGTACGGCAAAAAGGTCAAGGAGGTGCagaAGTTGCTGGTGCAgaCGGGCGTCACATCGTACAATCCC
ACCATCACCAGCCAGAGGCCAGAACTATACCAGAAGCGCATGCAACTCCTGTGGATGCAAGGACAACTGCTCCAG
CTGCTCCTGCACCAGCTGCAGCCACTAAATCATCGTGCTCTTTTTCCTTCGCTGGATCTATACTCTCTCGGAATG
ACAGCTTGAGGGCTCGGATGTGCTTAAGACGCCATGGGAAGGGCAAGGCATTTGGGCGAATAGACCTCCATCATG
TGGGATATAGCAGAATAGGAATTTGAAGATTTTGCCCTAACAC > SEQ ID NO:924  215290  215159_300878_1
GTTTTCCAAGGATTTACTCCAGCTTGCAGGGGCCAAGATGTCACTGCATGGGGGTTTCGTTAATGAAGCTGTTCA
GGGCATGATATGGTGCATGAGGATGCACGAGTGGATACTAACATATGACAGTTGATGCTCTTTTTATAGAGCATC
CGTTTGGATATAAAAGCATCGAGTGTCGCCAACATTTTGATCTTGTTCCATCCATCAATCGCATCAACCACTCTC
AAGCAACAATAACAACCTTTACCCAACTTCAAAGACTTTCAGTCTCTCAACTCAACACCTTCAAGATGTCTCCCT
GCGCATGCAACTCCTGTGGATGCAAGGACAACTGCTCCAGCTGCTCCTGCACCAGCTGCAGCCACTAAATCATCG
TGCTCTTTTTCCTTCGCTGGATCTATACTCTCTCGGAATGACAGCTTGAGGGCTCGGATGTGCTTAAGACGCCAT
GGGAAGGGCAAGGCATTTGGGCGAATAGACCTCCATCATGTGGGATATAGCAGAATAGGAATTTGAAGATTTTGC
CCTAACACACATATAATTTGCTTGTGAGAAAAAAAAAAaacaa

> SEQ ID NO:925  215316  220485_300955_1

Figure 2 continued

```
GTGCAGCTGATAAATTCCATCGATTGGTTTCTTTGGGAGCATTAATCGACCTTTCTCATTCTTCATACCATCGGC
GTCGTTGGCATTTATACGGCATCTCGTCTTGTTTCCTTCGTACTCGAGGTACGGTACCCTGACCGCGTCGTCATA
CGAATTTGCAGCATCGGCGAATTGACAGTATAAGGCAGACATCATGGCTGGGTGGCAGTCCTGGAACCCCTTCAG
TAAGAGGGAGACGCACAGCAATGGCTCCATCGTCGCATACAAGATTTTAACCTTGCTCTCATGGCTTTTGTCCGT
CGTCGTCACTGTCTACTATGCCGTTGACGAGCCTCACGATGGCTTCCACATCCGCCGGCGCATATGGGATCAGAA
CTATCTGTATCCCAGCGCCTTTACCATGAACCACATCCTCGCTGATATCTACTGGATTGTTCTCTTCATCCTCCA
GTTTGGATACGTCACATCGCTCTTCTCCAGCAGTGCCGACGTCGTTGCCGCAGCTGCTGGTGTCGGCAGCCACTT
CATCCTCAACAACTTGCTTCACTCTGCATTCGTCATGCTCTTTGTGAACTCGCACTTCCACATCGCCGAGGTCAT
ACTGATTCTCAACTTCTTCAACCTCAGCTCACTGTATTtccgccaCAACACGGTCCcgcGCtt
```

> SEQ ID NO:926 215338 120153_300359_1
```
cccccccccatctcaaatcaaattctatttctttttcagttcaattactttaccaacaaaatgtcaggccgtgga
aagggAGGCAAGGGTTTGGGAAAGGGCGGAGCAAAACGACACCGAAAGGTTCTCCGTGATAATATTCAGGGAATC
ACTAAGCCAGCTATTCGTCGATTGGCTCGTAGGGGTGGAGTGAAGAGAATCAGCGGGCTGATTTATGAAGAAACA
AGAGGAGTTCTGAAGATTTTTTTGGAGAATGTGATTCGTGATGCTGTGACTTACACTGAGCACGCCAGAAGAAAG
ACTGTCACTGCAATGGATGTTGTTTACTCTTTGAAGAGACAAGGCAGGACTCTTTATGGATTTGGTGGTTAAAGT
TTGGGAAATTgttGTTAACTTCTGTGTTACTATTTGGTGTTATTgttAATGTAGTTGACTAGATTTTCGTATTAA
TGAAATGAAATCCGTTGGTTTTATTCTC
```

> SEQ ID NO:927 215338 125181_300568_1
```
GATTCAGAAGAGGATTGAGCAACTCTTTCGCCAATTTCTATTTCTTGAATATGTAACGGGAGAATTACATTACCG
GGCTGAAAAAACTAAGAAATCCAAATCCACAATAGGGAAAAAACGATCTACAATCATTACCCACAAAACCCTAAT
TTCACAAACCTAACCCCCAAATCCGTAGAGAGTCCTGCCCTGCCTCTTGAGTGCATAAACAACATCCATAGCGGT
GACAGTCTTTCTTCTAGCGTGTTCGGTGTAGGTCACAGCGTCACGAATCACGTTCTCCAAAAATATCTTCAACAC
TCCACGAGTCTCCTCGTAAATCAAACCAGATATACGCTTTACTCCACCCCTACGAGCCAAACGCCGAATTGCAGG
CTTTGTAATCCCCTGAATGTTGTCCCTTAATACTTTCCTGTGCCTCTTTGCTCCTCCTTTGCCCAATCCTTTTCC
TCCCTTGCCCCTTCCTGACATTGTTCTGAGAAATTGATGAAAAAACTGAAGGAGATTATAGAAATTGATATAAAG
AGAAATG
```

> SEQ ID NO:928 215338 53476_300091_1
```
AAATTCATTCATGGTTAAACGGAAAAATTACAAATTTGAAATCCCTAAATGCTGAAATTGAAAAGTTTACAAAAT
CCGAATTTGCAATCCGAACGATTTACCCGCCGAATCCATACAAAGTTCGTCCTTGTTTTTTGAAAGCGAAAACAA
CGTCCTTCGCCGAAACAGTTTTCCGGGGAGCGTGCTCCGGGTAAGTAACGGGGTCACAAATCACGTTTTCAAAAA
AAATTTTGAAAACCCCGGGAGTTTTTTAATAAATAAAACCATTGATACGTTTAACGCCTCCTTTTTTGGGAGAC
AACAAATCGCAGGTTGGGAAATCCCTGGGAGGTGGTCTTTGAGTACTTTCCGAGGTCTTTGGGCTCCTCCTTTTC
CTAATCCTTTTCCTCCTTTTCCTGGGCCGGACATTTTTTTTTGGGGAAATTAATTTCGAACTAAAAAAAAAATTT
TTTGATCGGACCCGGGGGTCA
```

> SEQ ID NO:929 215338 48634_300033_1
```
GCCATTACGGCCGGGGATCGCCCTAATCATTATCTCTCGCACAATTTTTCAGCTTCAGGGTCTTTAATTTGCAGA
GAAACTAAAGGTTGATTGAAAATGTCTGGACGTGGAAAGGGAGGAAAAGGATTAGGAAAGGGAGGAGCAAAACGA
CACCGTAAAGTCCTCCGCGATAACATCCAAGGTATCACAAAGCCAGCAATCAGGCGTTTAGCTCGTAGAGGAGGA
GTGAAGCGTATCAGTGGACTCATCTATGAAGAGACACGTGGCGTGCTTAAGATCTTTTTGGAGAATGTCATTCGT
GATGCTGTAACTTACACTGAGCACGCTAGGAGAAAGACTGTGACTGCTATGGATGTTGTGTACGCGCTCAAGAGA
CAAGGAAGGACTTTGTATGGTTTTGGAGGTTAATGTGAAACTTTTATTTTTTCTGCAAGAGTCTTGCTGTCAAGA
AAACAACAAGAACGGTTACCATATGGTATATGAGGTTTGTTTTGCTTTTGATTAGGGATCTGATTCGGTGTAATT
AGTTTGGTTACCTATTGGTGATAGGTTTCTTTTTT
```

> SEQ ID NO:930 215338 279827_200065_1
```
tcgttcctctcttTTAAATTCAAAACCCTTGAATTCACTTTCAATTATCTCTTTCTCAAGCTTTTGAAAAATGTC
TGGACGTGGCAAGGGAGGCAAGGGATTGGGGAAAGGAGGAGCAAAGAGACACAGGAAAGTGCTGAGAGATAACAT
CCAGGGAATTACAAAGCCAGCTATTCGCAGGCTTGCTCGTAGGGGTGGTGTGAAGCGTATTTCTGGGTTGATTTA
CGAGGAGACTCGTGGAGTTCTTAAGATCTTTTTGGAGAATGTGATTCGCGATGCTGTGACCTACACTGAGCACGC
TAGGAGGAAGACTGTTACTGCCATGGATGTTGTTTACGCTCTCAAGAGGCAGGGAAGGACCTTGTACGGATTTGG
AGGTTAAATATTGGCGGTTAGGGTTTATTGTATTTTGTTGTTAGTGATTGTAGATTTTATGTTTGTGCTTTCTGT
TTGTGTTAGTGGTCAGTTTAAGCTAGGGTATTTTAATTTCCGTTGTTAAGGTCTGGACATTGTAATACCTCGTTA
TACAATTAAGTAAAACAGACCATTTCCTaaaAAAAAAAg
```

> SEQ ID NO:931 215338 270863_200128_1

Figure 2 continued ctcagtttaattactctacctacaaaatgtcaagccgtggaaaGGGAGGCAAGGGTTTGGGAAAAGGAGGAGCTA
AACGACACCGTAAGGTGCTCCGTGATAACATTCAGGGAATCACAAAGCCAGCTATTAGGAGATTAGCGAGAAGAG
GTGGAGTGAAGAGAATCAGCGGGCTGATTTATGAAGAGACAAGAGGAGTGTTGAAGATATTTTTGGAGAATGTGA
TTCGTGATGCTGTGACTTACACAGAGCATGCTAGGAGAAAGACTGTGACTGCAATGGATGTTGTTTATTCTCTCA
AGAGACAAGGCAGGACCCTTTATGGATTTGGTGGTTAATTTATGTATTTTTATTTGTTTTAGGGGAGATGGAGTT
TAGTTGGTGTTTAATTAGTGTTTGTTGATGAATGTTATGAGGTTGCTGTAATTGAGTTCTTTGTGTTAATGAAAT
GGATCTCATTACTATTTCCGaac > SEQ ID NO:932  215338  262722_301693_1
GCAGCATGTCAGGCCGAGGAAAGGGAGGAAAAGGATTAGGAAAGGGAGGAGCCAAGAGACATCGGAAAGTACTCA
GAGACAACATCCAAGGGATTACCAAACCTGCGATTCGTCGTCTCGCGAGAAGAGGAGGCGTGAAGCGTATCAGTG
GTTTGATCTATGAAGAGACTCGCGGCGTTCTCAAGATCTTTCTCGAGAACGTGATTCGTGACGCCGTTACTTACA
CGGAGCACGCTCGCCGGAAAACTGTTACGGCGATGGACGTCGTTTACGCTCTCAAGAGACAAGGACGAACTTTGT
ATGGATTCGGCGGCTAATAA > SEQ ID NO:933  215338  243169_301336_1
acgcgtcgagggtgctagagcaacagcagctaggaaatctctcgtcgtcgcggcaatgtctggaagaggcaaggg
aggtAAGGGATTGGGCAAGGGCGGCGCCAAGCGCCACCGCAAGCATCTCCGCGATAACATCCAGGGCATCACCAA
GCCGGCGATCCGGCGCCTTGCCCGGCGTGGCGGCGTCAAGCGTATCAGCGGCTTGATCTACGAGGAGACCCGAGG
CGTCCTCAAGATCTTCCTGGAGAACGTCATCAGGGATGCGGTCACCTACACCGAGCACGCCAGAAGGAAGACCGT
CACCGCCATGGACGTCGTCTATGCGCTCAAGAGGCAAGGCAGGACGCTCTACGGATTTGGCGGCTAGAAGAAGAA
AATTAGAAGCTCTCCATCTCCTTGGAAAATTTCTAGTTTTCCTCGATTTCTAACTGGTAGACAAGGAAGAAATAT
TTTCCTTTGCATTCCATCCACCACTTTGTAATATTCGAATCTAATGTAGAATCTTAAATCGGAAAAaaa > SEQ ID NO:934  215338  240610_301316_1
GTCGATAGCACTAGCAGCGCCTTCTCTCCTCTCCTCTCCAAGTAAGTAGCTCTTCTTCGATCGGCTAGAGGCAAT
GTCTGGGCGCGGCAAGGGCGGCAAGGGATTGGGCAAGGGCGGGGCCAAGCGCCACCGCAAGCATCTCCGCGATAA
CATCCAGGGCATCACCAAGCCCGCGATCCGGCGCCTTGCCCGGCGTGGCGGCGTGAAGCGCATCAGCGGCTTGAT
CTACGAGGAGACCCGGGGCGTGCTCAAGATCTTCCTggAGAACGTCATCCGCGACGCCGTCACCTACACAGAGCA
TGCCCGCCGCAAGACCGTCACCGCCATGGACGTGGTATATGCGCTCAAGAGGCAGGGCCGGACCTTGTACGGATT
TGGCGGCTAGAAAAATTCTTCTTTTGGATAGGGAAGAAACTGCCATAGCTCTTCCTGGCATTGGAATTTgTaAAT
TTTGTTCTCTTTGACTATCTTTCTGGAAATTTAAAGTATGATCTTGTACTGTTC > SEQ ID NO:935  215338  223702_300975_1
gggcccacgcgtccgcCCACGCGTCCGAAACAATGTCTGGCCGAGGAAAAGGTGGTAAAGGACTTGGAAAGGGTG
GCGCTAAGCGACACCGAAAGATTCTTCGAGATAACATTCAgGGTATCACTAAGCCCGCCATCCGACGTCTTGCGC
GACGAGGTGGTGTGAAGCGAATTTCCGCCCAGATCTACGAGGAGACCCGAAACGTTCTCAAGTCTTTCCTTGAGT
CTGTTATTCGAGACGCCGTCACCTACACTGAGCACGCCAAGCGAAAGACTGTCACTTCTCTTGATGTTGTCTACG
CTCTCAAGCGACAGGGCCGAACCCTTTACGGTTTCGGTGGTTAATTATTTATATTATATATGATATTGGAATGGA
TTTATTATACTG > SEQ ID NO:936  215338  219791_300948_1
TGGTGCGAAAAACGTCATTTTGCAAAGTGACGCGTTTATAACGGATTTCTATATCTTCCGACTTTTTCACATTTT
AATACATTCATCATGACTGGCCGTGGAAAGGGTGGCAAGGGCCTGGGCAAGGGCGGTGCCAAGCGTCACCGAAAG
ATTCTTCGTGACAACATTCAGGGCATCACCAAGCCTGCTATCCGACGTCTCGCTCGTCGTGGTGGTGTCAAGCGT
ATCTCTGCCATGATCTACGAGGAGACCCGCGGTGTTCTCAAGTCCTTCCTCGAGGGCGTCATCCGCGATGCCGTC
ACCTACACTGAGCACGCCAAGCGCAAGACCGTCACCTCGCTGGACGTTGTCTACGCTCTCAAGCGACAGGGCCGC
ACCCTCTACGGTTTCGGTGGTTAGAGCGTTGGACGCGTTGTTTTCTGCTGTCTGCGCGGTGGCGATGTGGAGCTG
GGGTTATCTGTGCAAATAACATGGACTCTTCTGTACTTTGATCGATTGGCGTTGGGGGAATGGGCTTACGAGGAG
GCGTCATGGTAGACGACCTTATAAATGAGAATACCACATGAATACAAATACGATAATCATTTG > SEQ ID NO:937  215338  195975_300639_1
GGTTTACCATCTGCATCTCTTTTTGATATCTCAAAACTCCCCAAACAACCCACATCAATCATCATGACTGGACGC
GGCAAAGGTGGCAAGGGCCTCGGCAAGGGTGGTGCCAAGCGTCACCGCAAGATTCTTCGTGACAACATCCAGGGT
ATTACCAAGCCCGCTATCCGACGTCTCGCTCGTCGTGGTGGTGTCAAGCGTATCTCTGCCATGATCTACGAGGAG
ACCCGTGGTGTCCTCAAGTCCTTCCTCGAGGGTGTCATCCGTGATGCCGTCACATACACTGAGCACGCCAAGCGC
AAGACCGTCACATCACTAGACGTTGTCTATGCTCTGAAACGACAGGGCCGCACCCTGTACGGTTTCGGTGGTTAA
GCGATCTGCCACTAGGTCGGGTCGACATAATGTGTTATTCGCGTGTTTGTTACGATTGGGCTTTTCACTATGGGC
GCGGGTCATTGCTTTTTGAGATTTTGTACTGTACAACGTACTGGGAAATGGGTGACCCCCGAAAGGGGGTAATTG

Figure 2 continued

AGACTTATTCAGTGGTGACCTTGAAATAAAGCATCACATATACTCTACAAGTAAAATCTTTCTGCCTGATTGTGA
AT

> SEQ ID NO:938  215338  159465_200024_1
AATTCAAATCTAAAACCCTAGAAGCTTCTTTTATCTTCAAATTTCTGTGTGAAAATGTCTGGTCGTGGAAAGGGA
GGAAAGGGATTGGGCAAGGGAGGAGCTAAGAGGCACAGGAAGGTGCTGAGGGATAACATCCAAGGAATTACGAAG
CCCGCAATTCGTCGGTTGGCTCGTAGGGGAGGTGTGAAGCGTATATCTGGTCTGATCTACGAAGAGACACGTGGA
GTGCTGAAGATCTTTCTAGAGAACGTGATTCGTGATGCTGTTACCTACACCGAGCACGCCAGGAGAAAGACTGTT
ACTGCTATGGATGTCGTTTATGCACTCAAGAGGCAGGGCAGGACTCTCTATGGATTTGGTGGTTAGGTTGTTTAG
GTGTGATTTTAGGTAACTGTATTTGTAGTAATTGTAGATTTTCTGGAATTTCTGTTGTCTCTTTGTTGGTTTCTC
CGCAGCTTTGTTCTAGTTGTTGTTCTTAAGGTCTTGATAATGTAATTTCTCATTACAGATTCAAGGAACAAAGTT
CATTTTC

> SEQ ID NO:939  215338  126606_300465_1
aacacatttttcCTCATTTCAAATTCAAAAATCCCCAAAAATCTAGTTTCACAATGTCAGGAAGAGGAAAGGGTG
GAAAAGGATTGGGCAAAGGAGGAGCTAAACGACACCGTAAGGTGCTTCGTGATAACATCCAGGGAATCACGAAAC
CTGCAATTCGGCGTTTGGCTCGTAGAGGAGGAGTGAAACGTATTTCTGGTTTGATTTACGAGGAGACACGAGGTG
TATTGAAGATATTTTTGGAGAATGTGATTCGTGATGCTGTGACTTACACCGAACATGCCAGGAGAAAGACTGTTA
CTGCTATGGATGTTGTTTATGCCCTCAAGAGGCAGGGAAGGACTCTCTACGGATTTGGGGGTTAGATTTGTCTAA
TTAGAGTTTTTGTGGGGTAATGATTGTAGATTTGTTCTTTACTATCTGATGTATTAGGGTTGGTTAGTTTTTGTT
GAGATTTTATAATGTAATTCTCTATTACATACTCAGGAATAGTAATTGCCCAAAAAAAATCTAACAAGCTTCTAG
TAGTATATATAACAAGCTCGCATTCTTAAAATCATAAATCTTGgaaCaaggttTTTTCTTTTCTTTCTAg > SEQ ID NO:940  215338  193633_300741_1
cCCGACTCCAATCACCACCACCTCTTCTCCAATTCCACTCgcttTTCTCTCTCTCTCGTGCGTCGAGCCACCGGA
ATCGTCGTCGTCGGCGGCCATGTCGGGGCGCGGCAAGGGAGGCAAGGGGCTCGGCAAGGGCGGCGCCAAGCGTCA
CCGGAAGGTGCTCCGCGACAACATCCAGGGCATCACCAAGCCGGCGATCCGGAGGCTGGCGAGGAGGGGCGGCGT
GAAGCGCATCTCCGGGCTGATCTACGAGGAGACCCGCGGCGTGCTCAAGATCTTCCTCGAGAACGTCATCCGCGA
CGCCGTCACCTACACGGAGCACGCCCGCCGCAAGACCGTCACCGCCATGGACGTCGTCTACGCGCTCAAGCGCCA
GGGCCGCACCCTCTACGGCTTCGGCGGCTGAGCCCTCCGGTCCTCCCTCGCCCTCGCGCTGGCCGCCTCTGCCGC
CGCCGCCTCCTGGACTGGCTGTTGCTGGTGTTTTAGCTCTTGTTGTGTCCTTTTGCTTTGCTGGTGTaaagaGAC
CCGGATGTGCCACGGGTGGGTTTTTAGTAGtAGGAtTAGTagtATCCCAACTCCTGGTTGTGATTTgcTCATttc
catAGATGTAATGACATtacGATTTCAATCGTaacaaAATTATtTg > SEQ ID NO:941  215343  208988_300810_1
GGTCGAAACCTGTGCTTCCTCCTCCCTCCGGTATTTCACGTGGGCCTTGCCCTTATTCTCAGAGTCCAGCTGAGA
AAACAAAAAGAATTTCTTTTTGTTTTGGAAATAGGGAGACGCTCATCGTTCAATTCGTCCTCCAACACAGACCGG
AGCAATGGACGAAAAGCACAGCGGCTCGGGTCGCAACTCGACCGATGTCCGTGACACCGAAATGCCATTCGCTGG
CGACCAGGTTGTTTGGCCGCCGCACACAACTGAGCGGCGCCTGATGGGAAAGATCGACATGCGAGTCGTGCCGTT
TCTCTGGATCATGTACCTGGTTGGATTCCTGGATCGTGTCAATATTGCCAACGCAAAGCTATTTGGTCTCGCTGG
TGGTCTGGATCTCGGCACTGGCGACAAGTACAACACGGCCCTGGTCATCTTCTTC > SEQ ID NO:942  215373  195472_300634_1
gctGCATTTTGGGGTCGCAAATCTACAGCAAAAATGGCCTCGACAACGACCAAGCAGACCCCGGCGTCCTTTGTC
GGGACCAGCAAGGTCGTCGAGACTGACTATCCGCTCATCGACAACGACCCTCACTTTAAGCGGGTTATCGGATAT
GCGAGAACGTCAGACTACGTAGCTGGTGCAACCTCTGCGGCCTTTGCACCGACTGCTCTCTATGCCCTCGAGAGG
CTCGCCCCGTCGCATGTTGGCCGGGGAGGCTTTGCCAAAGCCATGCGGTTAGCCGGATTCATTGGCTTGGCCGGC
GGTTTCCTCTACTTTTACCAGCGATCAGCCCTTCGATTCTACGGCGCCACTGAGAACTCAAGGGAAGTCGAGATG
GATATGCGAGAGATGGTTTCCAAGGTCAAGGCGGGACAGCCTCTGTATGGCGAGAGCAAGCTGAGCCCTCACCTG
CAGGGAGTTGCGGCCCGACAGAGCAGATACTCTGCGCTCTTTTTCAGCACAGTACCGTGGTTCAACTTTGTCAAC
CACAACCAGCACGGCGTGGACACGGCCAAGTACTATCAGCAGGCCGAGAGGGAACTGGAAGCAGAGCGGGCGGCG
GGCAAGAGCTAGACGGGACCAAATGTGTATATTTAGCGGGACTACCgctTCTTGcgg > SEQ ID NO:943  215379  11794_300294_1
gggGGCTAAGCTCTCAGCAACCATGGGTATCTCACGAGATTCTATGCACAAGAGGCGTGCCACTGGTGGCAAGAA
GAAAGCTTGGAGGAAGAAGCGAAAGTATGAACTTGGCCGCCAGCCTGCTAATACTAAGATCTCGGCTAACAAGAC
AGTCCGACGAATTCGTGTGCGTGGTGGCAATGTGAAGTGGAGGGCACTGAGATTGGATACCGGAAATTACTCATG
GGGTAGTGAGGCAGTCACACGCAAGACTCGTATCCTTGATGTGGTTTACAATGCCTCAAACAATGAACTTGTTCG
CACACAAACTCTGGTCAAGAGTGCTATTGTTCAAGTTGATGCTGCGCCATTTAAACAATGGTACCTCCAGCATTA

Figure 2 continued

TGGTGTTGACATTGGTAGGAAGAAGAAGGGCCCTGCTAAGAAGGAAACTACTGAGGAAGGAGAAGGTGCTGCTGC
CGCTGCAGAGGAAACTAAGAAGAGCAACCATGTTCTCCGGAAGATTGAGACACGTCAGAAGGATCGTAAACTTGA
TCCTCATATCGAAGAGCAATTTGGTGGTGGTAGGCTGTTGGCCTGTATCTCTTCTCGCCCTGGTCAATGTGGCAG
AGCAGATGGGTACATTTTGGAGGGAAAAGAGCTTGAGTTCTACATGAAGAAACTACAgAaGaaGaaa > SEQ ID NO:944 215379 139025_300406_1
cgctCTCCTCCCCCCCGCTAGTTCCCAACCAGCAGCTGCGGCGGCGCGAGCACACGAAGAGGAGGCGGAGCAGCC
GGAGCCACCTCCGCCGCCGCCGCCACCATGGGTATCTCGCGTGACTCCATGCACAAGCGCCGGGCCACCGGTGGG
AAGCAGAAAGCGTGGAGGAAGAAGCGAAAGTATGAGCTTGGTCGCCAGCCGGCAAACACCAAGTTGTCGAGCAAC
AAGACAGTGAGGAGGGTCCGTGTTCGTGGAGGAAATCTGAAGTGGAGGGCTCTTCGCCTGGATACTGGTAACTAT
TCTTGGGGAAGTGAGGCTGTCACTCGCAAGACCCGTATCCTTGATGTGGTCTACAATGCGTCAAACAATGAGCTT
GTGAGGACCCAGACCCTTGTGAAGAGTGCCATTGTGCAAGTTGATGCTGCCCCATTCAAGCAGTGGTATCTCACT
CACTATGGTGTCGATATCGGTAGGAAGAAGAAAGCTCCTGCTGCTAAGAAGGATGCTGCTGAGGGACAAGAGGGT
GAGGCTGCCACGGAGGAAGCAAAAAAGAGCAACCATGTTGTGAGGAAGCTTGAAAAGCGTCAGCAAACTCGCACT
CTGGACTCGCACATTGAAGAGCAATTTGGCAGCGGAAGGCTCTTGGCCTGCATCTCCTCCCGGCctgGGcaatgt
ggcagaGCTGATGGGTAca > SEQ ID NO:945 215379 211994_300872_1
gccGACAAGTCGATTGCCCTGGTGAGCACCATTATCATCAGAAACCGCAATCATGGGTATCTCTCGTGACTCTCG
CCACAAGCGCTCCGCCTCCGGTGCCAAGCGCGCCTACTACCGGAAGAAGCGCGCTTTCGAGGCTGGCCGCCAGGG
TGCCAACACCAAGATTGGCGCCAAGCGAATCCACACCGTCCGCACTCGTGGTGGTAACCACAAGTACCGTGCCCT
GCGTCTCGACTCCGGCAACTTCGCCTGGGCCTCCGAGGGCTGCACCCGCAAGACCCGTGTCATTGCCGTCGCCTA
CCACCCTTCCAACAACGAGCTGGTCCGAACCAACACCCTGACCCGTAGCGCCATCGTCCAGATCGACGCTGCTCC
TTTCCGACAGTGGTACGAGTCCCACTACGGCCAGCCCATCGGCCGTAGACGCCAGAAGGCCCAGGCCGCCAAGGA
GGGCAAGGAGGTCGAGGAGGTCAAGAAGAGCAAGTCCGTCGAGAAGAAGCAGGCTGCTCGCTACGCCGCCAACGG
CAAGGTCGAGTCCGCTGTTGAGAAGCAGTTCGAGGCCGGTCGTCTGTACGCCGTTGTCACCAGCCGTCCCGGCCA
GTCCGGCCGCTGTGACGGTTACGTtctGGAGGGTGAGGAGCTGGCTTTCTACCAGAAGAAGCTGCACAAATAAAC
TCACAATGGCGTGAGTTGGATGGTGTtcaaggATTTTTTCGTTATCTTGGGcAtTtTcagggcatGAAGAGCTTT
CTAACACACAAAGCATCGGAACGGGTCCatagGGAAATGAAAAGCTTTTCTGCAATCATGttactTTTTTCACGT
TGTTTCATTCAAGTATGATAATGATACAAGAAACAAAACAATTCAACACACCT > SEQ ID NO:946 215379 237744_301280_1
GGAGGAGGCGCCGCATCGTCGCGGATCGATCAGTCATGGGTATCTCCCGCGATTCGCTCCACAAGAGGAGGGCTA
CCGGTGGTAAGAAGAAGCAATGGAGGAAGAAGAGAAAATACGAGCTGGGGAGGCAGCCGGCGATGACCAAACTGG
CGGCCAAGACGGTGCGGCGCATTCGTGTCCGTGGTGGCAACCATAAGCTCCGCGCTCTGAGGCTGGACGCTGGGA
ACTACTCGTGGGGAACCGAAGCCGTGGCCCGGAAGACGAGGATCTTGGAGGTTGTCTACAACGCCTCCAACAACG
AGCTCGTCCGGACCCAGACGTTGGTGAAGAGCGCCATCGTTCAGGTGGACGCGACTCCCTTCCGCGCGTGGTACA
ACCAGCACTACGGCATCGACCTCTCCCGCAAGAAGAAGACTGCCGCCAAGAAGGACAAGGAAGGCGAGGAAGCTA
CGACCGAGGCAGCGACCGAAGAGGAGAAGCCGAGGAGCCAGAACGCGCTCCGAAAGCTTGCGAGGAGGGCCGACG
GcCACAAGATCGACCCGCACATTGAGGAGCAAATGGCGAGCGGGAGGCTCCTTGCGAGCATTGCGTCTCGCCCCG
GGCAgTGCgggcgtGCGgacgggTAcattctggaAggTAAGGAGCTggagttCTACATgaagaagATCAGaA > SEQ ID NO:947 215379 258478_301696_1
GCGAGACTCCCGACACAAGCGATCCCACACCGGCGCCAAGCGTGTCTCCATCCACAAGAAGCGAAAGTTCGAGTG
CGGTCGACAGGGTGCCGTCACCCGAATCGGCCCCAAGCGAATCCACACCGTCCGAACCCGTGGTGGTAACAAGAA
GTTCCGAGCCATCCGAATCGAGACCGGCAACTTCTCCTGGGGCTCTGAGGGAACCACCCGAAAGACCCGAGTCCT
CGGTGTCTCTTTCCACCCCTCCAACAACGAGCTTATCCGAACCAACACTCTGACCAAGTCTGCCATTGTCCAGAT
TGATGCCACTCCTTTCCGACAGTGGTACGAGTCCTACTACGGCAAGTCTCTCGGCAAGAAGAAGGCTGGCCAGGA
GGAGCCCGTCATTGCTGAGGCTGACCAGGCTGCCGTTGCTGCCCGACAGGCTGATGCCAAGCTCGACCCTGCCGT
CGAGGCTCAGTTCGGTGCTGGCCGACTCTACGCCTGCGTTTCTTCTCGACCCGGTCAGTCCGGCCGAGTTGACGG
TTACGTTCTCGAGGGAGAGGAGCTTGCTTTCTACCTCAAGAAGATTGTCTCCAAGAAGTAGACACAAAACTAAAA
TGTATTATTGCACGTGAAAAaa > SEQ ID NO:948 215379 262968_301720_1
GACCCACGCGTCGGGACTGCCACGCCATGGGTATCTCACGAGATTCAGTGCACAAGAGGAGGGCCACTGGAGGGA
AGAAGAAGGCATGGAGGAAGAAGAGAAAGTACGAGATGGGCCGTCAGCCAGCGATGACAAAGCTGTCAAGCAACA
AGACAGTGCGGAGGATCCGAGTGCGTGGTGGTAACTTCAAGTTCAGGGCTTTGCGTCTTGACACTTTAAACTACT
CCTGGGGGTCAGAGGCCACCACCCGCAAGTCGAGGATCCTGGATGTGGTCTACAATGCCTCCAACAATGAGCTTG
TCAGAACCCAGACTCTGGTCAAAAGTGCCATTGTCCAAGTTGATGCGACCCCTTTCAGACAGTGGTACAGTCAAC

Figure 2 continued

ATTATGGCCTGGATATTGGCCGCAAAAAGAAATCCAGCAGCGCTGCCAAGAAGGAGACTGAGGAGGGTGATGCTG
GAGATGAGGAAAACAAGAAAAGCAAGCATGTTCTGCGAAAGCTAACAAAGAGGCAGGAAGGTCAGAAGCTTGACT
CTCATCTAGAGGATCAGCTTGCAAGTGGTCGTCTCTTGGCATGCATTTCGTCCCGCCCGGGACAGTGTGGCCGAG
CTGATGGGTACA

> SEQ ID NO:949 215379 285116_200103_1
GTCGGCAGCCCTAGGATACTTACGTGGCCGGCAACAATGGGTCTCTCTCGGGATTCGATGCACAAGAGACGTGCC
ACCGGAGGCAAGAAGAAGGCGTGGAGGAAGAAGAGAAAGTACGAGCTTGGAAGACAGGCTGCAAATACATATTTT
GTGCCTAATTCTAAGACTGTTACGAGGATAATGGTCCGAGGAGGCACTGTGAAGTGGCGTGCTTTGAGGTTGGAC
ACTGGAAACTTGTAGTGGGGCATTGAGGCTGTTACTAGGAAGACTCGATTATTGGATGTGGTGTACAACGTCTAA
AACAATGATCTGGTTAGGACACACACTCTAATGAACAGTGCAATTGTTCAATTTGAT

> SEQ ID NO:950 215379 50242_300165_1
CCCCTCCACCCACGCGTGCGCTTTTGGAGAAACCCTAATCGGCGACAATGGGTATTTCTCGTGACTCTATCCACA
AGAGGCGTGCCACTGGAGGCAAGCAGAAGCAATGGAGGAAGAAGCGAAAGTATGAGATGGGAAGGCAGCCAGCCA
ACACCAAGCTCTCAAGCAACAAGACGGTCAGAAGAATAAGAGTTCGTGGTGGAAATGTTAAGTGGCGTGCGTTGA
GGCTCGATACTGGTAACTACTCGTGGGGAAGTGAAGCAACTACCCGCAAGACCAGAGTCCTTGATGTGGTCTACA
ATGCCTCCAACAATGAGCTTGTACGTACTAAGACACT

> SEQ ID NO:951 215379 193695_300741_1
cccccGAGCGAGGCACAGCTACCGGCGGCGCAGCCACACAGCAGCAGCAGGTGAGGAGGAGAGGAGACCCGCCGC
CGCCGCCGCCATGGGTATCTCGCGTGATTCCATGCACAAGCGCCGCGCCACGGGCGGCAAGCAGAAGGCATGGCG
CAAAAAGCGAAAGTATGAGCTCGGAAGGCAGCCTGCCAACACCAAGCTGTCAAGCAACAAGACAGTGAGGAGGGT
GCGTGTCCGTGGAGGTAATGTGAAATGGAGGGCCCTCCGTTTGGATACTGGCAACTACTCATGGGGAAGTGAGGC
CGTGACCCGCAAGACCCGTATCCTTGATGTGGTCTACAATGCATCCAACAATGAGCTTGTCAGGACTCAGACCCT
TGTAAAGAGTGCTATTGTGCAAGTTGATGCTGCCCCCTTCAAGCAGTGGTACCTCACTCACTATGAGTGGATAT
TGGTAGAAAGAAGAAGGCTCCTGCAGCCAAGAAGGATGCTGAGGGGCAGGATGCTGAAGCTACCACAGAGGAAGC
GAAGAAAAGCAACCATGTTGTCAGGAAGCTTGagaAGCGCCAACAGGGACGCACACTTGACGCCCACATCga > SEQ ID NO:952 215382 217771_300911_1
aattcgtgatcgcggaagggacgactccagatacccctcaACGCCCCGACAACCCCCAAGTCACAGCAGCCATGAG
GTACATTCACTCTCAGGAGATCCTGGAAATTCCAGAGGGCGTCAAGGTCAACATCAAGACCCGTATCGTCACCGT
TGAGGGTCCCCGAGGCAAGCTCACCAAGAACCTCGGTCACTTGGCTGTCAACTTCGGTCACCCCAAGAAGAACAC
CATCTCCATCGAGATCCACCACGGCAACCGTAAGAATGTCGCCACTCTCCGTACCGTCCGCTCCATCATCGAGAA
CTTGATCACCGGTGTCACCAAGGGCTTCAAGTACAAGATGCGATACGTCTACGCCCATTTTCCCATCAACGTCAA
CCTGGACAAGAACAAGGAGACCGGTCTGTTCGAGGTGGAGATCGGAAACTTCATCGGCGAGAAGATCGTCCGACG
GGTTACCATGCACGAGGGTGTCGATGTTGAGATCTCCAAGGCCCAGAAGGATGAGCTCATCCTGACCGGCAACTC
ACTCGAGAACGTTTCCCAGAGCGCCGCAGATATCCAGCAGATCtgccggGTGCGCAaCAaggataTCCGAAAgtt
cttggaCGGTCTGTAcgttTc > SEQ ID NO:953 215382 268876_200122_1
GCCGGTAGGCAGTAGTGAGCGCAGAAGCAGGGAGAGACACAAAAAATGAAGACTATACTCTCATCAGAAACGATG
GATATCCCCGATGGGGTGAAAATCAAGGTAAAAGCAAAGCAAATAGAAGTGGAGGGACCAAGAGGAAAGCTAACC
CGCAACTTCAAGCACTTGAATCTTGATTTTCAGCTCATAAAAGATGAAGAAACTGGAAAGAAAAAGCTCAAGATT
GATGCTTGGTTTGGATCTCGTAAAACCACAGCTGCTATTCGCACTGCTCTTAGTCACGTTGATAATCTCATAACT
GGTGTCACAAAAGGGTACCGTTACAAGATGCGTTTTGTTTATGCCCATTTTCCTATCAATGCTTCTATCACTGGT
GGGAACAAGGCTATTGAGATCAGGAACTTTCTGGGCGAGAAAAGGGTGAGGAAAGTCGATATGCTTGATGGGGTT
ACTGTTGTGAGGTCTGAGAAAGTTAAGGATGAATTGGTATTGGATGGAAATGACATTGAGCTTGTTTCTCGGTCT
GCTGCCCTCATCAATCAGAAATGCCATGTGAAGAACAAAGATATTCGTAAGTTCCTGGATGGTATCTATGTGAGT
GAGaaggGAAGaatAGCCGAAGAaGagtAAGTTttaGCAGATTGGTTGGGGGTTGTTtggggaTCATCTGCTGAT
TTCATACGAACTCATATTTGAAGTTAATTCAAcaat > SEQ ID NO:954 215382 48461_300376_1
ttttagcgatcgcCATTTTCACACACACAGAAGGAGAGCGGAAGAGAGAAACTAAGACAAGATGAAGACCATTCT
GTCATCAGAAACCATGGATATCCCCGACGGCGTGAGCATCAAGGTGAAGGCAAAGCAAATCGAAGTAGAGGGACC
AAGGGGCAAACTTGTCCGAAACTTCAAGCATCTCAACCTCGATTTTCAGCTGATCAAGGATGAGGAAACTGGCAA
GAAGAAGCTGAAGATCGACGCTTGGTTTGGTTCTCGTAAGACTACCGCTGCTATCCGTACTGCTCTTAGCCATGT
TGAGAATCTCATCACTGGTGTTACCAAAGGTTACCGCTACAAGATGCGTTTCGTGTATGCTCACTTTCCCATCAA
TGCCTCCATCACCGGTGGTAACAAGTCCATTGAGATCCGTAACTTCCTTGGCGAGAAGAGAGTTAGGAAAGTGGA

Figure 2 continued

CATGCTTGATGGGGTTACAGTTGTTCGATCTGAGAAGGTGAAGGATGAGCTTGTATTGGATGGAAATGACATTGA
GCTCGTTTCTCGCTCTGCTGCCCTCATCAATCAAAAATGCCATGTGAAGAACAaGGgatatccGaaaGtttCTTG
ATggtaTCtAtgtcagtGa > SEQ ID NO:955 215382  258567_301697_1
CAACACAATGAAATTCATCCAGGGCGACGTTCTGCTCGATATCCCCGAGGGTGTCACCGTTGACATCAAGGACCG
ACAAATCATCGTCACCGGCCCCGAGGTACCCTCAAGAAGAACCTGTCTCACATCAACGTAGCCTTCGCTAAAGG
TCTCCGATGACCATATCAAGATCACCATCTACGATGGTGACCGAAGGCATGTCGCTGCTCTGCGAACCGTCAAGA
CCCTCATCAACAACATGATCACCGGTGTCACCCGATGTTACAAGTACAAGATGCGATACGTCTACGCCCATTTCC
CCATCAACGTCAAGCTCATTAAGGACGGTTCCGTCGTTGAGATCCGAAACTTCCTCGGTGAGAAGCGATTCCTCT
AATTCCCCATCCACGAGGGCTGCAGCGCTGAGATCTCTACCAACCAGAAGGATGAGATCTGCATCATCGGTAACT
CCATCGAGAACGTCTCTCAGACCTGTGCTGACATCCAGCAGATCTGGCGAGTCCGACACAAGGATATCCGAAAGT
TCCTTGATGGTATCTACGTTTCCGAGAAT > SEQ ID NO:956 215382  237440_301287_1
GGCAGGCCGTCTTCGTTGGGCATTGTTGCGAGGAGGAGGAGGCGGGCGCGATGAAGACGATCTTGTCGGCCCAGA
CGATGGACATCCCCGAGGGGGTGAAGGTAGAGATCCGGGCGAAGCAGATCCGGGTGACGGGCCGCGGGGGGTGC
TGCACAGGAACTTCAAGCACCTCAACCTCGACTTCCAGCTGCTGGAGAATGGGCGCAAGCTCAAGGTGGAGGCGT
GGTTTGGTTCGCGCAAGACCATCGCCGCCATCCGCACCGCCGTGAGCCACGTGAAGAACCTCATCACCGGCGTCA
CCAAGGGCTTCCAGTACAAGTGAGGTTTGTCTACGCTCACTTCCCCATCAACGCCAACATCTCCGCCACCAAGC
AGAACATCGAGATCCGGAACTTCCTCGGCGAGAAGAGCGTGAGAACTGTCGACATGCTTCCGGGTGTGACTGTGA
CCAGGACGGAGAAGGTCAAGGACGAGCTCGTTCTCGAGGGGAATGACATCGAGCTTGTGTCGAGATCGGCCGCTC
TGATCAACCAGAAATGCCATGTCAAGAACAAGGATATCAGGAAGTTCTTGGATGGTATCTACGTGAGCGAGAAGG
GAACGATCGCTGTGGAGGAGTAGACCCCTTGCCTGTTCTGAGTATAATTTT > SEQ ID NO:957 215383  212163_300874_1
GGATTAATCGCAACTCCGAGATCCTGCTgaatcACAATGAGACCTACTCAGGTTCGTCTGGGCGGCGGCGCCCCT
CAACCCAAGACTGGCCACTGGCTCGGTGACTGGGGCTCCTTTGGTGAGTGTGCTCTACTTGACGAACGATTGCAT
CAGACCACCCGCGAAAGAGACTTTGAGGACGCAAGGAACCGGATGGTGGAGGGAAGATGAGGACGATTCAATGGG
CCGATATCTTGATTCAGCTGGAGCAATTGAGGCGGAAGACATTGAACACGCTACGGAGCAACAATTGGATCAGGA
ATTGCGTCGAAGGACCCGTCGGGACGAACTACAAAGATTGAAGGAGTCACTCGCATGCTAACATATGATGCTATA
GGTGGTGCCAAGCAGAAGGGCATTATCGACTACGGCCTGTCTGCCAACCGTCAGAACCCCTTTGCCGGTGCTGCC
CACGATGCCATCTTCAACACCTTCCGCCGCACCAAGTCCCAGATCTTCTACTGGCTCCCTCCTATGCTGGCTGGC
TACTACCTGCTGAGCTGGGCCACCGAGCGAAACCACTACCTCAACTCCAAGGCTGGCCGTGCTGAGTTTGCCGAC
TCGGAGTAAAATGGTGCACGAATATGTTGAATTATGGGTGTCCAGGGGACACAGTGTATATCAGCGTCTAGATTA
GGAGAAAACAATAGAAACGTTTGACTCTAAAAAAAAAacaaaa > SEQ ID NO:958 215409  211006_300895_1
gggagaccatggcctctgtccgatcggctgtgagagcattgccccgcaaaacggcagcaggataccagtccagct
attacCCCTCCATCCCCAGACCCAGATCTCTGTCTTCATTTTCATCTTTGTCTTTGTCTTCATCTTTGCATCGTT
CGGGCCCTCCGTCCTTTTCTCCGAGTCACGCACAGAGACACCAGCTAGCCACGATGTCTACGCAAGCCGCGCACC
CGGCCCTGCTCATCCCAGGGCCCATTGAGTTTGACGATGCTGTGCTCCAGTCCATGAGCCACTTCAGCGAGTCTC
ATGTTGGCCCTGGCTTCGTGGCCACCTTTGGCGAGACTCTGAGCATGCTCCGCCAGCTCTTCCAGACCACCGATC
CTGCCTCTCAGCCCTTCATCCTCAGCGGTTCCGGCACCTTGGGTTGGGATTTGGTGTCTGCTAACTTGATTGAGC
CCGGCGAGGACGCTTTGGTTCTAAGCACCGGCTACTTTGGCGACAGCTTCGCCGACTGCCTGGCTACCTACGGAG
CCAAGCCCACCAAGCTTGAGGGACCAATTGGCGGACGACCCAGTTCCCGGAGATCGAAAAGGCATTGTCGGAGA
AGAAGTACAAGCTCGTCACCGTCACCCATGTCGACACCTCTACTGGCGTTGTGAGCGACCTGAAGGGCCTTGTCC
AGGCTGTCAAGAAGGTCTCTCCCGAAACATTGGTCGTCGCCGATGGCGTCTGCAGTGTAGCTTGCGAGGAGATTG
CTTTCGACGACTGGGGCTTGGACGGTGTCATCACTGCAAGCcaaaA > SEQ ID NO:959 215410  195757_300637_1
ATTTGGCAATTCCTCAAGCTCACCCATTTGTTGACTCTGGCAGTGTAGCACACAGTCTGCTCAACAAACCACATC
ACCATGTCCGCCGAAGAGAAGACCACGGTGGCGACCGACGTCGCAAATCCCCCCAGTCGCGAGCATGAAGTTGTC
CACGGCGACGAGAGCAATGTCGACGTGCCTCTAGATTTGCCCGCAGGATGGAAGTACAGGCAGATTAGCCTTTTC
GGCTACAAGATGCCTTGGTACGCGTCGCCCCGTGTCCAGCTCCTCATGGTTGCTTTTGTCTGCTTCATGTGTCCT
GGCATGTTCAACGCGCTTGGTGGTTTGGGAGGTGGTGGTCGTGCCAGCGCGACCTTGGCTGACAACATGAACACC
GCCCTCTACAGCGCATTTGCTGTCTTCGGATTCTTTGGTGGCACCATCGTTAACAAACTCGGTGTTAAATGGACA
CTCGCTTTCGGCGGCATCGGCTATGGTATTTACGCCATCAGCCTGCTGGTTTCCCTCCATAAGACCGAACAGGGT
TTCAGCATTTTCGCTGGTACCTTCCTTGGTATCTGTGCCGGTCTTCTATGGACTGCTCAGGGCACCATCATGATC

Figure 2 continued

TCCTACCCAACCGAGAAAGAGAAGGGCCGATACTTTGCCTGGTTCTGGGCTATCTTCAACATGGGCGCTGTCGTG
GGCAGTCTTATTCCTCt

> SEQ ID NO:960 215410  212388_300848_1
AATTCTGGATCTGCTTGAGCCTTCTTTCTTCACTGTCCGCTCCCAATTGTCGCCTCGGTTCCACGGCTTCGGATT
GGAACACGCGCCCACAGACAGAAC

> SEQ ID NO:961 215410  213124_300847_1
ATCGTCCCTTCGGTTGCACGGTTTCAGATGGGAACTCGCGCCCACAGATACAAATCGCCGTATCCCATCGAACGT
CAAACTCTACTGAGCTTATATCAATTAGTACTATGCCGTCTTCGAATATTTCCAGAAAAAGACATCTGCCTTTCT
ATAAAATCAATTAGGAAAGAATAGCCAGTTCTTCACCATGGATGATGATGACAATCATGTAGCATGGCCTGTCAT
TACAGACGTCTCCCCCGTCCAGTCCTATGCGGCTGCCCACAAGGAGTTTCATAAGCGGCTTCCCGGATGGATTTA
CAAGGGCCACCACATCTTTGGTTGGGAGATGTACTATGCCTCATCCATAGTGCAATTCATGATGGTTGATCTCGT
GTGTATCCTCTGCCGCGGGATGTACAATTTCTTGACTGGTCTGGGATGTGGTGG

> SEQ ID NO:962 215410  244924_301563_1
GGCGCTATGGCGCTATGGCCTTCCCCGCCTACGGACCCCACTAGGGCAGGTCATGCTCATCGGCGCCGTCTGCTT
CTGCTGCCCGGGTATGTTCTCCGCACTCACCGGCATGGGCGGCGGCGGCCAGGTCGACCCCCACGCCGCCGATCG
CGCCCTCACCGCCCTCTACGCCGCATTCGCGGTCTTCGGCCTCCTCGGCGGCGGGTTCAACAACATCCTGGGCCC
GCGCATCACGGTCCTTGCCGGCAGCGTCTTCTACGCCCTCTACGTCGCGTCGTTCCTCCGCTACAACCACAGCCG
CGACGAAGGCCTCGTCGTCCTCGCCGGGGATTTCTAGGGTTTGGGGCAGGGCTTCTGTGGGCGGGCAGGGTTC
GATACTCATGTCCTACCCCCAGAGCGAGATAAAGGTTTGTATATATCCATCTTTTGGAGTGTGTTCAATATGGG
GGGTGTGGTTGGCGGACTTATACCTTTCTTCCTCAACTTtagctgcgATAGAAGCTCGTCTCACTCGGTGAACGA
CAccAccTACATCGTCTTcgtggTGGTGATGCTGTGt > SEQ ID NO:963 215420  139236_300408_1
cgagtACTAGTCACACCACACGCTTGGCTTGACGCCGCACGCCTCCGCTCCGCTCCGCCGCCGCGGCCGATCTCT
CTAGGGCTTCCAACCTCGCCGGCGACGCGACGCCACGCCATGGCCGCCCCGGTCGTGGACGCCGAGTACCTCCGC
CAGGTCGACAGGGCGCGCCGCCACCTCCGCGCCCTCATCTCCTCCAAGGGATGCGCGCCCATCATGCTCCGCCTC
GCATGGCATGACGCGGGCACTTATGACGTGAACACAAAAACTGGTGGTGCAAATGGTTCAATTAGATACGAGGAA
GAGTACACTCACGGTTCAAATGCTGGTCTAAAGATTGCTATTGATCTTCTCGAGCCTATTAAAGCCAAGAGCCCT
AAGATCACATATGCTGACCTTTATCAGCTTGCTGGAGTTGTTGCAGTTGAAGTTACTGGGGGTCCAACTGTTGAG
TTCATTCCTGGAAGACGTGATTCGTCAGTTTGCCCCCGTGAAGGGCGTCTTCCTGATGCTAAGAAAGGTGCACTG
CACTTGAGGGACATCTTTTACCGGATGGGCTTATCAGACAAAGATATAGTAGCTTTATCTGGGGgtcACActcTG
GGaa > SEQ ID NO:964 215420  57123_300378_1
cttatcctcattcaccTTTCCTCCAGCAATGGCGAAGCCAATCGTCGACACGGAGTACCTCAAAGAAATTGAGAA
AGCTCGTCGCGACCTCCGCGCTCTCATCTCCAGCAAAAACTGTGCTCCTATCATGCTTCGCTTAGCATGGCACGA
TGCAGGAACGTACGATGCTAAGTCTAAGACCGGTGGACCGAATGGTTCCATCAGAAATGAGGAAGAGTTCAGTCA
CGGTGCTAATAATGGATTAAAAATCGCTCTTGACTTTTGCGAAGCAGTGAAGTCTAAACATCAAATGATAACGTA
TGCAGATTTGTACCAGCTTGCAGGAGTTGTTGCAGTTGAAGTCACTGGTGGTCCGACCATTGATTTTGTCCCTGG
TAGGAAGGATTCCAGTGTTTCTCCAAAGGAAGGACGGCTGCCAGATGCTAAACAAGGTGTGCCACATCTGAAAGA
TGTATTTTATAGGATGGGTTTGTCTGACAAAGATATAGTGGCACTATCTGGTGGTCACACACTGGGAAGGGCACA
TCCAGATAGATCAGGCTTTGATGGTCCATGGACAAAGGAGCCACTGAAATTTGACAATTCATATTTTGTGGAGCT
GCTTAAGGGGGAAACTGAGgGCCTGCTGAAACTTGCTACAGaCATagc > SEQ ID NO:965 215420  202190_300781_1
CCCGGCCCAAGCCTTTCGAGTCGTCTTCTCCCCTTCTTCTCCTCCTCCTCGATTCGGAGCTCCACCCGCAGC
CATGGCTAAGAACTACCCCGTCGTGAGCGCCGAGTACCAGGAGGCCGTCGAGAAGGCCAGGCAGAAGCTGCGCGC
CCTCATCGCCGAGAAGAGCTGCGCCCCTCTCATGCTCCGCCTCGCGTGGCACTCGGCGGGACGTTCGACGTGTC
GTCGAAGACCGGGGGCCCGTTCGGACGATGAAGACCCCGGCGGAGCTGTCGCACGCCGCCAACGCGGGGCTGGA
CATCGCGGTGCGGATGCTCGAGCCCATCAAGGAGGAGATACCCACCATCTCCTACGCCGATTTCTACCAGCTTGC
CGGAGTTGTGGCCGTCGAGGTGTCCGGTGGACCTGCCGTCCCCTTCCACCCAGGAAGGGAGGACAAACCTGCACC
CCCACCTGAGGGCCGTCTTCCTGATGCTACCAAGGGTTCTGACCACCTAAGGCAGGTCTTCGGTGCGCAGATGGG
CTTGAGTGATCAGGACATTGTTGCCCTCTCTGGCGGTCACACCCTGGGAAGGTGCCACAAGGAAGATCTGGTTT
TGAGGGACCTTGGACAAGAAACCCTCTGCAGTTTGACAACTCTTACTTCACGGAGCTTCTGAGTGGTGACAAGGA
GGGCCTTCTTCAGCTTCCTAGTGACAAAGCCCTGCTGAGTGACCCTGCCTTCCGCCCACTCGTCGAGAAATATGC

Figure 2 continued

TGCAGATGAGAAGGCTTTCTTTGAAGACTACAAGGAGGCCCACCTCAAGCTctccgaactgggggttcgctgatgc
tgcgccgcttatccgtatgatgttccggattatgccgagcatctacaaacagct > SEQ ID NO:966  215420  245911_301573_1
gagGAGAGGGAGAGAATGCCGGTGCCGGTGGTGGACAATGCGTACCTCAAGGTGATCGAGTCGGCGAGGCGCGAT
CTCCGCGCGTTCATTGCGGAGAAGAATTCCGCGCCACTGATGCTTCGATTGGCATGGCACGATGCCGGGACGTAT
GATGCTGTGTCCAAGACTGGAGGACCGAATGGATCGATCCGGAGCGAGCGCGAGTATACCCACGCTGCCAACAAT
GGGATCAAAATCGCCATAGACTTTTGTGAGCCTATCAAACAGAAATATCCCATTATCACGTATGCTGATCTCTAC
CAGCTTGCTGGCGTTGTTGCTGTGGAAGTCACTGGAGGTCCTACAATAAATTTTGTTCCTGGCCGCAAGGAATCG
GTCGCTACTACACCCGAAGGACGGCTTCCCGATGCTCATCTCGGGGCAAAGCATATCCGCGATGTCTTCTACAGA
ATGGGTCTATCTGACAAGGATATCGTCGCTCTCTCTGGTGGTCACACACTGGGTAGAGGACACAAGGAAAGGTCT
GGGTTTGAGGGACCCTGGACATCACAGCCATTGAAGTTCGACAACTCATACTTCACGGAGCTTTTGAGAGGAGAA
TCGGAAGGCCTGTTGCAGTTGCCGACAGACAAGTGCTTGCTTGAGGATCCATCGTTCCGTCCATACGTGGAGCTG
TATGcaaaGGacgaagaCGcattcttcaaAGAttaCgCCGAGTCGCAcaagaagctAtCCga > SEQ ID NO:967  215420  30206_300393_1
cccacgcgtccgccagatttttattatccttcctcgaaacgagatccacgattcgttgctgcgatcggcgttatta
tcgtcAGCTCTCTCGTTTCTGTTCTGTGGTTCGATATTGCTGAGTTTCTAGGCTAATCTTACGAATCTGTGAAAG
TTTTTGAGAGATTTGGCTTCTGTAGCTCACTCCTGCTTGATTTAGAGCTTAGCTAAGATGACGAAGAACTACCCA
ACCGTGAGCGAAGATTACAAGAAGGCTGTTGAGAAGTGCAGGAGGAAGCTCAGAGGTTTGATCGCTGAGAAGAAC
TGTGCACCCATCATGGTCCGACTCGCATGGCACTCTGCTGGAACTTTCGATTGTCAATCAAGGACTGGAGGTCCA
TTCGGAACAATGAGGTTTGACGCTGAGCAAGCTCATGGAGCCAACAGTGGTATCCACATTGCTCTTAGGTTGTTG
GACCCCATCAGGGAGCAATTCCCTACCATCTCTTTTGCTGATTTCCATCAGCTTGCTGGTGTTGTGGCCGTTGAA
GTTACTGGTGGCCCTGACATTCCTTTCCACCCTGGAAGAGAGGACAAGCCCCAACCACCTCCaGaGGGTCGTCTT
CCTGATGCTACCAAggGTTGTGaccatTTGAGAGATGTCTTTGCTAaGcAGATGGGCTTATCTGACAAAGACAtT
gTCGCTTTATCTGgtgCCCACACTCTGGGACGATGCCACAaggATAGGTCTggcttcgaaggtgCATggACATCA
AACCCTCTaaTCTTCGACAACTCtTACttcaagGaaCTCttgagc > SEQ ID NO:968  215420  259825_301709_1
gcggacgcgtgggAGAGGAGACGAGAGGCGAGAGGCGAGGACGCATTCTTGGATCTAGATCGACAATCAGAATGG
GCAAATCTTATCCTGCAGTGAGCGACGAGTACCTGGCCGCCGTCGACAAGGCCAAGAGAAAGCTTCGCGGCTTCA
TCGCAGAGAAGAACTGTGCCCCATTGATGCTTCGTCTTGCATGGCATTCGGCCGGGACTTTCGACTGTGCGTCCA
AGACGGGTGGTCCCTTTGGAACCATGAAGCACGCCGAAGAACTCGGCCACGGCGCGAATGCCGGCCTCGACATCG
CTATCAAGCTTCTCCAGCCGATTAAAGACCAGTTTCCGGTCCTGAGCTATGGCGACTTCTACCAGCTTGCTGGGG
TCGTCGCAGTGGAGATCACTGGAGGCCCGGATATTCCATTCCATCCGGGGAGAGTGGACAGGGAGACATGCCCCG
TAGAGGGCCGGCTTCCAGACGCGACCAAGGGAGCCGATCATCTCCGTGACGTTTTTGTGAAGCAAATGGGGCTCT
CTGACAAGGACATTGTGGCTCTTTCTGGCGGTCACACTTTGGGAAGAGCACACAAGGAAAGGTCGGGTTTTGAGG
GCCCATGGACGCACAACCCTCTCCAGTTTGACAACTCCTACTTCACACTTCTGCTGAGCGGCGAGCAAGAAGGCA
TCCTGACGCTCAAGACGGACAaGGTTCTGGtg > SEQ ID NO:969  215429  103740_300027_1
tggtatcaacgcagagtggccattacggccggggctcttgagatatgtactagtGTCCATTCTCACCAAGAAACC
CTAGCCCCTACCGTGCTCGAGCTGCTTCGTTGCTAGGTTGCCAATTCTATCTCCACAACCATGGCGGATGTTGA
AGCCGATGTGACGGCAGGGCAGCCAAAGAAGAGGACGTTCAAGAAGTTTAGTTACAGAGGCGTCGATCTCGATGC
TTTACTTGACATGTCCACTGACGAGCTTGTTAAGCTCTTTAATGCTCGTCCTCGCAGAAGGTTCCAGAGAGGTTT
GAAGAGGAAGCCAATGGCCTTGATCAAGAAGCTGCGCAAGGCGAAACGTGAGGCACCACCAGGGGAGAAGCCAGA
GCCTGTCAAGACTCATCTGAGGAACATGATTATTGTTCCTGAGATGATTGGAAGTGTCATTGGCATCTACAATGG
AAAGACGTTCAATCAGATTGAGGTCAAACCTGAGATGATTGGTCACTATCTGGCTGAGTTCTCAATCTCATACAA
GCCTGTCAAGCACGGGAGGCCTGGTATTGGTGCTACTCACTCATCCAGGTTCATTCCTCTGAAGTAATATGGGAT
GTCAGGTTATTTAGTGCCTTCTTTTACTAGAATTTTGATGAAGGCCACAGATTATGAAAGAGTTGAGTCTTAAAT
TGCAGTGGTCAGCTGATAAATATCTATTTTTAGTTGTTTGTTATGAGGTTCGTTTCTTagaCTTTTCTTTTCAAA
TGCTCAATTTAggagaGgGCTTGATGCTCAcaagccATATg > SEQ ID NO:970  215429  124724_300437_1
ccgcgaaggtcgctgatttccatctccacaaccatgacgGACGTTGAAGCCGATGTGACGAGTGGACAGCCAAAG
AAGAGAACGTTTAAGAAGTTTAGCTACAGAGGCGTTGATCTCGATGCTCTTCTCGATATGTCCACTGATGAGCTC
GTGAAGCTCTTCAATGCTCGTCCTCGTAGAAGGTTTCAGAGAGGTTTGAAGAGGAAGCCGATGGCACTGATCAAG
AAGCTGCGGAAGGCTAAACGCGAGGCTCCACCAGGTGAAAAGCCAGAGCCTGTCAAGACTCACCTGAGGAACATG
ATTATCGTTCCTGAAATGATTGGAAGTGTTATTGGAATTTATAATGGAAAGACATTCAATCAGATTGAAGTCAAG

Figure 2 continued

CCTGAGATGATTGGCCACTATTTGGCTGAGTTCTCCATCTCATATAAGCCCGTCAAGCACGGTAGACCTGGTATT
GGTGCTACTCACTCGTCAAGgttTATACCACTCAAGTGATCTGgTCGAGTTCTCTATCTCATAAGCCTGtcaaGC
TCGGTAGAGCTggTAttggTGCtactcccCCAtc > SEQ ID NO:971 215429    254092_301631_1
GCTCCAACGAAGCTTTCTCCCGTCGATCGAATCCTCGCTCTTCCGCAGCTATGGCAGATGTTGAACTGGAGCCCG
GAACAGTGCAACCCAAGAAGAGGACGTTTAAGAAGTTCACATTCCGCGGTGTTGATCTTGATGCCTTGCTGGACA
TGTCATCTGACGAGCTTGTTGAGCTCTTCAACGCCAGAATCCGGAGAAGGTTCCAGCGTGGGTTGAAAAGGAAGT
CAGTGGCTCTCATAAAGAAGCTGAGAAAGGCGAAACTGGATGCACCAGCAGGTGATAAACCTGAACCAGTCAGAA
CTCATTTGCGTAACATGGTAATTGTACCTGAGATGATTGGGAGTGTTATTGGTGTCTACAATGGGAAAACATTTA
ATCAAGTTGAAATCAAGCCTGAGATGATTGGTCATTATTTGGCTGAGTTTTCTATCTCCTACAAGCCAGTGAAGC
ACGGCCGTCCTGGTATAGGAGCTACTCATTCCTCTCGGTTCATTCCTCTCAAGTAATTTGGAGCTAGTGATCGTC
TGCCATTGGATCTGCAATTCTTCATTATGCTGCAGAAGGAGCAGAGAAGTAGGCTGGCTAATATATATTTAATGT
TTTTCTGAGACAACCTGACAATTTTGAAATGTAGCTGTTCCTCCTTATTGCATCAAGTAGTGTGATGAATTGTGG
TAGGTAGCTGGTAATGTGCTAGTATAGCATGCTCCCTTAACTGTTTTTTTT > SEQ ID NO:972 215429    238096_301291_2
GGAGGCGCAGAACAAGGAGGAGGAGGAGGAGGAGCAGCCATGGCGGACACCGAGGATGCGGGCGCTGGATCCCTC
CAGCCGAAGAAGCGTACGTTCAAGAAGTTCTCTTTCCGTGGCGTCGATCTGGATGCGCTGCTCGACATGTCCAAT
GATTCGCTTGTCGAGCTCTTCCACGCCCGGGCCAGGAGAAGGTTCCAGAGGGGTCTCAAGAGGAAGCCCATGGCT
CTCATCAAGAAGCTACGCAAGGCGAAACGTGAGGCCCCGGCGGGAGAGAAGCCCGAGCCGGTGCGAACTCACCTC
CGCAACATGATCATCGTCCCGGAGATGATTGGAAGCATCATCGGCGTCTACAACGGCAAGACGTTCAACCAAGTG
GAGATCAAGCCCGAGATGATCGGCCACTACCTGGGAGAGTTTTCCATCTCGTACAAGCCGGTGAAGCACGGACGC
CCTGGTATCGGTGCTACGCACTCGTCCAGGTTTATTCCTCTCAAGTAAAAGGCGAGGTTTTGTAACGCTGGTTTT
TGAAACTTCTTTCTCGAATGCTGAAGTTTACATTGCAAGCTTAGATTCTTTTCTCTCGttngCCGGTGATATAA
GAGTAACGTAAAGGAATTTGCAATC > SEQ ID NO:973 215429    224136_300979_1
GCGCTTCTGCTGAATCCCGAAAGGCTCGAACCTTCAAGAAGTTCTCCTACCGAGGCGTTGACCTCAAGGATCTGC
TCGAGATCTCCACCGACGAGTTCAAGGAGCTCGTTTCCGCCCGAGCCCGAAGACGGTTCAACCGAGGCCTCAACA
AGAAGCCTACCATTCTCATCAACAAGCTGCGAAAGGCCAAGCTCGCCGCCGGCCCCAACGAGAAGCCCGCCGTGG
TCAAAGACCACCTGCGAAACATGCTCATCTTCCCCGAGATGATTGGCTCTGTTGTTGGTGTCTACAAACGGAAAG
TCCTTCACCACCGTTTGAGATCAAAGCCCGAGATGATCGGCATGTACCTCGGTGAGTTCTCCATCAACTAAAACC
CCAACCGAACACGGGCGACCCGGTGTCTCCAACTCCAAGTTCATTCCTCTGCGATAAGGGATTGCATGGTAATAA
AAATATGTATTGTATGATTGCACACCAAACAACACAA > SEQ ID NO:974 215429    179876_300564_1
GCGCTCGTCGATACCCTGCGCGTCGATAGGCGAATCCTTGGAATCAACACACAACCGCGATCATGGCTGACGAAT
ACAACGCCGAGGAGGCCGCTGAGATCAAGAAGAGAAGAACCTTCCGCAAGTTCTCTTACCGAGGAATCGACCTTG
ACAACCTCCTCGACCTCTCCTCTGACCAGCTCCGAGATGTCGTCCACGCCCGTGCCCGCAGAAGGATCAACCGCG
GCCTGAAGCGCCGCCCCATGGGCCTCATCAAGAAGCTCCGAAAGGCCAAGCAGGAGGCCAAGCCCAACGAGAAGC
CCGACCTCGTCAAGACCCACCTCCGAGACATGATTGTCGTCCCCGAGATGATTGGAAGCGTCATTGGTATCTACT
CCGGCAAGGAGTTCAACCAGGTCGAGATCAAGCCTGAAATGGTTGGCCACTACCTGGGTGAATTCTCTATCTCAT
ACAAGCCTGTCAAGCACGGTCGACCTGGTATCGGTGCCACTCACTCTTCTCGTTTCATTCCCCTCAAATAAGAAG
GTTGTGGTCTTGGGTGGTTTCTGCATTCACGGACATTTTTGGGCGAAAAGGACTGGTTTTAGtagacggAGGaaa
GCc > SEQ ID NO:975 215429    170212_300531_1
CGAACCGCCGCCGCCGCCGTCTCCTCCTCGTCATCCAAGCAGCTCGCGCCTCCGACCCCTCGCCTCGAGCTCCAG
CTCTCCCCAACCCCTTCAACAATGGCGGATGTCGAGGTCGAGGCGGAGGTGGCCGCGGCCGGAGCGCCGAAGAAG
AGGACGTTCCGCAAGTACAGCTACCGCGGCGTGGACCTGGACGCGCTCCTCGACATGTCCACCGACGACCTCGTC
CAGCTCTTCCCCGCGCGCGCCCGCAGAAGGTTCCAGAGGGGCCTGAAGAGGAAGCCCATGGCGCTCATCAAGAAG
CTCCGCAAGGCGAAAAAGGATGCACCTGCTGGTGAGAAGCCAGAGCCTGTGAGGACCCACCTCAGGAACATGATC
ATTGTGCCTGAGATGATCGGAAGCATCGTCGGTGTCTACAACGGCAAGACCTTCAACCAGGTTGAGATCAAGCCT
GAGATGATTGGCCACTACCTCGCAGAGTTCTCCATCTCGTACAAGCCAGTCAAGCACGGTAGGCCTGGTATTGGT
GCTACCCACTCCTCACGGTTTATCCCTCTCAAGTGAGAGATCATCTGCAGCTGTTTGCGCTTCCAGTATGTAGCT
TGAGCTGTCGAACAAAACTCCAAAGTACTTTATTAATTGCGTGTCCACCGAGCAGCCACTTTTTGAACCTTGGTT
AATCTGATGTTATTTCCCCAGATATTTTGAAGTTATAT

Figure 2 continued

> SEQ ID NO:976  215429  157474_301738_1
GTGCTTACTTCGCTGTTAGTGCAATTCCAAACCATGGCGGACGTTGAAGGTGCTGATGTTGCGGCCGGACAGCCA
AAGAAGAGGACGTTTAAGAAGTTTAGCTACAGAGGAGTAGATCTGGATGCTCTGCTTGACATGTCTACAGATGAG
CTCGTTAAGCTCTTCCCTGCTCGCCCTCGCAGAAGGTTCCAGAGGGGCTTGAAGAGGAAGCCAATGGCTTTGATC
AAGAAGCTGCGTAAGGCGAAACGTGAGGCTCCACCAGGTGAGAAGCCAGAGGTTGTCAGAACACATTTGAGGAAC
ATGATTATTGTACCTGAGATGATTGGAAGCGTTATTGGAATCTACAATGGGAAAACATTCAATCAAATTGAGGTC
AAGCCTGAAATGATTAGCCACTATTTAGCTGAGTTCTCAATCTCATACAAGCCTGTCAAGCACGGTAGGCCCGGT
ATTGGTGCTACTCACTCTTCAAGGTTCATTCCATTGAAGTAGTCTAAAAAAGGTTCATTCCATTGAATTGATTCA
GGCAGAGGTTTTCGTTATGGTTTCTAGTAATACTAGTACTTTATTTTACTGCAATTTTGATGAGAACAATGGATG
TTGATCTGTGATTAGTCTT

> SEQ ID NO:977  215429  13794_300270_1
CCCACGCGTCCGTGTGGAACCAGAGGTTGCAGCAGCAGGAGTTCCAAAGAAGAGAACGTTCAAGAAATTCGCCTT
CAAAGGAGTCGATCTCGATGCTCTTCTCGACATGTCTACCGATGATCTTGTCAAGCTCTTCTCTTCCCGTATTCG
CAGAAGGTTCTCTAGAGGATTGACGAGAAAGCCTATGGCTTTGATTAAGAAACTCCGCAAGGCGAAAAGAGAGGC
ACCAGCTGGTGAGAAGCCAGAACCAGTGAGAACCCACTTGAGGAACATGATCATTGTGCCTGAAATGATTGGAAG
CATCAT

> SEQ ID NO:978  215431  120067_300083_1
cccccccatctcattacccaacaactcttccagctactgctgctgttacatcttcctgcggtagcgccatggct
tcagaGAAGAAATTGAGCAACCCCATGAGAGAAATTAAGGTCCAGAAGCTCGTTCTCAATATCTCCGTCGGTGAG
AGCGGAGATCGTCTCACCAGAGCAGCTAAGGTCTTGGAGCAGCTTAGCGGCCAATCCCCTGTTTTCTCCAAGGCT
AGGTATACTGTGCGGTCTTTTGGAATCAGGCGTAATGAAAAGATAGCTTGCTATGTAACTGTCAGAGGGGAGAAA
GCTATGCAGCTACTTGAGAGTGGATTGAAAGTTAAGGAATACGAGTTGTTGAGAAGGAACTTCAGTGAGACCGGC
TGCTTTGGGTTTGGTATTCAGGAGCACATTGATCTTGGAATTAAATATGATCCGTCAACTGGTATTTATGGCATG
GACTTCTATGTTGTATTGGAGCGTCCTGGATACCGTGTTGCCCGTCGGCGCAGGTGTAAGTCTCGAGTTGGGATT
CAGCACAGAGTCACAAAGGAGGATGCGATGAAGTGGTTCCAGGTCAAATATGAAGGTGTTATCCTTAACAAGTCC
TCAAACATTCAGTGATAAGCTTAGAAAGCCAACTTCTGGATCAGTCTGTCTCCTCGCAAGTTTATGTTTATGTAT
TTTGTTGACCTGCATCTATATCACTCGTAGAGGGAAGTTTTGGAGAGTTTCTAGTAGTGGCGTATGAGGATGTTT
TAGTTCTCATTTTGGCTAtCAGATCAATTCaaTCTTTTTTTGgTCATtTTCTTTTGTtccaattaaatCAGattC
AttGAACTccACaaTCTAgTacaataGATg > SEQ ID NO:979  215431  41636_300197_1
aaccCCTAATCTTGAGATGGCATCGGAGAAGAAGCTCTCGAACCCTATGAGGGATATTAAGGTCCAGAAGCTAGT
TCTTAACATCTCTGTTGGTGAGAGTGGTGATCGTCTCACTCGTGCCTCCAAGGTGTTGGAACAGCTCAGTGGTCA
GACTCCTGTCTTCTCTAAGGCGAGGTACACTGTGAGGTCTTTCGGTATCAGGCGTAATGAAAAGATTGCGTGCTA
TGTCACCGTGAGAGGTGAGAAGGCAATGCAGCTTCTTGAGAGTGGCTTGAAAGTGAAGGAATACGAGCTGTTGAG
GAGGAACTTCAGTGACACTGGCTGCTTCGGATTCGGTATCCAGGAGCACATTGATCTTGGAATCAAGTATGATCC
TTCTACCGGTATCTACGGTATGGATTTCTACGTTGTTCTTGAACGTCCAGGATACCGTGTGGCCCGTCGCCGTAG
ATGCAAGACTCGCGTTGGTATTCAACATAGAGTTACCAAGGATGATGCCATGAAGTGGTTCCAAGTTAAGTATGA
AGGAGTTATCCTCAACAAGTCTCAGAACATCACTGGTTGAAGAGCTTTTTTTTGTCATTTTGTTTtgttcaagt
tcttatatttaagattctggatagtaaggatttcgtgttgtggtaacctttttgcggccgcaagctcgag > SEQ ID NO:980  215431  244907_301563_1
gGGCGCCGCGGCATGGCGGAAAAGCAGAACCCCATGCGGGACATCAAGGTCCAGAAGCTCGTCCTCAACATCTCC
GTCGGCGAGAGCGGCGATCGTCTCACCAGGGCCGCCAAGGTCCTGGAGCAGCTCAGCGGGCAGCAACCTGTCTTC
TCCAAGGCCCGGTTCACGGTCCGGTCTTTTGGCATCCGGCGTAACGAGAAGATCGCTTGCTACGTGACCGTTCGG
GGCGACAAGGCGATGCAGCTACTCGAGAGCGGGCTCAAGGTCAAGGAATACGAGCTGCTGCGCCGCAACTTCAGT
GACACTGGATGCTTTGGCTTCGGCATCCAGGAGCACATCGACCTGGGCATCAAGTACGATCCATCGACGGGCATT
TACGGGATGGATTTCTACGTAGTGCTGGAGCGGCCTGGCTACCGCGTTGCGAGGAGGCGGCGGTGCAAGTCCAAG
GTTGGGATCAAGCACCGGGTGACCAAGGAGGACGCCATGAAGTGGTTCCAGCTCAAGTACGAGGGCGTCATCCTC
AACAAGTCCCAGGCCTTCTGACCTGCTTGACACATAAAAACCAAAGCCGGATGTAACCTCTCTTGTGGTGTGTtt
tataTCAGCTTTTTTCCAAAAAAAAaa > SEQ ID NO:981  215431  231594_301231_1
cgacCCACGCGTCCGAACTTCATCACCAGGTCGACTAATAACAGCAGCCATGGCTTCCGAGAAGGCAAACAACCC
CATGCGGGAGCTTAAGATTCAGAAGCTCGTTCTGAACATCTCCGTCGGAGAGTCTGGTGACAGACTTACCCGAGC
CGCCAAGGTCCTTGAGCAGCTTTCTGGTCAAACCCCCGTCTACAGCAAGGCCCGTTACACCGTCCGAACTttCGG
TATTCGACGTAACGAAAAGATCTCTGTCCACGTCACCGTCCGAGGCCCCAAGGCTGAGGAGATTCTCGAGCGTGG

Figure 2 continued

CCTCAAGGTCAAGGAGTACGAGCTCCGCAAGCGCAACTTCTCCGAGACCGGCAACTTCGGTTTCGGTATCAGCGA
GCACATCGATCTCGGTATCAAGTACGACCCCTCCATTGGTATCTACGGCATGGACTTCTACTGCTGCATGACCCG
ACCTGGTGAGCGTGTCACCCGCCGTCGCCGAACAAAGACCAAGATCGGTGCCTCTCACCGCATCAAGCGTGAGGA
GAGCATCAAGTGGTTCAAGTCTCGCTTCGATGGTATCGTCCGATAAACGGTTGAAAACAAAATGGGTATTTGAAT
TTGCGGAtTgGGTCACGGCGAAAATAAGGGGAAAACTCACATGGGGCATGTATTTTCtgttgCCATTgctgcatc
aGCTCGACTCTTTTAGtCgag > SEQ ID NO:982 215431  128352_300475_1
CCCCCCCCCCGTTTTGGATCTTCTTCGCGCCATCAGTACCCTACAACTCTCCCTGCAGCTGCAACATCTTCCAGC
AGAATTGCGATGGCTTCAGAAAAGAAACTGAGCAATCCCATGAGGGAAATCAAGGTTCAGAAGCTTGTCCTTAAC
ATCTCCGTTGGTGAGAGTGGAGATCGACTTACTAGAGCTGCAAAGGTGTTGGAGCAACTTAGTGGTCAATCACCT
GTTTTTTCTAAGGCAAGGTACACTGTGAGGTCCTTCGGAATCAGGCGTAATGAAAAGATAGCTTGCTATGTGACT
GTCAGAGGGGAGAAAGCCACGCAGCTACTTGAGAGTGTATTGAAAGTCAAGGAATATGAGTTGTTGAGAAGGAAC
TTCAGTGAAACCGGCTGTTTTGGGTTTGGTATTCAGGAGCACATTGATCTTGGGATCAAATATGACCCTTCAACT
GGTATTTATGGTATGGATTTCTATGTTGTATTGGAGCGCCCTGGATACCGTGTTGCTCGTCGTCGTAGGTGCAAG
TCTCGAGTTGGGATCCAGCACAGGGTCACGAAGGAGGATGCAATGAAGTGGTTCCAGGTCAAATAT > SEQ ID NO:983 215431  220409_300955_1
GACGCAGCAGCAGACCACGTCGCAAAACAACCGCAGCAATGGCCGCCGAAAAGTCCAGCAACCCCATGCGGGAGC
TTAAGATTCAGAAGCTCGTTCTGAACATCTCCGTCGGTGAATCTGGTGACAGACTCACTCGTGCCGCCAAGGTGC
TTGAGCAGCTGTCTGGTCAAACCCCCGTCTACAGCAAGGCCCGTTACACCGTCCGTACCTTTGGTATCCGCCGTA
ACGAAAAGATTGCTGTCCACGTCACCGTCCGCGGCCCCAAGGCTGAGGAGATTCTCGAGCGTGGCCTCAAGGTCA
AGGAGTACGAGCTTCGCAAGCGCAACTTCTCCGAGACTGGCAACTTCGGCTTCGGTATCAGCGAGCACATCGATC
TTGGTATCAAGTACGACCCTTCCATCGGTATCTACGGCATGGACTTCTACTGCTGCATGACCCGCCCCGGTGAGC
GTGTCACCCGCCGCCGCCGCATGAAGAGCAGAATCGGTGCTTCTCACCGCATCAAGCGCGATGAGACCGTCAAGT
GGTTCAAGGGCCGCTTCGATGGCATTGTCCGATAAACGGTTTAAAATCCAAACCGAATAAAATACTTTTTTTTTC
TTGTCTTGAAGGAAATGGGCATGGCGAACATTTGGGGGtacaaagGATCATATggtCCATGTATTCTTCCGCTTG
AttTTTACATCAGCTCgtaccaaaatttttgAGTCGagcAAcggCCTGAgagaccgaccggCGCTATGCcggctt
cAcA > SEQ ID NO:984 215431  228247_301019_1
gatgcgggagatcaaggtgcagaagctcgtgctcaacatctccgtcggcgagagcggcgacaggctcacccgcgc
ctccaAGGTGTTGGAGCAGCTGAGTGGGCAGAGCCCAGTTTTCTCCAAGGCGAGGTACACCGTGAGGTCATTCGG
TATCCGTCGTAACGAGAAGATCGCGTGCTACGTCACCGTCAGGGGCGAGAAGGCCATGCAGCTTTTGGAGAGTGG
CCTCAAGGTCAAGGAGTACGAGCTGCTGAGGAGGAACTTCAGCGAGACCGGATGCTTCGGGTTCGGTATCCAGGA
GCACATTGATCTTGGCATCAAGTACGACCCCTCAACAGGTATCTATGGAATGGACTTCTATGTTGTGCTTGAGCG
TGCTGGCTACCGTGTTGCCCGTCGTCGGAGGTGCAAGTCTCGCGTTGGGATCCAGCACCGGGTGACCAAGgagGA
TGCCATgaaGTGGTTCCAGGTCAAGTATGAaGgagTCATCCTCAACAAGgcccaggcgAATACCTCTTAAAACAT
TTTcACCTgtaGgctCaGCTGTtagaAAAGCTTTTCCCTTGTTGGGcagAaGTTCACCTTCCAAGTTTtaTGtTA
CTTGATGAATTTTcCGGCCagatgtttttgtcaATTACCTGaaagCTAagagcAtgatcT > SEQ ID NO:985 215431  226395_300996_1
AAAAATGACTGACTCCTCTGCCAACCCCATGCGAGAGCTGCGAATCGAGAAGCTCACCCTCAACATTTGTGTTGG
TGAGTCCGGTGATCGACTTACCCGAGCCGCCAAGGTGCTCGAGCAGCTTTCCGGTCAGACCCCCGTCTACACCAA
GGCCCGATACACCATCCGATCTTTCTCTATCCGACGAAACGAAAAGATTGCCGTCCACGTGACCGTCCGAGGCCC
CAAGGCTGAGGAGATTCTCGAGCGAGGCCTCAAGGTCAAGGAGTACGAGCTCAAGGCCAAGAACTTCTCTGAGAC
TGGTAACTTCGGTTTCGGTATCAACGAGCACATCGACCTTGGTATCAAGTACGACCCCAACATCGGTATCTACGG
TATGGACTTCTTCGTCATCATTGGTCGACCCGGTTACCGagTgCCCGACGAAAGCGATGCCGAGCTTCCGTTGG
TATCAACCACCGAGTCACCAaGGAGGACACCATCAAGTGGttCAAGCAGAAGTACGACGCTTCCGTCCTCTAAGC
GGGTcATtTttGtATCAtatcctcaccCATCATGCAAaaATAAtCCA > SEQ ID NO:986 215431  155570_301357_1
TGACTACCCCCTCGACCCACGCGCTCGCGAATCGAAATGGCTTCAGAGAAGAAGTTGAGCAACCCAATGAGGGAA
ATCAAGGTTCAGAAGTTAGTCCTTAACATCTCTGTTGGTGAAAGCGGAGATAGGCTCACCAGAGCAGCCAAGGTC
TTGGAGCAACTCAGCGGCCAATCCCCTGTTTTCTCTAAGGCTAGGTATACTGTCCGGTCCTTCGGAATTAGGCGT
AATGAGAAGATTGCTTGCTATGTCACTGTCATGAGGAGACAAAGCTATGCAGCTCCTTGAGAGTGGGTTGAAAGT
CAAGGAATACGAGTTGTTGAGAAGAAACTTCAGTGAGACTGGCTGCTTTGGTTTTGGCATTCAGGAGCACATTGA
TCTTGGAATCAAGTATGACCCTTCAACCGGTATCTATGGTATGGATTTCTATGTTGTGCTTGAGCGCCCAGGATA
CCGTGTTGCTCGTCGTAGGAGGTGCAAGGCCCGAGTTGGAATTCAGCACAGGGTCACAAAGGATGACGCTATGAA

Figure 2 continued

GTGGTTCCAAGTCAAATATGAAGGTGTTATCCTTAACAAATCCTCAAACATTCAGTAAGTTGATTGTGGATCAGT
TTGTCCCCCAGCAAGTTTATGTTTTCTATGCATTTTGTAGACCAACATTTAATACTCCTAGAGTTCAAAGGTTTT
GAAGAGTTGCTGTTATTTGGCATATCAGGATAT

> SEQ ID NO:987  215432   205811_300802_1
ACTCCATCCAACCCTTCCAGTCCAACCTTCCAATCCCTCCTCAAACCATCAAAATGGCCTCCCGTGTCTTCGCCT
CCCGCCTGGCCTCCCAGATGGCCACCAAGGCTGCTCGCCCTGCCATGCGTGCTCCTCTCGCCGCTACCAAGCGCA
CCATCACCACTGGCAGCCCCATGCAGGCCATGAAGCGCCAGACCATCCAGGCTGCTGGACGCAACGCCTTCCAGG
CTCAGCGCCGCGCCTACTCTTCCGAGATCGCCCAGGCCATGGTTGAGGTCTCCAAGAACTTGGGTATGGGTTCTT
CTGCCATCGGTCTGACCGGTGCTGGTGTTGGTATCGGTGTCGTTTTCGCTGCCCTTATCAACGGTGTTGCCCGCA
ACCCCGCTCTCCGTGGCCAGCTCTTCTCCTACGCCATTCTGGGTTTCGCTTTCGTTGAGGCTATCGCTCTTTTCG
ACCTCATGATTGCCCTGATGGCCAAGTTCACCTAAATTGCCTCTCGAGAGATTGGAAAAGCTCCGGCCAGTGGAT
GGAGCAATTAATATAAGGGGACGACGTTGGACCGTCCGCCACTTGGAGTTTGATGGTTTGTCAAATGCAATTGGG
GTGCCGACGTGCACATAAAACGAGGAAGACGATGCATCATAGACGGTGTTAGagGTTGCGGAAGG

> SEQ ID NO:988  215461   218347_300917_1
ccgcaatccctccctcctcgaatgggtcCAATTGTCGCCCGCAAATcgcccGCACCGTCGCCGAagcCGAATCAT
TCATCATGTCCGACGAGGAAGGCCaggaGCTTGTCACCAAGCCCTTCAAGTTTGTCACTGCTGGTGAGATTGTCC
AAcacGgCCCCTTCTACGTGAACGAAACGACCGACCGGCTCGGGCAGCTTCATCAATGCATTGCCCATCGACTGC
GAGCTACTTACCCGCAGCTTGGAATAGCTTGAGCTTTGCCCGTCGCCGGAGGACCCGCTTCGCAGATATATATAC
CTTCGTTATATATGCACACATGTCGCTAACCCGAGTGCTCGCGCAGGCACTGATGCCCGTTTCCCCAACGTGAAT
CAGACCAAGCACTGCTGGCAAAACTACGTCGACTACCACAAGTGCATTCTCGCCAAGGGAGAGGACTTTGCGCCT
TGCCGTCAGTTCTGGTTGGCCTACCGATCACTGTGCCCTTCTGGATGGTACCAGCGATGGGACGAGCAGCGCGAG
TCTGGTAACTTCCCTGTGAAGCTCGATGCTTAAATTCCATATTTGAGGTGGCGGGGTACATAAGCAAGGGTGTTC
ACATAGATTAAGCAGCCAGGCGGCGCATGTGCTGCCAGAAAATGTAGTAGTAGTCAATCACAAGCAAACAGGCTC
AATTTTTGACTGTTAAAAT > SEQ ID NO:989  215516   205424_300798_1
AACCATCTTCATCCATCGTCTTTGATTCATCAAACAGCTCTTGGATCCGTTCTGATCCAGCCAACCAACCATCGC
CATGTCTGAACCTCTCACCAAGGTCGACTCCGCCGTTCAAGGCCTGTCATCATCACCGCCCAAAGAGAAGGGCCA
TAGGAGAACAAGCTCTAGCGCGGCTGGTGTTATGACCATTGCGGAAATCAATGAAAGCCATGCTCCTCTAGAACT
CGCAATAGAGACACAGCAGACAGCGTGGAAAATAAATCAGCGGCCCAAGGATCTCGACAATG > SEQ ID NO:990  215516   208143_300832_1
CATCAAACAGCTCTTGGGATCCGTTCTGATCCAGCCAACAACCATCGCCATGTCTGAACCTCTCACCAAGTCGAC
TCCGC > SEQ ID NO:991  215549   218632_300920_1
TCCTATTCACAGCATTCTTTCGCAATGGGGCCCTCCGTCGTAATGATAGACACCTCGGACGACTTCTTCGCTGCC
CCGGTGGCAACATCACAGACGAAGCGAACTCTCCTCCTGGCGCCGCCGTCTCTCGCCTCTCACCCAACTGCGCTC
ACCAACGTCGTGTCTCAATATGATCGCTCTGCTACAGATCTTCAGATGATCGACCGGTTGTCAGCCGGTCTCGTC
AAGCTGCCGTCTGCTACATACGACCTCGTTCTCGTCCTCGCCGATGCGTCTTCCTCTCTCAACGAGACCCTACCC
CTCTTGACTAGAAGCATCCCCTGCTGGCGTCGGCTTCATCGACTTCTCTGACGATCTCGACGCCGATTACGACGA
TGACGAGCTCATCGACGAAGACACTCTTATGACCGAAGATGACCTCAAGCGACCCATCAATATCCCTCCCGAATG
TCAGCCCAAAGCCGGCAAGCGCCGCCGCGCCTGCAAGGACTGCACCTGCGGCCTCGCCGAACGTCTCGAAGCTGA
AGACGCCGCCAAGCGCGCCGCCGCCGACAAGGGTCTCCAGAGCGTCAAGCTCGCCGTCGACGACCTCAC > SEQ ID NO:992  215550   210454_300889_1
ttctCTCTGCATACCAAACCACTTCCTCCCCCCGCAAGCAAACACAGTCTTTTCAGCTCTCTCTGGGCTTTTATA
TACGCATAGACTCTTCCATCGTTCTTTGTCAAATTCATCCTCCTCTTCAACCACAACAAGCCTTCGTTACACCGC
TTTACGAAGCCCCTTCTTCTCTCCTCTCCTCCATTCTTCTACCTTTTCCACACAACAAACACACACAGTCACA
ATGGCCTTCTCTACTCGAAGCGTACTGCGCGCCTCTCGCGCCGTCAACTTCTCAGCTGCCTCCCGTGTTGCTGCT
CCCAGCAACGCCGTCCGCTTCTTCTCGGCCTCCCGTGCCGTCCGCGTGTCTGACACTGCCAACAAGAAGAGCGTT
GTTCGCGAGAAGGAGGTTCCCGTCACCGTCTATGGCGCTGGCCAGGGTGACAAGCAGACACTGCAGGTTCCTGAT
GGCGCCTCCAAGGTCCCCTACGACAGCCCCGTCCCCGCTGAGCGTGAGGAGGTCGAGCCTCTTAACAAGAAGGTC
TACGACCAGCTGCCTCACACCGTCAAGAGCATGACGGTTCAGGACAAGGTCATCATCATCACTGGTGGTGCTCGA
GGCCTGGGCAACCACATGGCCCGAGCCTGTGCCGaggCTGGTGCCAAGgccATCATCATCTtcGATGCCAACCAG
GAGCTGGGCGACgcttccgctgcTGag

Figure 2 continued

> SEQ ID NO:993  215552  124824_300426_1
cccacgcgtccgctccctcaacaaatatcacacttccattacatctttgaagttcttttcattcattttatcaaA
ATGACAAATTCCTCCAATTCTGTTTTTGCCCATGTTGTTCGTGCTCCTGAAGATCCATCTTAGGAGTCACAGTT
GCTTATAACAAAGATACCAGCCCACTGAAGTTGAATTTGGGTGTTGGCGCATATCGCACTGAGGAAGGAAAGCCC
CTTGTTCTTAATGTGGTGAGACGGGCTGAACAAATGCTCGTCAATGACACGTCTCGGGTGAAGGAGTATCTCTCA
ATTACTGGACTAGCGGATTTTAACAAGCTGAGTGCAAAGCTTATATTTGGTGCTGACAGCCCTGCCATTCAAGAG
AACAGGGTGACTACTGTTCAGTGCTTGTCGGGCACAGGTTCTTTGAGGGTTGGGGCTGAGTTTCTGGCTAAGCAT
TATCATGAACGTACTATATATATACCACAGCCAACATGGGGAAACCATCCGAAGGTTTTCACTTTAGCCGGGCTT
TTAGTAAAATATTACCGTTACTACGACCCAGCAACACGAGGCCTGGATTTCCAAGGACTTTTggatGATCTTGCT
GCTGCACCCGCTggagcAATAGTTCTTCTCCATGCATGTGCTCATaACCCaaCtggCgttGAtccaacaAATgac
cagtgggagaaAA > SEQ ID NO:994  215552  147546_301253_1
aaaaaaggaaagttagcaagcaaaggTTTCGTACTGTCAAAATGAACATGTCACAACAATCACCGTCACCGTCCG
CTGACCGGAGGTTGAGTGTTCTGGCGAGACACCTTGAACCATCGTCCTGCGCCACCGTCGAATCCTCTATCGTCG
CTGCTCCTACCTCCGGAAATGCTGGAACCAACTCTGTCTTCTCCACATCGTTCGCGCTCCCGAAGATCCTATTC
TTGGCGTCACTATTGCTTACAATAAAGATAGCAGCCCCATGAAGTTGAATTTGGGAGTTGGTGCATATCGCACAG
AGGAAGGAAAACCTCTTGTTTTGAATGTTGTAAGACAAGCAGAGAAGCTACTAGTAAATGACAGGTCCCGCGTTA
AAGAGTACCTATCTATTACTGGACTGGCAGACTTCAATAAATTGAGTGCTAAGCTGATACTTGGCGCCGACAGCC
CTGCTATTCAAGAGAACAGAGTAACAACTGTCCAGTGTTTGTCTGGCACAGGCTCATTGAGGGTTGGAGCTGAAT
TTTTGgCTCGACATTATCATCAACGCACTATTTATATTCCCCAACCAACATGGGGAAACCACCCAAAAGttTTCA
CttTagcTgggttATCagtaaagagtTACCGCTACTATGATCcagcaaCTCGTggactcaaTttTCA > SEQ ID NO:995  215552  156550_301367_1
CATGGCGATCCGAGCCGCGATTTCCGGTCGTTCCCTCAAGCTTAGCTCGTCGGTAGGAGCGCGATCTTTGTCGTC
GTTGTGGCGAAACGTCGAGCCGGCTCCTAAAGATCCTATCCTCGGCGTTACCGAAGCTTTCCTCGCCGATCCTAC
TCCTCATAAAGTCAATGTTGGCGTTGGAGCTTACAGGGACGACAATGGAAAACCCGTGGTACTGGAGTGTGTCAG
AGAAGCAGAGCGGAGGATCGCTGGTAGTTTCAACATGGAATATCTTCCTATGGGAGGTAGTGTCAACATGATCGA
GGAGTCACTGAAGTTAGCCTATGGGAGAACTCAGACTTGATAAAAGATAAGCGCATTGCAGCAATTCAAGCTTT
ATCTGGGACTGGAGCGTGCCGAATTTTTGCAGACTTCCAAAGGCGCTTTTGTCCCGATTCACAGATTTATATTCC
TGTTCCTACATGGTCTAATCATCATAACATTTGGAAAGATGCTCACGTCCCTCAGAAAACGTACCATTATTATCA
TCCTGAAACAAAGGGGTTAGACTTTGCTGCACTAATGGATGATATAAAGAATGCCCCAAATGGATCCTTCTTTCT
GCTTCATGCTTGTGCTCACAATCCTACTGGGGTGGATCCTACAGAGGAACAATGGAGGGAGATCTCACACCAGTT
CAAGGTGAAGGGACATTTTGCTTTCTTTGACAT > SEQ ID NO:996  215552  284634_200100_1
CCCTCGACCACGCGTCCGCGGACGCGTGGGTTTCATCGATCAGTTCTTCCCTTTCTCTTCGGTTCCCTGTAAAAC
CAAAGCCTCCCCATTTTTCTCTTCTACCCGAGCTTTAAGATGGCTTCCACAATGTTCTCTCTAGCTTCTGCCGCT
CCGTCAGCTTCTTTTTCCTTGCTGANTATCTCAAGTCAAAGCTGAAGTTGGGGACTTCTAACCAAAGTGCCTTTT
TCGGGAACGACTTCGTGAAGGCAAAGTCAAATGGTCGTACTACTATGACTGTTGCTGCTAACGTCTCTCGATTTG
AGGGAATAACTATGGCTCCTCCTGACCCCATTCTTGGAGTTTCTGAAGCATTCAAGGCTGATACAAATGAACTGA
AGCTTAACCTTGGTGTTGGAGCTTACCGCACGGAGGAGCTTCAACCATATGTCCTCAATGTTGTTAAGAAAGCAG
AAAACCTTATGCTAGAAAGAGGAGATAACAAAGAGTATCTTCCAATAGAAGGTTTGGCTGCATTCAACAAAGTCA
CAGCAGAGTTATTGTTTGGAGCAGATAACCCAGTAATTCAGCAACAAAGGGTGGCTACTATTCAAGGCCTGTCAG
GAACTGGGTCATTGCGTATTGCTGCAGCACTGATAGAGCGTTACTTCCCTGGCTC > SEQ ID NO:997  215552  258632_301698_1
ATCTAGTCATCTCACGACATTTGACTAACGACTCTATTTATTAACCTGACGGTGCACCCCAACCCAGTAACACGT
TACTAACTACCCGTCTCTATCACCACGTGACTCTGAACCAAATCTTTGGCTTTATTTTCACGTTCCCAACACAA
AATCCAAACCGCCAATCACCCCATCTTTTTAATCAGCAACTCTCCCCTCAACACTACGGTTTTCGAAGTAGTTAT
TTATTCATATTTATAATGTCATACTTTGCATCAGTCCCCGCAGCTCCCGCAGATGCCCTTTTCGGCCTCATGGCC
AAGTACAAGGCCGATACCTTCGACAAGAAGGTCGACCTCGGAGTCGGAGCCTACCGAGATAACACCGGAAAACCC
TGGGTCCTCCCTGTCGTCTCCAAGGTCGATTCTCTGATTGTCGCCGACCCCACTGCCAACCACGAGTACCTCCCC
ATCACTGGTCTGCCAGACTTCACCAAGTCTGCCGCCAAGCTGATTCTGGGGCCTGACTCTCCTGCCATCAAGGAG
AACCGAGTTGCCTCTTGCCAGACAATCTCTGGAACT > SEQ ID NO:998  215552  256651_301674_1
GATCAGCTATGGAGAGCGTGGCGCTCAAGCGAGTTCTGCTGTAGCCAACCATCTCAATCCCGAGCAGCAGCAGC
AGCAGCAGCAGCAGCAACTCTCCATGGCTGTCGCCGCCAGCGCCGGCGCCTCTTCGGTGTTTGATCATCTGGAGC

Figure 2 continued

AGGCGCCCGAGGATCCCATTCTGGGAATAACTGTGGCATACAACAAGGACCCTCATCCCGGGAAAGTGAACCTTG
GAGTCGGAGCTTACCGCACAGAGGAAGGGAAACCCCTTATTTTGCATGTGGTTCATCGTGCTGAGGAACGTCTTC
TAGCTGATCGCTCCAGAAACAAGGAATACTTGTCAATCACTGGGCTGGCAGACTTTAACAAGCGAAGCGCGACGC
TCATTCTTGGGAGCGATAGCCCTGCTATCGTGGAGAAGAGATTGGTAACTGCGCAGTGCCTTTCTGGAACGGGTT
CCTTGCGTGTAGGAGCCGAGTTTCTTTCAAGACATTATGGTGTGAAGCTGGTTTTCCTTCCTACCCCGACGTGGG
GAAATCACTTCAAGGTTTTCATGAATGCTGGACTTGGTGTTAAGACGTATCGTTACTATGACAGCAAAACTCGTG
GTCTTGACTATGAGGGTATGCTCGAGGACATAAGTGCAGCTCCGACCGGATCGGTTATTCTCTTGCATGCATGTG
CTCATAa

> SEQ ID NO:999  215552  237078_301250_1
ACAGGGAGAGTAGCTTCCATTCCATTCCATCCGGTAGGGCTATGGCGACTAGCATGGCGCTCAACGAGATTGCTG
CTCCAGCGGCGTCCAAGATGTCTTCCAGCCCAGCCGCAAAGAGCTTCGTTGGGCTCCGCACGGCTGCGTTTTCCA
CGAAGAAGGCATCTTTTCCATCCATGAAGTGTGCTGCGAAGGTCAATATGGCTATCGCTGCCGACGTTTCTCGCT
TTGAGAACGTTAGCATGGCACCTCCGGATCCAATTCTCGGTGTTTCAGAGGCATTCAAGGCAGATAACGATGCTA
CCAAGTTAAACCTTGGCGTTGGTGCTTACAGGACCGAGGATCTCCAACCTTATGTTCTTAAAGTCGTGAGAAAGG
CTGAGAAGCTCATGCTGGAGAAGGGAGAGAACAAAGAGTATCTTCCTATCGAGGGTCTTGCCGCATTTAACAAGG
CCACTGCCGAACTTCTACTCGGAGCTGGCAATCCAGTTATCAAGAAtggccGGATtgccACCGTTCAagGCCTAT
CTGGAACCGGGTCTCTGCgTCTGgGAGcTgcaTTTAttgcaagATActtccCct > SEQ ID NO:1000  215552  234369_301099_1
GCTAGCGGGCTTGTCAGGAACGCGGGGAAGCGATTCATGTCTACTGCGGCGGCGGCTTCGGCATCGTCGGCTCCA
GCTGGAGCTCGATCCGGATGGTGGGAAGCCGTGCAGCCGGCGCCGCGGGATCCGATCCTCGGCGTCACTGAGGCT
TTTCTCGCCGATTCCGATCCCAAAAAGGTCAATGTTGGCGTGGGCGCGTATAGGAACGATGAGGGCAAGCCGGTC
GTGCTGGAATGCGTCCGCAAGGCCGAGCAAATCATTGCTGGCAAGCAAAATATGGAATATCTTCCAATGGGAGGC
CTTGTGAAGTTTAATGATCTCTCCGTCAAGCTTGCCTATGGCGACTCCGCTCCAGTTCTTGAGGAGAAGCGAGTG
GCCGCGGTCCAGACGCTCTCTGGAACTGGTGCTTGCAGACTTTTCGCTGATTTCCAGAAGCGATTCAAGCCAGAC
TCACGCATTTACATCCCGGTTCCTACCTGGGCCAACCATCATAACATTTGGAGGGATGCCCGAGTCGAGGCTCAC
ACTTTCCGCTACTACAAGCCAAGTACGCGGGGATTGGACTTCGAAGGGTTTGTGGAAGATCTGAAAAAAGCGCCG
GAGGGATCTTTCGTCCTGCTGCATGCTTGCGCTCACAACCCCACCGGAGTtggacccACCgCCGAGCAGTGGAAG
GAAAtttctCAGCTTTTCAAGAGCAATGGACTCTTCccgttcTTCGACATGGC > SEQ ID NO:1001  215552  216942_300903_1
tcatcatcGTCCTCTCAATCTCGTTCCCAATCAACTCCGTCTGCCTCTCTCGCCCGCATCAACAACATTGCGAGC
CACATCTCTCCCACAATGGCTTCCACCACCAGTTTCCCGGCAGAAACGGTGCCCCAGGCGCCTGAAGATCCCCTC
TTTGGCCTGGCCCGCGCCTACAAGGCTGACAACAGCCCGCTAAAGGTCGACCTGGGAATCGGCGCCTACCGAGAT
AACAATGCGAAGCCATGGGTTCTTCCTGTGGTAAAGAAGGCTGATGAGATTCTCCGAAACAACCCCGAACTGAAC
CACGAGTATGCCCCGATTGCAGGTATCGAGAGCTTCACCAGCAAGGCTGCGGAGCTGATGCTCGGCGCCGATTCG
CCCGCTCTCGCGGAGCGCCGCACTACGTCTATGCAGACCATCTCGGGAACCGGTGCCGTTCACTTGGGAGCTCTG
TTCCTCGCCAAGTTTTACAAAGGCAGCCAGACCGTCTATGTGTCAAATCCCACATGGGCAAACCACCATCAGATC
TTTTCCAATGTCGGCATCAAGGTCGCCCAGTATCCCTACTTCAGCAAGGAGACCCGGGGGCTGGACTTTGATGGC
ATGACCGCTGCCATCTCAGCGGCTCCTGAAGGTTCCATCATCCTGCTCCACCCCTGTGCGCACAACCCAACCGGC
GTCGACCCAACACTTGATCAGTGGAAGGAGTtGGccGTCATTATCCGagAGAAGAAGCACTTCCCCTTCTTTgac
TgtgccTAccagggcTTtgccTCTGGCGaccTTGCt > SEQ ID NO:1002  215552  207662_300827_3
AATCTCGTTCCCAATCAACTCCGTCTGCCTCTCTCGCCCGCATCAACAAACATTGCGAGCCACATCTCTCCAC > SEQ ID NO:1003  215552  168290_300554_1
GAATTCACAACCATGGAATCTCAAAACTCTGGGTTCTAATATTTCAATGTCTCCTACTGCTTCTCATGGTGATTC
TGTTTTTGCTCACATTGTTCAAGCTCCTGAAGATCCAATTTTAGGGGTTACTGTTGCTTATAATAAAGATCCAAG
TCCAATTAAGTTGAATTTAGGAGTTGGAGCTTATCGAACTGAGGAAGGAAAACCACTTGTATTGAATGTTGTAAG
AAAAGCTGAACAGATATTAGTTAATGACAGGTCTCGTGTGAAAGAGTATCTTCCTATTACTGGATTGGGAGAATT
TAACAAATTGAGTGCCAAGCTCATTTTTGGTGCTGACAGCCCTGCTATCCGTGAGAACAGGATTACTACTGTCCA
ATGCTTGTCTGGCACTGGCTCGCTGAGGGTGGGAGGTGAGTTTCTTGCAAGACATTACCATCAGCGAACAATATA
TATTCCACAGCCAACATGGGGGAACCATATCAAAGTATTCCAATTGGCAGGGTTGTCTGTGAAATATTATCGCTA
CTATGACCCAAAAACACGTGGATTGGACTTCCAAGGTATGCTGGGGGATCTCTCTTCTGCTCCATCAGGAGCCAT
AGTTCTTCT

> SEQ ID NO:1004  215553  127671_300471_1

Figure 2 continued

```
AGTAGCTAACCAGGTAAGAGATGAAGCACAACAATGTTATACCTAATGGGCACTTCAAGAAGCATTGGCAAAACT
ATGTAAGGACTTGGTTCAACCAGCCAGCTAGGAAAACAAGGAGACGTGCTGCTAGACAGCAGAAGGCTGTGAAGA
TCTTCCCTAGGCCGACTGCGGGATCACTTCGACCTATTGTTCATGGACAAACACTGAAATACAACATGAAAGTCC
GGGCTGGGAGGGGATTTTCTCTTGAAGAACTGAAAGCAGCTGGTATTCCCAAGAAACTAGCACCAACCATTGGCA
TTGCTGTTGATCATCGCCGCAGGAACAGATCATTGGAAGGTCTCCAAACCAATGTCCAGAGGCTCAAGACTTACA
AAGCTAAGCTTGTCATCTTCCCAAGGCGTGCTAAGAAAGTCAAGGCTGGTGATTCTAGTGTAGAGGAACTTGCTA
CTGCCACCCAGGTCCAAGGTTCTTACATGCCTATTACTAGGGAGCAGCCAGCTGTTGAACTTGTCAAGGTCACAG
ATGAGATGAAATCATTCAATGCCTATGGCAAGCTGCGTATCGAGCGTACAAATGCGCGACACATCGGAGCCAGGT
TGAagaGGGCAgctGaagcagAataggAAgaatagaaatAAGcacttacaaTtgtcgtgtaGCttgttaaGCATG
ATCAGTTTtctggtggaCTGagtgatgaagcttTTGATACAATCATATTCaggatcttgagcTTT > SEQ ID NO:1005  215553  255222_301647_1
GGAAGGGGATAGGTTGTTTCTCAGCTAGGTCAGAAGCCAGAGGTGAGGCAGAATGAAGCACAACAACGTGATCCC
GAATGGGCATTTCAAGAAGCATTGGCAGAACTATGTCAAGACGTGGTTCAACCAGCCTGCCAGGAAGAAGCGCAG
ACGCGTCGCGAGGCAAAAGAAGGCTGTGAAGATCTTCCCCCGACCTACCGGGGGACCCCTCCGGCCCGTTGTCCA
CTCACAGACTCTGAGGTACAACATGAAGGTTCGTGCTGGCCGAGGCTTCACTCTGGAGGAGCTCAAGGCAGCAGG
CATTTCTAGAAAACTGGCTCCAACAATTGGTGTTGCAGTAGACCATCGAAGGAAGAATCGTTGCCTAGAAAGCCT
TCAAGTCAATGTGCAGAGGCTCAACACATACAAGGCCAAGCTTGTTGTTTTCCCTCGACGTGCACGAAAGACCAA
GGCTGGTGACTCTTCTCCTGAGGAGCTTGCCAATGCTACACAGATCCAAGGATCTGCCCTTCCTATTATAAAGGA
CAAGGCGGTTGTTGAGCTTGTGCCTCTTACAGATGAGCTCAAGGCCCAGAAGGGCTACGCCAAGCTTCGTGTTGA
GAGGATGAATACGCGAATGATAGGCATCAGAAACAAG > SEQ ID NO:1006  215553  224628_300974_1
ggcgaggtagggatcgtatggaagcgctgcgggcattcgcagccgcagcgatcccctgctggcagggtttcgtt
GGCGGCGGGCAGCGGCGATGGTGAAGGGGAACAATGTCATCCCCAATCAGCATTTCAAGAAGGATTGGGAGCGAC
GGGTGAAGACGTGGTTCAATCAGCCGGCGCGCAAGGTCCGGAGAAGGAAGGCTCGGTCGATCAAGGCTGCCAAAA
TCTTCCCACGGCCGACGTCCGGACCCCTGCGCCCGATTGTCCACTGCCCGACCGTCAAGTACAACAGCAAGGTCA
AGTACGGCCGGGGTTTCACGCTGGAAGAGCTCAAAGAAGCTGGGATCCCGAAGAAGCTTGCCCGGACGATTGGGA
TCTCGATGGATCACCGGAGGAAGAACCGCAGCCTGGAGAGCTTGCAGATCAATGTCCAGCGGCTGAATACCTACA
AGACGAAGCTCGTCGTCtttcccTCgcAATGCTAAGAAACCcaaggctggcGACTCGtcgccgcaggaGcTGagc
agcgtGGTGCagCTCTCGggCCCGGTG > SEQ ID NO:1007  215553  179986_300565_1
tgacgagtctcctcctccgaaatttcaacGACTTCCGAACAACGACCACCGGAGCCCACGTTGATCGCAAGCAGA
CACAATGGCGATCAAGCACAACCAGACGATCATCAGCAACCATTTCCGCAAGGATTGGCAGCGCCGGGTTCGCAC
CCACTTTGACCAGCCCGGTCGCAAGACACGGAGACGCACTGCTCGTCAGGCCAAGGCTGCTGCTCTCGCTCCTCG
TCCCGTCGACAAGCTGCGACCCATCGTCCGATGCCCTACCGTTAAGTACAACCGACGGGTTCGTGCCGGTCGAGG
TTTCACCCTCACCGAGCTCAAGGAGGCCGGTATCTCCAAGTCCCTGGCTCCCACCATCGGTATCTCCGTCGATTT
CCGCCGACAGAACCTGAGCGAGGAGAGCCTTGCCGCCAACGTTGCCCGCCTCAAGGCCTACAAGGAGCGCCTCAT
CCTCCTGCCCCGCAAGTCCAACGCCCCAAGAAGGGTGACACCAAGACCGACGTCGCCTCCCTCGACAAGGTCGC
CTCCATCGCCGCTGCCCTGCCCATCGCCTCCGTCTCTGCTGGCTTCTCCGAGATCAAGAAGAGCGAGATCCCCGC
CGCTGTCGAGGGTGGTGCCTACACCAAGCTTCGCATTGCTCGAAGCAACGCCAGATACCAGGGTGCCCGTGAgaa
GCGTGCTCGGGACAaGGCTGaggccgagactgccaagaaaTaaACTTtGTCaaAAAgggaaCTggtg > SEQ ID NO:1008  215553  253111_301628_1
gacaaaaatggctatcgGTAAGAACTACCCCCTCGTCAAGAACCATTTCCGAAAGAACTGGCAGGAGCGGGTCAA
GACCCACTTTGACCAGCCCGGCAAGAAGTCTTCTCGACGACTTGCACGAACCAAGAAGGCCGCTGCTATCGCTCC
CCGACCTCTGGATCTTCTCCGACCTATTGTCCGAGCCCCCACTATCCGATACAACCGAAAGGTCCGAGCTGgCcG
AGGTTTCTCTCTTGAGGAGCTCAAGGCTGCCGGTATCCCCCGAGACTACGCTCGAACCATTGGTATTGCCGTTGA
CCACCGACGACAGAACCGATCCGTTGAGGGTCTTGAGGCCAACGTTCTGCGACTCAAGGAGTACCAGTCCAAGCT
GATTGTCTTCCCCCGAAAGCTCAaGAAGGGTGaGaccAACGAGGCCAAGTCCGcCGtccAGGTCCTCTCCACCTC
TgctaccttcccCATTGTCCaccAGGctgccgagtccgagCCCCGAGCCATCTCTgccgagggcaaggagcagaa
cgcaTAcag > SEQ ID NO:1009  215553  141848_300429_1
CCCCCCCTCGCTCTGCCACCGCTCGTCTTCCTCCCACCTTCCGCCGCCGCCGCCGTCGGTCTCCTCTTCGCTCCG
CCGCGCAGGTAAGAAGGAGAGGAGGAGAAAATGGTGAAGCACAACAACGTTATCCCCAATGGCCACTTCAAGAAG
CACTGGCAGAACTATGTCAAGACATGGTTCAACCAGCCCGCCCGCAAGCAGAGGCGCCGCATTGCTCGCCAGAAG
AAGGCTGTGAAGATCTTCCCCCGCCCAACATCTGGCCCTCTTCGACCCATTGTTCAGTGCCAAACTTTGAAGTAC
```

Figure 2 continued

AACATGAAGTCGAGGGCTGGGAGAGGCTTTACCCTTGAGGAGCTGAAGGCTGCGGGCATCCCCAAGAAGTATGCT
CCAACCATTGGAATTTCCGTGGATCACCGCCGCAAGAACCGCTCACTTGAGGGACTCCAGGCTAATGTCCAGAGG
CTCAAGACATACAAGGCCAAGCTGGTTATCTTCCCAAGGCGTGCTCGCAAGGTCAAGGCTGGTGATTCCACTGCC
GAGGAACTTGCCACTGCCACCCAGGTCCAGGGTGACTACATGCCTATT

> SEQ ID NO:1010 215553 157071_301734_1
gctccactcgttctgctcggtgtcctcgtcgtcgttgtcgtgtttaagtcatgaagcataacaatgttattccga
atggaCACTTCAAGAAAAACTGGCAGAACTATGTGAAGACCTGGTTCAATCAGCCAGCACGCAAGACCAGGAGAA
GAATTGCAAGGCAAAAGAAGGCTGTGAAGATTTTCCCCAGACCAAATGCTGGAACTCTTCGCCCTATTGTCATG
GTCAGACACTCAAATACAACATGAAAGTTAGGTCTGGTAGAGGATTCTCCCTTGAGGAGCTCAAGGCTGCAGGTA
TCCCTAAGAAACTGGCTCCAACAATTGGTATTGCTGTTGATCATCGTCGCAGGAATCGGTCACTTGAGGGGCTTC
AAACTAATGTTCAAAGGCTGAAGACATACAAGGCCAAATTAGTCGTCTTCCCAAGACGTGCTCGCAAGGTCAAGG
CTGGTGATTCTGCCCCCGAGGAATTGGCTACGGCAACACAAGTCCATGGTGCTTACATGCCTATTGCACGTGAGA
AGCCATCAGTTGATCTTGTCAAGGTTACTGAAGAGATGAAGTCATTCAATGCCTATGGCAAGCTACGTGTGGAGC
GGACGAATGAGCGTCACATTGGTGCTAGGATGAAGAGAGCTGCAGAGGCTGAGAAGGAGGAAAAGAAGTAGTGAG
GCTTATCTTGGTTGATTTACTTGTCCCATCTTTTTGAGTCCTATTTCGTTAATTAATTACAGAATTTGCTTTGAA
CTTTTTAGCTATAGCATTCAATGTcAGCTGGGTGTATGATTTTCAACACTTGtTACTTTGTTGATGAGATTTt > SEQ ID NO:1011 215586 209074_300811_1
AGCCTTGCCTTGGCAAATAGACAACAGAGACCCTGTTTCAAGCCCGTTGACTCTGTGAAGCCAGATCTGGATTTG
GCTTCCATGCGTGCGTCTTATACTTTCAGGAGAACGCCGCAGTAGACTACTTAAAGACTTACTCTCCCCACGTCA
AGACGTTCCTCTTCATCCATCTTTTCCAAGCACGACACCATGACTACCCGCTCCCTTCCTAGCAATGGCAGCTCT
GCCTTTGACTACATCATCGTTGGTGGAGGCACCGCAGGCTGTGTGATTGCCTCGAGACTCTCCAGCTATCTGCCC
GAGCTCCGCGTTCTTCTCATCGAGGCTGGTCCCTCCGACTTTAACCTCAACCACGTCCTCAATCTGAGAGAATGG
CTGAGCCTGCTGGGCGGCGAGCTAGACTACGACTACGGCACGACAGAGCAGCCCATGGGTAACAGCCATATCCGC
CATTCTCGTGCCAAGGTTCTTGGAGGATGCTCGTCACACAACACGCTCATTTCCTTCCGTCCTTTCCGCCACGAC
ATGGACCGCTGGGTTGCTCAGGGCTGCAAAGGCTGGACCTTTGAGAATGTCACTCGTCACATTGACAACCTTCGC
AACAC > SEQ ID NO:1012 215593 199744_300752_1
ccgccactttgctctcctttcaagcatcgcaaaactctgtcAACTCTTTTTATAATACTCTGACTCTTCGTCCAC
TCTCTGCTTCTGAACCACTTCGACTCATAcTacTTGcacTTGCATACAcTcGGGACTCTTCCCCCGCCtactctA
CTCttcTAcacaacCAaCcacCAacgcaaTGGCTCtcgacaTgtCaccctctctcctccAaccGGGGcctcaccc
CctcgagctcacacagcagccTCTGCTCCATgcagagCGtatcctcTAccgcCGAggCGAGCcagctGTCAGACA
aggcacgcatggaaCTGCGaGcatacgcTgTTTCAttcgagcagggtagactgcagcgcccgcgatCATAcTAAA
taAccaaaatcatcaTCctacaaacaaaacatacACACACATACCaCACTCTACCATCTACCATCTACCATTACG
CAACTCaatCATAcgcAACACAATAtGAAACGAtacgaaaccATCctaccatTACTTGCTATActgttcttgttc
ttttaAAAcaagcccatttcttTTACCTCATTtt > SEQ ID NO:1013 215593 218695_300920_1
TTCTACCACTTTGCTCTCCTTTCAAGGCATCGCGAAGACTCTTGTCAACTCTTTTTATAATACTCTGACTCTTCG
TCCACTCTCTGCTTCTGAACCACTTCGACTCATACTACTTGCACTTGCATACACTCGGGACTCTTCCCCCGCCTA
CTCTACTCTTCTACACAACCAACCACCAACGCAATGGCTCTCGACATGTGGACTCACGAGTTCTGCCTTACTTGC
GACCGACAGGTCCAGGTCGACGGCGACGCCTACTGCTCTGAAGCATGCAGAATGTCCGACTTCGAAAAGACTCCC
TCTACTCCCAGCTCGCAGGCCAGCTCGCCCGGCTTCTCTCCCGTCTCCTACGCTAGATCAGGCAGCCTCTCCAGC
CGACCTGCTCCCACCAAGTTCTTCCTGTCTCCCGCCTACGACTTCAACCAGGCCCAGCCCTACGGCTCAACTCCT
CGGTCGTCATCGTCGTTTGGCAGCTACATGTCGGACATGTCACCTCTCTCCTCCAACCGGGGCCTCACCCCCTCG
AGCTCACACAGCAGCCTCTGCTCCATGCAGAGCGTATCCTCTACCGCCGAGGCGAGCCAGCTGTCAGACAAGGCA
CGCATGGAACTGCGAGCATACGCTGTTTCATTCGAGCAGGTCAGACTGCAGCGCCGGCGATCATACTAAATAAAc
aaCATCATCATCCtACaaACAACACatacACACACataccACACtCTaccaTC > SEQ ID NO:1014 215595 211010_300895_1
tcAGCTCACACTCTCCAGGCTCACACAAAACTCACTACAATAAAAACACAATCTTCAATTCTTTGAACCTTTTTC
AAGTTTCGCCAACATGAAGTTCACCACTACTGCCGTTCTTGCCATTGCCGCATTCGTTGAATCGGCCACTGCTCT
GGGCAAGGCCCGTGTCGTCAACAAGTGCCCCTTCAGCGTCACCACCTGGTCCGTTGGCAGCGCCATCTCCAACCC
AACAACCCTTGCTCAAGGCGGTTCCTATGGCGAGACCTTCTCACGAGACCCCGTAACCGGCGGTCGTGCCATCAA
GGTCACCGTCCAGCCCGATGGCCTCTACACTGGCAAGCCCCAGACCAACTTCGCCATCAACCTTGAGGGCAACAC
CATCTGGTACGATCTTTCAGATGTCTTTGGCGATGCCTTCAACGGCCACAAGGTCGTTGTTTCCAGCGCCAACAC
TGCTTGCCCCAGATTGTTTGGGGCAGCGGAATCCCTCCTGCCGGAAGCCAGGTCAAGAACTGCGGTGCGGATAA

Figure 2 continued

GGATGTGACTTTGACTCTGTGTGCTTAGAGTTAAGGGAGGACGGAATCATGTCAAGGGAAAGGTTTAAATCAAGT
TTATGATAGAATTTCAAGTCCTAGCTATGTTTAAGACTTATGACAGTATGAATTGATGAGTTTACTGC

> SEQ ID NO:1015 215606 206185_300819_1
cTCTACTGGACAGCACTTCCACAAGATTTGTTTACTTTCATATCTTTTTGCATAGGTTCAGCAACAAGCATCAAG
CTGTGTTATCGTAGCTGCTGCTTCTCTCCCAAAGTGACCTGATTGTCACCTTTTCCACTTGCAATTGCCACCGCA
AAGCTCCAATACCGCAAACATGTCTGCTGTCAACGGCGCTCACAGCAGCACTTCCAAGGCCACCGATCAAGATGG
CTCTTCGGTTCCCGGCTTCCAGCCCCAGAACAAGATGACGGTCCAGCCGCCCAGGGGAGAAGACCTCCAGGTCAG
CTATGCCGCTGAAATTGGAGGCGAGGCCAACCCCAAGGGCTGGTATGGCAGCATGATCAACAATCTTGGCGCATG
CATTGGAACATGCGGCGCCATTCCCTGCTGTGTCATCTGCCCCAACCCTTATAAGCACGTCAACCAAGGCCATGT
TGGTCTCGTCACCAAGTTCGGTCGTTTCTACAAGGCTGTCGACCCCGGTCTGATCAAGGTCAACCCCCTCAGCGA
GAGGCTCATTCAAGTCGATGTCAAGATCCAGATCGCAGAGGTGCCTGAGCAGACCTGTATGACCAAGGACAATGT
CACTCTGCGCCTGACCTCTGTCATCTACTATCACATTGTGTCTCCTCACAaggccggttTGGTAttTCTaAcg > SEQ ID NO:1016 215611 200547_300853_1
CGATCAGTCGACAATTCATTCAAGATGGCTAAGGAAACGCCTGCAAAGACCGGTCTGGCCGTTGGCCTGAACAAG
GGCCACAAGACCACTGCTCGTGTCGTCAAGCCCCGTGTTTCTCGCACCAAGGGCCACCTGAGCAAGCGAACCGCT
TTCGTGCGTGAGGTCGTCAAGGAGGTTGCTGGCCTCGCCCCCTACGAGCGTCGTGTCATCGAACTGCTCCGAAAC
AGCAAGGACAAGCGTGCCCGTAAGCTGGCCAAGAAGAGGCTCGGTACCTTTGGCCGTGCCAAGAGAAAGGTCGAT
GAGCTCCAGCGCGTCATCGCCGAGTCTCGTCGTGCTCACTAAACGATTTCTTCTTTAAGCGAGCGGGAGAGATTC
ATCTTGGTAATGGGGAAAAACAAAAATTATTTCAACAGGGAAATGAATTAAAAAAACACTACGGGTTTCGCATGG
ATTTGGCGTGGTCATGAATTTTGATTGAATTCAAATGGGGCTCTTTGATGCGGGCGCAGCAGCGTTTATATAGCT
GCGATTTCGTTCATCGAATTTCTTAAACTCTTCAAGACATGCCGTCTTTATGACCCAACCTAGAAAATTTTCTTC
TTCTaggaaAaaaAaaaggaaaAaggaa > SEQ ID NO:1017 215611 210994_300963_1
GATCAGTCGACAATTCATTCAACATGGCTAATGAAACGCCTGTAAATATCGGTCTGGCCGTTGGCCTGAACAAGG
GCCACTAGATCTCTGCTCTTGTCATCAAGCCCCGTGTATCTCGCAACTAGGGCCAACTGATCAAGCGAACCGCTT
TCGTGCGTGACGTCCTCAAGGACGTTGATGGCCTCTCCCCCTACAACCGTCGTGTCATCAAACT > SEQ ID NO:1018 215615 141821_300429_1
AGAGAGAGAGAGAGAGAGAGAGAGATGGCGCTCGCAATCCTGGCGAGGAGGCGGGGGGCGGAGGCGCTGCTGC
GACGGCCGCTGGGGGCGGCGGGGGTGTCGGCGCTGAGGGCGTCGTACGCGGCGGTGGCGGGGGAGGAGAGCGACG
TGGTGGTGGTGGGCGGCGGGCCGGGAGGGTACGTGGCGGCGATCAAGGCGGCGCAGCTGGGCTCAAGACCACCT
GCATCGAGAAGAGGGGCACCCTCGGCGGGACATGCCTCAACGTCGGCTGCATCCCCTCCAAGGCTCTGTTGCACT
CATCTCATATGTACCATGAAGCAAAAAGTTCCTTTGCACACCATGGAGTGAAATTTTCCAATCTGGAGGTAGACC
TCCCAGCTATGATGGCACAGAAAGACAAGGCTGTGGCAGGCCTGACTAAGGGGATTGAAGGTCTCTTCAAGAAGA
ACAAAGTGACGTATGTCAAAGGCTTTGGGAAACTTGCTTCGCCCTCAGAGGTGTCTGTTGATCTGAGCGATGGTG
GCAGCACAGTTGTCAAAGGGAAAAACATAATCATTGCTACAGGGTCTGATGTAAAATCACTCCCTGGAGTCACAA
TTGATGAAAGAAAATCGTCTCATCTACTGGGGCCTTGTGCT > SEQ ID NO:1019 215615 158316_200003_1
GAGAAAATGGCGATAGGGAGCTTAGCAAGACGAAAGGCCACAACAATTTTATCTTCCAGATATCTCTATAGCACA
TCCAAATATTCATTTTCTCTTAACAGATATTACTCTTCGGGATCTGATGAAAACGACGTCGTTGTTATCGGCGGT
GGACCCGGCGGCTATGTGGCGGCGATTAAAGCTGCACAGCTTGGGCTCAAAACTACTTGTATTGAGAAACGTGGT
ACCCTTGGTGGTACCTGTCTCAATGTTGGTTGTATTCCTTCTAAGGCACTTCTTCACTCCTCCCACATGTACCAT
GAAGCTCAACATTCATTTGCTAGTCATGGTGTGAAGTTCTCTTCCGTTGAGGTAGATCTTCCTGCCATGATGGGC
CAAAAAGATAAAGCTGTGGCTAACTTAACACGAGGTATTGAGGGTCTATTCAAGAAGAACAAAGTGAACTATGTT
AAGGGCTATGGCAAATTCCTTTCTCCTTCTGAAGTTTCTGTCGACACTGTGGAAGGTGGTAATACTGTTGTTAAG
GGGAAGAATATTATAATTGCCACTGGTTCTGATGTCAAAAGTCTACCTGGGCTAACTATTGATGAGAAGAGAATT
GTATCATCCACTGGAGCTTTAGCTTTGACCGAAGTTCCAAAAAAGCTGGTTGTTATTGGTGCTGGCTACA > SEQ ID NO:1020 215615 234115_301097_1
GATTCGCTTGGGTCCTCGCATTGCTCGGCGGGTTGCCATGGCCATGGCGGGAGGCAGGGGGAGGAGCGCCGCTCT
CGGATTGGGTCGGCTCCTGTACACGAGGAATGGCTTCATCGGTCGCTTGGGTGTGAGGGGCTTTGCGTCCGGCGG
CGAAGAGAATGACGTAATTGTCATCGGCGGCGGACCTGGCGGATACGTTGCGGCGATCAAGGCGGCGCAGCTGGG
ATTCAAGACGACCTGCATCGACAAGAGAGGTTCCCTCGGCGGCACTTGCCTCAACGTCGGATGCATCCCTTCCAA
AGCACTGCTCCACTCGTCGCATATGTTCCACGAAGCCAAGCACACATTCTCCAAGCACGGCGTGAAGCTGTCCGG
TGTGGACATCGACGTCGCACCCATGATGGCGCAGAAGGAGCAGGCCGCGTCGGGGCTGACTAAGGGAATCGAGGG

Figure 2 continued

CCTGTTCAAGAAGAACAAGGTGACGTACGTCAAAGGCAGCGGCAAGATCGTGTCCCCCAACGACGTGTCTGTGGA
GACGCTCGACTCGG

> SEQ ID NO:1021 215615 208692_300807_1
atagcacctgtcaacGGCTGCCCAGCATGATTGCTAGCCGCCTGATACCCCGAAGTGCCATCCGCACGCTGCCCA
GCAGGCAATTGACCCTGTCACGATGGAGTCGAGGATTTGCCTCTGCTTCTGAGGAGAAGGACCTGATCATCATCG
GTGGTGGTGTTGCCGGATATGTGGCCGCCATCAAGGCCGGACAGGAGGGCATGAAGGTGGCCTGCATTGAGAAGC
GTGGCACCCTCGGCGGTACCTGCTTGAACGTTGGCTGCATTCCCTCAAAATCGCTGCTCAACAACTCCCACCTGT
ACCACCAGATTCTCCATGACTCAAAAAACCGCGGTATCGAGGTCGGAGAGGTTAAACTCAACCTCGAGACTTTCA
TGAAGGCCAAGGAAACCGCCGTTACCGGCCTGACCAAGGGTGTCGAGTTCCTCCTGAAGAAGAACGGCGCCGAGT
ACATCAAGGGCACCGGTTCCTTCATCAACGAGAACGAAATCAAGgTCGAACTCAATGACGGCGGCGAGTCCGTCA
TCCGCGGCAAGAACATTCTCATCGCCACCGGCTCTGAAGCCACTCCCTTCCCCGGcCTcACcaTTgacgagcAGC
G > SEQ ID NO:1022 215615 181932_300658_1
GAATTCAGGAAGAAGAAGCCATGGCAATGGCAAGTTTAGCAAGAAAGAAGGCTTTATATTTCAGTANCAATCTCG
GCAAATCTTCATCATCGTCATTTAAATATTCGTTTTCAGTTTCAAGAGGTTTTGCTTCTGGATCGGCTACTGATG
AGAACGATGTTGTTATCATTGGAGGTGGTCCTGGTGGTTATGTAGCAGCGATTAAGGCTGCTCAATTAGGTCTTA
AGACCACTTGTATTGAAAAACGTGGTGCTCTTGGTGGTACTTGTCTTAATGTTGGTTGTATCCCTTCTAAGGCCC
TTTTACACTCCTCCCACATGTACCATGAAGCCAAGCATGCATTTGCTAATCACGGTGTTAAGGTTTCAAATGTGG
AAGTTGATTTGCCTGCAATGCTTGGTCAGAAAGATAAAGCGGTTTCCAATCTCACTCGAGGTATTGAAGGCCTCT
TCAAGAAAAACAAGGTAACATATGTCAAGGGTTATGGTAAGCTTATCTCTCCATCTGAGGTCTCTGTCGAAACCA
TTGAAGGGGAAAACACTGTTGTCAAAGGTAAAAACATTATAATTGCAACAGGGTCAGATGTGAAACCTCTTCCAG
GTATAACTATTGATGAAAAGAAGATTGTNTCATCAACCGGAGCTCTATCTTTATCAGAAATCCCCAAGAAACTTG
TTGTCATTGGAGCAGGTTATATTGGTCT > SEQ ID NO:1023 215630 210819_300893_1
CCCACGCGTCCGCCCACGCGTCCGCCCACGCGTCCGCCCACGCGTCCGACATCCTCTACAACAAGCAAACAGCTT
GGATCAACAGCCTCATTAATTGGCTTCAATATACCCTCATACATTAATATATATACCCCGACAGCACCGCCACCT
CGAGCTCCTTGAAGCATCGTCATCCCCACAACACCCATTAATACCCTTTAGAAGCAACTTGCACTTAATACCGCC
AAAATGTTCGGCAACTTGG > SEQ ID NO:1024 215630 212066_300873_1
GGACGTTGGTGTCATCAGTGTCCTACTGCGCGAGTTGGTGCGACACGGCTGCCAGCACATTCGGCCGTCTCTGGG
GACGATATACCCCGAGACTGCGCCGCGGCAAGTCTTTGGCTGGATCTCTCGCCGCTTTTCTCGTCGGCGTGGCCA
CCTCGTACCTCTGGTACGGGTGGCTGGTCCCAACTATAGGACCCATGCCCGGTGACGAGAACTTCATGTTCACGG
GCACTCTGTCGCTGCCGCGAGCATTGACCGAGGCCGTCGGCATCCCGGACAGCATGGCATCCGTCTCCGGCTCCG
TGGCCCTTGGCATCATGAGCGTCTGGTCTGGATTTGTCGCCTCTGCCAGCGAAGTGGCCGACCTCTTCGGATGGG
ATGACAACTTGACGATCCCGGTGCTTAGCGGAATCGGCATTTGGGGCTTCCTTAAAGTGTTTGGCTAACCATACA
CAACCTTCTCTATAGGAGGCTGCATTTGTTTCGATAATGGTATATAACTGTGTTTTCACATCTTCTTCACTCTGT
AATGCAGTTTCTTCTCTCTTCCTCCCCCT > SEQ ID NO:1025 215637 208050_300831_1
gTctcgccgcttcTCCAACCCCAttgAcGTTGCTGagcGTGAATACCGagaACGtttcCGTCCTCAACAACCCGA
AGCTACTACCGGTCTTGAACTagttcaagTCCGTCGTCCTCATCACcagAagTCAAAGTCCTCTCACAAGGTCTC
TGACATCACCGTCgacgaGCGTGTTTCTATTGCCCGTCCCAACTTCCGtgagGATATCAAGATCACTGAGGAAAT
CCGcgagTCTACTCCGTatccttCCGAACAATCAGCCAAGATGGGTTACTACgacGAcgaaGAGCACgttgagGt
TgATGTTGTCCGccACGATGCTAATTCTTCGCGccgcccagcTcCTgccaccgAgTCgc > SEQ ID NO:1026 215637 215701_300884_1
TGATTCATCTCgccgcTTCTCCAACCCCATTGACGTGCTGAGCGTGAATACCGAGAACGTTTCCGTCCTCAACAA
CCCGAAGCTACTACcgttcttgAACTAGTTCAAGTCCGTCGTCCTCATCACCAGAAGTCAAAGTCCTCTCACAAG
GTctcttttatcaccgtCGACGAGCGTGTTTCTATTGCCCGTCCCAACTTCCGTGAGGATATCAAGATCACTGAG
GAAATCCGCGAGTCTACTCCGTATCCTTCCGAACAATCAGCCAAGATGGGTTACTACGACGACGAAGGCTCCTAC
CACTCCATCCGCCAGGATGTCAAGCATGGCTTGGCCAAGGCTGCCGACAAGCTGCTTCCCCATCATCACCACCAC
CACCATCATCACAGTGACAATAATAACACTACCATTACAGAGCACGtTGAGGTTGATGTTGTCCGCCACGATGCT
AATTCTTCGCGCCGCCCAGCTCCTGCCACCGAGtcGCAGCCTAACACTGTGTCCATCCCTGCCACCACATCCGT
CTGGGTGACTTCTTGATGCTCCagggccgACCatgccagGTCATCCGCATCtcGACCTCGTCTGCCACTGGCCag
tACCGCtaccttggtgttgacctCTTCACCAAGca

Figure 2 continued

> SEQ ID NO:1027 215637 215466_300881_1
ggaacaaagaaagaaaagactctcagaggggtggaatccctctctcttttctctctctcttcgactttgtttca
ggaacAAAAGCTTGAGGATCCTTCTTGTCTTCCTTTCGTGATCTTACGGAAGGTTGTATGAGAAGATTCTCTCGC
GCCAGCGCAAGCCGTCAACCTGGACTTTGAagCCCGAGTTCCCGTGCCCTTTAGCATCTTCCCGTCCACTTATAA
GGACAACGAAGCAGCACGCCCTCAGACTCAAATCACCACTCACGAGGAGGTTCAACTAACCCTCCCTCAAAAGAA
GCCAGCCGGACGGGAGGGTCAACTCTCTTCTTTCCCCCCAAGCACCGACCTAGCTCCTCCTCGCGTCGAACAACG
CTTTGAAGAAGAGGTCCGTATCACTCGTGAGGAaGaACGTCACCGCCGTCCCGGTTCCCGCCAGTCCGAACGCTT
CGTAAAGGAAGAGTTCCGACCTATCCCACCTCCTCCTCGCGACTACACTGAgaCTCAGGTCAAAGTTGATTCATC
TCGCCGCTTCTCCAACCCCATTGACGTTGCTGAGCGTGAATACCGAGAACGTTTCCGTCCTCAACAACCCGAAGC
TACTACCGGTCTTGAACTAGTTCAAGTCCGTCGTCCTCATCACCAGAAGTCAAAGTCCTCTCACAAGGTCTCTGA
CATCACCGTCGACGAGCGTGTTTCTATTGCCCGTCCCAACTTCCGTGAGGATATCAAGATCACTGAGGAAATCCG
CGAGTCTACTCCGTATCCTTCCGAACAATCAGCCAAGATGGGTTACTACGACGACGAAGCTCCTGCCACCGAGTC
GCAGCCTAACACTGTGTCCATCCCCTGCCACCACATCCGTCTGGGTGACTTCTTGATGCTCCagggcCGACCATG
CCAGGTCATCCGCATCTCGACCTCGTCTGCCACTGGCCAGTACCGCTACCTTGGTGTTGACCTCTTCACCAAGCA
GCTGCACGAGGAGTCTTCCTTCATTGCCAAccccgcCCCCAGCGTTGTTGTCCAGACCATGCTcGGCCctgtcT
TCAAGCAgtACCGTGTCCtcGACATGGCTGACGGCTTCGTCACTGCCATGACCGagaccgGtgATGTCAAgcagg
gtcTGGCTGTCAttgaccagtC > SEQ ID NO:1028 215638 204359_300792_1
CCCACGCGTCCGCCCACGCGTCCGACATTCGTTGTCTGAACACTAAACCAAAAAACTCCAAAAAAACAACTTAAT
ACACACCCCCCAACAACACTTAATACCGACAAGATGAAGGCCGCTTTCGTTGCTGTTGCTCTCGCCGCTCTGGC
CCAGGCTCAGACCCGCGCTGATATCCCATCCTGCGCTCTGCCCTGCCTCGACGACGCCGTCAAGGCCAACACCAA
GTGCTCCACCACCGACTACGCCTGTATCTGCAAGGACTTCAACGCTGTTCAGGGCGCTGCCACCGGCTGTGTCGT
TGAGAAGTGCGGTACCGACGTTGCCATCAACAAGGTCCT > SEQ ID NO:1029 215639 212629_300842_1
AGCTCGCCAAGGAGATTGGCTGCACTCCTGAGCACCTCCAGAAGACCTTCCAGACATACAATGCTATTGCCGATG
GCAAGCAGAAGGACCCCTGGGGCAAGAAGTTCTTCCACAACCTGCCCGTCGACATCAACGACGACTTCCACGTCG
CTCTCATGGAGCCCGTCCTCCACTTCACCATGGGTGGTGTCGAGATCAACGACAAGGCCCAGGTCCTCAACCAGG
AGAAGCAGCCTTTCGAGGGTCTCTACGCCTGTGGTGAACTGGCTGGTGGTGTCCACGGTGCCAACCGTCTCGGAG
GCTCCTCACTGCTTCGTCGCGTCGTCTACGGCCGTGTTGCCGGTGACAGCGCCAGCAGCTACCTCTTCCAGCATG
CCCTCCAGGGCACCGCCGGCGCTGCTCAGCGTCTGGGCCAGATCTCCCTGCACCTCGACCCCTCTGCTCCCGGCA
AGCTGACCGTCGAGTGGGCCAACGGCGCCGTTGCCGGCTCCGCTCCCGCTCAGGTCGCCGAGAAGCCCGCCGCTT
CTTCTGCCGGTGCCA > SEQ ID NO:1030 215661 218585_300967_1
cggacgcgtgggCCTCGCTGCAACTCCACGCCTCGCCAATCTCGAACGCCTGTCAAAATGCTCTCCCGCGCCGCC
ACTCGCACCACCTCCGTGGTCGCCCGCCGAGGCTTCCACACCACCCGCCCTCGCATGTCCTCTCCTTACCACTAC
CCCGAGGGTCCTTACTCCAACTTGCCCTTCAACCCTCGCAGCAAGTGGTT > SEQ ID NO:1031 215669 195810_300638_1
cagatcattaCAATCAAACTCTTAATCTCTATTCTTAAATACATCTACCTCTCACAATGGATTTCGTCAACAAGG
CTATGGGCAAGGAGGAGCGCTCCACTCAGGGCACCGCTCCCGCTGCTCCCCAAGCAGGCGGCCAGGTCCAGAAGG
ACGATTACGTCGACAAGGCTTTCGCCATGGGTGCCAAAAAGAGCGGCCACAACATGGATCGCAACACACAGGAGA
AGATTACGGATGCAGGCCGTAACATGTACGAGAAGGTGACAGGAAACAAGGTCGACCCCAAGTGGTCTAATTAAT
GAACGGACGAGTTATGACTCACAACAAGACTGTACAATAGTAATAATAACATCTTATCAACGCTGTCTGTTCCT > SEQ ID NO:1032 215670 210675_300891_1
AAATTCGAGGTGTTTTAGACGCAAGCTTCTCTTTTACACACTGAAGCTGCTGCTGCAACCATCACCAACATACCA
CACGCAACAACACAACACCACCACGTAATAACGAGCAGAACACCCCTCGCTTGAACTTGTTGCAAAAAACACTCT
CGCCTCTATTTCATAAATCAAATTACACACGAACAAAACAATGAATCCAACAGTCAGAGGCTTCTCAACCGCCGC
AAGAGTGCACCCGCCCTTTTTGCCACATCTCCGCCCATCGCCGCGCCGAGCCCCGATCCGACGCTGGCTAAAAAC
TGCCGCCGTCATCACCGCCGTCGGATACGCCTCAAAGACCTACCTCGACGCCACCCGCGCCCAGCGCCGCGAAAC
CGCCCTCGCACTTGAACATGATTCCGCCGAGAGGCAGCGCATGATGGAGAATTTGTATGGTGGGAGGGAGAGCTT
GGAGGATTTGGAGAAGGGGGTTGCTGAGTATGGCAAGCGGTAATCACCGAAGGAAAAacaaaAAAAAACGACAAC
AGACGGAaaaAaaaacttgaAGTAAAtTcaaGGGGTATTATTACACCAAAAGCGGCGAGGCATTTGGGGGGATTT
GCATCAGGgctGATGGTGCCCTTGAGCGAAGCatacatGGGAg

Figure 2 continued

> SEQ ID NO:1033 215672 111127_300052_1
cgccattagagttccatcgtattcactgctcagcagctgctacaactcgtcCGGCCAAAATGACATTCAAGAGAA
GAAACGGAGGTCGTAACAAGCATGGACGTGGCCACACTAAATTCATTCGCTGCTCTAACTGCGGCAAGTGCTGCC
CTAAGGACAAAGCAATCAAGAGGTTCCTTGTGAGGAACATCGTTGAGCAAGCAGCAGTGAGGGATGTTCAGGAAG
CTTGTGCTTTTGAATTGTACACTCTTCCTAAGCTGTACTTGAAGATGCAATATTGTGTCTCATGTGCCATCCACT
CCAAAGTTGTTAGGGTCCGCTCTGTTACTGATAGGAGGGTCCGTGAGCCTCCACAGCGCTTCAGACGCCCAAGGG
ATGATGCTCCCAAGCCTGGTCAAGCTCCACGCCCTGCCGGAGCTCCTACTGCAGCTCGTTCTTAAGTGCCTACAT
TTTGATCAACTACTGTTAGGCTTTTGAGTTTTAGTTAATTTGAGATGTATTTTTGAAGTGGATTTCTCTATTTAG
TTTTACTGGAACTATCATTAAATTTGTGTATGCAAATCTCAAGCAAACAGGCCTGTTGttCGTCctaTAGCttAT
ATAtcctttgcaattaaaCtc > SEQ ID NO:1034 215672 124727_300437_1
gTCCAGCCAGAATTTCATGCCATAAAATAGTACTAGGTCCCATTAAACTGAACCAAAAAAGTACTCAAAACCACC
ATATATAACAAAACTCCATAGTCACTTTCACACTATAGCTAAACAACATGATCAAAACAGCAGGCACTCAAGTAC
GAGCTGCTGCTGTCGGAGCAGCTCCAGGAACCCGTGGAGCTTGACCAGGCTTTGGAGCATCATCCCTTGGGCGCC
TGAATCGCTGTGGAGGCTCACGGACCCTCCTATCAGTTCGAGAGCGGACCCTAACCACCTTTGAGTGGATGGCAC
ATGATACACAATATTGCATCTTCAGATACAGCTTAGGCAGAGTGTACGTTTCAAAAGCACAAGCTTCCTGCACAT
CCCTAACAGCTGCTTGCTCAACAATATTTCTCACAAGAAACCTCTTGATGGCTTTGTCCTTAGGGCAGCATTTGC
CGCAGTTGGAGCAACGGACGAATTTGACGTGGCCACGTCCATGCTTGTTGCGACCTCCGTTCCTTCTCTTGAAAG
TCATTTTCGGAGATGGCTGGAACTCGACCCCACGCGTCCGCCCACGCGTCCGCCCACGCGTCCGCCCACGCGTCC
GCCCACGCGTCCGAACTTACAAAGCCAAGAAACCATTGAAGCACATAACaaacgcgggttCGAAAAccggcaAca
agtgGTCTATCGTCCAGCCACAAGAATACCAGACCGTTGACGACGTGCCGTATCAGCGAGGCCGTCCTCTCCCAA
CAGTCACCCCCGTCTTCAGAACAAGCTGCCCAACTCGCCTGGCAAGACGTCCATCGGCCTCCTCGTCGACTTCC
CGCCCAACTCGTCGACGCCCCCCACACGCACGGCGGCGCGGCCATCTCCGTCTTCGTCATCAAGGGCACCGTGC
TCAACAAGATGAACGATGGCCCGACTCGTGTGATCCCGGCGGGCGGCACGTGGTTCGAGGCCCCCGGCTGCCACC
ACCGGACCAGCGACAACTTCAGCACCACGGAGCCGGCGCAGATTCTGGCGACGATGGTGGTTGACACAAAGACTG
TTGAAGAGGGAGGGATGGCGGCTCTTGTTGTGCTCGACCCGGAGTATGCTGATATCAGACTTGGTTAAATTGATA
TGGATGCTGCAGTGAAGAGAACCGGAAGCTCGGAAAGGGTGTGGGTGTTGTCAATATCAGAAGTGGCCAGCGGAG
GCTCGGATTGCTGTTAGTAAACGGGCATCTCAGCAGGAAGGCAAAATGAatATGtaAAGCAATCAATGgcaacg
aatcGttt > SEQ ID NO:1035 215672 202059_300722_1
ATAAATGGTAAACCACATTTAGTAAAGATGAAACCAGTAACAGCAGATCCGATATTTGAAAAAGAACAGGTTGGT
CCTAGATAAAGTTCAACACCCTGGTATCATGCTAGATTTAGGGAAACGACTGAAAAAAGGTTTATCACTCCGGAG
ACAATCAGGTGCGAGCAACGTTGGGGGCAGGAGCAGCAGCTCCACCAGGAGCGGGAGCGCCACCACCTGGACGAG
GGCCTTGGGGCCTATCCTCCCTGCGGCGGAAGCGTTCCGGAGGCCTGCGGTCCCTCCGGTTCTCACGGGAGCGGA
CACGGACGATGTGAGCATGGATTGCACAGGACACACAGTGATGCACCTTGGCGTAAAGCTTGGGGAGAACGTATC
CATCGTGCACGCACGCCTCCTGGACGTCCCTGATGGCGGCCTGCTCCACGATGTTCCTCACCTGAAACCTCTTGA
TCGCCTTGTCCTTGGGGCAGCACTTGGCGCAGTTGGAGCAGCGGATGTACTTGACGTGGCCGCGGCCGTGCTTGT
T > SEQ ID NO:1036 215672 205543_300799_1
aacagttcaatccagACACCGCCAAAATGGTCAAGAAGAGAAAGAACAACGGCCGCAACAAGAAGGGCCGCGGCC
ACACCAAGCCCATCCGCTGCAGCAACTGCTCGCGATGCACTCCCAAGGATAAGGCGATCAAGCGCTTCACCATCC
GCAACATGGTCGAGTCTGCTGCCATCCGTGATATCTCCGATGCCTCTGTCTTCGCCGAGTACACTGTCCCCAAGA
TGTACCTGAAGCTGCAGTACTGCGTCTCTTGCGCTATCCACGGCAAGATTGTCCGTGTCCGATCTCGCGTTGGCC
GCCGTAACAGGGCTCCCCCCCCTCGTGTCCGCTACAACAAGGACGGCAAGAAGATCACCCCTACCGCTGCCCCCA
AGGTTTAAAAAATGGGTATGACGGGAATGGGTTGGACGGAGTCTGGTTTACTTTAACGCCTTCATGTAATTTGCT
TAGATGAATACCCAGGACAAAGAGAATCCTGGAGCCTAAATGAATCGGACTTTTTTTCTTGTTGAAAAGATTC > SEQ ID NO:1037 215672 267003_200088_1
gcagattatactcagaagctaccatccagagcgaaaatgactttcaagagaagaaacggaggtcgtaacaaacat
ggacgTGGCCACACAAAATTTATTCGTTGCTCTAATTGCGGCAAATGCTGCCCAAAGGACAAGGCCATCAAGAGG
TTTCTTGTAAGGAACATTGTTGAGCAAGCTGCTGTACGTGATGTTCAGGAAGCTTGTGCTTTTGAAACGTACACT
CTTCCTAAGCTGTACTTGAAGATGCAATATTGTGTTTCATGTGCAATTCACTCTAAGGTGGTCAGAGTTCGTTCT
GTTACTGATAGGAGAGTTCGTGAGCCCCCACAGCGTTTCAGGCGCCCAAGGGATGATCTCCCAAAGCCAGGTCAA
GCTCCACGCCCCGCTGGAGGAGCCCCTGCTGCACCTCGCACTTAACTTGATAGGCTTCAGGTTTTAATTAATCTG
ATAGTTATTTTATCTGTTATATGTCGTGGTTTTGACTGTACTGTTTGATttaGtTGATGGgaCcatntaCCAttt
TATGGAATTGAATTTTGAATGGAAAATGAGagaTCTaaAttttTCAtaatgaaGcGCTTTTAAg

Figure 2 continued

> SEQ ID NO:1038 215672 252883_301605_1
GGAAGAGGTAGAGGACTCTTTGTAGGTTTTGCTTGCAGGGTAGAAGACTCTTTTACTAGGGAGCTATGACGGTTA
AGCGTAGAAGTAGGGGACGAAGTAAGCATGGCCGTGGTCATGTTAATCCCATCCGATGCTCCAACTGTGGTCGAT
GCTGCCCTAAGGACAAAGCAGTGAAGAGGTTCCTTGTCCGCAACATTGTCGAGCAAGCGGCAATCAGGGATGTCC
AGGAAGCATGTGTTTATGATGGATATGTTCTTCCAAAGCTTTACACAAAGATCCAACATTGCATCTCTTGCGCTA
TCCACTCCCGTGTAGTACGTGTCCGCTCCAGAGAGGCTCGGAGGAACAGGGAGCCACCACAGCGTTTCCGTAGAA
GGGAGGATAATGGCCCAGGACAGAACCGTCCCCCTCCCCCTCCCCGCCCTTGAGATTTGTCAGGCACTTCATTAA
TCCTCGAGACTTAGTGCTT

> SEQ ID NO:1039 215672 224017_300978_1
CACGCGTCGCAAGGACAAGGCCATCAAGCGATTCACCATCCGAAACATGGTCGAGGCCGCCTCCATCCGAGATCT
TTCCGAGGCCTCCGTCTACCAGGAGTACGTGCTGCCCAAGCTCTACCTCAAGATCCAGTACTGCGTGTCTTGCGC
CATCCACTCCAAGGTTGTCCGAGTCCGATCTCGAGAGGGCCGAAAGGTTCGAACTCCTCCCCAGCGAGTCCGATT
CAACAAGGACGGTAAGAAGATCAACCCTGCTGCCGCCGCCAAGGTTGTCGTTTAGGCGATGTATAAAAAATTGCA
CTGTGTATG

> SEQ ID NO:1040 215672 211383_300957_1
tgggctttgcactgccaaaacggcccctccgccggcatggccataagaatggaggccttgtggaaagatcgtgaa
ctttcCATGTACTTTACTTCGATCGTGAACTGCACCTCGCATTACATAAGGTGATTTATAGCAGGTACCACGGTA
CAACACCAAAAAGAGCATACACCGCCAAAATGGTCAAGAAGAGAAAGAACAACGGCCGCAACAAGAAGGGCCGCG
GCCACACCAAGCCCATCCGCTGCAGCAACTGCTCGCGATGCACTCCCAAGGATAAGGCGATCAAGCGCTTCACCA
TCCGCAACATGGTCGAGTCTGCTGCCATCCGTGATATCTCCGATGCCTCTGTCTTCGCCGAGTACACTGTCCCCA
AGATGTACCTGAAGCTGCAGTACTGCGTCTCTTGCGCTATCCACGGCAAGATTGTCCGGTACGTTGCCTCCCTG
GGAGTGTTACAACTGCGCCTTTCTGGCGTATGTGCTTCAGATGAGCCTTGGTTGTACTTTGGGACGTTCACACAC
GTCCCAGCTCTCGAACATATATACCCTCCCCCGTCCCCCTAAAGGTACGTTTGACGCTGACAGAATCAAAATAGT
GTCCGATCTCGCGTTGGCCGCCGTAACAGGGCTCCCCCCCCTCGTGTCCGCTACAACAAGGACGgcaAGAAGATC
ACCCCTACCgcTGCCCCCAAGGTTTAAAAAATGGGTATGACGGGAATGGGTTGGACGGAGTCTGGTTTACTTTAA
CGCCTTCATGTaAtttgctTaGatgaatacccaGgaCAAAGAGaaTc > SEQ ID NO:1041 215678 211872_300871_1
CACCATCAAACAACAATACAATCCATAGAGGATTACCTCTCAACTCAACCACCTTTACGACAATCGCAACTCAAT
AAGATTCTTTCAGTGTATTATCACTCAAGATTTGAATTTCGATTCGACCAAGAAAACTCCAATCAAATTTATTAC
ACCATATAATATTTTCAACTTCAAACATTTTTCTCAATATGTCTGCTGCTACCGTCACCCGCGCTGCTGCCAGCA
CTGTTCGCAAGCCTATTTCCTTCTACACTCAAGTCCGAAGAATGGGCCGTGTCTTTGAGAGCCACCCATACGAGA
GATTTGCAACCACCATGAAGCCTGCAAAGCCCGACTACTACAAGAACATTTCTTTCACTGCTGGCAAGGTTGTCA
CTTATTTCCCCATCATCGGCGCCATGCTTGGCTGGCCCGTCCTTTGCAAATGGGCTTTGGACGGACAGATCGGTC
GCCTGTAAAGAGGTGATAGAGGCAATGGTATAGAGTGGGACAGCAAAAAGATATAGAGATGTCCATCTTTCGACT
GTATATATACACTTTGGGCGTTTGGATGGACTATGGGTGCGAAGCATATTTCGGCGCAACACAGATTAATTCAAT
TTGATTCTCTTTGTTAATTTATTCAAACGCGCGCCTACACAACAATCTGTGATATAagaaTGTGTCAgccgAAA > SEQ ID NO:1042 215678 215357_300880_1
tccgACAATCCATagagGATTACCTCTCAACTCAACCACCTTTACGACAATCGCAACTCAATAAGATTCTTTCAG
TGTATTATCACTCAAGATTTGAATTTCGATTCGACCAAGAAAACTCCAATCAAATTTATTACACCATATAATATT
TTCAACTTCAAACATTTTTCTCAATATGTCTGCTGCTACCGTCACCCGCGCTGCTGCCAGCACTGTTCGCAAGCC
TATTTCCTTCTACACTCAAGTCCGAAGAATGGGCCGTGTCTTTGAGAGCCACCCATACGAGAGATTTGCAACCAC
CATGAAGCCTGCAAAGCCCGACTACTACAAGAACATTTCTTTCACTGCTGGCAAGGTTGTCACGTAAGTACCCCA
GACAATACAATACAACAAACCAGTACATCCATAGAGCGGCTGTACTAACACTTGGATTTTTGCAGTTATTTCCCC
ATCATCGGCGCCATGCTTGGCTGGCCCGTCCTTTGCAAATGGGCTTTGGACGGACAGATCGGTCGCCTGTAAAGA
GGTGATAGAGGCAATGGTATagagTGGGACAGCAAAAAGATATAGAGATGTCCATCTTTCGACTGTATATATACA
CTTTGGGCGTTtggaTGGACTATGGGtGcGAAGCATATTTCGGCGCAACACAGATtaaTTCaaTTTGATTCTCTT
CGAAAAAAaa > SEQ ID NO:1043 215685 200205_300757_1
atCACCAATTGCACCCCGCCATGGCTTCACCAATGGCTGCCTCTCGCCATGTCCAGCGCGTGGCTACACAGATCC
GTCTGCGCTCAGCGCGGGTTCCCAGAGGCCAATTGACCTTCAATCGATGGGCATCGTCCGCTTCGGGCAGTCGGC
GAGCTCCCGCCAGCTTCGGAACTTCATCCTCGGCAGCCGTTTGGCTTGCAGCCGCCGCCATTGGCATCACGGCTC
CCTTGGCCTACAGCTTGGTGAGTTTTACACGATAGGCCCGGGGAGACACAATTCATGCCGAGACCTTTCCAACTT
ACATGTCTCTTCTTGTTTCCTTTTCCAGACAACAGCAGAACCTGCAAAGCTCGACGTCACATCCCTTGCCGAAAA

Figure 2 continued

```
GGATGAGCAGAAGAAGAGAGAGGCGGTTGTCACCGAAGAGTCGCCCATGCGCCTGCGGATGGAAAAGTTCATCAA
GGAGCAGCAGCAAATAATTGTCAAGGAACTCGAGCGCATCGACGGCAAGAAGTTTCGCAAAGACGAGTGGACGCG
ACCCAATGGCGGCGGCGGCATAACCTGTGTGCTGCAGGAGGGCAACGTATTCGAAAAGGCCGGTCTCGGCGTCAG
CGTCGTCTACGGAACGCTTCCCAAGCCcgCCATCTTGAAGATGCGCGAAAATCACAAgaaccTcgaccccGacgt
cgagtcgctggaatcttCGCTgctg
```

> SEQ ID NO:1044 215685 209003_300811_1
```
atCCCATCACCAATTGCACCCCGCCATGGCTTCACCAATGGCTGCCTCTCGCCATGTCCAGCGCGTGGCTACACA
GATCCGTCTGCGCTCAGCGCGGGTTCCCAGAGGCCAATTGACCTTCAATCGATGGGCATCGTCCGCTTCGGGCAG
TCGGCGAGCTCCCGCCAGCTTCGGAACTTCATCCTCGGCAGCCGTTTGGCTTGCAGCCGCCGCCATTGGCATCAC
GGCTCCCTTGGCCTACAGCTTGACAACAGCAGAACCTGCAAAGCTCGACGTCACATCCCTTGCCGAAAAGGATGA
GCAGAAGAAGAGAGAGGCGGTTGTCACCGAAGAGTCGCCCATGCGCCTGCGGATGGAAAAGTTCATCAAGGAGCA
GCAGCAAATAATTGTCAAGGAACTCGAGCGCATCGACGGCAAGAAGTTTCGCAAAGACGAGTGGACGCGACCCAA
TGGCGGCGGCGGCATAACCTGTGTGCTGCAGGAGGGCAACGTATTCGAAAAGGCCGGTCTCGGCGTCAGCGTCGT
CTACGGAACGCTTCCCAAGCCCGCCATCTTGAAGATGCGCGAAAATCACAAGAACCTCGACCCCGACGTCGAGTC
GCTGGAATTCTTCGCTGCTGGCCTGAGCATGGTGCTCCATCCGTACAACCCCATGGCTCCCACCGTGCACCTGAA
TTACCGATACTTCGAaacgggcaatCCCGaCggTACCtctcaggcgTGgtgGt
```

> SEQ ID NO:1045 215722 199413_300749_1
```
TCTCCATAGAGCTTCCGGCCCAGGCTCTTATAGAAGTCAGAATTTTTTGCATTCCAGTCTTCATGAGTCGCACCT
ACTCTATGCCAACGATGTCTTGTACGTATTTACCAGCAGTACAGAGGTAGGACGTCAACTCGCCAGCAAAAATAG
GGATGAACTCACTCTGAAGCTGCGTCATGTCAATATATATATTGATCTCTTTGCATATCTTCTTGTCGACCGATATC
TAATGATAGATCGTTGATCTGGCCAACTTTCTGCTATCTTTCAATCCGCCACCGTTGGAATCCCAATGATATTGA
GGCCCTCTTCTATAAATGTACGTATGATTCAAGTACCAGATCTCGAATCCTCGAATATATCGACTTTAATGTGTT
CTGTTTTTCCTCTCAGATTCTGAGTCATATAGATGGTGTACCAAGCAATCGACCCATCTAACAATAACTCGTATA
GAAAAGAGGTGCTACTTCTTCATCCAAGCAATATTTTATTGTTTACTAGAGTCCTTGCCTCGCTCATTAAAATAA
ACGGTGGAGCGTTGTAGCGTAAATAAATGAAAGCGGAGGGGTTGCCACGAGGTCGACAACTCAACTCAAGTCACT
CCGATCCGGCCATAGGTCTCTCAAAATTCTTCTCCGTTTCCTTTTATTTG
```

> SEQ ID NO:1046 215747 200101_300756_1
```
GTTGATACCAAACAAAGGTGGAAGTGGATCTTGGGGAGAGGGAGAAAGATGATTGCTTGACATGTATGATACCCA
AGATACCCCAGGAGAAATGATGGCGATAAAGCAAAA
```

> SEQ ID NO:1047 215771 214170_300855_1
```
GGACGGCAGCCATGAATTCCGCCTCGCGACCCGGCCAGGGCCAATTGTTGGGCCTTTTGAGATCCGGAGTGCGGT
TTGCACACACGGGCCGGCCACGAGGGGCTGCGGCAGGATCCCAAGACGCCGAGAGCCATGGAGAGAATATCTGGG
TGTTTGCCCACAGAAGATCAGAACAGGTCATTTACAGCTTCACCAAGCAATTGGATGGGTTCCATGGCCTGAAAC
AGCTGCCGTTCAACGGCAAGAAGACCAAGCCTGCAAAGCTTCGCAAAGACTACTGGTCACCGCTCGCCCACATTC
GATTCCAGCCCGGCCAAGGATCCGTCGGCCGCTCGGTATTCCAGAAGCTGCGAGAGCTGAAGCACCTTCACGAGG
TTGCATGGACAGACGAGTTGCGACATAAGCGGCCGGAACAGTACACCAGCCAGGACAAGAAGAAGATTGCCGAGG
AGAAGGAAAAGGGATTCGATTACCAACCAATCCGGAGCAAGCAGGAGCGTGGAATCGCTCTCAACGCCCAGAAGC
AAAATGCGATTGCCGATATGGCATCCGTTTTGGCGGGCGAAGGCCGTGGCAACAAGGTCTTGACCGCGGAGGCTG
AAGGAGGCGagaaaGAG
```

> SEQ ID NO:1048 215783 200007_300755_1
```
AATAATTCAATCTTCTACAGCTGCTTCAACTACACCACATCAAGCATATCCTCACTTTTTGTCTCACTTCAAAAC
ACCAACCATCTCAACTTATTCACCATGTGTGGCGGAAACTGCGGCTGCTCTTCTACCTCTGCCTGCAGCTGCGGC
TCCAACTGCTCCTGCTCCAGCTGCCACTAAGAACATGACTTGAAACTCGGGCACATGGCTTGCATCACTTGATGC
TTGAGAGAAATACGCCAACTGCATCTACAGCACTGGCTCACTCTTCTCAAATTATACTACACGACGACATATCA
CCAAATGCAATTCAATGATGGCTAGCTAGGGCACTTTATAATCAATGTATTTTTATTGAACTATAATTATT
```

> SEQ ID NO:1049 215882 210509_300962_1
```
CCCACGCGTCCGCCCACGCGTCCGCTGAGCGCACATCGCAAGCATAGAAGCCGTCATCAGTCCTCCATTTCTCGA
TACCTCCAGCGAGTTGATTTCATCGCAACAGCTTACTGCGTTGTCTGCCTTTTTTCTCCGCTTACTCCTGAACC
CCAACAACCAAGATGGCGAACCCTCTCGATACCGATGCTGGCTCCGAACTTTTCAGCTCGTATGAGGCGGAGCTC
AAGCTCGTACAGGCCGATCTGGCGCAAAAGCTGGACCAGATCCCCGAACTGAGTGGTGAACCGCGCAAGGCTGCC
GTCAGCCAGGCTGAACGTGCCCTGGAAGAGGCAGATGAACTGCTTGGTCAAATGCGCCTTGAAAAGCAAAACATC
CCTACATCTGCACGAGCCAAAGTCAACCAGCGCTTCCGCAACTACGAGTCCGACATCGATTCAAACCGCCGAAAG
CTTACGGGTCTCGCCACTAACCGAGCGGCCATGTTCGGTTCACGCTACACCGACGAACCATCCGGATCAACGGAT
```

Figure 2 continued

ATCAATCTGGAACAGCGACAGCAGTTGCTGTCAGGGACCGAAAGACTCGACCGAAGCACACAACGACTTCTTAGC
AGCCAGCGGCTCGCCAGCGAGACAGAGGCTATCGGAGCTGAAACGTTGGCCGATCTGCACAGGCagggcgaGACT
ATT > SEQ ID NO:1050 215884 211921_300872_1
aaccaccACATTTTACCAGTTGCAACAAGCCACTGAATCAATCAGAAAAACCATCAAACAAGACAATCGGCATCA
ATCTAAATATCGAGCACTCATCAATCGAAATGATGCCGCTGCACAGGCCGGAAACGCCACAACCCGAATCCCCTC
TTCCCACCGAGCCCGATACCAGCGAGGGCGACGGCACTGCGGATTACTGAGGGGCAACACAAGCTCAAACTTTGA
TGACGACAAGGGCCGCTCGGGAATGAGAGAATACGACCGAGTCTAAATGGCACTCAAGAGCGGCGTCGAAATGCT
GGTTGCGGAAACGAACTGGGGAAACGACCTAGATTGAATAGACATGCTCGGAGATGGCGCATGGAGGAAACGTCT
ATGAAGCGCATGTCTTTTTTTGGCTTTCTTTGTTTTTTCTTTTTACGGCCGACGACGACACGATACGCCGATAAC
ATATACACTTGCCCCCGCCACTGCCCAAAGAGCGCGATTCTGCGGGGGTAGCAGTTTTATCAGAATGAATGCGGA
TTGGAATTGAGCGAGCGATGTACATTATTTTGTCTTTTATTTGATTGAGAAATTCTTTCAATTTTTTACGCATTT
ATCATTTGCCAATGTTGTTGTTGCTGTTGTTTTCACGGTTAGGCGTTGTGAGTGAGCTGTCAAGAGTTCCTTGAT
CTAATCAGTATAGCTTCAATATTAATCACTTTGGCAACTTCCC > SEQ ID NO:1051 215907 206530_300823_1
CACGAAGCCTACCAACGACGAGCTCCTTCGCCTCTACGCTCTTTTCAAGATCGGCAAGGGCTTCGATTTGGAGTC
GGCCCCCAAGCCTGGAATGTTCGACATGAAGAACAAGGCCAAGTACAACGCGTGGAAGGCCGCTGTAGAGGAGGA
GAACATCACCGACCCCGAGGAGGCACAGAAGAAGTATGTTGAGTTTGTCGAGGGGCTCAAGTCCAAATACGCCTA
ATCTCGACAAGACTCGAGGATTGAATTagaAGGGGGCACGCTGCGAGTGTAATACATGGTACTAGAGACGCATGG
CTTTTGGGATAGAATGCCAGTTAGCATGAAGAAATAAAGTAAACAAATTGTCCacaaAAAAAAgaacagataac > SEQ ID NO:1052 215915 205083_300795_1
CCAAACCGCCAAACAACGCATCTTACGGCTTCACAACAGCTTGGAAAGCTCTCTATTCGCAATGGCTATCGCACC
GATCACTGGAGTACGTCCCTATTCCGGCCAATGGCGCAGCGTCGCACTGGGAATCGTGGCAGGTCCTGCTATAAA
TTCATTGGAGTAGCTAACACAGGATGCAGATGCTGCGGCGACAGCTCATCCTTGACCTCGGCGTTGGTCTTGGAT
CCGGATTCATCATGGCCAACTGGTACTGGTACGGCTACCACATGCCCCGAACCAACGGCCGAGACGCCTACTACG
CCAAGAAGGAGGCCGACCGTGCCGCCGCGGCATCACAGTAAGGGGGGCACTTGTATACTCGATGGACCGAGAGGG
AATGCGGCATGAACAACTGCTGGTCGAATAGAAGGGGAATGACTGGGCCAACGGGCTGTTCATGCCTGCAGGAGC
ATAGTTGCTGGACAGATGTCGAATATCACTGAAGAAAGGCAACCGGGCGAACCTCTACTTAGACCAATAAGTCGC
GGGGCAATACGATTCAATTATCTCGATTGGCTTATTATATGTTTTTGCCATGCCGACTCCCCTTTGTTTATTGCT
GAAAATAGTGCTGGTGGTTTCTTTCCAATTATGTACAAATTATGTGCTATACGAAGCCaaaaAAAAaaagaaa > SEQ ID NO:1053 215915 219802_300949_2
GAGTTCACCAAACCGCCAAACAACGCATCTTACGGCTTCACAACAGCTTGGAAAGCTCTCTATTCGCAATGGCTA
TCGCACCGATCACTGGAATGCTGCGGCGACAGCTCATCCTTGACCTCGGCGTTGGTCTTGGATCCGGATTCATCA
TGGCCAACTGGTACTGGTATGGAACTTGAAAATAGTACGGCTACCACATGCCCCGAACCAACGGCCGAGACGCCT
ACTACGCCAAGAAGGAGGCCGACCGTGCCGCCGCGGCATCACAGTAAGGGGGGCACTTGTATACTCGATGGACCG
AGAGGGAATGCGGCATGAACAACTGCTGGTCGAATAGAAGGGGAATGACTGGGCCAACGGGCTGTTCATGCCTGC
AGGAGCATAGTTGCTGGACAGATGTCGAATATCACTGAAGAAAGGCAACCGGGCGAACCTCTACTTAGACCAATA
AGTCGCGGGGCAATACGATTCAATTATCTC > SEQ ID NO:1054 215915 211280_300897_1
tactcgaccacgcgtcgAATGGCGCAGCGTCGCACTGGGAATCGTGGCAGGTCCTGCTATAAAATTCATTGGAGTA
GCTAACACAGGATGCAGATGCTGCGGCGACAGCTCATCCTTGACCTCGGCGTTGGTCTTGGTAAATATTGGCCCC
CGACtGTCCGCAGAGCTTTGGCACAGCTATGCGGCTATtTGTtTtatTATCCGCTTTGactcacgttTCGTTATA
GgatCCGGATTCATCATGGCCAacTGGTACTGGTATGGAACTTGAAAATAGCGAGCCGACTCCGATTTGTCaggg
aatAATGTctaataaTGGGATAGGTAcggctaCCAcatgcccgaaccAacgggcgagaCGCCTACTacgccaag
aaggaggccgaccgtgccgccGcggcatcACAgtaaggGGGGCACTTGTATACTcgatg > SEQ ID NO:1055 215915 208306_300834_1
ACAACAGCTTGGAAAGCTCTCTATTCGCAATGGCTATCGCACCGATCACTGGAGTACGTCCCTATTCCGGCCAAT
GGCGCAGCGTCGCACTGGGAATCGTGGCAGGTCCTGCTATAAATTCATTGGAGTAGCTAACACAGGATGCAGATG
CTGCGGCGACAGCTCATCCTTGACCTCGGCGTTGGTCTTGGTAAATATTGGCCCCCGACTGTCCGCAGAGCTTTG
GCACAGCTATGCGGCTATTTGTTTTATTATCCGCTTTGACTCACGTTTCGTTATAGGATCCGGATTCATCATGGC
CAACTGGTACTGGTACGGCTACCACATGCCCCGAACCAACGGCCGAGACGCCTACTACGCCAAGAAGGAGGCCGA
CCGTGCCGCCGCGGCATCACAGTAAGGGGGGCACTTGTATACTCGATGGACCGAGAGGGAATGCGGCATGAACAA
CTGCTGGTCGAATAGAAGGGGAATGACTGGGCCAACGGGCTGTTCATGCCTGCAGGAGCATAGTTGCTGGACAGA

Figure 2 continued

TGTCGAATATCACTGAagaAaggcaacCGGGCGaaccTCTACTTAGACcAATAAgtcGCGGGGCAATACGattca
aTTATCTCGAt > SEQ ID NO:1056 215918 107682_300380_1
acgaacataaggccgacgcgtatcatttaacctcccgtcgacgtctatcattcaattctcgccgcttttgctcG
CGGTGAGGATGTCGACACCGGCGAGGAAGAGACTGATGAGGGATTTTAAGCGGTTACAGCAAGATCCCCGGCCG
GCATCAGTGGAGCTCCGTATGACAACAATATAATGCTATGGAATGCAGTCATTTTCGGCCCTGATGATACTCCCT
GGGATGGAGGTACATTTAAGCTGACACTTCAATTCTCAGAGGACTATCCAAACAAACCACCAACTGTGCGGTTTA
TTTCCAGAATGTTCCACCCAAATATTTACGCTGATGGAAGTATTTGCTTAGACATCCTGCAAAATCAGTGGAGTC
CCATATATGATGTAGCTGCTATACTGACTTCAATCCAGTgCAGTCTTTGCTCTGTGATCCAAATCCTAACTCGCC
AGCAAATTCAGAAGCAGCACGCATGTTCAGTGAGaaCAAGCGTGAATAcaacaaggaggtgCGCGAGATTGTTGA
ACagagcTggACAGCAGACTGACTTCTccctCACTCTCgTCTgtgACAGcagattAtcctgtctCATACTGAAAT
tgttCTCgtcttgtcaCTACATTAGtaacta > SEQ ID NO:1057 215918 121412_300357_1
ATTTGATCGGAGGGTGAATATGTCGACGCCAGCAAGGAAGAGGTTGATGAGGGATTTCAAACGACTGATGCAGGA
TCCTCCAGCTGGCATAAGTGGGGCCCCACAGGACAACAATATAATGCTTTGGAATGCTGTAATTTTTGGCCCTGA
TGATACTCCTTGGGATGGAGGTACGTTCAAGCTGACACTTCAGTTTACTGAAGATTATCCTAACAAGCCACCTAC
AGTGCGATTTGTTTCTCGGATGTTTCATCCTAACATTTATGCTGATGGGAGCATATGCTTAGATATACTACAAAA
CCAGTGGAGCCCCATATATGATGTAGCTGCTATACTCACATCCATCCAGTCGCTGCTTTGCGATCCAAACCCAAA
TTCACCTGCCAACTCTGAAGCTGCCCGCCTATTCAGTGAGAACAAGCGGGAATACAACCGAAAAGTTCGTGAGAT
AGTGGAGCAGAGCTGGACCGCGGACTGATCCACTCCATCTAACCATATGATGCCTGATACTTAAAACGCTCATCT
TTTCAGTGTGTCGTGTACCAAACTGCTTGTAATTAAAATGCTAAAACAGTAAAACGTGC > SEQ ID NO:1058 215918 57194_300378_1
CCCACGCGTCCGATCTCTTCTATTCATAAGTTGTAAATTCTTATTATTGGGATTTTTTCCCTTTTTAATTCAATC
CAAGAATTGAGTAGGACTAATGGCATCCAGGAGAATTCACAAGGAACTAAGGGAGTTGCAAAGAGACCCTCCTAC
TTCATGCAGTGCAGGTCCGGTGGCACAGGATATGTTCCATTGGCAAGCAACCATTATAGGTCCAAATGACAGCCC
TTATGCAGGTGGTGTTTTCCAAGTGGCCATCCATTTTCCTCCTGATTACCCTTTCAAACCTCCCAAGGTGGCTTT
CAAGACCAAAGTTTTCCATCCAAATATAAATAATAATGGAAATATTTGTTTGGACATTCTTAAGGATCAATGGAG
TCCTGCCCTCACCATATCAAAGGTTTTGCTTTCCATATGTTCACTACTAACAGATCCAAATCCAGATGATCCATT
GGTTCCAGAAATTGCTCATATGTACAAATCTGATCGGAAGAAATATGAATCAATGGCTCGTAATTGGACCCAAAA
GTTTGCTATGAATTGAGTTGTTGTATTCATATAAAGCTCATGTGCTATAATTTGTAACAAAAGATCAATGATTTT
CTCCTCCGCAGGCATGTAATAAAAGCACAAAAATTATAACA > SEQ ID NO:1059 215918 52729_300086_1
ttttaaatcgtaatacatatatacacaaaagtgaataattgagatggtttggtACAAAGTTGTTTTTTTAAGGAT
GTTGGGTTACATCAAAGCATGGAATCACTTAAATAGTTTTGGAAACACAAGACATGAATGAAAAGAGAAGAAAGC
TGTTGCTGAATCGTGATTGAGAGAAAGTAGAGAGAGCTACAACGCTTACAACAAACTACTACTAGTCAGCAGTCC
AGCTTTGCTCAACAACATCACGCACTCTCCTGTTGTACTCGCGCTTGCTTTCGCTGTACATCCGAGCAGCTTCCG
AGTTTGCAGGAGAATTCGGATTAGGGTCACAGAGCAAGGACTGGATGGAGGTAAGTATAGCAGCAACATCATAGA
TTGGACTCCACTGGTTTTGTAGAATGTCCAAGCAGATACTCCCATCTGCATAAATATTAGGATGAAACATCCGTG
ACACAAACCGAACTGTTGGTGGTTTATTGGGATAATCTTCAGAGAACTGCAGTGAGAGTTTGAAAGTACCTCCAT
CCCATGGTGTGTCATCAGGCCCAAATATGACAGCATTCCAGAGCATAATGTTGTTGTCCTGTGGAGCACCACTAA
TACCCGCAGGTGGGTCTTGCTGCAACCTCTTGAAATCCCTCATTAACCTCTTCCTTGCTGGCGTCGACATCCTCC
TTTCTTTCGTGGAAACAGATCTCGTTGTTGAGGTAAAGATCGCGGAGAGAAGAGGTCGTCAAACAAACATATGTG
TTCAGCGGTGttgaccgccggtaatcagagaaagttttccgatcgattcaggtcggcgattctcaatatcaccgt
gcgcggacgcgtggg > SEQ ID NO:1060 215918 38614_300209_1
attaattaactGCAGTGCTGGCCCAGTTGCTGAAGACATGTTTCATTGGCAAGCTACAATAATGGGTCCATCTGA
TAGTCCTTATTCAGGCGGTGTCTTTCTCGTAACCATTCACTTCCCTCCGGATTATCCTTTCAAACCACCAAAGGT
TGCATTCAGGACAAAAGTGTTCCACCCTAATGTCAACAGCAATGGAAGCATTTGCCTTGACATTTTGAAAGAACA
ATGGAGTCCTGCACTCACCATATCGAAGGTTTTGCTTTCGATATGTTCATTGTTAACGGACCCAAACCCAGATGA
TCCATTGGTTCCAGAGATTGCTCACATGTACAAAACCGATAGAGCAAAGTATGAGTCTACTGCGAGAAGCTGGAC
TCAGAAATATGCAATGGGATGAAAGTTTGTGTCCTTTGATCCCTCACAGACTCGGTTTTAATAGAGAGAGAGAGA
GAAAGAGAGAGGACTTCTTCACATAGGGATCTTCCATGAAATAAGTTAGATTCCTATGTTTTATCATCTCTTTGT
TTGAAACCTCTTTAATCTCAAACAAAAACATTACTTCACCTCTTTATTATcc

Figure 2 continued

> SEQ ID NO:1061 215918 37480_300389_1
TTGAATGGAGATCAAATAATTTCTTACTGATCCTGTCTTCACAAATTTTATAAGACAGACAAGTCTATAAAAGAT
CATTACATAGAAATAAGAAGAGTTTAATTATTAGGGCTCTTCCTTAAGGACAGTATTTGTGTCAGCCCATGGCAT
ACTTTTGGGTCCAGGTCCGAGCAGTGGACTCGTACTTGTTCTTGTCTGTCTTGTACATGTGAGCTATCTCAGGGA
CCAAAGGATCATCTGGGTTTGGATCCGTTAACAAAGAACAGATCGATAGCAGCACCTTGGAAATTGTGAGAGCAG
GACTCCACTGCTCCTTCAAGATGTCGAGGCAGATGCTTCCATTGCTGTTAATGTTTGGATGGAACACCTTCGTCC
TAAAAGCCACCTTAGGAGGCTTAAATGGGTAATCTGGAGGGAAATGGATGGTTACAAGAAAAACTCCTCCAGAAT
AAGGGCTATCCGATGGACCCATTATAGTGGCCTGCCAATGAAACATGTCTTCCGCAACGGGTCCTGCGCTACATG
AAGTAGGAGGATCCTT

> SEQ ID NO:1062 215918 274422_200057_1
gcgaactCCTCCCAAGTCATATCCCTCAAAGTCACAGTATCTCGTACTTTGGTTTCTCCTTTTGTTTGGGATAAG
AGAAAGACAGTAATGTCAGGAGGTATAGCCCGTGGCCGTCTTGCAGAGGAGCGCAAAGCTTGGCGCAAAAATCAC
CCCCATGGGTTTGTAGCAAAGCCAGAGACGCTTTCGGATGGGTCAGTTAACTTGATGGTTTGGCACTGCAGTATT
CCTGGTAAAGCAGGAACGGACTGGGAAGGCGGTTTTTATCCGGTTACGATACACTTCAGTGAAGATTATCCTAGC
AAACCACCTAAGTGCAAATTCCCACAAGGCTTCTTCCATCCGAATGTCTATCCATCAGGAACAGTTTGCTTGTCG
ATCCTCAACGAAGATAGCGGTTGGAGACCTGCCATTACAGTGAAACAGATACTGGTTGGTATCCAAGACTTGTTA
GATCAGCCAAACCCTGCTGATCCTGCCCAAACCGAAGGGTATCATCTCTTTATTCAGGATGCTATTGAGTACAAG
AAGCGGGTTAGGCTGCAGGCCAAGCAGTATCCTCCTCTGGTGTAGTCTAAATAATGGTCGTATGTTTGGATCGTG
GTTCTAATGCAACTTGAAACTATGGTATTCATAGCCTGCTGATAGCTGACAGTCTTCTGGCAAATGATGCTGACT
TGg > SEQ ID NO:1063 215918 272617_200131_1
gggcacCTCCTCCAACACAAAGCAGGAGTTCAACGCAGAATCAAACCAAAACCCTAGCTCACCGCCTTGTTTCCT
CCGTATTGGTGGTTACAATGTCGACTCCGGCTAGAAAGAGGTTGATGAGAGATTTCAAGAGGTTGCAGCAGGACC
CTCCTGCTGGTATTAGTGGTGCACCTCAAGACAACAACATTATGCTTTGGAATGCCGTGATATTTGGTCCTGATG
ACACTCCTTGGGATGGTGGTACGTTCAAGCTGACTCTTCAATTCTCTGAGGATTACCCCAATAAGCCACCAACAG
TGCGGTTTGTTTCTCGCATGTTTCATCCTAACATTTATGCAGATGGAAGTATATGTTTGGATATTCTTCAAAATC
AGTGGAGTCCAATATATGATGTTGCAGCTATACTTACATCCATTCAGTCATTGCTGTGCGATCCCAACCCCAATT
CACCTGCAAATTCGGAAGCAGCTCGGATGTTCAGCGAGAATAAAAGGGATTACAACCGCAGaGTTAGaGaaGTTG
TGGAGCagAGCTGGACTGCAGACTGATTCTAAGGAAGAAAGATGTCATTGCTGACCGCAATTCGGGAGCAccagg
gtTCATCtatgttAcAtTtACggAtTGAAACCTcttctt > SEQ ID NO:1064 215918 265916_200082_1
aatctccattgcctttttaagccggcgacgaacataaggccgccgccTATCATTTAACCTCCCGTCGACGTCTATC
ATTCAATTCTCGCCGCTTTTTGCTCGTAGGTCAACAATTCCGTATTTCTTATGCGGTGAGGATGTCGACACCGGC
GAGGAAGaGACTGATGAGGGATTTTAAGCGATTACAGCAGGATCCCCCGGCCGGCATCagcGGAGCTCCGTGTGA
CAACAATATAATGCTATGGAATGCAGTCATTTTcggtcccttgatgcataacctccgctgggcactggAGGTACA
TTTAagCTGACACTtcaATTCTCTGAagaCTATCCAAAcaaACcaccaACtgtgcgaattaTTTccagaaTgttc
cACCCAAATATTTACGCTGATGGAAGTATTTGCttGGACATCCTGCAAAATCAgTgGAGTCccATATATGatgta
acTGCTATACTGACTtCaatccagtcTTTGCTCTGTGATccaaatccTaACTcgccagctaattcagaagcagca
cgcATGTTCaGtGAGaacaagCgttgatacaacaggaacgtgCgcgagattgttgaaCAGAGCTggACAgCagaC
TGACTtATtccgcac > SEQ ID NO:1065 215918 258580_301697_1
GAAACCACCGTCCACCCTACCCACCCTCCGCAGACCTCTTCTCTTGCGCCGCGACCCAAAGAACAAGAGGATAGC
TGAAGAACCCGAAAAGAATGCAGATGGAAGCCCAGAATGCCGACCCCTTTGCTGAAAACCCCGCCAAGCTGCAAA
TGTCGGGATCCAACTCAAACGACGGCCACTCGGTCACCAAGCGCCTGCAAAACGAGCTGATGCAACTCATGATGT
CCGACACGCCCGGAATCTCGGCGTTCCCCGTGTCCGACGCAGATCTGCTCAACTGGACCGGCACCCTGACCGGCC
CGGAGGGAACGGTCTACGAGGACCTGACGTTCAAAATCTCGCTGGCCTTCCCCCAAAACTACCCCTACACCGCAC
CCACAATCAAGTTCATCAGCCCCATGTGGCATCCCAACGTGGACATGTCCGGCAACATCTGCCTGGACATTCTCA
AGGAAAAGTGGTCTGCCGTGTACAACGTGCAGCAATTCTCTTGTCCCTGCAGTCGCTGTTTGGCGAGCCCAACA
ACAAGTCGCCTCTCAACGCCCAGGCCGCCCAGCTGTGGGACACGGACATGGATGAGTACAAGCGGCTGCTGATGC
AGCGGTACGAGGCCCCTGACGATGA > SEQ ID NO:1066 215918 255121_301642_1
TCCTCTCTCTCTCTCTTTAATCTCTGGTCTCCGTCTCCGTGTCCGTCTCCGTTACTGTGTCTGTCTCCCTTCCGT
CGAGATCTGTGGATCTTATAGCCTAGCCCTAAAGGGGAACAGCAAGCTTTGGACTTTCCATGGCCTCCAAACGGA
TCCTGAAGGAGCTCAAGGATCTGCAGAGGGATCCTCCCACATCATGCAGCGCAGGACCTGTTGGGGAAGATATGT

Figure 2 continued

TTCACTGGCAGGCAACAATCATGGGACCGAATGATAGTCCATATGCTGGCGGTGTGTTTATGGTGACCATTCATT
TCCCACCGGATTACCCCTTCAAGCCGCCAAAGGTTGCTTTCAGGACTAAAGTTTTTCACCCTAACATCAACAGCA
ATGGGAGCATTTGCTTGGATATATTAAAAGAGCAATGGAGTCCTGCTCTTACAATATCGAAGGTCCTGCTGTCAA
TTTGTTCGCTCCTGACGGATCCAAACCCCGATGATCCCCTTGTTCCTGAGATTGCGCATATGTACAAGACAGACA
GAGCCAAATATGAAGGCACTGCAAGGAGTTGGACGCAGAAGTATGCAATGGGCTGAATCTCTGACCTCTCTCGCC
CCTTTGTAATAATCAAAAGATA

> SEQ ID NO:1067 215918 254087_301631_1
ACGACCACCAATTCCAAGCACACATTCGGACACCCACACTCTCTATCTTGCGAACAGCCTGTCACGCGCGAAATC
ACTTCCCCAACATCATCCTGGACTACAGTCTCCATAACGACACCACTCGCGCCTCACATCCCACGCATCACTTTC
CAACATGTCCACAGCAGCGAGGAGACGCTTGATGCGCGACTTCAAGCGCATGCAGACCGACCCTCCAGCTGGCGT
CTCAGCCTCTCCGATCGCAGACAATGTGATGACATGGAACGCCGTGATCATCGGGCCCTCCGACACACCCTTCGA
GGATGGCACTTTCCGTCTTGTCATGCACTTCGAAGAACAGTACCCCAACAAGCCACCGGGCGTCAAGTTCATCTC
ACAAATGTTCCACCCAAACGTCTATGCCACCGGAGAGCTGTGTCTTGACATCCTGCAGAACCGCTGGAGTCCGAC
ATACGACGTGGCGGCAATCTTGACCAGCGTGCAGAGCTTGCTCAACGACCCGAACACCAGCAGCCCTGCGAACGT
GGAAGCCAGCAATCTATACAAGGACAACCGCAAAGAGTACACTAAGAGGGTACGGGAGACGGTCGAGAAAAGCTG
GGATGACTGAGCAAAGCGCGCAACACGAAAGTGAGTTATGAGGCAATCACTATCGAATTCAGACTGGCTTGCATG
AGAC

> SEQ ID NO:1068 215918 253305_301625_1
AACCAAAAATACCATACACCATGTCGGGCAAGCGACCATCTGTGGCCCAGAAGCGGCTCATGAAGGAGTACAAGC
AGTTCATTAGTGATCCTCCCCAGGGAATCAGTGCAGGTCCTGCTGACGAAGATAACTTTCTACTCTGGGAATGTC
TGATACAGGGACCAGATGATACTCCGTACGAGGGTGGCCTGTTCCCCGCAACACTCAAATTCCCCCAGGATTACC
CCCTGTCCCCTCCAGTGATGAAGTTCACCTGCGAAATGTACCACCCCAACATTTACAAGGACGGAACCGTGTGTA
TTTCCATTTTGCATGCTCCTGGTGACGATCCCAACATGTATGAGAGCGCTTCGGAACGGTGGTCGCCCATCCAGT
CGGTAGACAAGATTCTGCTGTCGGTGATGAGCATGCTAGCCGAGCCCAACGACGAGTCAGGGGCCAACATTGACG
CCAGCAAAATGTGGCGA

> SEQ ID NO:1069 215918 249521_301593_1
TTGACAGTGTGTGTTCTTCTTTCTCGCACTTGTTCCGTGTGCCCGGGGTTAGCCCTAGGGCGATCTTTGCGCGAT
CCGGGCAGGGGATCGGGGCCGCGGCGCATCCACGCGGGCGATGCGCTAGATTGGGCACCCGGCGGCGAGGATCAG
GGTTTGGATTTGTCGGTAGCAATAGCCCTATCGATCTCCATCGATCGATCGAGCTGGGCGGCGGGGGAATGGGCG
AGAGCCAGGCGAGCCTCCTCTTGCGCAAGCAGTTGAAAGATTTGACAAGAAATCCTCTGGATGGATTCTCGGCTG
GATTGGTGGACGATTCCAATGTGTTTGAGTGGGCGGTGACCATCATCGGGCCACCAGACACCTTGTATGAAGGTG
GTTATTTCAACGCTATCATGAGCTTTCCTCTGAATTATCCGAATAGTCCTCCGACCGTGAGATTTACGTCGGATA
TGTGGCATCCAAATGTTTACCCGGATGGTCGTGTTTGCATCTCCATCCTTCACGCTCCTGGAGACGATCCAAATG
GCTACGAGCTGGCGAGCGAACGATGGTCTCCAGTTCACACGGTAGAAACTATTCTTTTGAGTATAATCTCGATGC
TTTCGAGCCCAAACGATGAGTCCCCAGCCAACATCGACGCCGCTAAAGAGTGGC

> SEQ ID NO:1070 215918 244825_301562_1
cgcgattgtagatgctatagatcCAGGTCGCCTCGTCGTCGTCCCGTGGCGCCGCTGTAGATAGGGTTTGATTCA
TCGCGCAGCAGCGGCAGCGGCGATGTCTACGCCGGCGAGGAAGCGGCTGATGCGGGATTTCAAGCGGCTGCAGCA
CGATCACCGGCGGGCATCAGCGGCGCTCCACAGGACAACAACATCATGCTGTGGAATGCGGTCATCTTTGGGCC
GGATGATACGCCATGGGATGGAGGAACATTCAAGCTCACCTTGCAGTTCACAGAGGATTATCCAAACAAGCCACC
AAATGTGCGGTTTGTTTCGAAGATGTTCCATCCCAATATTTATGCGGACGGAAGCATTTGCCTGGACATTCTCCA
AAACCAGTGGAGCCCGATCTACGATGTTGCTGCAATATTGACATCGATCCAGTCTCTACTATGCGATCCAAACCC
AAACTCTCCTGCTAATTCCGAAGCCGCACGAATGTACAACGAGAACAGGCGAGAGTACAACAAGAAAGTTCGCCA
AGTCGTGGAGCAGAGCTGGACAGCGAACGACTGAAACCGAGAGTTCtgctCGGCTGCTCGACATGCTGgTACGCG
ATTTTCTggCGATCACGGACGGAATtcTACTAACCAGCAGGAGCactgTATatcctcTGTACTCGGAtTTTTTTT
cttaggtGATGTGGTTGcaactaagaaagt > SEQ ID NO:1071 215918 237695_301289_1
gggaacgcgggaaggggcggcaaCGGCGATGGCGCTGGCGTCGGCGGCGGCCTTGTGACAGTCAACCACAGCATG
CTCGTTGCGGCTGCCGCCACTGCCACTACAGCGTCGATCGAATTCTTGTATTCCTGCAAGCTAGGGTGGGGCGAG
AATGCTGTCGTCAGCCCAGTTGCGGCTCATGTCCGACCTCAAGGCGATTCAACAGGAGCCGCCAGAGGGATGTAG
TGCTAGTCCACAAGGCGAAGAGAATCTCTTTGTGTGGGAGCCACTGTGTTTGGGCCGGATGAAACACCATGGGA
AGGGGCGATCTTGCCTCTTCGTCTCACCTTTGGCGAGCACTACCCGGCGAAGCCACCGCGCGTGAGATTCACGTC
CGAAGTGTTCCATCCAAATGTCTACAGTGACGGCGCACTGTGCATGGATATCATCCAGGATGCATGGTCTCCTTG
CCACAACGTCAGCACCATTCTCACCTCGATTCAGTCTCTCCTGACTGATCCAAATCCAGCGAGTCCAGCGAATCC

Figure 2 continued

```
CGAAGCCGCGCATATGTATCAAAACGATCTCCAAGCATACAACAGGAGAGTGCGCCAGTGTGTGAGGAAGTCCCT
AGATATATAAAACTCCAAAGTTTTATTTATCTATCTATCATAGTGAtTATCta

> SEQ ID NO:1072  215918  230618_301070_1
tactccatccaggaagcgcttgatgcgagatttcaagcgcctccagcatgatccaccgccgggatcagcggcgc
gccgcAGGACAACAACATCATGCTGTGGAATGCGGTGATTTTCGGGCCTGACGATACTCCCTGGGATGGAGGGAC
GTTCAAGCTGACATTGCAGTTTACGGAGGACTACCCCAACAAACCTCCCACTGTGAGATTTGTTTCAAAGATGTT
CCATCCCAATATTTATGCTGACGGAAGTATTTGCCTTGACATCCTGCAAAATCAATGGAGTCCAATCTACGATGT
CGCGGCCATTCTTACTTCCATACAGTCATTGCTTTGTGATCCTAACCCGAACTCGCCGGCCAACTCCGAGGCAGC
TCGGATGTACAGCGAAAACCGCCGAGAGTACAACAGGAGAGTTCGCGACATAGTCGAGCAGAGTTGGACGGCGGA
GTAGCTCCCCTggtTCAAGAGCTTGTAAGAGTGGCCATCACAGAGAGATGTGTGCTGCTCCGAGCACACATAAA
GAATCTTGTCAAAAAACAATCCGGAAAGCTGTCGCCTCTACAGACCAGCGTTGAAGGTCGACCATCGAACTCGTT
TGCTTCTGTTGGAACCAgggccaGTGTTCTGGTACTCACCATAGAACAGGGTGCTGAGAGCGAAGTCCCCGTTCC
ATTCCAACCATCCACGGGGTTGAATTATGTCACTGATGAACGACTTCATGAACACCGTCCgcgAGTAGAGCTTCC
ACGgCCTTCCgagtttATGAAAGAcAGCCccgtgttcTGTCGCTTATCGACg > SEQ ID NO:1073  215918  230567_301069_1
CGCGTCGGGGGGAAGGGCGATTAGGGTATATGGCTTGTCGCGGCTATGGCGTCCAAGAGAATCCTCAAGGAATTA
AAGGACTTGCAGAAGGATCCGCCCACTTCGTGTAGCGCAGGTCCTGTGGCCGAGGATATGTTTCATTGGCAAGCG
ACGATAATGGGTCCTCCCGATAGCCCCTACGCAGGGGGTGTGTTTTGGTCACCATCCATTTCCCCCCGGATTAT
CCCTTTAAGCCCCCCAAGGTCGCATTTAGAACGAAAGTTTTCCACCCAAACATCAACAGCAATGGCAGCATCTGC
CTCGACATTCTCAAGGAGCAGTGGAGCCCGGCCTTGACAATCTCCAAGGTGCTGCTATCAATCTGCTCGTTGCTA
ACCGATCCAAACCCCGACGATCCACTGGTGCCCGAGATTGCTCACATGTACAAGACAGACAGGCCCAAGTATGAA
TCGACCGCCAGGAACTGGACGCAGAAGTACGCCATGGGTAAGCCCGGGCTTGTGAGCGGCGGCGGCGGCGGTGG
CGGTGGCATGGCTCGCTATGATGTTTGTGATACCATTTGGTTGCCTATCTATAAGT > SEQ ID NO:1074  215918  228530_301022_1
CCCACGCGTCCGCCCACGCGTCCGCTCACCTGGCGCGCCGAAGCTTCTCTCCTCTCTCTCAACTCCGGCGAGAGG
AGGAGGCGGCGGTGGGGCGTTCGTCGGGAGAGAGACCAGGGCCGGGGGGCTAGGGTTCGGCCGTTCAGAGAGGCG
GCGGCTGAGGAGGAGGAGGAGGAGGAGGAGGGGGTGAGGAGAGATGTCGACGCCGGCGAGGAAGCGGCTGATGCG
GGACTTCAAGCGGCTGCAGCAGGACCCGCCCGCCGGAATCAGCGGCGCGCCGCACGACAACAACATCATGCTCTG
GAACGCCGTCATATTCGGACCGGATGACACGCCGTGGGATGGAGGCACGTTCAAGCTGACACTACAATTTACAGA
AGATTATCCCAACAAACCACCAGTTGTTCGGTTTGTCTCAAGGATGTTTCACCCAAATATTTATGCAGATGGAAG
TATCTGCTTGGATATCCTACAAAATCAATGGAGCCCTATATATGATGTTGCTGCGATATTGACCTCTATCCAGTC
CCTGCTCTGTGATCCAAACCCAAACTCCCCTGCAAACTCCGAAGC > SEQ ID NO:1075  215918  226238_300995_1
acgacaccAATTTTAAAAAATGGCTTTGAAGCGAATCAACAAGGAACTCAGTGATCTTGGACGTGATCCCCCCTC
CTCTTGCTCTGCTGGTCCTGTTGGCCAGGATCTGTTCCACTGGCAGGCTACTATCATGGGACCCTCAGACTCTCC
TTACTCCGGAGGTGTTTTCTTTCTGTCTATCCACTTCCCCACTGACTACCCCTTCAAGCCACCAAAGGTGACCTT
CACTACCCGAATCTACCACCCCAACGTCAACACCAACGGATCCATCTGTCTGGATATTCTCAAGGAGAACTGGTC
TCCCGCACTCACCATCTCCAAGGTGCTGCTGTCCATCTGCTCCATGCTCACAGACCCCAACCCTGACGATCCTCT
CGTGCCCGACATTGGCCACCTGTACAAGAACGACCGAGCACGATACGACGCCACTGCCAAGGAGTGGACCAAGAA
GTATGCCGTCTAggATGTATATAGGGAGCAGGCATGAGCCTATGCAAGCGAATGGCTGTGACGATACAACTAGCC
AATGTtagatttaTGGATGGtaaaaAaaaaa > SEQ ID NO:1076  215918  211510_300900_1
GCTTTTATCACTTTTGAGAACCACTCATTCATCCATCTCCGCAAGATCGTCTGTTTTTGTTTACAATGGATTATA
CCGAGGATAACCAGAATTCTGCTCCTGGCAGCGTCCAGGCTTCCAAGCTCAATGCCGCTCGCAAGGGTCCCGATT
CGCAGAGCGTCACTAAACGACTCCAGACCGAGCTGATGACTCTCATGACATCTCCAGCACCCGGTATCTCCGCAT
TCCCCTCTGCCGACGGCAACCTTATGTCGTGGACCGCCACCATCGAGGGCCCCGAGGATACACCTTATTCCGGAC
TCACGTTCAAGCTGAGCTTCGCGTTTCCTTCAAACTATCCTTATGCCGCGCCGACGGTCCTCTTCAAGACGCCCA
TCTACCAGCCCAAAGTCGACTTCTCTGGCCGCATCTGCCTTGACATCCTCAAGGACAAGTGGACAGCCGCCTACA
ACATTCAGACCGTTCTGCTGAGTCTGCAGAGCTTACTCGGCGAGCCCAATAACGCATCTCCATTAAACG > SEQ ID NO:1077  215918  187287_300675_1
CTCGTGTCCGCTGCGAAGAAAAGGGGCATATCATGGCATTGAAGCGGATCCTCAAGGAACTAAAGGACCTGCAGA
AAGATCCTCCAACATCATGCAGTGCAGGTCCTGCTGGTGAGGATATGTTCCATTGGCAGGCGACCATTATGGGTC
CTCCAGATAGTCCCTATGCTGGTGGAGTTTTCTTAGTGAATATTCATTTCCCCCCGGACTACCCCTTCAAGCCTC
```

Figure 2 continued

CAAAGGTATCTTTTAAGACAAAGGTCTTCCATCCAAACATCAATAGCAATGGAAGCATATGCCTTGACATTCTTA
AGGAGCAATGGAGCCCTGCTTTGACCATTTCTAAGGTGTTGCTTTCGATCTGCTCGCTGCTCACTGACCCCAACC
CGGACGACCCTCTTGTCCCTGAGATTGCCCACATGTACAAGACGGATCGTCCAAAGTATGAGACGACAGCCCGCA
GCTGGACCCAGAAGTATGCCATGGGATGATGAAACCCACAAGCCCTGAATTCAAACCTGCTGCTTAAATGCAGAC
AGTCGTGGTAATTGTCCCATGAAAACT

> SEQ ID NO:1078 215918 179640_300562_1
AACAATCCCCAGCCTCACCAAAAAGGACACAAAATAACGACATTCACTCTCTCTCTCTCTCTCTCTTCCTCTTTT
CTCCATTCTCTCGCGGGGTCATCCGCCCACCATGGCCCAATCCACCGCCCACCGCCGCCTCCTTCAAGAATACCG
CGCCCTCACAAACAACCCGCCCGAAGGCATCACCGCCGGCCCCGTCTCCGAGGACGACCTGCTGCACTGGGAATG
CCTCATCCAGGGGCCTGAGGGAACTCCCTTTGAGGGCGGCGTCTTTCCCGCAGAGCTCAAGTTTCCCAAGGACTA
TCCGCTGGCGCCGCCGACGATGAAGTTTCTCGCTGACATGTGGCATCCGAACGTCTACCCCAGCGGCCTCGTCTG
CATCTCCATCCTCCACCCTCCCGGCGACGACCCCAACCACTACGAGCACGCCTCCGAGCGCTGGTCCCCCATCCA
GTCCGTCGAAAAGATCCTCATCTCTGTTATGAGCATGCTAGCTGAGCCCAACGACGAGAGCCCCGCCAACGTCGA
GGCCGCCAAGATGTGGCGCGAGCGTCGGGATGAGTACGAAAAGACggTCCGCGacggtGTTCGGCGCATGttGGG
TTTGTAACAGCGCATGTTggGtttg > SEQ ID NO:1079 215918 127722_300472_1
cccgcacttcttccAACGTACTGGTGTACTATTATTGGCCCAAAATCCTCTTCCAGCTCTGCAATCTCCGTCTCC
GTCAATTTTCAGTCAACCGAAATCCACCATCTTTCATTGTTCATCACCTTCAGGTTAGGGTTTGGATTTGAAGGT
ACAAGGGGCTAATTGATGGCGTCGAAGAGGATATTGAAGGAGCTCAAGGATCTGCAGAAGGATCCTCCTACATCA
TGCAGTGCTGGTCCAGTGGCAGAGGATATGTTCCATTGGCAAGCAACTATCATGGGGCCTACAGATAGCCCTTAT
GCCGGAGGTGTATTTTTGGTTTCAATTCATTTCCCTCCGGATTATCCTTTCAAGCCTCCAAAGGTTGCCTTTAGA
ACTAAGGTTTTCCACCCTAACATCAATAGCAATGGAAGTATTTGTCTGGATATTCTAAAAGAGCAGTGGAGTCCA
GCGTTAACCATATCTAAGGTCCTGCTCTCCATCTGCTCCCTATTGACTGACCCAAATCCAGATGATCCACTTGTA
CCAGAAATTGCCCACATGTATAAGACTGAAAGGTCTAAATACGAGACCACTGCTCGTAGCTGGACTCagaAATAT
GCTATGGGATAATGGC > SEQ ID NO:1080 215918 12575_300252_1
CCCACGCGTCCGCGATTTCTCTATCATCATCATCCATGGCTTCGCAAGCTAGCCTTCTCCTTCAGAAACAACTCA
AAGATCTCTGTAAGCATCCTGTTGATGGATTCTCTGCTGGTCTCGTTGATGAGAAGAATATATTCGAATGGAGCG
TTACCATTATCGGACCTCCTGATACTCTCTATGAAGGAGGATTCTTTAACGCGATTATGACATTTCCGCAAAACT
ATCCGAATAGTCCGCCAACCGTGAGGTTTACTTCGGATATGTGGCATCCTAACGTTTATTCTGATGGTCGTGTTT
GCATATCTATTCTTCATCCTCCCGGTGATGATCCTAGCGGTTATGAGCTTGCAAGCGAGCGTTGGACTCCTGTTC
aTAcagttgagaGTATTATGTtgAGTATCATATCAATGCTTTCTGGTCCTAACGATGAGTCTCCAGCAAATGTTG
AAGCTGCCAAAGAATGGCGAGATAAGAGAGATGAGTTCAAGAaGaaagtGAGCCgttGTGTCagaaAGTCTCAAG
AAATGTTTTGATCAACGTCaaACTTCACACCTTTGAGATCTCTGGAGTTTcAaTcaaAAGttCTTCaTattccTA
TCTGAAACCCTTTGAAACGCAacttgttATAACTCggatTaCAtcTCTTTTTGTCgCGTTCG > SEQ ID NO:1081 215918 125313_300630_1
ggttcaattctcgctaatcaggttaagactcatatttcttcgattgtttggttgggaatggcttcgaaacgaata
ttgaaGGAGCTGAAGGATCTCCAAAAAGATCCTCCTACCTCATGCAGCGCCGGTCCTGTTGGAGAGGACATGTTT
CACTGGCAAGCTACAATAATGGGGCCCTCTGACAGCCCTTACGCTGGGGGTGTATTTTTAGTCACTATCCATTTT
CCTCCAGATTATCCATTCAAACCTCCTAAGGTTGCTTTTAGGACAAAAGTTTTCCATCCAAATATCAACAGTAAT
GGGAGCATATGCTTGGACATACTGAAGGAGCAGTGGAGCCCCGCCTTAACTATTTCCAAGGTTTTGCTTTCAATC
TGCTCACTTTTGACGGACCCAAACCCTGATGATCCCCTTGTTCCTGAGATTGCTCACATGTACAAGACAGACAAG
GCCAAATATGAAGCAACTGCCAGGAGTTGGACCCAGAAGTATGCCATGGGCTAACTATTGCCTATGGCGGCTTGA
ATTGATATAAAGAAAAACAAATTTCAATGTCCTCCTTCTATGCTCTCTCCATTAACAAGTtgTATAATAGCATtA
AGCATtgcccTCTGCAGGAAGAGACTAATGATGCTttgAatttTgttTATATAggTAATAATAttTTATGCg > SEQ ID NO:1082 215918 125232_300629_1
GGCGTCGATTCTCTTTGACACTCGTGCCGCTTCATCACTCAGGCGGTCAGGGATGTCGACGCCAGCGAGGAAAAG
ATTGATGAGGGATTTTAAGAGGTTACAGCAGGATCCTCCTGCCGGCATCAGTGGTGCTCCGTATGACAACAATAT
TATGCTCTGGAATGCCGTTATATTCGGTCCTGATGACACACCTTGGGATGGAGGTACGTTCAAGCTCACCCTTCA
GTTTACGGAGGACTACCCCAACAAGCCTCCAACTGTGCGGTTTATTTCCAGGATGTTCCATCCAAATATTTACGC
CGATGGAAGTATATGCTTGGACATACTGCAAAATCAGTGGAGTCCTATATATGACGTAGCTGCTATACTTACTTC
AATCCAGTCTTTGCTCTGTGATCCAAACCCAAACTCGCCAGCAAATTCAGAAGCAGCACGCATGTTTAGTGAGAA
TAAGCGCGAGTACAACAGGAAGGTGCGTGAGATTGTTGAGCAGAGCTGGACAGCAGACTAACATCTCTCAGGCTG
AATCTGTTTTGGGAGATTTTCCTGGTACCGCCTGTGTCGAGCTGAAAACTTTTCAGTGCCGTTGCTACATTAAAA

Figure 2 continued

ACAAATGTAGCAGGAAATTGTACTTTTATGTGTTGTAGGAAACTCTGATTGCCTTTATCTTCATGTTCTGCTACT
CGACTATGAGACGTTGTACATATGATGATCTCTTGT

> SEQ ID NO:1083 215918 109206_300044_1
CAAATTCTTAAAACTATCTCCACTATCTCTTTCTCTCTCTAGACAAATTAAGAACCCTTAGCGTAAACTCTGCGA
CCGAAGAACCCCACCCACCCAGGCAGCCTTCAATTCAATTCCAATGGCGAACAGCAATCTTCCTCGCCGAATTAT
CAAGGAAACTCAACGGCTTCTCAGCGAACCTGCACCAGGAATAAGTGCATCTCCATCGGAAGATAATATGCGATA
CTTTAATGTCATGATTCTTGGTCCTACACAGTCTCCTTATGAAGGAGGCGTCTTCAAGCTCGAACTCTTTTTGCC
TGAAGAGTACCCGATGGCTGCTCCTAAGGTTCGATTCCTCACCAAAATCTACCATCCGAACATTGATAAGCTTGG
AAGGATATGTCTTGATATTCTTAAAGACAAGTGGAGTCCTGCACTTCAGATCCGTACTGTACTTTTGAGCATTCA
AGCACTTTTGAGTGCTCCAAATCCGGATGATCCACTCTCTGAGAATATCGCAAAGCACTGGAAGTCAAATGAGGC
TGAAGCTGTTGAAACGGCTAAGGAGTGGACACGCCTATATGCAAGTGGTGCATGAAGGCATTAGCAACGAAATAT
TTAAAAATAACAAAAATTATGGACTGTATCCTATTGAC

> SEQ ID NO:1084 215926 120256_300383_1
CTTTCATAATGGACAGCAGGAGATGCAAATGCAAGTGGTGCGGGACGAAAATTTCAGCTCCCATTGGAGCACAAA
CCATTTCGTGCCCAAGGTGCCAATCTGTTACCCAACTCCAACCTCCAAGAACCAACAACGGCTTTGCCGCTGGGG
TTATTAACAATATTATGGGTGCAGTAGTTAACACAGGGTTTCCAGCAAGGCTGGGAAGGATGAATCCAACAGATG
CCAATAATTATCAGCCTCAACCGTTCAACATGTCACCCCAGATTACTATGCAACCTCCAGCTGTTCATGGACGGA
AGCGAGCAGTACTCTGTGGAATAACCTACCGTGGGCATTCCAAGAGTCTGAAAGGAAGTATTAACGATGTTTTAT
CCATGAGATATCTTCTGGTTCAGAAGTTGGGTTTCCCCAATGCATCCGTTCTTGTCCTTACAGAGGATGAGAAAG
ATCCATACAAAATCCCAACCAAGGGCAATATCAGATCAGCCCTACGTTGGCTTGTTCATGGTTGTCAGCCAGGAG
ATTCACTAGTGTTCCACTACTCTGGCCATGGCACAC

> SEQ ID NO:1085 215926 199646_300751_1
TCGACCACGCGTCGGCAAAACATCCTCCGTGCAATGCACTGGCTGGTCAAGGATGCCAGACCCAATGACTCTCTC
TTCTTCCACTATTCCGGCCACGGTGGGCAAACAAAGGATCTTGACGGCGATGAGCCTGATGGATATGACGAAGTC
ATTTACCCTGTTGATTTCAGGCAACATGGACATATCACAGATGACGAGATGCACCGCATCATGGTCACCCCCCTC
CAGGCAGGTGTAAGGCTGACAGCCATCTTCGATTCGTGCCATTCTGGCACAGCACTCGACCTGCCATACATCTAT
TCTACACAAGGTATCCTCAAGGAGCCCAACTTGGCCAAGGAGGCCGGCCAGGGCTTGCTCGGCGTCATTTCCTCG
TACAGCCAGGGAGATCTCGGCGGTGTTGCCAACAACATCATCGGTTTCTTCAAGAAGGCCACCACTTGGCGAAAA
AGCCCACAACCGGGCCCTCGCAACCAAGACTTCTCCTGCCGACGTCGTCATGTGGTCCGGAAGCAAAGACGACCA
AACCTCTGCCGATGCTACCATTGCTTCACAAGCTACTGGTGCCATGTCCTGGGCGTTTGTCACGGCGCCCAGGAA
GAACCCCAGCAGAGCTACGTCCAGCTGCTCAA

> SEQ ID NO:1086 215926 205094_300795_1
CCCACGCGTCCGCCCGCCTCAGCATGGAGGATATGGACCACCTCAGCCTCAATACGGCGGCCACCAGAACCAATA
TCCTCCTCCCGGCGGCCCTCCCCCGAGCCACTACGCACCTCCTGCGCACCATCCTCCTCCGGGTCTAGATGCTTA
CGGCTATCCTCTCAACCCTCCGACTGCCATGCACGCAAAGGCCGGCCCCCCGCCTCCCTCGGCCCCTCAGCAGTT
TGGCCACGGTGCTCCGGCGGCTACACCTTCCAGTACTCCAACTGCACAGGAAAGCGAAAGGCGCTGTTGATTGG
AATCAACTATTTTGGCACAAAGGCCGAGCTCAAGGGATGCATCAACGATGTCCACAACGTGTCGGCATTCTTGGT
TGAGCGATATGGCTATAAGCGCGAGGACATGGTCATCCTGACAGATGACCAAAGCAACCCTGTCATGCGCCCAAC
CAAGGCCAACATCGTCCGTGCCATGGGATGGCTTGTTAATGGCGCCCAGCCCAACGATGCCCTTGTTCCTTCACT
ATTCTGGCCACGGCGGCCAGACCGAGGACAAGGACGGCGACGAAGACGACGGCTACGATGAAGTTATATACCCCG
TTGACTTTGAACAAGCTGGACATCTTGTAGATGATGAGATCCACTTC

> SEQ ID NO:1087 215930 130233_300486_1
GAATCCCCACCATCTTCATCACCAAAAATGGGTGGGGTAATCAGATCTCAACGTAAGGGAGCTGGTTCCATCTTC
AAATCCCACACCCACCACCGCAAAGGACCAGCAAGATTCAGGAGTTTAGATTTCGGTGAAAGAAATGGTTACTTG
AAAGGAGTAGTTACAGAAATCATCCACGATCCAGGACGTGGTGCTCCATTAGCTAGGGTTACTTTCAGACATCCA
TTCAGGTACAAGCATCAGAAGGAGCCTTTTGTTGCTGCTGAGGGTATGTATACTGGACAGTTTTTGTATTGTGGG
AAGAAGGCTAATCTTATGGTTGGAAATGTTCTTCCATTGAGATCTATCCCTGAAGGAGCTGTGGTTTGTAATGTT
GAACATCATGTTGGTGATAGAGGAACATTGGCTAGAGCTTCTGGTGATTATGCTATTGTTATCAGTCACAACCCT
GATAATGGTACTTCAAGGATCAAGCTTCCATCTGGAGCAAAAAAGATTGTACCAAGTGGATGCCGTGCTATGAT
TGGTCAAGTTGCTGGTGGAGGTAGGACTGAAAAGCCCATGCTGAAAGCAGGAAATGCTTACCACAAATACAGAGT
GAAGAGAAACTCCTGGCCC

> SEQ ID NO:1088 215930 206193_300819_1

Figure 2 continued

AGCGGCCGGACTCAGCTACCCGTAACATCGCAGCCAGCGACGTCGAGTCACCATGGGTAGAGTTATTCGCAACCA
GAGAAAAGGCCGTGGCTCCATCTTCACGGCCAACACCCGCCTGAACAAGGCTCCCGCCAAGTTCCGCACCCTCGA
TTACGCCGAGCGCCATGGCTACGTCCGTGGAATCGTGAAGGACATCATCCACGACCCTGGTCGTGGTGCTCCTCT
CGCCAAGGTCCAGTTCCGCCACCCTTATAAGTATAAGCAGGTCACCGAGACCTTCATCGCCAACGAGGGCATGTA
CACCGGCCAGTTCATCTATGCCGGAAAGCGCGCTGCTCTGACCGTCGGCAACGTCCTGCCCGTCGGTGAGATGCC
CGAGGGTACCGTTGTCTCCAACGTCGAGGAGAAGATTGGCGACCGTGGCACTCTCGGCCGTAACTCTGGTGGCTA
CATCACCATTGTTGGCCACAACCCCGATGAGGGCAAGACCCGTATCAAGCTTCCCTCTGGTGCCAAGAAGGTCGT
CCACTCCCGATCTCGTGGCATGATCGGCATCGTTGCCGGTGGTGGCCGTACCGACAAGCCTCTGTTGAAGGCTTC
TCGTGCCAAGCACAAGTTCGCTGTCAAGCGTAACAGCTGGCCCAAGACTCGTGGTGTTGCCATGAACCCCGTgga
ccacctcaccgtGG > SEQ ID NO:1089 215930 235758_301229_1
GCGAGGAAGCAGCAATGGGTCGCGTGATCCGGGCACACGCGTAAGGGTCGCTGGCTCCGTCTTTAAGTCGCACACG
CACCACCGCAAGGGGCCGGCGCGGCTGCGGAAGCTCGACTTCTCGGAGCGCAATGGCTACATCAAGGGCGTGGTG
ACGGAGCTGATCCACGACAGCGGGCGAGGGGCGCCGCTCTGCAAGGTGACGTTCCGTTACCCCTTCCGGTTCAAG
CACCAGAAGGAGCTCATGATCGCGGCCGAGGGCATCTACTCGGGCCAGTTCATGTACTGCGGCAAGAAGGCCCAG
CTCGCCATTGGGAATGTCCTGCCGCTGCGGTCGGTCCCGAGGGAGCAGTCGTTTGCAATGTCGAGCACCGTGTC
GGGGACAGGGGTTCATTCGCCCGGGCCTCTGGGGACTACGCGATTGTAGTTAGCCACAACCCGGATATGGGAACC
TCACGTATCAAGCTTCCGTCTGGCGCCAAGAAAATCGTCCCCAGCGGCTGCCGCGCGATGATCGGTCAGGTGGCG
GGCGGTGGCAGGACCGAGAAGCCGCTGCTCAAGGCCGGGAACGCGTACCACAAGTTCCGCGTCAAGCGCAACAGT
TGGACCAAGGTGCGTGGTGTGGCTATGAATCCCGTGGAGCATCCCCACGGAGGAG > SEQ ID NO:1090 215930 265928_200082_1
ctccttagtatcatttcctcaACTCCTCTGGCGAGAGAGAGAGAGACGGCGAAATGGGTCGTGTAATCAGAGCTC
AACGTAAGGGAGCAGGGTCCGTTTTCAAATCCCACACTCACCACCGTAAAGGTCCGGCCCGATTCCGTACCCTCG
ATTTCGGCGAACGTAATGGTTACCTAAAGGGAGTAATCACAGAAGTGATTCACGATCCTGGTAGAGGAGCACCAC
TCGCGCGCGTGACATTCCGTCACCCGTTCCGTTACAAGCACCAAAAAGAGTTGTTCGTTGCTGCTGAAGGGATGT
ACACTGGTCAGTTCGTTTACTGTGGTAAAAAAGCTACTCTTATGGTCGGTAATGTGTTGCCGCTCAGATCTATAC
CAGAAGGAGCTGTTTGTATGTAACGTGGAGCATAAAGTAGGAGATCGTGGTGTTTTTGCTAGAAGCTCTGGTGATT
ATGCCATTGTTATCAGTCACAACCCTGATAATGGTACCACTAGAGTTAAGCTTCCATCAGGAGCCAAAAAGATTG
TACCCAGTGGATGTCGTGCCATGATTGGTCAAGTTGCTGGAGGAGGACGTACTGAGAAACCAATGCTCAAAGCTG
GTAATGCTTACCACAAGTACCGGGTAAAGAGGAACTGCTGGCCTaAGGTCCGTgGTGTTGCTATGAatc > SEQ ID NO:1091 215930 38923_300081_1
CCCACGCGTCCGCTCAAAAACCCTAATATCTGAACTTCGCCGTCGAGAGCATCCATGGGTCGTGTCATCAGAGCTC
AACGTAAGGGTGCGGGTTCCGTCTTCAAATCCCACACTCACCACCGCAAAGGTCCGGCTAAGTTCCGTAGCCTCG
ATTTCGGCGAGAGAAATGGTTACCTCAAGGGCGTCGTGACGGAGATCATCCACGATCCTGGTCGTGGTGCTCCTC
TTGCTCGTGTCACTTTCCGTCATCCTTTCCGTTTCAAGAAACAAAAGGAGCTCTTCGTCGCCGCCGAAGGTATGT
ACACCGGTCAGTTCTTGTACTGCGGTAAGAAAGCTACTCTCGTCGTTGGAAATGTTCTCCCTCTTAGATCTATTC
CTGAAGGAGCTGTTGTCTGCAACGTCGAGCATCACGTCGGTGATCGTGGTGTCCTCGCTAGAGCTTCTGGTGATT
ACGCCATTGTTATCGCTCACAACCCTGACAGCGACACTACTAGGATTAAGTTGCCATCGGGTTCGAAGAAGATTG
TCCCAAGTGGATGCAGGGCTATGATTGGACAAGTTGCTGGAGGTGGAAGAACTGAGAAGCCGATGCTCAAGGCAG
GAAACGCGTACCACAAGTACCGTGTGAAGAGGAACTCATGGCCTAAGGTTCGTGGTGTGGCTATGAATCCAGTGG
AGCATCCTCATGGAGGAGGTAACCATCAGCACATTGGTCACGCCAGTACTGTTAGGCGTGATGCACCTCCT > SEQ ID NO:1092 215930 266886_200031_1
cgttatttattatgcatcttgactaccccctcgaccacgcgtccgGCCGAGCAAGCTCGAGAGAGGGAGAGAGA
GACGGCGAAATGGGTCGTGTGATCAGAGCACAACGTAAGGGAGCAGGGTCAGTCTTCAAGTCCCATACCCACCAC
CGTAAAGGCCCTGCCCGTTTCCGTTCCCTGGACTTCGGCGAACGGAATGGTTACCTCAAGGGTGTCATAACGGAG
GTTATTCATGATCCAGGTAGGGGTGCCCCATTGGCGCGTATCACTTTCCGTCACCCGTTCCGTTACAAGCACCAG
AAGGAACTGTTCGTGGCTGCTGAGGGTATGTACACTGGCCAGTTCGTTTACTGTGGGAAGAAGGCTACTCTCATG
GTTGGGAATGTTCTCCCACTCAGATCTGTCCCTGAAGGAGCTGTCGTTTGCAATGTGGAACACAAGGTTGGTGAC
CGTGGCGTTTTTGCCAGATGCTCTGGTGATTATGCTATTGTCATCAGTCACAACCCCGATAACGGAACCACTAGG
ATTAAGCTTCCATCAGGATCCAAGAAGATTGTGCCCAGTGGGTGTCGTGCCATGATTGGTCAAGTAGCTGGAGGA
GGACGTACTGAGAAACCAATGCTTAAGGCTGGTAACGCATACCACAAGTACCGGGTAAAGAGGAACTGCTGgCCc
aaggttCGTGGTGTtgccaTGaaCCCTGTgGaaCAtccTCATGgTggTggTaactatcaacATAtTGgTCATGCT
agTACTgtccGTCgtgatGcA

> SEQ ID NO:1093 215930 255275_301647_1

Figure 2 continued

```
GAGAGAGAGAGAGAGAGAGAGAGAGAGAGAGAGAGAGAGGGGTAGGTAGGAAAGGGTAGCAGCAGCAGCAATGGGTA
GAGTTATCAGGGCTCAGAGGAAGGGAGCAGGTTCCGTTTTCAAGTCCCACACGCACCGGAGGAAGGGCCCTGCCA
GGTTTCGGTCCCTCGACTATGCGGAGCGCAACGGGTACATCAAGGGCGTCGTGTCGGAGATCGTTCACGACTCTG
GCCGCGGGGCGCCCCTCTGCAAGGTCACCTTCCGTCACCCGTTCCGGTTCAAGCACCAGAAGGAGCTCTTCGTTG
CCGCCGAGGGCATCTACTCCGGGCAGTTCCTCTACTGCGGGAAGAAGGCCACCCTCTCCATCGGAAACGTGCTGC
CGCTCAAGTCGGTCCCCGAGGGGGCCGTCGTCTGCAACGTGGAGCAGCGCGTTGGGGACCGGGGTGCTATCGCCA
GGGCCTCCGGCGACTACGCCATCGTTGTCAGCCACAACCCCGACAACAATACCTCAAGAATCAAGCTTCCCTCCG
GTGCAAAGAAGATTGTCCCTAGCGAC

> SEQ ID NO:1094 215930 223831_300976_1
GCCGATAATCAACAATGGGTCGTGTCATTCGAAACCAAAGAAAGGGTGCTGGTTCTATCTTCACCGCCCACACCC
GGCTCCGAAAGGGCGCTGCCAAGCTCCGAGATCTCGACTACGCCGAGCGACACGGATACATCCGAGGTGTTGTCA
AGGAGATCATCCATGACCCCGGTCGTGGTGCTCCCCTCGCCAAGGTCGTCTTCCGAGACCCCTACAAGTACAAGC
AGCGAGTTGAGACCTTCATTGCTAACGAGGGTGTCTACACTGGCCAGTTCATCTACGCCGGTAAGAAGGCTACTC
TGAACGTCGGAAACGTTCTGCCCCCTGGGCTCTGTCCCCGAGGGTACCATCCTCTCCAAACGTCGAGGGAGCACG
CCGG

> SEQ ID NO:1095 215930 142748_300445_1
AAACAGAGAACGCCGAAATGGGTCGTGTTATCAGAGCACAACGTAAGGGAGCAGGCTCCGTTTTCAAATCCCACA
CTCACCACCGTAAGGGCCCTGCCAAATTCCGTTCACTCGATTACGGTGAACGGAACGGTTACCTTAAAGGTGTGG
TCTCAGAAATCATACATGACCCAGGTAGGGGTGCACCGTTGGCACGCGTAACATTCCGAAACCCGTTCCGTTACA
AGCACCAGAAAGAGTTGTTCGTTGCTGCTGAGGGGATGTACACTGGTCAGTTTATTTACTGTGGTAAAAAAGCTA
ATCTAATGGTGGGTAATGTGTTGGCACTTAGATCTATCCCTGAAGGTGCTGTCGTTTGTAACGTGGAACACAAAG
TTGGTGACCGTGGTGTTTTTGCTAGATGCTCAGGTGATTATGCTATTGTCATCAGTCACAACCCTGATAATGGAA
CTACTAGGATTAAGCTTCCATCTGGAGCAAAGAAGATTGTGCCCAGTGGGTGTAGAGCCATGATTGGCCAGGTTG
CTGGTGGAGGAAGAACTGAGAAACCAATGCTCAAAGCTGGAAATGCATACCACAAATACCGGGTTAAGAGGAACT
GCTGGCCTAAGGTTCGTGGTGTTGCTATGAATCCTGTGGAGCATCCTCATGGTGGTGGTAACCATCAACATATTG
GTCATGCCAGTACTGTCCGCCGTGATGCACCACCTGGACAGAAGGTTGGTCTTATTGCTGCAAGGAGAACTGGTC
GTCTTCGTGGTCAAGCTGCTGCTACTGCTGCCAAGGCTGACAAGGCTTAAGATATTAAGTTTGTTACTTTTTTCA
TTGTCGTTGTATTCTGATCGGATTTGAGACCGTCTTTATACTAAGTTCTGTTTggatattatttagtaaggtttg
tttaggaaccctcgtttggacaagtttgccacttataaatgtgttttagcttggctct > SEQ ID NO:1096 215937 217717_300911_1
TTTGACTTCCTTGACGGCAAGGTTGCCCGATGGAGGAAGAAGAGCAGCCTCATGGGCCAGGAGCTGGATTCCCTT
GCCGACTTGATCTCGTTTGGTGTCGCCCCCGCCATGGTGGCCTTTTCAATTGGTCTTCGAACTACTGTCGATACC
GTCGGCCTCACCTTCTTCGTCCTGTGCGGCCTGACCCGACTGGCCCGCTTCAACGTTACCGTCGCGGTTTTGCCA
AAGGACGCCAGTGGCAAGAGCAAATATTTCGAGGGCACCCCCATTCCGACGTCGCTGGGCCTGGATGCCATCATG
GGCTACTGGCTGAAGCAGGGCTTGATATTGGACAACATTCCGTTTGGCACCTTGCTTGAGGGCACTCCGCTCGAG
TTCCACCCCG > SEQ ID NO:1097 215940 218757_300936_1
TCCTGTTCGGTCGCAGATCAAAAGTTCAGACGACACAGTCTTTGTTTCTTTTTCTTTTACAATTGTACAAAAGAG
AAAAGATCTTCTATTTAAAGGGATCAATTGGTGTTGGGACGCGAATCTACGAAGAGGCGCATATAATACAAAAGG
GGCTTCCAACATCCAGCCATGAAGTTCACGACTCTCCTCTTCCTTCTACCAGCCGTCCTCGCTCTTCCAACCGAG
CAGGCGCAAGACTCCAATGCCATCGATGCGAGCCGCAGTTTCCACTGCCCCGACAAAGTCCAGGGCTTCTGCTCC
GCGTCCAACATCAAATCGGGATGCAGCTCAGACGGAAAGTTTCATTCCGAGGCCATGGATACATGCAGCGAGTGT
TCATGTGATTGAGTGGTGGTGGTTACGGTGATTTGGTGGTATAATCATAGTACATGGACGGGTTTCACGTGCTTC
TTGTTTTGTCAATGCTGCGAGTTTGATGCGAGTTCCTTGCTAGCTGCTTAGATTGTTCTAATTACTGTCAGTGGA
AAATGTAAATTGAGCATCAGTCTATTAC > SEQ ID NO:1098 215955 205575_300799_1
CGATCCAGTAAGACATCACGCAGCGAAAAGTTAAACGTTTGGGCGCAAATGTATGGATTGTATTACTAAAAAATT
GCAGTATCTTCTTGCATGTCCCTGCATGGGAGAATAAACCTTCATCCCTTTGAGCGCGCCTCATCTAGTGGGGAA
CCGGGCAGAGGTCGGAGAAGAGATGGAAGTGGAAGTGGGCTTTAACACGGAGGAGCAGAATGTATATCAGTTAGG
CTGTCACAGTCACATGCGACA > SEQ ID NO:1099 215957 127812_300473_1
cccccccgaatccaatctccgcctaggggggttgctgccgagccACTCCCCTCGTTCCAGTTAAGCTTTCAGCTC
CTTCAACTCCACAGCCATGGCCGAACAGACGGAGAAGGCGTTCTTGAAGCAGCCAGGTGTTTTTCTTAGCTCGAA
```

Figure 2 continued

GAAGACAGGGAAGGGGAAGAGACCAGGGAAGGGAGGTAACCGCTACTTCAAGAGCATTGGTCTAGGGTTCAAGAC
TCCTCGCGAGGCTATTGAAGGTACGTACATTGACAAGAAATGTCCATTTACTGGAAATGTTTCAATCAGAGGTCG
TATCCTTGCTGGTACATGCCATAGTGCCAAGATGAACAGAACCATCATTGTTCGTCGGAACTACCTGCATTACGT
TAAGAAGTACCAAAGATATGAGAAGAGGCATTCCAATATCCCAGCTCACATATCACCTTGCTTCCGTGTGAAAGA
GGGAGATCATGTTATCATTGGACAGTGCAGGCCTTTGTCCAAGACTGTGAGGTTTAATGTGTTAAAGGTGATTCC
AGCTGGTTCTGCTGGTGGTGGCAAGAAAGCATTTACAGGAATGTGAGCAGGTGTTTCTTGAGTTTACTGTCACTT
CTAGAGTATGAAAGTAATTATGCTTGAGACTGAGAagaggAGTGACGTTGAGACTTCTCTACTAAAAGCTGTTTG
CGTTTGCCTTTGAAGGCTTAAATTTTGTATGGATACttgctacctatcATTAGTATAAGg > SEQ ID NO:1100  215957  56494_300139_1
AATCAGTAGCCATGGCTGAGCAGACTGAGAAAGCTTTTCTTAAGCAACCCAACGTCTTCCTTACCTCGAAGACAT
CTGGGAAAGGAAAGAGACCTGGTAAAGGTGGAAACCGTTTCTGGAAGAACATTGGTTTGGGCTTCAAGACTCCTA
GAGAAGCCATTGATGGAGCTTACATTGACAGTAAATGCCCATTCACTGCAACCGTTTCTATCAGAGGACGTATCT
TACCTGGTACTT > SEQ ID NO:1101  215957  279226_200060_1
tagggttttgccgccgtgcatctatcctcgtccagttcagcttgtagtcctcaatcatggcggagcagacggaga
aggcgTTTTTGAAGCAGCCAGGTGTTTTTCTAAGCTCGAAGAAGACAGGGAAAGGGAAAAGGCCAGGAAAGGGAG
GCAATCGCTACTTTAAGAGTATCGGTCTAGGGTTCAAAACTCCTCGTGAGGCTGTTGAAGGTACATACATTGACA
AGAAATGCCCATTCACTGGCAATGTTTCTATCCGAGGTCGTATCCTTGCTGGTACATGCCACAGTGCTAAGATGA
ACAGAACCATCATTGTTCGACGCAACTACTTACATTATGTCAAGAAGTACCAGAGATATGAGAAGAGGCACTCAA
ACATTCCAGCGCACATCTCACCATGCTTCCGTGTGAAAGAGGGAGATCATGTTATCATTGGACAGTGCAGGCCTT
TGTCcaAAACCGTGAGGttCAATGTCTTAAAGGTGATTCcAGCTGGTTCTGCTGGTGGAGGAAAAAaggCTTTTA
CCGGGATGTGAGCTTTGTGcttccatttCaaCTGTTATTTCTAGGAATGATGTCaagactTTTCTGctTTTACTG
AATTGttgccttCAttGattntccTTTGaacatcaaATTTTGTaacttaaaTCtTagcaattttttTTAAgccta
tGTACTActc > SEQ ID NO:1102  215957  254670_301634_1
acgcgtcgcttctaggtTTTAGGTTTAGGAGGAAGAAGAGGAGGAGGAGAGGAGCGCCGTAGGCCAGCAGAGGAG
GAGCAAGGCGATGGCGGAACAGACTGAGAAAGCCTTTTTGAAGCAGCCAAAGGTTTTCCTCTGTAGTAAAAAAAC
AgggaaAGGCAAAAGGCCTGGAAAGGGTGGAAACAGGTTTTTTAAGAGCATAGGATTGGGCTTCAAGACTCCAAA
AGAAGCCGTTAATGGTACTTATATTGACAAGAAATGCCCATTCACTGGGAATGTTTCAATCCGGGGTCGAATCCT
CACAGGGACGGTCCACTGTGCGAAAATGACTAGAACCATTATTGTTCGAAGAGACTATCTCCACTTTGTCAAGAA
GTATCAAAGGTACGAGAAAAGGCATTCTAATCTTGCTGCCCATGTTTCACCTTGTTTCCGAGTCAAGGAAGGCGA
TAAGGTTATCATTGGACAGTGCAGGCCCTTGTCTAAGACTGTCAGGTTTAATGTTCTGAAGGTAATTCCAATGGG
GTCATCTGATGGAGGAAGCAAAAAATCATTTGCAGGAATGTAAGCGTAGTCACTATCTGCACTAGATGTAGTGGT
CATACATTTGCAgggatTTAGCAGATTTTTCCATTGGGCTTTTGTGCCGCTGGTTCATGa > SEQ ID NO:1103  215957  253363_301625_1
gaccAGCAAAATGTCCGAGCTTCACGTCCAGAACGAGCGAGCTTTCCAGAAGCAACCTCACATCTTCCAGAACGC
CAAGTCCAAGGTCAACCGAAAGACCAAGCGATGGTATAAGGAGGTCGGTCTCGGATTCAAGACCCCCTCTGCCGC
CATCACCGGTGACTACATTGACAAGAAGTGCCCCTTTGTTGGTGACATTTCTATCCGAGGCAAGATCCTGACTGG
TAAGGTTGTCTCCACCAAAATGCACAGAACCATCATCATCCGACGAGAGTACCTCCACTACATCCCCAAGTACAA
CCGATACGAGAAGCGACACAAGAACCTCGCTGCCCACGTCTCTCCCGCTTTCCGAGTCGAGAACGGCGATATGGT
TACCGTTGGTCAGTGCCGACCTCTCTCCAAGACCGTTCGATTCAACGTTCTCCGAGTTCTGCCTGCCACCGGTAA
GGCTAACAAGGCCTTCTCCAAGTTCTAAACTTGAAAAAATCTAGTAAGATATTGTATTAAAAATCGTCAAGC > SEQ ID NO:1104  215957  237072_301250_1
GGTGTAGATTTTGTTAAAATCAGGGTTAGGGTTTATCAGCGGGCGGCTAGAGGAGCAAAAGAAGCGCCATGGCGG
AGCAGACCGAGCGCGCGTTCCTCAAGCAGCCGAAAGTCTTCCTTCTCGCCAAGAACACTGGAAAGGGAAAGAAGC
CAGGTAAGGGCGGGAATCGATTCTGGAAGAACGTTGGATTGGGCTTCAAGACCCCGCGGGAGGCAATCGAAGGGA
CTTACATCGACAAGAAATGTCCCTTCACGAGCAATGTGTCCATCCGTGGACGTATTCTCTCTGGAACTGTGGCCA
CGACCAAGATGACCCGCAGTATCATCGTGAGGCGGGATTACCTGCACTACGTGAAGAAGTACCAGCGGTATGAGA
AGAGGCACTCGAATGTGGCTGCTCATGTCTCGCCGTGCTTTCGCGTGAAAGAAGGTGACCAAGTGATCATCGGCC
AGTGCAGACCTCTCTCGAAGACGATTCGCTTCAACGTCTTGAAGGTGATGCCGAGAGGAGC > SEQ ID NO:1105  215957  195959_300639_1
ATCTCTCCGGAGCAGGATAATTCAAGATGGCGACCGAGTTGACCGTCCAGTCGGAGCGTGCTTTCCAGAAGCAGC
CTCACATCTTCTTGAACTCCAAGACCAAGACCAAGAGCGCCCGACCGGGTAAGGGAGGACGACGATGGTACAAGG

Figure 2 continued

ATGTTGGTCTGGGTTTCCGTACCCCCAAGACTGCCATTGAGGGCAGCTACATCGACAAGAAGTGCCCTTTCACCG
GTCTCGTCTCTATCCGTGGCCGTATCCTGACCGGCACCGTTGTTTCCACCAAGATGCACCGAACCGTCATCATCC
GAAGAGAGTACCTTCACTACATCCCCAAGTACTCTCGTTACGAGAAGCGACACAAGAACCTTGCCGCCCACGTCT
CTCCTGCTTTCCGTGTTGAGGAGGGTGACCAGGTTACCGTTGGCCAGTGCAGGCCTCTCTCCAAGACTGTCCGCT
TCAACGTCCTCCGCGTTCTGCCCCGAACTGGCAAGGCGGTCAAGTCCTTCTCCAAGTTCTAAATTGGGTTTCTCT
ACTGGCATTTTTGGCGTGATAAACATCGGGGGGAACGAATCATCCCCGCTGGAGGGTCGGCATGGGAAGTTGCT
TTACAAAATGAGTTGTAGACGCAATCGTGAATAAAAAAGGATTCATGACCACGATCTCGACGTCTCAGGGTTGTT
TACGACGCTTAATTCGATTCCCAATCACGGAGCCCGGTGCAAAAAAGAAATCTTGATGAGGCCCTCAGGTGATGA
ATGAATAAAAACCCAATGTTTAAATATCAACAACAGGTCTCATGGTACAGCGGAAGCAGTGATTGTACAACAGAG
AAAATATCGCGTGATatcaaTGCACACGGCATA > SEQ ID NO:1106 215957 175888_300522_1
ccCCCCGGCCGCCGCATCCTCCTTCGCAAGCCTCGCCTCCACTCCCCGCGCCGCCGCCGCCGCCGCCGACTCGCCG
GTCGTCACCCTCGCCCCGCAGCCATGGCTGAGCAGACTGAGAAGGCTTTCCTGAAGCAGCCAAAGGTTTTCCTCA
GCTCAAAGAAGTCTGGCAAGGGTAAGAAGCCAGGCAAGGGTGGCAACCGCTTCTGGAAGAGCATTGGCCTTGGCT
TCAAGACCCCCAGGGAAGCAATTGAAGGGACATACATTGACAAGAAGTGCCCATTCACTGGAACTGTTTCTATCA
GAGGCAGAATCATTGCTGGAACATGCCACAGTGCCAAGATGAACAGAACTATCATTGTTCGCAGGAACTACCTCC
ATTTTGTCAAGAAATATCAGAGGTATGAGAAGAGGCATTCCAACATTCCGGCTCACGTCTCCCCATGCTTCCGTG
TCAAGGAAGGTGACCATGTCATCATTGGCCAGTGCAGGCCGCTGTCGAAAACTGTGAGGTTCAACGTCCTGAAGG
TCATCCCAGCTGGATCCACCGGCGGCAGCGGTGGCAagaaggccTTTACCgcaGCCTgagCTTGTACTCTCATAt
tCATGGGTAGTTTATAGgCaGaTCCTTTTgctTgAaGTccTggCa > SEQ ID NO:1107 215957 172095_300539_1
CGCGCCAGTGCGTCTCTTGGTCGCGCGGCGATCATGGCGGAGCAGACTGAGAGGGCATTCTTGAAGCAGCCTAAG
GTTTTTCTCTGTCCTAAGAAAACCACCAAGGGGAAGAAGCCTGGCAAGGGCGGGAATAGGTTCTGGAAGAACATT
GGCCTTGGGTTCAAGACACCCAGGGAAGCCATCGAAGGAACCTACATTGACAAGAAATGCCCATTCACTGGTACT
GTATCAATTAGGGGTCGTATCATAGCTGGAACATGCCATAGTGCTAAGATGAACAGGACCATTATTGTTCGGAGG
AATTATCTGCACTTTGTCAAGAAGTACCAGAGGTACGAGAAGAGGCACTCCAATATTCCTGCTCACATTTCACCG
TGCTTCCGTGTTAAGGAAGGAGATCACGTGATCATTGGCCAGTGCAGGCCACTGTCAAAGACCGTGAGGTTCAAT
GTGCTGAAGGTCATTCCGGCAGGGTCAAAGAGTGGTGCAGGGAAGAAGGTTTTCACAGCCGCTTAAGATGTATAT
GAGGAGATATTCAGGGTTCTGAAAGCTTTGATCATGAGATTTTGATGCCACCTAGATGTCTTTCTCGTGTCTACC
ATCTT > SEQ ID NO:1108 215962 205446_300798_1
attttacataggagcgtttctcgttcgcgtcCATTTTCATTTTGCGTCTACAGCGAAGCGATACTCTTCCAGCAC
TACGCGATACCCCCTTTTGTCTATACTCACACCACCAAACGTAGCGACAAGCACAGCGACGCAACATTTACAATG
AGCGCAAGAAGCGGAGCGAAACGACTCATCAAGGAGCTTGAGAGCTGGCGCAAGGAGCGCAAGGACGAAAAGGGC
GTGGAGAGGCTGGGTCCGATCAATGAGGATGATTTATTCGAGTGGGAGGCCGTCATCAACGGGAGGGAGATTGGA
TCGGGCTATGATGAGGGCCGCTGGCTCATACACATCCAAATCCCCGCGCAGTATCCCTTGCAGCCGCCCAAGATG
CGCTTCGTGACGACCATTGTGCACCCCAACATTGCGCTGCAGTCGGGCGAGATCTGCCTCGACCTGCTCAAGGAc
AAGTGGACGCCGACGTACAGCGTGCTGCAGTGCGTGCGCGCCGTGCGCATGCTGCTGAGCTATCCCGAGACGGAC
AGCCCgCTCAACGTCGATGTCGCGGCGCTGCTTAGAGGAGGCGATGTTTGGGGACGCGAAAGCTGGTGCAATAt
tGGTGCTCGGAGCCGGAGGGAagatATGATGgcccGTAaggGGGTGTG > SEQ ID NO:1109 215962 238009_301291_2
atcataagtggggcaaaaaagggttcatggcgaaggcgcacgAATCCACTGCGGCACTCCCCTTCTTGATCGAT
TAGGTCAGATCGAAGTAGGTCGATCGATTGATAGATAGATTGGAAAGGGATCGGCGAAGATGCTCGATGTGTCCC
GCGTCCAGAAGGAGCTGGTGGAGATCGAGCGCGACAAGAAGCTGTCGGGCGTGAGCATTCAAGTCTTCGACGATG
GGTTGAGTCGAATGCGAGGAACAATCACGGGGCCTGTTGGCACCCCCTACGAGGGCGGAATCTTCACCATCGATA
TTCAGTTACCTTCTGCTTATCCTTTCGAACCACCAAAGATGCAATTCATGACTAAAGTCTGGCATCCAAACATCA
GCAGCCAAAACGGAGCTATCTGCCTGGACATTCTAAAGGATCAGTGGAGTCCAGCGCTGACGCTAAAGACTGCGC
TACTGTCGCTACAAGCGCTGCTTTCGACGCCGGAGCCGGGGGACCCTCAAGACGCGGTCGTCGAAAGCAGTACC
TGAGTGAGTATCCGGTTTTCGAGAGCACTGCGAGATACTGGACCGAAACGTTTGCAAAGAGATCGTCCCTTGGCA
TGGAAGAAAAGGTAGCGAAGCTAGTCGAGATGGGATTTACGGATGAGGTTGCGACCGCTGCTCTAGAGTGCTGTG
GCggcgacGAGAATg > SEQ ID NO:1110 215962 210910_300894_1
AAGCCTCTTCGACCACCCTCTGCCATCGTCAGCCTTCGACTCTCTTCACCAAACCTCAACAAGCGACAAATTATC
GCCAGGGTGCTCCAACGCTCGCTCCGCCATCGCCAGTATCCTTTGGACCCATACTTTCGCTCTACAACACACACA

Figure 2 continued

ACCCCTCTTACGCCCACATAGCTTCGGCTACGTCAAGTTTCGGCATCATGTCTAGCAGAGATCGCCGTATAATGA
AGGAGCTGCAGGATCTGACCGAGGACAAGGACACTTCCGGCATTCATGCTGCCCTAGAACAAGAGGGCTCGCTGA
CCGCTCTCAAGGGCTGGTTCTTTGGCCCTGGAAATACGCCGTACGCTGGTGGCAAATTCGTGATTCACATTCAGC
TTCCCACCGACTACCCCTTCAAGCCACCCAAGATGAAGTTTGAGACCAGGATCTGGCATCCTAATGTCAGCAGTC
AGACGGGCGTCATTTGTCTCGACACCCTCAACAAGAACTGGTCGCCTGTCCAAACGATCAAGACGGCTCTCCTCT
CCGTCCGAATGCTTCTCGAAAACCCAAACCCCTCAGATCCACAGGACGGCGAAGTTGCACGGATGCTGCTCGACA
GTCCCGACTCGTTTGTCCAGATGGCTCACGAGTGGGCAGTCAGGCACGCCGGTGCGCCgcga > SEQ ID NO:1111 215968 215782_300884_1
GGGCTCTGCAACAACCAaggacaACTCGCAAGAGAGAATATGGCGACCAAGCGTGATGCCGCCGCAACACCGGCA
GCACCGGTACGAGGGCCGGCCGACGTCGGTGTCCTAGCCGTGACGGTAGCTATGGGTTCTTTCTTGTCCGGCAAG
TCACCCCTTTGAGACGGGCAGCCGCAGAGCAGAAGAAGCTAACCGGTTCGCACCACAGGTGCCATGATGAGCCTG
TCGGCATTCGCGGTGCCCGTCATCCTCGACACAAACCCGGTCGACGGCGTGCACACGCTGCGGCAGTGGGTGCGC
GTCTACCACTACGGACACATTTACCTGCCGGCCCTGTGCGTGGCCACGACGGGGCTGTACGCCTTTGAAGCCCTG
CGGAAGCGCTCTCagggcaAATACCAGTGGGTGCGGTACGCACTGGCGGCGGTTTCGACCCTGGTCATGGTGCCC
TTTACCTGGATCTTCATGACGCCGACCAATAATACGCTGTTCGCGCTCGAGGCCGCCGCCGCCGCGTCGGATCCG
GgAGCTCTGGCAGACACCCCGGGCGCCGTGGTACGCTCGCTGGTCGTCCGGTGGGCATGGCTGCACGTGACgagg
tCGCTgacgcctctCTTCGGGGcAtATCTAggct > SEQ ID NO:1112 215968 220669_300937_1
ggtgcAAGGATCGTGCTACTGGGCTCTGCAACAACCAAGGACAACTCGCAAGAGAGAATATGGCGACCAAGCGTG
ATGCCGCCGCAACACCGGCAGCACCGGTACGAGGGCCGGCCGACGTCGGTGTCCTAGCCGTGACGGTAGCTATGG
GTTCTTTCTTGTCCGGTGCCATGATGAGCCTGTCGGCATTCGCGGTGCCCGTCATCCTCGACACAAACCCGGTCG
ACGGCGTGCACACGCTGCGGCAGTGGGTGCGCGTCTACCACTACGGACACATTTACCTGCCGGCCCTGTGCGTGG
CCACGACGGGGCTGTACGCCTTTGAAGCCCTGCGGAAGCGCTCTCAGGGCAAATACCAGTGGGTGCGGTACGCAC
TGGCGGCGGTTTCGACCCTGGTCATGGTGCCCTTTACCTGGATCTTCATGACGCCGACCAATAATACGCTGTTCG
CGCTCGAGGCCGCCGCCGCCGCGTCGGATCCGGGAGCTCTGGCAGACACCCCGGGCGCCGTGGTACGCTCGCTGG
TCGTCCGGTGGGCATGGCTGCACGTGACGAGGTCGCTGACGCCTCTCTTCGGGGCATATCTAGGCTTTACGGGGC
TTCTGTGCGAAATGCGATCGTCGGCCTAAACAGCTAGTGCGGCGGccGGGattctcGGGGTGGGGAagacgggTG
TggCttGCaaggATGttcg > SEQ ID NO:1113 215973 211822_300871_1
TCCCATCCCATCTTCCAAACCACATCATCAATCTCTAAGCGTTGCCCATTATGAAGAGCGCTTTGATCGCCGCCG
CGGCGCTTGTTGGCTCCGCCCAAGCTGGCGTCCACAAGATGAAGCTGCAGAAGGTCTCCCTCGAGCAGCAGCTGG
AGGGTTCAACCATCGAGTCCCAGGTCCAGCAGCTCGGCCAGAAGTACATGGGCATCCGCCCTACTAGCCGTGCCG
ATGTCATGTTCAATGACAAGGTGCCCAAGGTCCAGGGCGGTCACCCAGTGCCCGTCACCAACTTCATGAACGCCC
AATACTTCTCCGAGATTACCATCGGTACTCCCCCTCAGACCTTCAAGGTTGTCCTTGACACTGGAAGCTCCAACC
TTTGGGTTCCCTCCCAGTCGTGCAACAGCATTGCCTGCTTCCTGCATTCCACGTACGATTCGTCCTCCTCGAAGA
CGTACAAGCAGAATGGATCCGACTTCGAGATCCACTACGGATCAGGCAGCTTGACTGGCTTCATCTCCAATGATG
TCGTCACCATTGGTGACCTCAAGATCGAGAAGCAGGACTTTGCCGAGGCTACCAGCGAGCCCGGCCTTGCCTTTG
CTTTCGGTCGCTTCGACg > SEQ ID NO:1114 215986 205765_300801_1
AGCTGGATAAATTTCTCCTGTCATCCTCATTTCGCTGCCCTGCGCCACGACACCGGCTGCTGCAGTCCCTTTTCT
AGGCGATACCCAGCATCTGCACTCTGCCCTTTTTTATATTCTCTCCTTTGAAACTCGCATTCTCGTCGCGATAGC
TATTCCAGCGGTTGCCCTAACTTTCTATTTGCATCACATAACCTGACAAAATGGGTGAATCCAGACAAGAGCTCC
TCAATTGGCTGAACAGCCTCCTTCAGCTTAACATGACCAAGGTCGAGCAGTGCGGAACTGGCGCTGCGCTCTGCC
AGGTCTTTGACAGCATATACATGGACGTGCCTATGTCCAAGGTCAAGTTCAACGTCAGCGGCGATTACGCCTACA
TCCAAAACTTCAAAGTTTTGCAGAACACGTTCCTCAAGCACCAGGTCGATAAGCCCATCCCCGTCGAATCGTTGG
TGAAATGTAAGATGCAAGACAACCTAGAGTTCTTGCAATGGACGAAGAAGTTCTGGGACCTCAACTTCCCCGACC
ACGATTACGACGCTGTTGCACGAAGAAAGGCTGGCGGTtgcgcccgcAGcCAGt > SEQ ID NO:1115 216008 205884_300802_1
agcacggAGCACCACCATGGCTTCAAGGTTGAAGATCTGGGGTGCCTGCAGGACTCTGGCGGTCCGGACGCAGCC
CGTCCGCCTTGCGGCTCAGCCATTCCGAAACCAGGTTTCAGCGACTCGATTCTATGCCGACGATGCGACCAACAA
ACCCTCCAATTCTCCGAGCGGTGCAAAGAGAGAAGCTTCTAGATCAGTTTCTAAATCAGAACCAACAAGTTCCAg
ggtTACTGAGGGCACCTCTGGAGAATTGACCCAGAAAGCCGCACAAGAGACATCTTCATCACAAGCCTCACCCAT
TGAAGCGCTAGACGATGCGACCTTgGAACAAATACTATATGGCGGTCGACCCGTAACAAGTCAGCGGGAGGGCGG
CTTGACAGAGGCGCAAGAGGAGGCTCTATATCGCGAGGGTGTCATTCCCccaacagaGCAGGCggaagCTATCGT

Figure 2 continued

TGctgccgGGtcaCcagTCAatagtcCCTGTTGGCTCAGAAGTGCAAAacgccggccaTAAgtttggtCTTCCTC
AGAagccctatcCGGAcgg > SEQ ID NO:1116 216012 208640_300807_1
GAAGCAACCAAGAATCTGCACCTCACTCGATAATAAAAAGAAATCGGTACTCAAGGTTTATAACTCATTCAAAAT
GCGTTATACTGCTGTCCTCGCTGTCCTCGGCTTCTCCGGAGTCATGGCCAACAAAAACTTCGGACCCTTCGGATT
TTTCGGACCCTGGTTCGATGGCGACTTAACTATCGATGACCTCGCTGACTTTCAGTTTCCTGAGAACCCTTGTGA
GTTCATTGGTGGTACTTGCGAGATCGCCACTTCCCTTACATTCTGCGCTGGTCGGGGCGACTTCAGCGTTGATTT
GCCTTGTGGCGTTGGCCTCGGCTGCTGCTGGCACCAGGACACCAGCAATGTTTGGTTTGAGCAATGGAAGGAGTG
GCTCGAGCTACACAGCCGCATCAACTAAAGCCGCTTTAATGTCTTGACGCTTTGATGGCTTGACGCTTCTATGGC
TTGACGCTTCTATGGCTTGATGCTTTAATGGCTTGACGGAGTCTTCAATTGGCACGGTAGTGGGTGATGGAGAAA
TTAGCCGTACTGAACTCAATGAGAGATTGTTAACCCCGATTAAGTagt > SEQ ID NO:1117 216030 206080_300804_1
GGGAGATGTGTGAGTGAGTCTCTACATATGCAGCCGACCTTGACAGAATCATGTTGAGTCGCCAGGCAGGTCACA
GCGGTAGTGGGAATTAGTGGGATAGATTATAGCGGGATAGCGGGCCAAGCGCTGTGGGAAGTACATGTACAAGTA
CGGGTACCAGGTGCTAGGCATGTATTTGCGGATGCTGAGTGGCTGGAGCGGTGCTCGATAGCTGGGACGGCGGGG
CGCGAGATGGCCCAGAAGTGGCTCTGCAGTACTGGGAGATACATGGATGGGCATCGGGAGGTACAAGCTGGAGAT
GGATCTCTCCAAACCTT > SEQ ID NO:1118 216047 212017_300873_1
TTTGGACTGTAGGCTGTagagGAGTATGGAGCCGTTGTGTGCCTCTGTCTGACATTGGAGGATTCTGGATCCATT
GTGTGCCTCTATCTGGCATTGGAGGAGTCTGGAGTTGCTGTGTGCCCCTGTCTGGCAGTGGAGGAGTGCGGTGTT
GCTGTGTGCTCTTGTCTCGTCGGCGAAGCATCAGTGTAGCCTGAGCAGGTGCCGTAAAGACCGGTGCTACGGGCA
ACTGTGGGAGCTTGGGAGGAAGGACAAACGGTTTTGCCGCCTCTGGATGCTTTTCCAAGAACGCTTGTTCATATT
GACCAACCCCGAAGAACTCGTCCAAGTCGCTCAGAGTAGGAGAGGGTTGTTTTCGTTGCTGAGACTGAGAGCCAT
TAGTTGGTGAAGCAGCATTATACATTTCATTCATAGAGCGAGAAGGTCTTGGTTCCGCGCGCTGGGCTGCGTAGC
TTGTTTGTTTGCTTAGCCCAGGCTTGGATGGAGTGATAACGGCTGAAATTGAACTGCTTGagTCGGAGCTACCCG
ATAGATTTCGCGGGATTCT > SEQ ID NO:1119 216059 217351_300907_1
tttcgagcgctggagatatcGACACAATGGCCAAGAAAGCAAAGGCAAGATTGATCAACGTCCGGCTCATCTCCA
TGGCCATGACCGGCTTCTTCTACACCTTCAAGCGGCCTAGAACATCGCCCATGATGGGAATGCTGAAATACGACC
CGATAGTCCGCAAAAAGGTCTTGTTCCTAGAAACGAAAAAGCGATCCAAATAGAGACATTTCCGAGCAATGTAAA
ATTTCAAACTATACACCTCACGGACGGGAAAATAATGATTGGGTTGCGGGCGGTCTGGTTGTTCGAACCTGCGGC
CACCTATGTACATGTATCAATACGAAGAGCATTTCTGGAGTTTTAGGGATGGGCTGGCATTGCGCTCGATGCGCT
GACAGGTCACGATATCTGGTCTGATTGGAATATAAATTCACTCCCAAATATTCCACTTTTGATTCTTTTCTc > SEQ ID NO:1120 216059 221282_300943_1
AAGAAAGCAAAGGCAAGATGATCAACGTCCGGCTCATCTCCATGGCCATGACCGGCTTCTTCTACA > SEQ ID NO:1121 216062 207919_300830_1
GCCAGTACGAACGAACATTCAGCCTTGTGCAGGGGAAGCAGAAGATCATATAGAGCATTTATCAAGCGAATAACA
GACCCTGAGACACTGAATCAGAGAAGCTTTAGAAGCTCTTCTTCTCTGTCTCCGCGCCTCTTATCGCAAACAG
CCCCTCTACTGCTGCTGCTGCCTTTGTCAGGCCTGTCTTTTCAGTGTCGCATGCCCCGCCTCATCTTTCTACCTT
GCACAACTCAGCCTTTGCGCTAATCAACGACATCTGCGATCTGTGTCGGCAGCAGAAGAGTCCCCAGATTCACTG
GTCTCTCTTTTATTCTCCTTCTTTCTAAACAGATCTGTGTTGCCCCCAAAGCAAGCGAGAAATACGTCAAGATG
GCTCTTCCGAAACGGCATCATCAAAGAAACCGAACGCCTTATGGCGGAACCAGTTCCCCGGAATCAGCGCCGTGC
CTCACGAAGATAACCTGCGATACTTTGACGTCGAGAATCCACGGCCCTGCATCGTCACCATACGAAGGCGGCATT
TTCAAGCTTGAGCTCTTCCTCCCAGATGACTATCCCATGACTCCGCCCAAGATTCGATTCCTTACTAAGATTTTC
CACCCAAAC > SEQ ID NO:1122 216071 120607_300428_1
gagctcagCGTAAAATTTGAGAGTTTCATTGTCAGCTTGGCGGCCCCCACTGAGTTCGACCGAAAATGAAGTTCA
ACATTGCAAATCCGACAACTGGATGCCAGAAGAAGCTCGAGATCGACGATGACCAGAAACTCCGGGCTTCTTTG
ACAAAAGGATCTCCCAGGAGGTTGCTGGAGATGCTTGGGAGACGAGTTCAAGGGATATGTTTTAAGATTATGG
GAGGATGTGACAAGCAAGGTTTCCCAATGAAGCAGGGAGTGTTGACTCCAGGCCGTGTTCGTCTTCTGCTGTACA
GAGGTACTCCTTGTTTCCGGGGCTATGGTAGGCGAAATGGGGAGCGCAGAAGGAAGTCTGTCCGTGGATGCATTG
TTAGTCCTGATCTTTCTGTTCTGAATTTGGTTATTGTGAAAAAGGGTGAGAATGATCTGCCTGGACTGACAGACA

Figure 2 continued

CCGAGAAACCAAGGATGAGAGGACCCAAAAGGGCTTCCAAGATTAGGAAGCTCTTCAACCTTTCCAAGGAAGATG
ACGTCAGGAAGTACGTCAATACCTACCGTCGAAATTTCACAACCAAAACTGGGAAAAaggcTAGCAAGGCTccta
agaTCCagaggctggTAACACCATTGACTCTc > SEQ ID NO:1123  216071  258568_301697_1
gcaaaatgaaggtgagtgacggtggatattggtgtgactaaggcgacacgggagaacgacagagacggtattgag
gggagAAATTACCAAGTCCCGTTTGTCGAATTATGTTGGATCACATTTGGATCATATCTCTGACAAATTTCTAAC
ACCAGCTTAACATCGCATACCCCGCTCAGGGCACCCAGAAGTGCATTGATATTGAGGACGAGCACCGAGTCCGAG
GCTTCTACGAGAAGCGAATGGGCCAGGAGGTTGAGGCTGACTTCCTCGGTGACGAGTTCAAGGGCTACGTGCTCA
AGATTACCGGTGGTAACGACAAGCAGGGTTTCCCCATGAAGCAGGGAGTCATGCACCCCACCCGAGTCCGACTTC
TGCTGTCCAAGGACTCTTCCTGTTACAGATCTCGACGAGCCGGTGAGCGAAAGCGAAGTCCGTCCGAGGATGCA
TTGTCTCTTCCGACCTGTCTGTTCTGTCTGTCGTTATCGTCAAGCAGGGCGATGCCGACATTGAGGGCCTGACCA
CCGAGACTGTTCCCCGACGACTCGGCCCCAAGCGAGCCAACAACATCCGAAAGCTGTTTGCTCTCTCCAAGGAGG
ATGATGTCCGACAGTACGTTATCCGACGTGAGGTGACCACCAAGTCCGGAAAGACCTACACCAAGGCCCCCAAGA
TCCAGCGACTCATCACTCCCCGACGACTCGCCCACaaggccCAGCTccg > SEQ ID NO:1124  216071  235052_301223_1
TTCGTCGCGGCTGGCCCTAGAGAGGCGGAAGCAAGAGCAAGAGGAGGGATCTCCGCCATGAAGCTCAACATTGCG
AATCCCACCACGGGATGCCAGAAGAAGATCGACATTGATGACGACCAGAAGCTGAAGATGTTCTTTGAGAAGCGA
ATCTCCCAGGAGGTGCCCGGAGATGGTCTTGGAGAGGAATTCAAAGGCTATGTCTTTAAGATCATGGGTGGATGT
GACAAGGATGGCTTTCCCATGAAGCAGGGCGTCCTTAAGAACAAACGTGTGCGCCTCCTCTTGAAGAGAGGTGAT
ACTTGCTTCCGTGGGTATGGACGACGTGATGGTGAGCGCAGGAGGAAGTCAGTTCGTGGCTGTATCGTCAGCCAT
GATCTGTCTGTTCTCAACCTTGTGATCGTCAAGCAAGGTGACAAGCATCTGCCTGATCTCACGGACACGGAGAAG
CCGCGGATGCGGGGTCCGAAGAGGGCCAGCAAGATCCGGAAGCTCTTCAACCTGTCCAAGGAGGACGACGTCCGA
AAGTACGTCAACACGTATCGCCGGACGTTCACCTCCCCCTCGGGCAAGAAGCGCAGCAAGGCCCCGAAGATCCAG
AGGCTGGTGAcgcCCCTGAcgcTgcagaggaaacgCGaccgcatccgcaccaagaaggcgcGCGTGGTCAaggcc
AAGCTggaggctgccgAGtaccaga > SEQ ID NO:1125  216071  270216_200124_1
GCAGTTCGTCATCTCACGGCGCTTCTACGAGTTCAACCGAAGATGAAGTTCAACATCGCAAATCCCACCACTGGA
TGCCAGAGGAAGCTCGAAATCGACGATGACCAGAAGCTCCGAGCCTTCTTTGACAAAAGGATCTCCCAGGAGGTT
AGCGGAGATGCGTTGGGCGATGAGTTCAAGGGTTACGTTTTCAAGATTATGGGAGGATGTGACAAGCAAGGTTTT
CCAATGAAGCAGGGAGTGTTAACTCCTGGCCGAGTTCGCCTTTTGCTCTACCGAGGTACCCCTTGCTTCCGTGGT
TATGGTAGGCGAAATGGAGAGCGCAGAAGGAAGTCTGTCCGTGGATGCATTGTCAGTCCTGATCTTTCTGTTTTG
AATCTGGATATTGCTAAGAAGGGAGAGAAAGATCTGCCTGGGCTGACCGATACTGAAAAACCAAGGATGAGAGGA
CCCAAGAGGGCTTCTAAGATTAGAAAGCTCTTCAATCTTTCCAAGGAAGATGATGTCAGGAAGTATGTCAACACA
TATCGCAGAAACTTCACAACCAAAACTGGGAAAAAGGCGAGCAAAGCTCCTAAGATTCAAAGGTTAGTGACACCC
TTGAC > SEQ ID NO:1126  216071  204323_300792_1
AAGCCGACTTCACGCGAGCCAGGTCAAGCCAAACTTGCACCACCACAACACTGGCAAGATGAAGTTGAACATCTC
TTACCCTGCCAATGGCAGCCAGAAGCTCATCGACATTGAGGATGAGCGTAAGCTCGCCGTCTTCATGGGAGAAGCG
CATGGGCGCTGAGGTCCCCGGTGACTCTGTCGGCGACGAGTTCAAGGGCTACATCTTCCGCATCACCGGTGGAAA
CGACAAGCAGGGTTTCCCCATGAAGCAGGGTGTCATGCACCCCAGCCGTGTCCGCCTCCTGCTCTCCGACGGCCA
CTCCTGCTACCGCCCCCGCCGAACCGGTGAGCGCAAGCGAAAGTCCGTCCGCGGCTGCATCGTCGCCATGGACCT
GTCCGTCCTCGCCCTCTCCATCGTCAAGCAGGGTGATGCCGACATCCCCGGCCTGACCGACGTCGTCCAGCCCAA
GCGCCTCGGACCCAAGCGCGCCACCAAGATCCGCAAGTTCTTCAACCTCACCAAGGATGACGATGTCCGCAAGTA
CGTCATCCGACGAGAGGTCCAGCCCAAGGGCGAGGGCAAGAAGCCTTACACCAAGGCTCCCAAGATCCAGAGACT
GGTCACCCCCAGCGCCTGCAGCACAAGCGCCACCGTCTCGCTCTCAAGCGCCGgcaggccgagaaggTCaagga
cgaggccaacgaGTACgccca > SEQ ID NO:1127  216071  226710_301004_1
AAAACCCTATCCCGCGCGCCGCCGCCGCCGCTCCCCCGCGCACTCGCCGCTCGCCGCCCGCGAGCTCGCGCC
GCTTCGCAACCATGAAGTTCAACATCGCGAACCCGACCACCGGGTGCCAGAACAAGCTCGAGATCGATGACGACC
AGAAGCTGCGTGCATTTTTTGACAAGAGGATCTCTCAGGAGGTCAGTGGCGATGCTCTGGGCGAGGAATTCAAGG
GCTATGTCTTCAAGATCATGGGGGGTTGTGACAAGCAGGGTTTCCCTATGACGCAGGGAGTGCTCACTGCTGGAC
GTGTCCTCCTTCTTCTTCACAGGGGCACACCTTGCTTCCGTGGGTATGGCAGGCGTGATGGTGAGCGCAGGAGGA
AGTCTGTCCGTGGTTGCCTCGTCA

Figure 2 continued

> SEQ ID NO:1128 216071 224265_300970_1
ACGGGATGCCAGAAGAAGATCGACATTGATGACGACCAGAAGCTGAAGATGTTCTTTGAGAAGCGAATCTCGCAG
GAGGAATTCAAAGGCTATGTCTTTAAGATCATGGGTGGATGTGACAAGGATGGCTTTCCCATGAAGCagggcgtC
CTTAATAACAAACGTGTGCGCCTCCTCTTGAaGAGAGGTGATACTTGCTTCCGTGGGTATGGACGACGTGATGGT
GAGCGCAGGAGGAAGTCAGTTCGTGGCTGTATCGTCAGCCATGATCTGTCTGTTCTCAACCTTGTGATCGTCAAG
CAAGGTGAGAAGCATCTGCCTGATTCACGGACACGGAGAAGCCGCGGATGCGGGGTCCGAAGAGGGCCAGCAAGA
TCCGGAAGCTCTTCAAccTGTCCAAggaggACGACGTCCTAAAGtatgtcaACACGTATCGCCCCTCGGGCAAGA
AGCGCAGCAAGGCGAGTACCAGAAGCTGCTGTCGCTGCGgctccaagGAGCAGCGGGAGCACAGGAGCGAGAGCt
tggccaagaGGCGAGCGTCtcgtctctcTGTCgcctaatttGCGctatgaacaTTT > SEQ ID NO:1129 216093 213819_300861_1
gGGCCTCTCCCTGACATTCATTCCACCATGGCGCGCCGCCAGCATCTCACAGCGTCCATCCTGTTGGTCGTCGTC
CTGTTCTTCAGCTTCTCGTATTTCCTGTCCGGCTCGTCCAGCCACGATGTGGACCGAATCCATGAGCCTGCGGGA
GAGCCCAAGTCGGAATTCAAAGTGGACCTGGGTGGCATGCCAGCTAGTCTGCTTGACGGAGAGTCTATAGCCCCC
AAGCTGGAGAATGCAACACTCAAGGCCGAGCTGGGTCGTGCAACATGGAAGTTTATGCACACAATGGTCGCCAGA
TTCCCCGAGCAGCCCTCAAAGGAAGAGCGTAAGACTCTCGAGACGTTCATCTACCTCTTCAGCCGCCTATATCCC
TGCGGTGACTGTGCGAGGCACTTCCGGGGGCTGCTGTCAAAATACCCTCCCCAGACGAGCAGTAGGAATGCGGCG
GCTGGATGGCTGTGCTTTGTGCATAACCAGGTTAACGAGAGACTGAAGAAGCCGATATTTGACTGCAACAACATT
GGCGACTTTTACGACTGCGGCTGCGGAGATGAAGATAAGAAGAAGGGGGA > SEQ ID NO:1130 216113 206748_300825_1
CCGAGTTGAAGAGCTTCCCGACGACGAGACCAAGACCAAGCCCACGGTCGAGGAACAGGATTCCAGCGATGAGTC
CGATGCTGAAGAGCTCGGCGATGGATCTCTCCCCGCCGGTTCTACTGCTGTAGTCCACTCTCGCTACGAGAAGAA
AGCTCGCAAGGCCCTGCTGGAGAAGGGCAACTTGGTCCGAGTCCCTGGCATCACCCGAGTCACTCTCCGCCGCCC
CAAGAACATCCTCTTTGTCATCAACAACCCCGAAGTCTACAAGTCCCCCAACAGCAACACCCTACATTGTCTTTG
GTGAGGCTAAGATCGAGGACATCAACGCCACCCGCTCAGCAGG > SEQ ID NO:1131 216130 210976_300894_1
AAACAACCATGCCTCACAAACACAAGTCAAAAAAGGGCGAATTTGAAGCAGAGTTCGTTTGTGAGCGTACCATGA
GTAGATTTCACTGACTAATCTTGGAGCTAGATTCGATCTCGCCCCTACAGAGAAAGCGCGATCTCTTCCAGTAAA
CAAACGAAAAGCGGCATCAAGTTCTGGAGAGCAAGTCACAAAGAAGCGTGCCAGAAGCTCATTAAGAGGCAATGA
CACTCCGCGAGCATTCAAGAGAATCATGGCTGTGGCAGGGGGGAAGAAAATTAGATCAGGCTTGGATGATGGTCA
ACTCGACAAAACGACTACGAAGGCTACCGATGTAACGAGCGAGAAACTTCAAATTCGTCCCGGTGAAAATTTAGG
GGCCTTTGCCAGCCGGGTTGATGCGGCTCTACCAGTATCAGGGCTTGCGAAGAAAACCAGCACGAATGCAGAGGG
CAAAGACGCATTAGGATTGAAAGTGTATCGCACTCGCAAAGAGCGCAAAATGCACAAACTCTACGATCAGTGGAG
GGCAGAGGAATCCAAGATACGAGAAAAGAGGGAGGAGGAGCTAGAGCGCATAGCAGAACGCGACTTGGAAGACGA
TGCTGCCGGCATTCTTACTTCAGCTGCCTTCGAAAACGACAATAGCCACACGAAAAAGAGGAAGGGGGGCAAGAG
GAAGAGAATAGTAGAGGAAGa > SEQ ID NO:1132 216131 195983_300639_1
gcgctgAGAAGCCTGCATCGCCCGCCATGGCCATTACGCCGACCCAATTCGCCAAGAAGACGGCGCAGTCGACCA
GCTGGTCGGATGCGAAGCGTCGAGTCCTTTCTTCGTACCGCGAATGGATCCGAGCTGCGCCTGAGATCCAGACCA
TGTACAATGTCCCTCTCCCCATTTCTACCCTCCGAACACGGATGCGACAAGAGTTCGAGCGACACCGATACACGA
ACCAGCTGTCCATAGTTGACGTGCTTCTCTTCAAGTCCCATGCAGAGTACCAGGAAACAATGAACTTCTGGAAGC
AGCAGACTCACATCTTGTCTTATTTCGGCGAAAACTTTAGAGGTGACAAGAGGCTTCCGTCCAGCTTCATGGCTG
GTTTCCTTGAGGGTCGAAATTAGAAAGACAATGCAAGAAAGTTTGTTTTGTAAATATCTCTGTATAAAGATTTTG
TGCCGAAACCCTCCAATAaaaAaaaacacaacaacac > SEQ ID NO:1133 216157 221045_300941_1
GAATTTCTACCCCCCTCCTAAAAAGACCGCCCAAAGAGAAACTTCAATGGCTACCTTGAAGCAACGAAAGGTCG
CCATCGTGGGCAGTCGATCCGTTGGTATGCATCCGTGAAGCCCGCGTCTTTTCTTCTACCCGCGCCGTCAAACCT
TTGGCTGACCTGAATTCCCTAGGCAAATCATCGCTCGCCGTGCAGTTCGTCGATGGTCACTTCGTCGACAGCTAC
TACCCCACGATCGAGAACACCTTcagcaAGACCATCCAGTATAAGGGCCAGGATTACGTCACTGAGATCGTcGAT
ACCGCGGGACAGGTAagatTTTCTcggGCTGCTTCTCTTCTCGCAGTCGCAGCCGCAGCCGCAGCCGCAGCCcgt
cgAGACGCTGACGCTGTGCCCAATCCGAACAGGATGAATACAGCATTCTCAACTCGAAGCACTTCATCGGCATCC
ATGGCTACATGCTAGTCTACTCCGTGTCGTCCCTGCCCTCCTTTGAAATGGTCCAGGTTGTCCGCGAGAAAATCC
TTAATCATCTAGGTACCGAGTCCGTTCCCATCGTCATAGTAGGTAACAAGAGCGACCTCCGACCAGAGCAGCGCC
AAGTCAGCCCCGAAGAAGGCAAGAAGCTGTCAGAAAAGTTCGACTGCGGCTGGACCGAGGCCAGTGCAAGGTACA

Figure 2 continued

ACCAGAACGTCGGCAGGGCGTTTgAGCTCTTGATTGCCCAGATTGAGAAATCTCAGAACCCTGGCGAGCCCCCTg
cCAAGA

> SEQ ID NO:1134 216187 208071_300831_1
ATTTATCGAGTTTCACAGGGCTTACAACTCCTGTCCGGGGGGATTGGCAGATCTTGACAACTGAGGAGGACCGGA
TGCCGTGACGTGTAGCTGCTAGGATGAATCTTGGATTGGAGATTTGCCAGTCGATTTGGATGGTGCCTTTCGGGA
TGGAGGGGTGGAGGGTGGAGAGATATGACTAGTGTGGAGGTATCACAGCGTCGGGGGGCTGTGGAGAGTTCAGGG
TAAGCCATTTGCGGCTTTCACGCTCAGTAACACTCGGGGGTTTAAAACTGACTGATGGCCCATCTATACCTTGCA
GAACGAATTTAGGTCCTCGCAAGACTCTCCCTAGAGCCGCGTCCCGTCACTACTGCTGCTTTGGCATCAAATAGT
GCTCAATGGCTAGGCCGAGGGATTTGAAGACGATAGCAATGTAACCCATACGATCTGACTGAACGAAAAAAAACA
ACAACC

> SEQ ID NO:1135 216189 208347_300959_1
ATCAGTCAAACTCCAAACGAGGTATGTATGGCCTTGGTCACCGCTGACGGCGATTCGGACCTGGCAGGATGACGC
CTTTTATCGTGGCTGGGGACAGCAATCGAAGACGCCGGCCCCGATGAGCGACAATGAACGCGCGATGATGCATCA
CATCACATCATGCGGTTTTCTGTTTGGCACACAACGGCTTTGGCTGGCGTTTCTCGATACGCTGCTTCCCCTTCG
GCAATGAGCGGGCTGAACCCTCGTCGACGGATCGCTGAGGGCACTCTCCACGCTTCTGGGCCACTCCTAGTCTAA
CATGTGTTTCCCTTCTGGCAGATACCTCATTTCCAACTCCGACTTGAGAATCTCCTTTTCATCAATACCGCCAAG
ATGGTCCGCACTTCCGTTCTCCACGATGCCCTCAACAGCATCAACAACGCCGAGAAGGCCGGCAAGCGTCAGGTC
CTGATCCGACCTAGCTCCAAGGTCATTGTCAAGTTCCTCCAGGTCATGCAGCGCCACGGCTACATTGGCGAGTTC
GAGGAGGTCGATGACCACCGCTCCGGCAAGATTGTCGTCCAGCTGAACGGCCGTCTCAACAAGACTGGTGTCATC
TCCCCCCGCTACAACGTCCGCCTGGCCGACCTCGAGAAGTGGGTCGTCAAGCTGCTGCCTGCCCGTCAGTTCGGC
TATGTCATCCTCACCACCTCTGCTGGTATCATGGACCACGAGGAGGCCCGACGAAAGCACGTTGCCGGCAAGATC
ATCGGCTTCTTCTACTAAAAAAATTGGCGGAGAGAGGAATGAAAAAAAAGTGAATTTgTGgcaTTCTCGGCGTTC
CAATGGTGGTCGCGGTGACGGTAATCAGCATCCTCTGAtTTACAGCTGGGATAGTCACCCTTtagcTTAGCGTAC
ACTggcaaTaAatcACAGATGAGaag > SEQ ID NO:1136 216189 226458_301034_1
GAACCTCCGTTCTCGCTGACGCTCTCCAGTCCATCACCAACGCCGAGAAGGCCGGCAAGCGACAGGTCCTGATCC
GACCTTCCTCCAAGGTCATCATCAAGTTCCTGACCGTCATGCAGCAGCACGGCTACATTGGCGAGTTCGAGTACG
TGGACGACCACCGATCCGGCAAGATTGTGGTCCAGCTCAACGGCCGACTCAACAAGTGCGGAGTCATTTCTCCCC
GATTCAACGTCAAGATCGACGACGTTGAGAAGTGGATCCAGAACCTGCTGCCCTCTCGACAGTTTGGTTACATCA
TTCTGACCACCTCTGCCGGAATCATGGACCACGAGGAGGCCCGACGACGACACGTTGCCGGCAAGATCCTCGGAT
TCTTCTACTAGACGATTTGGGGTTTCTCAAAAGTCTGGTACAAAAATAAAAATGAATTGTTTGAATGG > SEQ ID NO:1137 216191 208132_300832_1
gagcgcgggtatgagtaaaagattcaaaatagcccttatcagggcgacgcggtgttttttcgtctccatcttctca
aacacCCGCAGCACCTAAAATGCCTCCAGCACCCATTCTCAAGCTCAAAAACTGCCTGGTGCGGGCTTACGATGA
AGGAGACGTGAAGTCCCTCGCCAGAGCAGCAAACAATCCCAAGATATCGCGATGGATGCGTAACACATTCCCACA
ACCATACACGACCGATGATGCCAAGAAGTGGATCTCTATCGCCAACTCTGCATCTCCGATCCGTGACTTCGCCAT
CTGCCAGCTGGACAGTTCAGTGGTTATCGGCGGTATTGGTCTCAAAGCACGAGACGACATCCACTACCGAACGAT
GGATATCGGCTACTGGCTGAGTGAAGATCGCTGGCATCAAGGTATAGCCACAGAAGTCGTCATTGCCTTCTCCGA
CTGGGCTTTCGAAAACTTCAAGCAGCTATTAAGACTAGAGGCCGAAGTCTTGGAGGGGAACGTAGGAAGCTGCCG
GGTTCTAGAGAAAGCGGGCTTCGTGTTTGAAGCAAGGCAGAAAAACGCGGTTGAGAAAATGGGCGCAGTCATGGA
TACCTTTATATATTCCAAGTTTAGATAGAAACCTTAGACTGAATTCTTCTTGGTGAAATAATAGACTTTCTTTTC
TTTTTCTCTTtagaaaaaaaaaaacaaaaaaaaccac > SEQ ID NO:1138 216193 208088_300831_1
GACACTATACGTCAAACCAACAGCCTAAGAAATGGGTCAAGGAGTTCAAGAACGCCGGTTGCGACCTGTACTGCT
TCCACTACGAGGCTGCCTTTTCCTCTGCCGCAGAGTCTCCCGAACAAACGACCGATAAGAAGACCAACCCCAAGG
AATTGATCCGATATATCCACGACCAGGNACTGCTTGCAGGCATTGCCATTAAGCCTGACACATCCGTCGACGTGC
TTTGGGACATTCTCGAGACTTCGGAATCCAAGGAAAAACCTGATATGGTTCTAGTCATGACAGTCTACCCCGGCT
TTGGAGGACAGAAATTCATGGCCTCGGAGCTGGCCAAGGTGCAGGAGCTACGAAAGCGATACCCCGAACTGAACA
TCGAGGTTGACGGAGGACTCGGCCCCAGCACCATTGACCAGGCCGCCGACGCGGGAGCCAATGTCATTGTTGCGG
GCAGCGCCGTCTTTGGAGCCAAGGACCCGGCCGAAGTCATTTCGCTGCTACGGAGGTCCGTCGACACCAAGGGAG
GCAAGCTGTAAGTGTGGAGAGTTGGATATAGAAGAACAAATAGCTGCATGAAATAGAAATAGCGATTGCTTCCCC
T

> SEQ ID NO:1139 216193 247266_301618_1

Figure 2 continued

GGGCCAAGATTGCGCCATCCATGCTTTCCTCGGACTTCGCCAATCTCGCAGCCGAGGCACAGCGAATGCTGGATT
GTGGAGCGGACTGGCTACACATGGACATCATGGATGGGCATTTTGTTCCAAACTTGACTATTGGAGCTCCGGTGG
TAAGTTCGCTGCGAAAGCATACAAGTGCTTATTTGGATTGCCACCTTATGGTGACGAATCCACTCGACTACGTAG
AGCCTCTTGCCAAGGCCGGGGCGTCTGGCTTCACTTTCCACATTGAAGCTTCTCGAGATAATTGGACACAAATAT
CAAAGAAGGTCAAGGAATGCGGCATGAAAGTTGGAATTTGCCTCAAGCCTGGAACTCCAGTCGAAGAGGTGTACC
CTCTAGTTGACAGTGGTGATATTGATTTAGTGTTGATCATGACTGTCGAGCCAGGATTTGGAGGTCAGAAGTTCA
TGCCGGAAACAATGAGCAAGGTGAAAGCTCTTCGAGCTCGCTATCCAAAACTAGACATCGAGGTTGATGGCGGTC
TTGGCCCTTCGACGATCCAGCAAGCCGCCGATGCTGGAGCAAACTGCATCGTCGCTGGAAGCTCGGTTTTTGGAG
CTCCAGATCCGG

> SEQ ID NO:1140 216228 145879_301062_1
TGTGGTTTGAAGTTCTTTCCTACTGCTTAGTTATAATTGTTTTCATCTATGGCTGCAACGACAGGGACCCATGGT
CAAGGGGAGCAGATACCGCCGGGAAAGCCTATGTCAACGGAGCAACACATGCTAGATAAAGGTGCTCAGATGCTG
CAGTCTTTGACTCCAATCAAACAAATGAACCAGCATGTTTGCACTTTTGCACTTTACAACCATGACATGAATCGC
CAAATTGAAACTCACCATTATGTTACCCGGCTCAATCAAGATTTTCTCCAGTGTGCTGTTTACGACTCTGATCAT
TCCACCGCCCGCCTAATCGGGCTGGAGTATATAGTATCTGATCGTATCTTTGAAACCTTGCCTGAAGAAGAGCAA
AAACTTTGGCATTCTCATGCTTATGAGATAAAATCAGGACTCTGGGTGAATCCTAGAGCTCCAGAAATGGTGGTA
AAGCGTGAACTTGAAAATATTGCCAAGACGTACGGCAAATTCTGGTGCACATGGCAAACAGATAGAGGTGATAAG
CTACCAATTGGGGCACCAGCACTGATGATGTCTCCACAGGCGGTGAATTTGGGGATGATTAAGGCAGAACTAATC
CAGAAAAGAGATGACAAGTACAATATGTCGACTGATGCCATG

> SEQ ID NO:1141 216228 218712_300936_1
gatatGTATATATAGACGAGATCAGTTCCCAATTGCACTAGCAAATTGAGTTGAACATTCCATGTGATCACAACT
CGGCATTCTATTGGGCTTCGAGGCAATACACACACCGAAAATGAGTTCGGAAGCACACGACAAAGCACCGGGTGA
TCTTTTCCCCAAAGAGGACACTGTGCTTTCGAGTGCGGCATCCTTCACACAGGACTTTAAGCCGGTTAAGAATAT
ATGTGCTCATCTTAACGCTTTCCACGCTTATGCGAATGATCCTATGCGATCCGTGGAAGCGAATCATTACTGCAG
CCAATTGGACGACGAGGTTCGGCAATGTGTGTTATACGACTCTCCGGAACCCAATGCACGGATCATAGGCATAGA
ATACATGATCACACCGAAACGCTACGAATCTCTACCCGCTGATGAGCGCCGCCTGTGGCATTCCCACGTATACGA
GGTGAAATCGGGGATGCTGGTGATGCCTAACCGCATGGTACCCAAAGCAGCATGGGAATTAGCAGAGAAGAGGGA
GATGGAAAAGATTATCACGCTATATGGGAAGGCGTATCATTTGTGGCAGACGGACAGAGGGGATGAGCTTCCGCT
GGGGGAGCCACAGCTCATGATGAGTTATACGAGTGATGGGCATTTGGACTTTGGGAGGGTGGAGGAGCGGGATGA
GAGGTTTGGGACGAATTATAGGGAGAAGAGGGAGGCTAGGAAGGATATTCCTTCTCCGAAGATTCATGGAGATGC
TGATTCCTGCTGGCATGCTTGGAGGGAGAGGGGAAACAAGACTCCTCCGAGTTATAACCAGAAGTGATGGCGGGC
AGATGGGAAATTCGATCTTGGCGAAGATTTGGAATTGTTGGTTGTATCTGATAACACGGACACTgcaATATGAAA
CTGTCCGACGGAATTAAAGCAGAGTCCGTGATTCTGGTTTgTaGTTTAAACAAACGGAAATGACATAATGGATGA
ATGACATGCTTAGTACGTTACTTATC > SEQ ID NO:1142 216228 243580_301340_1
ggagaagaGGAAAATGAAGGCAAGAGGGAGAGAATTGTTCTTGCAATTTGTAGCTCTACAAGCAGGGTTCCATAT
GACTTCGTGCGACAAGCCCCCGGCCGGACAGGTTCCAAGTTCTGTCGACGATGTTCCTGGAAAGGCGACGACGAT
GATGTCCAAGATCATGGAGAAAGGTGCCGATATGCTCCAGTCTCTCACGCCTGTGAAGCAAATCAGCCAGCATAT
TTGTACCTTCGCGTTCTACTCGCACGATATGAAGCGGCAGATCGAAACTCATCACTATGCTACTCGCGTCAACGA
GGACTTTGTCCAGTGTCTCGTCTTCGATCGAGACGACTCTCATGCTCGACTCATAGGCGTCGAGTATATAGTGTC
GGAGCGTCTCTTCGGGACGCTGCCGGACGAGGAAAAGAAGCTGTGGCATTCTCATTCGCATGAGATAAAAGCCGG
ACTATGGACTCATCCTACCATACCCGAGATCTTGAGAAGAGCGAGCTCCAGAAGCTAGCACCAACTTACGGCAA
GTTCTGGTGCACTTGGCAGTTCGATCGAGGTGACAGGCTTCCAATGGGTCCTCCAGCGCTGATGATGTCTCCGCA
GCCGGAGTGCCCGGTTGATCCGCAGCTCGTCGCTACCAGAGACGCAAAATACGACTTCTCTACGAGCGGAAAGGC
TGATGCGAGACGAGACATCCCCGGGCTTTcccGTGTGGATCCTCTGGCCGATCACTGGAGGGCGAGaggc > SEQ ID NO:1143 216228 251986_301662_1
GAGGAAAGGAAGAATGGCTGCTGCTGGGCCGGGACCTGTGGCGACGAAGGACTATCTCCCTGGCAGGGAGAAGGA
GACCAAGAGCAAGATCTTGGAGACCACAGCTTCGGTGCTCCAGGGCTTCGCCCCGATCAAGAAGATCCATCAACA
CCTTTGCGCGTAAGTTCTCTATGCCTTTGCATGCAAGACCTCTTCGTTCTTGTTGTTTCGCTTGATCCAGCTTCC
ACTGCTATGGAAACAACTTGAGCCGCCAAGTCGAAGCTCACCACTACTGCGGCCATGTAAACGAAGACCTGAGGC
AGTGCGCCATCTACGACACGGATGCCGCAGATGCGAGGCTCATCGGGATCGAGTATCTCATCTCCGAGTCTCTCT
TCCGGGGCCTCCCGGACGAGGAGAAGAAGCTCTGGCACTCTCACGAGTACGAGGTGAAGAGCGGCATCCTCTTCT
GCCCGGGGCTGCCGGAGGTTGCCGAGCATGCCGAGCTTTCCAAGGTTGCCAAGACGTATGGCAAGACGTTCCACT
TCTGGCAGTTTGATCGCGGTGACGCGCTGCCTCTGGGACCTCCTCAGCTCATGATGTCCTTCACGAACGACGGTC
AGGTCAATGAAAGCATGGCGAAAGTCGTCGAGGAACGGTATGGTGTCTCGTTTGAGGCCAAGAGGAAGAAGCGAG

Figure 2 continued

CTGACATCAAAGGACCGGATTTCGGCATTGATCCTCAGGCTGACTACTGGcagaagggaaaaGGCTTCGAGACTG
tt

> SEQ ID NO:1144 216228 242633_301331_1
GAAGAGAGAAGAGGAAAGGAAGAATGGCTGCTGCTGGGCCGGGACCTGTGGCGACGAAGGACTATCTCCCTGGCA
GGGAGAAGGAGACCAAGAGCAAGATCTTGGAGACCACAGCTTCGGTGCTCCAAGGCTTCGCCCCGATCAAGAAGA
TCCATCAACACCTTTGCGCCTTCCACTGCTATGGAAACAACTTGAGCCGCCAAGTCGAAGCTCACCACTACTGCG
GCCATGTAAACGAAGACCTGAGGCAGTGCGCCATCTACGACACCGATGCCGCAGATGCGAGGCTCATCGGGATCG
AGTATCTCATCTCCGAGTCTCTCTTCCGGGGCCTCCCGGACGAGGAGAAGAAGCTCTGGCACTCTCACGAGTACG
AGGTGAAGAGCGGCATCCTCTTCTGTCCGGGGCTGCCGGAGGTTGCCGAGCATGCCGAGCTTTCCAAGGTTGCAA
AGACGTATGGCAAGACGTTCCACTTCTGGCAGTTTGATCGCGGTGACGCGCTGCCTCTGGGACCTCCGCAGCTCA
TGATGTCCTTCACGAACGACGGTCAGGTCAATGAAAGCATGGCGAAAGTCGTCGAGGAACGGTATGGTGTCTCGT
TTGAGGCCAAGAGGAAGAAGCGAGCTGACATCAAAGGACCGGATTTCGGCATTGATCCTCAGGCTGACTACTGGC
AGAAGGGAAAAggcttcgagactgttgtcaaggAGATGGTGt > SEQ ID NO:1145 216228 181719_300627_1
GAATTCAAGCCAATGTCAGTCGGTCAACATATGTTGGACAAAGGAGCAGCTATGCTTCAATCTTTGAAGCCTATT
AAAATGATGCAGCAACATGTATGTACCTTTGCTCTTTATAGTCACGACATGAGTCGTCAGATCGAAACTCATCAC
TTTGTCACCCGTATCAACCAAGACTTCCTTCAGTGCGCTGTTTATGACTCTGATTCTACCTCCGCTCGCCTTATC
GGAGTCGAATACATAGTATCAGATCGGATCTTTGAAACTTTACCAGCTGAGGAACAGAAACTGTGGCACTCTCAT
GCATATGAGATTAAATCTGGCTTATGGATGAATCCAAGGGTTCCAGAGATGGTACAATCGAGAGAACATGAAAAT
CTAACAAAAACATATGGTAAATTTTGGTGCACTTGGCAAGTAGATAGAGGTGATGTGCTCCCGTTGGGTGCGCCA
TCCTTGATGATGTCTCCACAAGGAGTACCCACGGGAATGGTGAAGCCAGACTTGGTGCAGAAAAGAGATGAGAAG
TACAACATTTCAAGTGAAGATCTGAAGAAATTGAGATT > SEQ ID NO:1146 216237 208607_300807_1
GACAGCCTGAAACCGCGAGTACAAGCATGGGGTTGGAAGCTCGACGTGTGAGCTCTCCTTTCGTCTGCCGTCAAA
AAGTCGATGCCAAGGAGGGTATTGCAGATGTGTTGTTGGCCATCAGCTTACCACTGGAGAGATCCAAGCAGTCAT
CCCGTGTGCAGGCACAAGCCCAGTAAGCCGCTGCTCCCAATATGGACCACGTCAGCCATGCCGCCAACCGAGTCC
CTCACCGTCTTCCAAGATGGAGATGCTGTAGGGCTCACCCAGCGGTCGAAACATACCGCCTGTCTGAGGCCCCCT
CCAGGGCATTTGCTAGCCGACCTACTGTACTCGTGTCTCGTACACGGCAGTCGAATTGGTATACCTCCTCCGAAG
CTGGTTCGTCATGCGCATGAAAAGGGTGTAGCGAGCAAGACTCAGCCGGCCAATCACGAATATCTCGGGCATCCT
TGTCCGTCCAGGAATAGGCACACCACTCGAAATTAAGCT > SEQ ID NO:1147 216251 208672_300807_1
TCTGCACAACCCTGTTGGGAGCGCCTTGTTGGACTCGGTACCCCACGCATCACGAGCGTTTCCTCCATCCACTTG
TCACCCGTGCTTGTACGAGTATGGAGTGCCTTTATCTTGAACAACACTGAACGCAACATAAATGCCTCTCCCGGC
GGCTGGCACAGATTCCCCAGCTTCGGCCTGGGCTGCACTCGTTGCAAACGGCTGAATATCTTTGCACTCCTCCAA
ACGAGCAAGGAGCCGGATATCTTTGCGCAGGCTCCAACAGCCAGCACTGAACCGGGGCTTCGTTTCCACCGATG
AAATGTGCACTGTCGAATGCTGCTCACGATTGTCATATGTTATCCGTTCATGTGTGTCTACTTGCATCTCATCTG
TGCACTGTAGTGCTGTCCTCCTCGTATCAAACGTCCACTTGTCTGGATTGCGTAATCCGAGACGGCAAGCGAATT
TTCGGATGAATGGTGGTATTTTGTATCGGATGGTTCTGGTATAGGTTACCTCGCTTTGAAAGCGTATAAATTCAT
CTCCTCTCTGCATG > SEQ ID NO:1148 216262 218530_300919_1
AGGGACTGCTGCTGGCGGCCATCCGAAGCAATGACCCCTGCATCTTCATGGAGCCCAAGATCCTGTACCGAGCCG
CCGTGGAGGAGGTCCCCGTGGCGCCGTATGAGTTGCCTCTGTCCAAGGCGGAAGTCATCAAGGAGGGCAAGAACG
TCACAATTGTTTCATATGGTCAGCCGTTGTACAACTGCATGGCGGCCATCAAGCAGGCAGAGGAGGATTTGGGCA
TCTCCGTCGAGCTGATTGACCTGCGCACAATCTATCCCTGGGACAAGAAGACTGTGTTTGAAAGCGTTCAGAAGA
CTGGAAGAGTCCTGGTCGTCCATGAGTCTATGGTGAACGCTGGTGTTGGTGCCGAGGTGGCTGCCGCCATTCAAG
AGAACGCAGATACCTTCAACAGGCTCGAGGCTCCCGTGTCTCGTGTTGCTGGATGGAGTATCCACAACGCTCTGA
TATTCGAAAAGTTTCACGTCCCAGATGTTGCAAGAATTTACGACAGTATTAAAAAGACGGTTCAGTACTAAGAAT
GTGGGGAGCGAGTAACGTGTGACTTTATCTTTGAATTTCTAGAGCTTCTTCCTAGCATAAGTGTAAATAATAGAG
AATAAAGCTTTCTGTAACACAC > SEQ ID NO:1149 216268 103453_300026_1
tggtatcaacgcagagtgccattacgccggggactcacaacagaaatagctactaaacaaacagcAAAAGATAAC
CAGAAAAGATGGCGACTTTCCCTGTTGTTGATTTGGGGTTGCTTCAAACTGGGAAAAGGGCTGAAACATTGGATA
AAATCAAAGATGCATGTGAAAACTGGGGTTTCTTTGAGCTTGTGAATCATGGGATTTCCCATGAAGTGCTGGACA

Figure 2 continued

CAGTTGAGAAGCTTACTAAGGAGCATTACAAGAAATGCATGGAGCAAAGGTTCAAGGAAATGGTGGCAAGTAAAG
GTCTTGAGGCTGTCCAAACTGAGATTGATGATCTGGATTGGGAAAGCACTTTTTACTTGAAACACCTCCCTGTTT
CCACTGTGTATGAAGTTCCAGACTTAGAGGATAAATACAGAAATGTTATGAAAGACTTCGCGTTGAGGCTAGAGA
AACTAGCTGAAGATCTTCTTGATTTGCTGTGTGAAAATCTCGGGCTCGAGCAAGGTTATTTGAAGAAAGCATTTT
ATGGTTCAAAGGGTCCAACTTTTGGTACCAAAGTTAGCAACTATCCTCCTTGCCCCAAACCAGAACTGATCAAAG
GCCTACGTGCTCACACTGATGCTGGTGGCCTAATCCTGCTTTTCcAAGATGACAAAGTCAGTGGTCTTCAGTTAC
TGAAAGAcggtaATTg > SEQ ID NO:1150 216268 11073_300288_1
CTCGAGCTTGCGGCCGCCAAGCTCAATGGGGAAGAGAGAGACCAAACCATGGCTCTAATCAATGAAGCTTGTGAG
AATTGGGGCTTCTTTGAGATAGTGAACCATGGATTACCACATGACTTAATGGACAAGATCGAGAAGATGACAAAG
GACCATTACAAGACATGCCAAGAACAAAAGTTCAATGACATGCTCAAGTCCAAAGGTTTGGATAATCTTGAGACA
GAAGTCGAAGATGTCGATTGGGAAAGCACTTTCTACGTTCGTCACCTCCCTCAATCCAATCTCAATGACATTTCA
GATGTGTCTGATGAATACAGGACGGCCATGAAAGACTTTGGTAAGAGACTGGAGAATCTTGCTGAGGATTTGTTG
GATCTACTGTGTGAGAATCTAGGGTTAGAGAAAGGGTATTTGAAGAAAGTGTTTCATGGAACAaa > SEQ ID NO:1151 216268 128550_300476_1
AAAATACATAGAAAGATGGAGAGTTTCCCAGTGGTTAACATGGAGTTGCTTAACACTGAACAAAGGGCTGCAACA
ATGGAGAAAATTAAGGATGCTTGTGAGAACTGGGGCTTCTTTGAGGTGGTAAATCATGGGATCTGTCATGAGCTT
CTGGACACAGTGGAGAAGTTGACAAAGGGACACTACAAGAAGTGTATGAACAAAGGTTTAAGGAAATGGTTGCA
AGTAAAGGGCTTGAAGCTGTTGAGACTGAAATAAAGGATTTGGATTGGGAAAGTACTTTCTTCTTGAAACACCTT
CCTGTTTCAAATATCTCAGAAGTTCCTGATCTTGAAGATGAATACAGGAAAATCATGAAGGAGTTTGCTGAAAAG
CTAGAGAAATTAGCAGAGCAACTTTTGGACTTGCTCTGTGAAAATCTAGGACTGGAGCAAGGTTACCTGAAGAAA
GCCTTTTATGGTTCAAATGGTCCTACTTTTGGCACCAAAGTTAGCAACTATCCACCATGTCCCAAGCCTGATTTG
ATTAAAGGCCTTAGGGCTCACACTGATGCTGGTGGAATCATCCTTCTATTCCAAGATGACAAAGTCAGTGGTCTC
CAACTACTCAAAGACGACAAATGGATCGACGTTCCACCAATGCGCCACTCCATCGTCATCAACCTCGGagaCCAA
CTCGAGGTGATTACTAATGGAAAGTACAAGAGTGTGGAGCATaggGTGATTGCTCAGCCTGATGGAAaCAGAATG
TcCctagcttCAttctat > SEQ ID NO:1152 216268 132569_300447_1
AAAAAGATAGGATCTGTCTGCTATTATTATCTAAGTCTGTTTAGGTTTTGTGTTTTTTATTACTACAACAACATA
ATGACTATTCCGGTGATTGATTTCTCAAAGCTTGATGGAGAGGAAAGAGCCCAAACTTTGGTTCAGATTTCCAAA
GGTTGTGAAGAATGGGGATTTTTTCAGTTGGTGAATCATGGGATACCAGTGGAGCTGCTTGAGAGGGTGAAGAAA
GTGTGTGCAGAATGCTTTAAGCTGGAAAGAGAAGAGGCTTTCAAGAATTCAACACCAGTCAAGTTGCTTAATGAG
CTAGCGGAGAGCAAGAAGAGTGGCAATTATAAGGTTGAAAATGTGGATTGGGAAGATGTCTTCCTTCTCACTGAT
GACAATCAATGGCCCTCCAACACTCCTCAATTCAAGGAGACAATGAAAGAATATAGATCAGAACTGAAGAAGCTA
GCAGAGAGTGTGATGGAAGTAATGGATGAAAACTTAGGCTTACAAAAAGGGTCAATCAAGAAAGCCTTCAATGAA
GGAGAAGGTGACAATAATGCTTTTTTTGGAACAAAAGTGAGTCACTACCCACCTTGCCCTCATCCAGAAATGGTG
AATGGCCTAAGAGCTCACACTGATGCTGGAGGTGTGATTCTACTCTTCCAAGATGATCAAGTTGATGGCCTTCAA
ATCCTC > SEQ ID NO:1153 216268 141827_300429_1
ccccgacttcctcACTAGATTCTTAATACACAACCCAGCTGGTGAAAGAGAGGAACTTGAGAGTTAGCTAGCATG
GCGGCAGCATTGTCGTTCCCGATCATCGACATGAGTCTGCTCGACGGGGCAGAGAGGCCCGCGGCGATGGGCTG
CTCCGCGACGCATGCGAGAGCTGGGGCTTCTTTGAGATCCTGAACCACGGCATCTCGACGGAGCTGATGGACGAG
GTGGAGAAGATGACCAAGGACCACTACAAGCGTGTGCGCGAGCAGAGGTTCCTCGAGTTCGCGAGCAAGACGCTC
AAGGAAGGCTGCGACGACGTGAATAAGGCGGAGAAGCTGGACTGGGAGAGCACCTTCTTCGTCCGCCACCTCCCG
GAGTCCAACATCGCCGACATACCCGACCTCGACGACGACTACAGGCGCCTCATGAAGCGCTTCGCGGCGGAGCTG
GAGACGCTGGCGGAGCGGCTACTGGACCTGCTCTGCGAGAACCTCGGCCTCGAGAAGGGCTACCTCACCAAGGCC
TTCCGTGGCCCCGCGGGCGCACCCACCTTCGGCACCAAGGTCAGCAGCTACCCGCCGTGCCCGCGCCCCGACCTC
GTCaagggCCtccGCGCCCACACCGACGCcggcggcATCATCcTGCTCtTc > SEQ ID NO:1154 216268 124507_300423_1
GTAATATTCGCTATTCTATTAATTTATTGTATCACATTTTTCACACACTCAAAAATTAAACACATATTTTACCAA
GAAAGCTATGGAGAACTTCCCAATTATCAACTTGGAAAAGCTCAATGGTTCTGAGAGAGCTGACACCATGGAAAT
GATTAAAGATGCTTGTGAGAACTGGGGCTTCTTTGAGTTAGTGAACCATGGTATTCCACATGAAGTAATGGATAC
AGTGGAGAAAATGACAAAGGGACATTACAAGAAGTACATGGAACAGAGATTTAAAGAATTGGTGGCTAGCAAAGG
TCTTGAAGCTGTGCAAGCTGAGGTTACTGATCTTGATTGGGAAAGCACTTTCTTCTTGCGCCATCTTCCTAATTC
TAACATTTCTGCAGTACCTGATCTTGATGATCAATACAGGGAAGTAATGAGAGATTTTGCTAAAAGGTTAGAAAA

Figure 2 continued

```
TTTGGCAGAGGAGTTACTGGAGTTGCTATGTGAAAATCTTGGCCTTGAAAAAGGCTACCTGAAAAAGGTGTTTTA
TGGGACAAAAGGTCCCAATTTTGGAACTAAGGTTAGCAACTATCCTCCATGCCCAAAACCAGATTTGATAAAGGG
ACTGCGCGCCCACACAGATGCaggtggtATAAtccttCTCTtccaagatGACAAAgtaagtggccTtcaacTcct
c
```

> SEQ ID NO:1155 216268 44156_300443_1
```
GCCATTACGGCCGGGGTTCCAAACTTGGAGGATAAATGGGGAAATGTAATGAAGGACTTCTCGTTGAATCTGCAA
AAACTAACTGACGATCTTCTTGATATGCTGTGTGAAAACCTCCAACTCGAGCACGGTTATCTGAAGAAAGTATTC
TATGGCTTACAGGGTCCAACTTTAGGTACCAAAGTTAGCAACTATCGTCCTTGGCCTAAGCCATAACTGATCACA
GGCCTACGCGCTCACACTGATGCTGGTGGCCTAATCCTGCTGGTTCAAGACGACAAAGTCAGTGGTCTTCAGTTA
CTGAACGATGGCAAATGGATTGATGTCCCACCTATGAAACACTCAATTGACATCAACCTTGGCGACCAGCTCGAG
GTGATAACAAATGGAAGATACAAGAGTATTGAGCACAGAGTTATT
```

> SEQ ID NO:1156 216268 43466_300031_1
```
cccacgcgtccgcTTCATATCTTCTTATTCATACACTAAATAAAAGCACATTTCTTCAATTCATTCTGCAAGAAA
GATGGAGAATTTCCCAATTATCAACTTGGAAAAATTAAATGGTTCTGAAAAAGCTGCCACCATGGAAATGATTAA
GGATGCTTGTGAAAACTGGGGCTTCTTTGAGTTGGTGAACCATGGAATCCCACATGAAGTAATGGACACAGTTGA
GAAATTAACAAAAGGGCATTACAAGAAATGCATGGAACAGAGGTTTAAGGAATTGGTGGCCAGTAAAGGTCTTGA
AGGTGTACAAGCTGAGGTTACTGATATGGATTGGGAAAGCACTTTCTTCTTGCGCCATCTTCCTGTTTCTAACAT
CTCTGAAGTCCCTGATCTTGATGATCAATACAGGGAGGTTATGAGAGATTTTGCTAAAAGATTAGAGAATTTAGC
AGAGGAGCTCTTGGATTTGCTCTGTGAAAATCTTGGTCTAGAAAAGGGATACTTGAAAAAGGTATTTTATGGATC
AAAGGGTCCAAATTTTGGGACTAAAGTTAGCAACTATCCACCATGCCCAAAACCAGATTTGATTAAAGGACTGCG
CGCCCATACGGACGCTGGTGGCATAATCCTTCTCTtccaagaTGACaaagTAAGC
```

> SEQ ID NO:1157 216268 267836_200119_1
```
CCCCTCGACCACGCGTCCGGGAGATTCCGGTGATAGACTTCAGTAAGCTTGACTGTGAGGAGAGAAGTGCAACCA
TGACACTTCTCCATCACGCTTGTGAGAAATGGGGCTTCTTTATGATAGAGAACCATGGAATTGACACTAACCTGA
TGGACAATGTGAAGCAGTACGATAANTAGCACTATGAAGCCAATATGAAGAAACGGTTCTATGAATCAGAGCTAC
CTATGAGCTTAGAGAAGAAAGAAAAACTCAGCAACACAGACTGGGAAAGCACCTTCTTTCTTTGGCATCGTCCAA
GTTCTAACATCTATGAGATTGAAGGTCTCTCAAAGGATCTTTGCAACGCAGTAGATGGATACATTGATCAGCTGA
TTAATCTTGCTGAAAATCTTTCAGAACTAATGTGTGAGAACCTTGGCCTAGAGAGGAGTTACATTAAGGAAGCAT
TTTCAGGAAGCAAGGGTCCTTCTGTTGGAACAAAAGTGGCAATATATCCTCAATGTACGCGCCCTGAATTAGTCA
GGGGATTGCGTGAGCACACAGATGCTGGTGGTATCATTCTCTTACTCCAAGACGAACAAGTTCCTGGTCTGGAAT
TCTTTAAAGATGGACATTGGGTGAAAATTCCACCTTCCAAGAACAACAGAATTTTTGTAAACACTGGTGATCAAA
TCGAAATTTTAAGCAATGGGAT
```

> SEQ ID NO:1158 216268 176055_300524_1
```
GACACACAGACGCACTCACACACTCAGCTTAAGCGAGCGAGCGAGTGAACGAGAGAGAGAGAGACAGAGATGGCGAG
TGTTGCCTCCTTCCCGGTGATCAACATGGAGAACCTGGAGACCGAGGAGAGGGGCGCAGCAATGGAGGTCATCCG
CGACGCCTGCGAGAACTGGGGCTTCTTCGAGATGCTGAACCATGGCATCGCGCACGAGCTGATGGACGAGGTGGA
GCGGGTGAGCAAGGCGCACTACGCCAACTGCCGGAGGAGAAGTTCAAGGAGTTCGCGCGGCGGATGCTGGAGGC
CGGCGAGAAGGGCGCCGACGTGAAGGGCATCGACTGGGAGAGCACCTTCTTCGTCCGCCACCGCCCCGTCTCCAA
CCTCGCCGACCTCCCCGACGTCGACGACCACTACAGGCAGGTGATGAAtcaaTTTGCgTcGGAgaTCGAGAAGCT
CTCGGagaGGGTgcTGGACCTGCTGTGCgagaATCTGggCCTGgagaagggtTACCT
```

> SEQ ID NO:1159 216270 208805_300809_1
```
TGCTATTCAAACCCGTCGCCCGACGACCTCCAGATTCAAAATGTTTGCCCTTTCAGAAGAGTCCAAGGAGCGCAT
TGCCAAGCTCATTGACATTTCTCGAGTCGCCATTCACTATGGCTACCTTCCTCTGATTCTCTACCTCGGCTACAC
CCGCAGCGACCCCCGACCTTCAGTCATCCGCCTTCTCTCTCCTCTTTCCTAAACGCAAACACAGACGGACATGCG
ATGTTGTACGATATACGATTATAATACGGCTCAAGGGCACGGGAAAAGGCATGCAACAAGAAGAGGCGAACAGTC
AGAGAGAAGCTCAACGTCCAGCATTCATCATGGCGTTTGGGTAATATGCACATGTCTTGGAAGAAGGCAGGACAG
GGCACGGGACGGGTGATACAATATGACGACAAGGTCGCCGAGAGGACGCAGAGGAGGACACCAAATGCTGCCATG
TACCAATAAGAATGTATTATCTACTGCTCCGTACTGTAATTGGACCAAGTAACCACG
```

> SEQ ID NO:1160 216277 172017_301608_1
```
GGACAGGGGAAGGGGGTGTTAGTTGCGATAGCCGATGTTTGCATGTGAAGGCCACTACTTTACCAAAAGAGGATG
CTGGGATGGCTGTTGCCGGTCGAGTAATTAATATGCATAATAGTATCCGCAGGTGATGAGGTGATTTTAATGTAT
AATTGCTAAAAAAAAAAacaaaa
```

Figure 2 continued

> SEQ ID NO:1161 216305 211845_300871_1
tgccggcgctgtaATCTTCTCTTCTTCACTCCGTTTTCTCTGGCTTGCAGATACAGAGTCGCTGTAAAAGAAAAG
AGGAAAGGGAGAAAGGAGGAGCATGCCTTCACACAGCTTCACCACGTCCAGGTGGCTTGCGCCGCCCATCCAGTT
CGCGTCCTTCAAGTCGCTCCTCGTTATTCCCATCATCCTCTCCGTCGGCACCTTTGTCGCTCTCTTCGCCCATTC
CGACGTCGACATCGCTTTACTGTGGTCGCAATGCCACTCCCGCGCCCGCATCCCCGGCCTCAGCCACATCCCGCT
CATCGGCACGCCGAGCTGCTTCCTCGTCAGCTTCTTCCAGTGCGCGCTGGACTCGCTGCGGTCCAAGGCCGTCAT
GGCCGTGATTCTGTCGTATGTTGGCGCGCTGGCGACTGTATGCACCGTGGAGTCGGCCAGGCGCTGCAACAAGCC
TAATTCGCTGATTGCGAAGCCCACGCTGTGGTGGCTGTTGTTCAACTTGCTGGGAGGCGCCATGGTCTGGCAGTT
GGTGATTGTGCCGGCGTTTCTGCACCGGGCcaAGGCGCTGGTGCTCGcGGAGAagCACAGCCAGGGAACCGGTGG
TGAagattcgaCTGTGGCCGCGGCtgagctttgaagatattagTGAGGAgggccgcACGCTGCCAGACtccgagg
cCGTGGCGATCCCcattgccgttgCTgc > SEQ ID NO:1162 216319 210561_300890_1
AAACCACCGTCATCATGCCTCCAGCAAGCTACTCGCGCCCGCCACAACACGACTCGTGGTTCGCGCCTCTATCCG
TCGACCTGATCCTCAAGGTTCTCAACGTCACCATCTTCCATCCCTTCATCTGCTGGCTGATCCCGCTGTGCCTGC
GCGCCCAGACGACCAAATGGGAGGCGCCGCCCATGGTGGGCGCCATTGCCTGGGCCATCTTCATCTCGGCCATGT
GGATCGCGAGCGCGGTCAACCAGCGCATTGCCAACGGCGCGCCGCGCGAGGTGGACCTGGGCGAGGAGGTGATTG
TGGTGACGGGCGGCGCGAGCGGGCTGGGCATGCTGGTGGCCGAGGTGTACGGCATGAGGGGCGCCAGCGTGGCCG
TGCTGGATGTGAACGAGATGGAGAATGGCGAGGCGAGGGGCGTGACGTTTTACAAGTGCGATGTGAGCGACAAGG
AGCAGGTGGCCAAGGTTGCCGTTGAGATTGAGAAGGATCTCGGTACGCCTACTGTGCTCATTAACAACGCTGCTA
TTGTCGTGGGCAAGCCGCTGCTGGACCTCTCCATCGATGAGATCGAGaccAGCATCGGCACCAACCTCCTcGgcc
CCTTCTACT > SEQ ID NO:1163 216320 210593_300890_1
GTCTATCGTTAATACAGCAAGATGTATGATGTGGTATCGAAACAAGGACAAGAACAAAGAGAAGAAGAAGTCGTA
AAGAGACTGAAGTGCTGTTTGAGCTGGTATCGTTGACTGGTTGTATGTAGTGTAGCAAAGTTGTGACATATGAAG
AGATGAAGCAGAGAAGGGTTCCGTTGTTGCTCAAGACGTTCGGGGGGTGGCAGCTTTGATGAGTGGCCGCCCGCC
CAATTACAGCTACAGCTACCAAGTACGAAGTACCAGACCTTACAGCATCGACACGACATGAATGCATGTACCTGC
TGGTACAGCGACGGCCCTGGCGCTGGTTGTCAGTGACTCGATAACGCGGGGGGAGGAACAGAAGGTTCCAGGTCC
GCTGGCCGGGCCTTGCAGTGGCAGCTGTTGGGGGGCGTGATTCCGCCAAGGGGGGCCGAAGGGGGGTCGCATCCC
AGCCTGCGAGGTCAGAGGGGGAGGGGCGTGCCGCGTACAGTGACggCGAGGTACTGGGCTGgCAGAGGTGACGG
AACAGTgGtcagcggCcacAGgGgcaaacAGCgctCGCGgcaGcgcTAatctcagCTGgGCaAACCTgcaggctt
gtgctcCTATgTACATAGcct > SEQ ID NO:1164 216329 214955_300876_1
TTGACCGAAAGCCGTCTTTAACCCTCCCCCCAGCTGCACGAAAGCGGAGGATAGGCAGCCGGAACGGAGATCTCT
TCCCAAAGCTGGACCAAAGGGCAGGGCGCGCCAAGTACGGAGCTTGTGCACTGCCGTCCCAAGTACCTGGCAGCC
TGGCAGTACCTCGGACGCACGCTGCCTGCCCCTCACCACGCGGAGTATCCAGGTACCTCGGTGTGCAGGTGCAGG
CAGCTCTCCCTGTCCTGCAGGAAAATGCAGGATAGAGGAAAGACCCGGAGACAAGTCTGGTGATTCTGGTGATTC
CATCCTGCCGGGGGTCAGGTTTTTACATAAGGCACTCTCGACTTCCATCTTATTTCCCCACTCGATCCCGATCTC
TCTCTCTCTTGCACCAGCAGGGAAGGAGTGGGCGACCCCGAAAAAAAAAACAATTAGAAAAAAAAAAAGAAAAAA
AgaGGCGAACGAAGGAACGagCGAACGAgCGTCGTCGAGAaggcgCgAACAAggagAACGGagCCTGCGGGGTAC
CTTGGTGGACTTCCTGAc > SEQ ID NO:1165 216338 205090_300795_1
aattGACGACCACCAGCGCCGCCAGAATGTTCGCCGCACGATCAAGGGCAGTCTGCGCCGCCCGCCAGCTGCAGC
GGACAACCCGAACCTACGCCTCCGAGTCCCACGGCCACCACTCGCCCGCTCCGGTCAACGAGTCCTTTGGGGCCG
GATCTGTTATTGCCCTGGGCGCTTTCCTGGGCACCGTCCTAGTCTACCAGTTCCGCCCCACGGAGAGCGACAACT
GGACGCCCTCTGCCCTGCTCAACAAGTATCGATCAAAGGCCGAGGACTGGGAGGCCGTCAACACTCTGCACACAA
AGGCCATGGAGCAGGCCGGCTATGACAGGAATCTGTTCGAGAACGGCTCCAACAAGCACCGATTTGTCGACGTCG
CATACCCCGAAGCTCTCCAATCCCACGCCGCGCGAAACATCCAGGCCGGCCACCTTGCCAACATTGACCATGCTG
TGGAACACTACCGACAGCAGCACCTGAAGATGGAGGAGAAGAAGGCGGCCAAGCTGGCGGCTGCCAAGGCAGAGT
AGTTGCAGTTGCTACAGTATATCCAATTTATAGAACAAAGTTTGCAACACATTGGGGCCAaTTCaatgcgTGATA
ATGATTCCAGTTgccggatgtaCCt > SEQ ID NO:1166 216345 214316_300857_1
gaaaactcaaaattaaattaaacataaagacaggctcccaaaaggctgtgacctcttcttattacatctttacaa
gcctcCATAGCGTAAGATTCCCTCCACAAGGGTCGGGCTGATTTTATCCTGTCGGAATAATCACTTGCGTAATTC
GACGTCGTTTCGCTCGCTTCTTACGGCAAGCCTACAAATCCCATTCCGGCAGCGAGCTCGCCTGGCGCGTGCCAA

Figure 2 continued

AATACGACGACCGAAAACACCAAGTGCATGTGCCAACGGTGATTGGATTTGTGCGCTCCGAGATACCCAAACCAA
AAGTACATGTTAGGATGCACGCGACCACGCCATGATCGGCGCTTGATCACGGGCCCATAATCGAGAGAGAGGCGC
CGCTACCGGACGATAGAACGGAGGGAATAGACAGATAGACGATAGACGGGACGAGCGATCGATCAAGTCAGAGAC
AACAAATACCGAGTGGCGATGCCTTCATCCGATAGTCTTGGGAGGCGGGCCTCACACGGCGCTGCCAGCCTGGCG
ACGTCGGCATCTTCTATACACGGCGCAGCAGTTGGGTTTCGAGAAGGCCTGGGCTTGGCTGGAGTTGCGAGGAGG
ACGTTGGGAATCTGCTTTCTGCTATTGACGGTGTTTCTATGGACGCTGTCCAACTTTCTCGCCAGCTTTATCTTT
TCCGATGCAACCTACGATAAGCCCTTCTTCCTCGTCTACTTCAACACCTCCATGTTCGCCATCTCTTTAATACCC
ATGTTTGTACGATATCTGCTCCAGAAAGGATTCCATGGCCTACGAAGCGACGTCAGGCGCATGTGGGCGGAGCAT
CGATACCAAGCCGCCCCAGGCAGTCCCGCGATAGATAAAGAAGATCACCTAGCTCAAGAACGCTTGCTAGTAGAC
GAACGAGACCCCATGGCACCAACCTCGACTCCTTCAAAAGAGAAGCTCAGCTTCCGAGAAACCGCAGTACTGAGC
CTTGAGTTCTGCATGTTGTGGTTCCTCGCAAACTATTTtgCGTCTGCATGTCTCgagtatAccag

> SEQ ID NO:1167   216351   211247_300897_1

ACAGAATATCATGTTTCAATCCAAGCAAAACATAACGGGTGTCAATGGAGTCGTCAACAATACAGTGACGACGGG
TAGAGAAGCTGAAATCATTCTCAACCATTGGCTGGATTCCATGGACACCTTCGAAAACTGGTACGGCCACAATGA
GGAATTTGTGCATAAGCCGAAAGCACTTCCTCAACAGAAGCCTCCAGAGATAAATAAAGTTTTCACGATTAAGAA
GGAGGACTGGTATCTGGCTATTAAAGAATACCTACTAGTTGCTTATACTTGGTATTACTAGAAAGAAAACGAAGG
AGGCGAATGTTGTTAGCTGCCCTTATATAAGGCTTATTATAAGCGGCTTCCTAATgttcTAAAGCCAGTTAAACA
GTACTTTACTTATCTCAGTATTATCTCTGGTTTACCTGCGGTATGACTTAACCTTTGGGGTCTGGTAGTTATAGT
ATACTTAAATAGTGCCtgaagcTAGTTTACAGAAGGTAGTGATAGAGGATATAGAGTAATATtactggcTAAGAA
CTTTATTTTAACTAttAG

> SEQ ID NO:1168   216355   210774_300892_1

CTTGCATCTCGCCATAACTTTCATCTCAAACATAGCGGGTTGCTTCCTAGTCTGATAGCGGCAAAATCTCACACT
CAAGGTTTTACTGCGTATCCAGCATACTGCCTCCGCTCTCTCACACCATCTCACAAGACAACGTCAAAAAGGGCA
TCTTTTCACAGCACAGCAATAATGAGCGCTCTC

> SEQ ID NO:1169   216377   210776_300892_1

GAGAGCATCTGAGGCTGTACTGCAAAACACCATCCGCCATATGGTTATCGAGGCAAACCGTCACCAGCCTGCGCG
CTATGTAGGAAGAGGAAGATTAAGTGCGATCTCCAGAGACCAAGATGTTCACAATGCAGACGAGCGAAAGAAACG
TGTACAGGGTATCGTGATCTTATTGATGTGATATTCCACGATGAAACCAACTCGACCAAATCCAAAGCTCTTGCC
AGGATCTGTCGCGCTCAAGCCGAAGCCCATGCGGATAATAGTATTGCAATCAACAATGCCATTTCTTTGTGTTTC
CTGCCATACAATATTGACGAACAAACCAAATCGTATTTTGTCCATAGCTATGTCCTTATCCAAGAAGGCACTGCT
GGCTATCTATCCGGCGTGGCTCGACTGCTAGTTCGACCAGGCCTCAACAGCGCCTTGGAGGCGGCTATGGTTGCA
GTTGGTTCAGCGGGGATGGCGTGCAAAGAATCATCACCACTTCTGGAGCTGAAGGCAAGGCAAAGTTACGGCATT
GCTATAAATTACATCAATGAAGCGATCCACAACACGGCCAAGATAAAAGAGGCTGGGACGCTCGCCGCCATTCTG
GCACTTGGGCTTTATGAAGTCAGTGACATTCTGGCAGATGAAGTGTTCGACCTCATGTTCGTGTACATGCTGA

> SEQ ID NO:1170   216408   138763_300727_1

CGAGCAGAAGCCGCCGCCGCCGCCCGAAACCCTCGCCGCCGTCGCTTCTCCTCGGGGCGCAGCCATGGTGGCCGC
AAAGAAGACGAATAAGTCCACGGACAACATCAACAACAAGCTGCAGCTCGTGATGAAGAGCGGCAAGTACACGCT
CGGCTACAAGACCGTCCTCAGGACCCTCAGGAACTCCAAGGCGAAGCTAGTGATCATTTCTAACAACTGCCCACC
TCTTCGGAAGTCAGAAATTGAGTACTACGCTATGTTGGCCAAGGTCACCGTCCACCATTTCCACGGAAATAATGT
CGATCTGGGGACAGCCTGTGGTAAATACTTCCGTGTTTGCTGCCTCAGCATTATTGATCCTGGTGACTCGGATAT
CATCAAGACCACGGGTGAGCAGTAAGGATGAGCGGTTCCGCTGGCGCTTCAGATGCTGTCACACTGAGCTGTTCT
AGACATTGTAGTTGTTGCTGGACTTGATTTGGTCTCTCTCGTGTATCGAACAGCTTTTACCAGTCAACCAAAGTT
TCGTGGGAACATTGTTCTTGGATT

> SEQ ID NO:1171   216408   284756_200101_1

GGCCACTTCCCTTTCCCCGTTGTTTCAGAGTGTTTTTATCAACAAAAATGGCGACAACAGGGAAGAAAACGAAGA
AGACCCATGAGAGCATCAATAACAGGTTAGCTCTGGTAATGAAGAGTGGCAAGTACTCTCTCGGTTACAAGACCG
TTNCTAATACTCTCAGGAGCTCCAAAGGGAAGTTGATATTGATATCTAACAACTGCCCACCATTGAGAAAGTCAG
AGATTGAGTACTATGCTATGCTTGCTAAAGTTGGTGTTCACCATTTCAATGGATACAATGTTGATCTTGGAACAG
CATGTGGGAAGTATTTCCGTGTTTCATGCCTCAGCATCATTGACCCAGGTGATTCGGACATCATCAAGTCTCTAC
CTGGTGATCACTAAGAGATATTCACCAGGGTTTTGCTAAACCATTTTAGTGAGTTGCGAAAATCTGTACTATCTT
TTTATTCTTGTATTTCAGAGTTATACCAAGATTATAGAGGATGTTGGTATTATCTAGTTTTGGTGGTTTTATCAT
TTCTCCAGAAGTTTTGAGGTCAGGTACATTATGATTTATTCACAGATCAATTTCCCTTATACCATTTTGCTTTT
CAAAAA

Figure 2 continued

> SEQ ID NO:1172 216408 271222_200032_1
cgttatttattatgcatcttgactaccctcgaccacgcgtccgcccacgcgtccgcccacgcgtccgCGCCGTC
GACGCATTTGCCTCTTCCTATAATTTCCGACTACATATCTCCAGGCCAGAGCCAACCATGGTTGCTGCAAAGAAA
ACCAAGAAGACTCATGAGAGTATTAATAACAGGCTGGCTCTGGTAATGAAGAGCGGCAAATACACATTGGGATAC
AAGACTGTTCTCAAAACTCTTAGAAACTCCAAAGGCAAACTCGTCATCATTGCCAACAACTGCCCTCCTCTCAGG
AAGTCTGAGATAGAGTACTATGCTATGTTGGCAAAGATTGGAGTCCACCACTACAATGGAAACAACGTAGATTTG
GGGACTGCATGTGGTAAGTATTTCAGAGTCTGTTGCCTCAGCATCATTGATCCAGGTGATTCTGATATCATTAAG
AGCATGCCTGGTGACCAGTGAGATAGCAGCTGATGTTAGATCGCTCCAATGAACACTGCTCAATCATAGTGGAAC
TTTGCCGTTTTTCCTTATTGAGACAAATATCTAGTTTAGATGAGTTTTGCTACTTTGGTGATGTTAAAAGGAAGT
TTTGATGGTATTTGGAATCTTAATGACATCAATTTTTTTTCCTGGAGttttgaatcttcTaattgacTgtCATTT
gttgCTTA > SEQ ID NO:1173 216408 253632_301629_2
tgaccctagcaagaagaagaaGAAGAATATTAGTTCCATCTCTTTGCCGGAAGTTCAACAGAGAAGGCAATCATG
GTGGCCGCTAAGAAGACGAAAAAGGCCCAAGAGAGCATCAACAATAGGCTAGCCCTAGTCATGAAGAGTGGCAAG
TTCACTCTTGGATATAAGACCACATTAAAGTCTCTACGCGGTGGCAAAGGGAAGCTTATTATTATCTCCAATAAC
TGTCCCCCCTTAAGGAAATCAGAAATCGAGTACTATGCTATGCTCTCTAAAACTGGAGTTCATCAGTACAGTGGA
AACAATGTGGACTTAGGCACAGCCTGCGGGAAGTACTATCGGGTTAGCTGTCTTAGCATCACAGATCCGGTGAT
TCGGACATTATCAGAACTGTTGAATAGAGCTTAGAGAGGATTAAAGGCGGTAATGCTTATCATATTAGCTCATCT
CGAGGGGGCTTCTTTGGAAgacttGCATGAATTTCCCTAGTTTTCTTTTCTTGCTTTATTGGATCAGAGAAACCA
ATTAATATATATGGCTAAATTAAACATGGAAAATTAAATTTGTAGTAGCCGACTGTTTTGCCGTGTCATTGGTGT
TGCAAGTAAGGttctcgttTTTgTGCCAAAAAAAAAaaacaa > SEQ ID NO:1174 216408 237988_301290_1
GAAGAGAGAGGAGAGATCCAAGATGGTGGTCGCCGGGAAGAAGCAGAAGAAGACCCAGGAGAGCATCAACAACAG
GTTGGCGCTGGTGATGAAGAGCGGCAAGTTCACTCTGGGCTACAAGACGGTGCTCAAATCGCTGCGGAGTGGGAA
AGGCAAGCTCGTTCTCATCTCCAACAATTGCCCGCCGCTCCGCAAGTCGGAGATCGAGTACTACGCGATGCTCTC
CAAAACCAACGTCCACCATTACAGTGGAAACAATGTGGAGCTTGGTACCGCTTGCGGCAAGTACTATCGGGTCTC
TTGCCTTACCATCACAGATCCAGGCGATTCGGATATCATCAAATCCATGTCCGCCGAGTGAAAATCCATCCATCG
ATCAGCGCTCCTCTGTTTTGTTTCGCTGTTCAACTTCTTGTAGGCCTCTTACTCTAGAAATATGGAACTTTAATG
GAAAAACATTTCCTTCATAG > SEQ ID NO:1175 216408 217679_300910_1
GCAACCGCATCAATCTAATCGCAAGATCGCAGCTCGCGCCCAAAATCAGTCAAAATGGCCCCTCAGAAGAAGAGC
AAGAAGGATGCCAACAGCATCAACTCCAAGTTGGCGCTTGTTATGAAGTCCGGAAAGGTCACTCTCGGCTACAAG
TCTACTCTCAAGTCTCTGCGATCCGGCAAGGCCAAGCTGATCATCATTGCTGGCAACACTCCTCCCCTGAGAAAG
AGTGAACTCGAGTACTACAGCATGCTGTCCAAGGCTCCCATCCACCACTTCGCTGGTAACAACATTGAGCTCGGC
ACTGCCTGCGGAAAGCTCTTCCGCTGCTCCACCCTTGCCATCCTGGATGCTGGTGACTCTGATATCCTCAGCGAC
CAGCAGGCTTAAATAGCCGAAATCTAGTGCATTCAAAACGGCGTTGGGGTAAAACGGTTCAAGGGCAATATGGA
TACCATACACTTTCACATTATGTGCGAGACGAAAACTTTTGATGCGAGACATCATCTACTAGGAAGGCAAATCCT
TTGGGGATGGAAAAAAGCCCCAGAAATTTCCAAGTGATAGTTATCTCAATGGAATAATACAGCCATGAAGACTGT
TCCCCCTGTCaaaaaa > SEQ ID NO:1176 216408 206031_300804_1
TAATCGCAAGATCGCAGCTCGCGCCCAAAATCAGTCAAAATGGCCCCTCAGAAGAAGAGCAAGAAGGATGCCAAC
AGCATCAACTCCAAGTTGGCGCTTGTTATGAAGTCCGGAAAGGTCACTCTCGGCTACAAGTCTACTCTCAAGTCT
CTGCGATCCGGCAAGGCCAAGCTGATCATCATTGCTGGCAACACTCCTCCCCTGAGAAAGAGTGAACTCGAGTAC
TACAGCATGCTGTCCAAGGCTCCCATCCACCACTTCGCTGGTAACAACGTAAGTTTTGCAATCTCAGACGCCCTG
GACAAGTGAAGACCTGGAAACGGGTATATCTACTTGCGCCATTACACACTTCTCGCTTCTTTCAGAAGCTACTCT
TGCTACCCGAGAATTGCCAATTCTTGCGGAATTGCCCAGAGAAGAAGTCTTTCAGACTTTGGAGGGTTCACATTG
GCTTACATTATTCGTAAAACAGATTGAGCTCGGCACTGCCTGCGGAAAGCTCTTCCGCTGCTCCACCCTTGCCAT
CCTGGATGCTGGTGACTCTGATATCCTCAGCGACCAGCAGGCTTAAATAGCCGAAATCTAGTGCATTCAAAACGG
CGTTGGGGGTAAAACGgttcaagggCaaTATggataccataCACTttcACATTATGTg > SEQ ID NO:1177 216461 212130_300874_1
cccacgcgtccgcggacggggggcggacgcttgggttcgacagaagccgagttaagcggcgatagaagcaacaa
aggtgAAGTTGTGCCGGTCTGGTGGTTTATTGGAAAGAAACGAAGAGAAGAATGTTCCGGTCAAGGGAAGCGGCC
TTTGGTCAGTAGCCAAAGGGCAGATCAAGCGCCGCCTTGGAGGATTAAAAGGGCGGCTGCAGGGGTCCCAAGGCT
GGTGCGCCTCATGGAATTGTATCGAagaAAGTCGATGGTGTGGCGGTGCCCGATAACGCAAAAAGCTGGCAACCT

Figure 2 continued

TTGTGCTGCCATGCGGGCTAGCAGCGGGTACCGCCGAGTATTTGTTTGTCACTGTACAGAGGCGAGACGTGAGGC
CGAgatTCGCATTGGTTCGGAGTCTGGAGTAGGGAGGACAATATGGTAGCACGATTGTCATTGTGATTGCTTTGT
TTATTAGTACTTAAAAAAAAAAT > SEQ ID NO:1178 216463 211675_300901_2
GGCCAATATGTGGCCTGCATGCTGTTTCTGATACAAATCCTCGTAATGCACAGACGTGAATAGTGCTGGCACAAG
TCACATTGCTGCTGCCTTGAAGGGTTCCATTTACATTTTGGTGCAGCTCTACCAACCG > SEQ ID NO:1179 216464 211851_300871_1
GCCGTTCTCACCACAGCCTGCGCGCTCTGGCGCGGACCGGGCGCGCCTTGGGAGTGCGGATAGACAGCCCTTTGT
CGCAACAAACCGTTCGGCGGAAATCAGGTCCGTACGGCTACACTCAGGCCAAGGCTCTTGTCTTCTCCAAGAATG
GAGAGCCATCAGATGTACTACAGTTGCACACGTTTTCTATTTCGCCCTCGATTTCGTCCAAATCCCTTTTGTTGC
GGTCTCTTGCGGCTCCCATTAACCCTGCGGATATAAACACCATTCAAGGGACTTATGGCTCTCAGCCTAGCTTCA
CATCTTTAATAGGGACGTCTAGCCCGTCCGCCATCCCAGGAAATGAAGGTGTCTTCGAAGTTGTTTCAACGGGCG
ATCCGGCATCACCTATTCGCAAGGGGGATTGGGTCATCCCGGCAGTTGCGCAATTCGGCACATGGAGGACGCATG
CCGTTGCAGAGCTGGATCAGGTCTTGAAGATCGACAAGGAGGGACTGCGCGCGACTCAGGCGGCAACCATCTCTG
TCAATCCCAGCACAGCATATCGCATTCTGAGGGCATATGGCCCCAGCACTGGACTGGGAGGCATTGGAATG > SEQ ID NO:1180 216471 211746_300870_1
GAACAATGCAGCTGGTGACAGGTTTGTCAAGTGGCAGGGGAGAATCGTATTCGTGTGGCGATGGTGATGTCGAAT
TTCGAATGAGGGAGCCTTGGCGCGAAGAAAAAAGAAGAGAGAGAGAGAGCGGAGAGGAGAGGAGAGGAGAGTGAA
ACAAGGAGAAGTACAGAGGAGAGAGGAGAGAGACGCTGTGGTGCTAAGCAACCACGAGAGAGGAACATGAATGCG
GTTTACAAGGTTGACATTGGCGAACGAGCTTGGACCGCTTTGACAATGTGATGTGATGCAGGCTGGGTACTCCAA
ATGTTTCCAATTGAACGAATATCCAATCAGACAAGTAGAGA > SEQ ID NO:1181 216477 211763_300870_1
GCTGTACATACGTAATTGCAGCAGGGAAACGGGGGGGAAGGACAGCCGTCGGTGATGGGACTGTCAGGTTCACGG
CCACTCCCCGGTCTGGCTTCGCCTGGGCTGGACTCTTTCACCCTGTCCTCTGTCTAATGCAATGCCAGCCAACGG
CCACCGAAGTGCTGCATGTGCTTGCATACGTTGATGTCTCAGGGCACACACGGCATGCATACGAGTAGGTAGATC
C > SEQ ID NO:1182 216483 211975_300872_1
GTGGATGCGGTCGTCTCAGTTTACCTGTCCCATTTCTACTCATGCCATTCTTGTTTACCATCTGCATTGCTCTGT
CGAAAACCACAACTGCCTCGTGCCAAAAGTCATGACTCAGCAGGGAACAATTCGAAAGGCAGAACCTCAGCTAGA
ACGCCAGGCTTTCCTCCTATCGGGTCCATCAGCTTGATTCGGCAGCCTGCAATTGAATTGGCCATCATGTGGGT
TCCGATGTGCAAAAACCCGCAATTGGGGGACCTTGTGCGAAGCTCCCGCTCTGTACAGGCACGGGTACAGGTAGA
GGTACACGTTACATGTGTCACGGAATACGGGGGCACAAGAGACAGGCGGAGAAGCCGTCCCGAACGAGTACCTGG
CGGCGAACAGATGGGCAGAGACAAGTGTCGGAATAGCCGACCTTGCATCAGTCCTTACAGTAGCGAGCGTTTGCA
CAACGCTCTTGGTATTGCTCGGGAATAAAACGTCGAAGGAGGATGTCATCAACTTGTTGGCTCAGGCAAGGTATG
TACGAGTACCAAAAGGTTAAGCATAAGGCACTCGCAGTGCTGCTACCGGTTTGTATGT > SEQ ID NO:1183 219049 206063_300804_1
ATGGGATTGAATCGTCTTTGAGCCATGGTTGAAAAGTGCTTGGGGAGAGGAGATGGGGATGTGGATTATAGAGGG
GTTCATCGTATTAGCAATTTAGCCTAAATAGAGCTTTTGTCTCTGCTACTTTGAGGCGTTGCTAGCAAGCGGTAT
CTTGGCTCGGGATCGATGTATACAGTACTTGAGCCAAAGATGATATTGCTCTTGGCCATCCACAAAACTCCGTAC
GAGTACTCATACTTGATACTTCTCATCTCAAGTAATAGATGCCATGCCATAGAGGTAAGCAAGTCAACTTGAGGA
ACAGGGTATATACAGATTGCCATCGTTCATCTAAATTCTCTTCGTGCACCTCTTTACCTTTACATGCACCAATTT
GAGCACTACCTCCTCCCACTACCCCTGGCCACGAACCATCAACATCATCAGACAGCCAAGATAACGGCCTGACTG
CGGAGCCGGAACCAGACCCGGAGCAATGCCGGAGCAAGGGACTACGGAATATTCGCATGAGAGATCGGAGCC > SEQ ID NO:1184 219053 204916_300794_1
AACTAAACATCATTCTTACACTCTACTCTACATCAAAAGACCAGCATACAAACATTCACCATGCTTCTCAAGTCT
GTCCTCCTCACTCTCGCCATCTCTCTCGCCTCAGCGCAGAGCGAAGTCGGCCGGCCCTGCGGCTTCAAAATTGCT
CCCTGCCCCTTCGACATGAAATGCGTCGCCGACAACCCGTACTGCCCTGATCGCAACAAATGCCCCGGCCACTGC
GAGTTCAAGAACAAGTACGCCTCGTGCGGAGGCTTCACCCCGAGACCGCACAACTGCGACGGCAATCACGTGTGC
CAGGACGACCCTCGGCTGCCTCCAAACTGCGGCATGGCTTGCGATATTCCGGGAATCTGCGTTCCGAAGACTGCT
GAGTTTTGTGGAGGATTTGCGGGTTTTGCTTGTCCTGCGGGAAAGTATTGTTATGATGTGCTGGATGATTGTGAT
CCTGAGAATGGCGGTGCGGATTGCGGTGGCATTTGTTTGTAGAGAAAATTATCGATGCTTCAGGAAATGGTAAAG

Figure 2 continued

TGCAATATCATTCGCATCTCTATTCTATCATCGTCAAGACTTTAGAGGTAGTTATACAGTGATAGCCAAGAACGT
TGCTCTTGCAGATCTGAATTGGCCTGCATCTCCAT

> SEQ ID NO:1185 219080 206279_300820_1
AGCCGCGTGTGTTTGATGGAACCCCTCATCTTGCGGCATGGGGGATTGTCCTCAAGAGGCCATTGGTTGGGACGG
GCAGAAGAAGAGGCCATTGGTTGGACGATAGGCAGAGGAAGAGATTATTGGTTTTACGATAGGCAGAGGAAGAAA
GACGCCAAGTACTCTGTACTACCTCACAAGGTAGCAGTCCCTTTTTNTCCATTCCAACGTTCTGGGATCACCCAG
AACTGCCGAACGCAACCGCGCCCTTGCCCTGGAGATGGCGGGAGAGGAAGTGGTGTTGGTTGTGAGCGCCGCCCC
AAACGATGCCCCGTGCCGATACGGAGGGGATAGATTAGGTCGGTAGTCGGGGTGGTACTTGATAGACGTCAAATA
TCTGAATGAATCAGTAATATAATTGTTAAGTAGG

> SEQ ID NO:1186 219090 206542_300823_1
GTCCAATTAGGCATTGACAGCAAACCAATTCCCTCCATAACTGGGCCTCTTCACACCCGTACTCAGAATGACCGA
CAGAATATTCCGCATCTTTAACCCGGGAGAACCAAAGGGTGATCCCGTTGAGAAGAGGCGCGCTCAGCTGCGACG
TGCCCAACAATCTTATCGAGATCGCAAGGACAAGTACACCAAGGCGCTCGAGGCTGAACTAGCACGGTCTCGGAA
GAGCGAGGCGGGCTTGACGTTCCAGATCGAGCAGCTTCGTGTCAAAGTTCAGAAACTGGCCAGTCTCTTGTCCCA
AAATGGCATCTCACTTCCTCCAGATTTTGACAATGAGGAACAACTTCATGATGATGTACCGCGTATAGATTCATC
TCCGCTCACAACGCGTGGACAACCACAAACCGCTGAAGGCTTCCTATCAAGTACAGATTCAACCTCTCCTGAGTC
GGTGACGGACCAAGGAGCTATCTTAAATAGTGGAAACCGCACTCTACGGCAGTACAGTTCGA

> SEQ ID NO:1187 219159 190483_300818_1
ccgGTGATGCAGACCTTGGTCCAGTGATCAGCAAACAGGCTAAGGAACGTATCTGCAAATTAATACAAAGTGGTG
CTGATAATGGTGCTCGTGTGCTGCTTGATGGAAGAGATATTGTGGTTCCTAACTTCGAGAATGGTAATTTTGTTG
GTCCAACACTCCTTGCTGATGTTAAAAGTGAAATGGAATGTTACAAGGAGGAGATTTTTGGTCCAGTTCTTCTCT
TGATGAAGGCTGAGAGCCTAGATGATGCTATCCAAATTGTGAACAGAAACAAATATGGCAATGGAGCATCCATAT
TTACAACATCTGGTGTGTCTGCAAGGAAATTTCAAACAGACATTGAAGCTGGCCAGGTGGGCATCAACGTGCCGA
TTCCAGTACCCCTGCCGTTCTTCTCCTTCACCGGCAGCAAAGCCTCCTTTGCAGGAGACTTGAATTTCTACGGCA
AGGCGGGCGTGCAGTTCTTCACCCAGATCAAGACGGTCACGCAGCAGTGGAAGGAGTCGCCGGCTCAGCgCGTCT
CCCTCTCCATGCCCACCTCGCAGAAgtGAGGTGAAAAAAAGaaAggCATCTtgtacg > SEQ ID NO:1188 219159 211395_300957_1
aaccacgccgccgtcctccccgactgcaacaagaaccacttcatcaacagtgtcgtgggagctgcctttggagct
gccggTCAGCGCTGCATGGCCCTGAGCACACTGGTCATGGTTGGCGAGACCAAGGAGTGGCTCTCTGAGGTTGCT
GAGCATGCGCAGGCGCTCAAGGTCGATGGTGGCTTCGAGGAGGGTGCCGATCTGGGCCCCGTCATCTCCCCCCAG
AGCAAGGAGCGCATCTTGAGCATCATTGACAGCGCCGAGAAGGAGGGTGCTACGATCCTGCTCGACGGCCGTGGC
TTCAAGTCTGAAAAGTACCCCAACGGCAACTTCATCGGACCCACCATCATCTCCAACGTCACTCCCGACATGACC
TGCTACAAGCAGGAGATCTTCGGCCCCGTGCTGGTGTGCCTCAACGTCGAGACCATCGACGACGCCATTGAGCTC
ATCAACAAGAACGAGTACGGCAACGGCGTTGCCATCTTCACAAAGTCGGGCGCCACCGCCGAGACGTTCCGCAAG
AACATCGAGGCCGGCCAGGTGGGCATCAACGTGCCCATCCCCGTGCCGCTGCCCATGTTCTCCTTCACCGGCAAC
AAGAAGTCGATTGCCGGAGGCGGTGCCAACACCTTCTACGGCCGACCTGGTATCAACTTTTACACGCAGCTCAAG
ACGGTGACGGCGTTATGGCAGAGCGCCGATGCCGTGGCCAAAAAGGCCGCGGTGCACATGCCCACGCTGCAGTAG
AAGATGAAATTGGGTTGAGCGGTTTAGGATTGTTTGTGTGCGGAATATGACGGAATGGTGGGAAAAATTGATGAT
GCCTTGATGAAATGAAGGGTGGTTGTCTCACAGAACATGCATGTACTGTACATAATATAGCCACGAGCAGATGGG
CTGGACAGCATGGGAATTGCtTTTTTTAAGCAGAATGAAATAAATCTACGTTAAATCCGAaaaa > SEQ ID NO:1189 219215 205427_300798_1
gaCGAGCaagtTCGTGAGCAGATTATCACCCCGACTCATTCCTTATTCCATTGGGCCGTGGAAAAGGTACAGAAC
AGGCGAATACTGGTACAGATAGGTGGCGGCGAGGCAATTTTCTTGCTACCTGATGTATACATGTCTCCCTGGGGA
ATAAATCCCGTGCATGTAGGTACAGGTACCGGTACTGGCACTCTTCGAAGTTCTTTTGCCTCTCTAACACAGCAT
GACGCTTCTCACAAGTGATTCTCCAGCTGTCTCACATCCAGCATCCATGtTCTCTGgagAACTACAGACAGCCAA
CCAACTGAGAAATCCTCAATgcAATCATCTGCCCATCCCAAGCAAAAAGTCTCACAAGGCACGTCCCGCAACACT
CAACTtgtCTCTCCTCTGAGTCTCTTCCTCCCCCACATCTGTTGGGAATTTTGTTGagGGGccACATAAACCCgc
ccagccCCAgcgccAaggggTCCCCTTTCCctggggccgtcgatcTGGcgTGGGGCACCCC > SEQ ID NO:1190 219215 212673_300842_1
CCCACGCGTCCGAGAGAGAGAGACGAGCAAGTTCGTGAGCAGATTATCACCCCGACTCATTCCTTATTCCATTGG
GCCGTGGAAAAGGTACAGAACAGGCGAATACTGGTACAGATAGGTGGCGGCGAGGCAATTTTCTTGCTACCTGAT
GTATACATGTCTCCCTGGGGAATAAATCCCGTGCATGTAGGTACAGTGATTCTCCAGCTGTCTCACATCCAGCAT

Figure 2 continued

CCATGTTCTCTGCAGAACTACAGACAGCCAACCAACTGAGAAATCCTCAATGCAATCATCTGCCCATCCCAAGCA
AAAAGTCTCACAAGGCACGTCCCGCAACACTCAACTTGTCTCTCCTCTGA

> SEQ ID NO:1191 219216 210754_300892_1
TGCGAGCAAACAGAAAGCAGCCCGTCATCCTTCGGGAACCCGCATGATCAGCGCCTGGCCGTCTGGGGGTGGCTG
AGAGGTCGCTGGGTCGCGGGTTAATGAAACACGGGCTCTGCGTTTATTTGGTGGTGATCGACACTTTTGCCCTCG
CAGCGTGAGGACT

> SEQ ID NO:1192 219224 220453_300955_1
ATCGCATCTACCGAACTCCGGAGTTCTCGCAAAAGGTTCGCACATTGTATTTTCGAAAGCGAAGATACACATATA
CACAAACAACTACAATATGTCGGAGAACCCTACGACAAACGGGCACGACGCCCTTGAAGAGAAGCTCGGCCGCCT
GGCTAGGAAACCCGGCATCAAGGCCAGCCTCGTTTTGGACCGAGCAACCGGCGCAATCCTCAAGACGAGCGGCCA
GATCGACGCGCTCCAGACGGCGAAATCGCGAAACGCGTCAACGGCGGCCTCATTCTCCAACGACGCTCCCGCAGC
GGAGGAGGGCGAGGCGCagggcGTCGAAGAGTTTGCGGAAATGATCTGGAACTTTGTCAACAGCTCCGGGCAGCT
AGTCGGGGACATTGACACAGAGGACGAATTGAAATTACTGCGACTGCGAACGAAGAAGCAAGAGATTGTCATAGT
GCCGGACCAGAAGTACCTACTGACGGTCATCCACGATACTCagCCGGGCTgATTACACAATTTGGAGCGGACTTT
CCGATACGCAAAGCAGCGGGTTTATTAAAGGGGCTACTATGATGGAATATAaTACt > SEQ ID NO:1193 219226 210824_300893_1
GGGCTCGTCAACATCGTCCGCCATACCAAGAAGAGGCTGAGAATAAATCTGGTGCATGCAAAGAATGATAGGGAT
ATCCCCTGGACGGAGGATAACAAGCTGTTTCGCGCTGCCGAAGCGAGACGATTGGCACTTTAGATGACGATGAA
TTCGACACTTGGAAAGAGTCTTGCACAGTTCGAACGAGCAATGATTCGTTTGTGACTACATTGAAAACAGGCGAT
GACATTATCATTCGTCAAGAGCTATTTCCCTATGGCGGACACAATGAAATTCTGGGCTTTGCACCGGTCAGCTTG
GCCATTATGAGGTCGTTTGATCTTGAAGGCACCGCCTACGATTAATAGCGATGCCACATAGAAGGTATAGCACGC
ACATGACTGAATATTCGGTGCGAGTTGCGAGCTGTATACTCGTACGAACCACGTCGAGTCTAATGGCTGAATCAT
TCAAACCAAATCTAAACATCAAGGAATTGAGCAGTTGTTTTGCAGGAATGTTCTCAAGAGGACAAAAAAAGTCTG
GTCTACAACACGACGGCTACACGCCATTCATTCTTGAGAGGTCCAATCACA > SEQ ID NO:1194 48411 124691_300424_1
ctcacatttctccTACTCTCTCTCATATTTCATTTCTCTCTCTAGTGTTTACACAATGGCACCAAAAGCCGAGAA
GAAACCCGCCGAGAAGAAGCCAGCAGCTGAGAAGGCACCAGTAGCAGCAGGTGCAGCGGAGAAGAAGCCAAAGGC
TGGGAAGAAGCTTCCCAAGGACGGTGCCGGAGCAGCTGCAGGAGACAAGAAGAAGAAGAGGTTAAAGAAGTCTGT
TGAAACTTACAAGATCTACATCTTCAAGGTGTTGAAACAGGTTCATCCTGATATTGGTATCTCTAGTAAGGCTAT
GGGGATCATGAACAGTTTTATTAATGACATTTTCGAGAAGCTGGCTCAGGAATCTTCTAGATTGGCCCGTTACAA
CAAGAAGCCTACTATCACTTCTCGGGAGATTCAGACTGCTGTGAGGCTTGTGCTTCCTGGTGAATTGGCTAAGCA
TGCTGTTTCTGAGGGTACCAAGGCTGTTACTAAATTTACTAGCTCTTAATCAATTTTAGAGTTTGTGTTTTGATT
AGGGTTTGTAGATGTAAAGAATTGTCCAATTAGGGTTGCATTTGACATTTGTGGCATGTAATGGACATCTATATT
ATGAATGAAGAGTTTTCTGTTTTCTCTGACAAAAagaaacaagaaagaaaaaaaaaaccatgtcggccgcctt
ggcc > SEQ ID NO:1195 48435 143586_200010_1
caagcttggcatccatgaggactccaccaacaggaccaagattgctgagctcctgaggtatcactccaccaagag
tggtgATGAGTTGACCAGCCTCAAGGACTACGTAACCCGGATGAAGGAGGGCCAGAGTGAGATCTATTACATCAC
TGGTGAGAGCAAGAAGGCTGTTGAGAACTCCCCCTTCCTTGAGAAGCTGAAGAAGAAGGGATATGAGGTCCTGTA
CATGGTTGATGCCATTGATGAGTACGCTGTTGGTCAGCTTAAGGAGTTTGAGGGCAAGAAGCTCGTCTCTGCCAC
CAAGGAAGGTCTGAAGCTTGATGAGAGTGAGGACGAGAAGAAGCGGCAGGAGGAACTCAAGGAGAAGTTCGAGGG
TCTGTGCAAGGTGATCAAGGAGGTGCTCGGTGACAAGGTGGAGAAGGTTGTTGTCTCTGACCGTGTGGTGGACTC
TCCCTGCTGTCTAGTCACTGGGGAGTATGGCTGGACTGCTAACATGGAGAGGATCATGAAGGCCCAGGCTCTGAG
GGACTCCAGCATGGCCGGCTACATGTCGAGCAAGAAGACCATGGAGATCAACCCGGAGAATGCCATCATGGACGA
GCTCCGCAAGCGTGCCGATGCTGACAAGAACGACAAGTCTGTGAAGGACCTGGTGATGCTGCTCTTCGAGACTGC
CCTCCTGACCTCCGGCTTCAGCCTTGAGGACCCCAACACCTTCGGCACCAGGATCCACCGGATGCTCAAGCTCGG
CCTGAGCATCGACGAGGACGAGTCCGCCGAGGCTGACGCCGACATGCCTCCGCTGGAGGACGACGCCGGCGAGAG
CAAGATGGAGGAGGTCGACTAAACGTCATGGACCCATGGATGCCATTCTGTCCCTTCTAGTTATCCCTCTCcTag
tTCTCTTCTCATAGCTTTCTGACTgctgctgttcGCtTtctTTTTGGTACGTTGGATGCATCAgttttgtcTTTg
tctTagcTCTTaaaCaaTGCGtggtACCtTGTCATACTgtttgCGTTGCaatgctAct > SEQ ID NO:1196 48435 223757_300975_1
AAGAACTTTGAGGTTCTGTACATGGTTGACCCCATTGACGAGTACGCCATGGCCCAGCTCAAGGAGTTTGATAAC
CGAAAGCTGGTTGATATCACCAAGGACTTCGAGCTTGAGGAGACCGAGGAGGAGAAGAAGCAGCGAGAGGCTGAG

Figure 2 continued

```
GACAAGGAGTTCGAGCCCCTTGCCGCCGCCCTCAAGGAGATTCTTGGCGACCAGGTCGAGAAGGTTGTTGTGTCC
CACAAGCTTGTCGACGCTCCTGCTGCCATCCGGACCGGCCAGTTTGGCTGGTCCGCTAACATGGAGCGAATCATG
CGAGCCCAGGCTCTGCGAGACACCTCCATGTCTGCCTACATGGCCTCCAAGAAGACCTTTGAGATTTCTCCCAAG
TCTCCTATCATCAAGGAGCTCAAGAACAAGGTTGAGGCCGATGGTGCTGAGGACCGAACTGTCAAGGACCTCACC
ACTCTTCTGTACGAGACTGCTCTGCTGACCTCCGGCGTCACTCTTGATGAGCCCGCCAGCTTTGCTTCTCGAATC
AACCGACTCATTTCTCTCGGTCTCAACATTGACGAGGCTGAGC
```

> SEQ ID NO:1197 48435   251525_301658_1
```
TCAAGCTCGAGGACACGGACGACGAGAAGAAGAAGTTCGAGGAGAAGAAGGCGGCGTTTGAGCCTCTGTGCAAGG
TGATCAAGGACATCCTCGGCGAGAAGGTGGAGAAGGTTGTGGTGTCGGACAGGATCGTCGACTCGCCGTGCTGCC
TGGTGACCGGCGAGTATGGATGGACGGCCAACATGGAACGTATCATGAAGGCTCAGGCTCTCCGGGACAGCAGCA
TGTCGAGCTACATGTCGTCGAAGAAGACGATGGAGATCAACCCGGACAACTCGATCATGGACGAGCTGCGGAAGC
GAGCGGATGCGGACAAGAACGACAAGGCGGTGAAGGATCTGGTGCTGCTGCTGTTTGAGACCGCGCTGCTCACGT
CGGGATTCAGCTTGGATGATCCCAACACGTTTGGATCCAGGATCCATCGCATGCTCAAGCTGGGGCTCAGCATCG
ACGATGATGTTGCTACTGGCGGTGAGGATGTTGAAATGCCACCCCTTGAGGAAGGGGCGGATGCCGAGGGA
```

> SEQ ID NO:1198 48435   168438_300556_1
```
GAATTCGCGAAGCCTTCTCCAAGAACCTGGGGAAGAAGTGCCTTGAGCTCTTCTTTGAGATTGCTGAGAACAAAG
AAGATTACAACAAGTTCTACGAAGCCTTCTCCAAGAACCTGAAGCTTGGAATCCATGAGGATTCTACCAACAAGT
CAAAGATTGCTGATTTGCTCCGATACCACTCAACCAAGAGTGGTGATGAGATGACCAGTTTGAAAGACTATGTGA
CCAGAATGAAGGAGGGTCAGAATGACATCTTCTACATCACTGGTGAGAGCAAGAAAGCAGTTGAGAACTCTCCTT
TCCTTGAGAGGTTGAAGAAGAAGGGTTATGAAGTTCTGTACATGGTTGATGCCATTGATGAATATGCTGTTGGTC
AGTTGAAGGATTATGAGGGAAAGAAACTTGTGTCTGCGACCAAGGAAGGTTTGAAATTGGAGGAAAGTGAGGATG
AAAAGAAGAAGGCTGAGACATTGAAGGAGAAGTTTGAGGGTCTTTGCAAGGTGATTAAGGAAGTGTTGGGTGACA
GAGTTGAGAAGGTTGTTGTCTCTGAACGTGTTGTTGAATCTCCCTGTGTTTTGGTTACTGGAGAGTATGGTTGGA
CTGCTAATATGGAGAGAATCATGAAGGCTCAAGCTTTGAGGGATTCAAGCATGGCTGGGTACATGTCCAGT
```

> SEQ ID NO:1199 48435   3473_300342_1
```
ggtcgaCCCACGCGTCCGAGGAAATCTCGCTAGCGAAAACGTAGACGATGTCAAAATCAGCAACCGTTTGGCTGA
CACTCCATGTGTAGTCGTAACATCCAAGTTTGGATGGAGTGCTAATATGGAGAGGATCATGCAGTCCCAAACTCT
CTCGGATGCTAATAAGCAAGCTTACATGCGCGGAAAGAGAGTCCTCGAGATCAACCCACGACACCCTATCATCAA
AGAACTCAAGGATAGAATTGCAAGTGACCCagaGGATGAGAGTGTGAAGGAAACAGCACAGCTCATGTACCAGAC
AGCTTTGATCGAGAGTGGATTCATACTCACCGACCCAAAaG
```

> SEQ ID NO:1200 48435   187202_300675_1
```
AGACTGCTCCTTTCTTGGAAAAGTTGGTTCAAAAAGACATTGAAGTTCTCTACCTTATCGAGCCGATTGATGAGG
TTGCCATTCAGAATTTACAGACATACAAAGAGAAAAAATTTGTTGATATCAGCAAAGAAGACCTGGAATTGGGTG
ATGAAGATGAGGACAAGGAAAATGAGAGCAAGCAGGAATACACTCTTCTATGTGACTGGATAAAGCAACAGCTTG
GTGACAAAGTTGCCAAGGTTCAGATATCAAAACGGCTTAGCTCTTCGCCATGTGTTCTTGTATCTGGCAAATTTG
GTTGGTCAGCAAACATGGAAAGGCTTATGAAGGCACAAACTCTTGGTGATACTTCAAGCTTAGAGTTCATGAG
```

> SEQ ID NO:1201 48443   128840_300478_1
```
ccccgatcaataattatcttccattctcagttcctagtgacactaactgaaaaagtattaagagaaGCAAAAATG
GCAGCAACAATGTCCACTGTTGTAGGCTTAGTTACTTCATCTCTTTCTTCTCCAAAGAAGGCTTGCCTCAGCTCA
GGCTTCTTGAAATCACCAGTGACAGCAAGAAACCCTTTAAGGGTAGCACAAGCTTCAGGAGGCAAATTTACATGT
AATTTTCAAAGAGATTGGCTGAGGAGAGACTTGAATGTGATTGGATTTGGTTTGATTGGATGGCTGGCTCCTTCT
AGCATTCCAGTAATCAATGGCAAGAGTTTGAGTGGGCTTTTCTTTGATAGCATTGGCACTGAACTCTCTCATTTC
CCCACTGGACCTGCTCTCACTTCTCAGTTCTGGCTATGGTTGGTGTGCTGGCACTTGGGCTTGTTCATCTGCCTA
ACTTTTGGACAAATTGGATTCAAGGGACGGACTGAGGACTATTTCTCAAAGTAAAATATTCCCTTCTGAAAATTT
GTGTATAAATAAGAAATACGCTATTTCAGTTCCTTAATATTGGTATTTTCCCTTCATTTCAGCATGTTATGAGCG
TCAGAAATCCCTTCTACTTTAATGTCATAATAACATATGACATTGTGTTATTAAACTGCATCGGCTGTCCGCCTG
CATAACTTATTTTCCTTTTATTGCTCCAAGTATAACATATGACa
```

> SEQ ID NO:1202 48443   196271_300770_1
```
ccccacggagaCAACACACGCAGCTCGCCGACCAGAGACAGAGAGAGACCATCTGCTAGCTTAGCTGCCATGGCC
GCCTCCACCGTCTCCGGCCTCGCCGGCGCCACCCTCGCCCGCCGGCCGGCCTTCTCCACCGGCTTCACGACGGGC
GCCCGGGTGTCGGCGAGGAACCCGCTGCTGACGAGGAACCTGGAGAGGAACGGCAGGATCACCTGCATGACGTTT
CCGCAGGACTGGCTTAGGAGGGACCTGAACGTGATCGGGTTCGGGCTGATCGGGTGGATCGCGCCGTCGAGCGTC
CCGGCGATCAACGGCAACAGCCTCACGGGGCTCTTCTTCTCCAGCATCGGCCAGGAGCTCTCCCACTTCCCCTCG
```

Figure 2 continued

CCGCCGGCGCTCGACTCGCCGTTCTGGCTGTGGTTGGTGACGTGGCACCTTGGGCTGTTCCTGGCGCTCACCTTC
GGCCAGATCGGGTTCAAGGGCAGGACCGAGGGCTACTTCGACAAGTGAATGAATCCATAGTGGCTTTTGGTTAGC
TTGACTGTACGGACGGATGTGTGCGCTGCATATCCTTCCTTTTGTATAGGGCTCTGATTTGATCCTCTTGCGGAT
GTACGCTGTTGTAATTCTCCTCAACTCCTTAAAACTTTaa

> SEQ ID NO:1203 48443 57538_300029_1
cactaactgaaatactattcagagaaGCAAAAATGGCAGCAACAATGTCCACTGTTGTAGGCTTAGTTAGTTCGT
CTCTTTCTTCTCCAAAGAAGGCTTGCCTCAGCTCAGGCTTCTTGAAATCACCAGCGACAGCAAGAAACCCTTTAA
GGGTAGCACAAGCTTCAGGAGGCAAATTTACATGTTTTGAAAGAGATTGGCTGAGGAGAGACTTGAATGTGATTG
GATTTGGTTTGATTGGATGGCTGGCTCCTTCTAGCATTCCAGTAATCAATGGCAAGAGTTTGAGTGGGCTTTTCT
TTGATAGCATTGGCACTGAACTCTCTCATTTCCCCACTGGACCTGCTCTCACTTCTCAGTTCTGGCTTTGGTTGG
TGTGCTGGCACTTGGGCTTGTTCATCTGCCTAACTTTTGGACAAATTGGATTCAAGGGACGGACTGAGGACTATT
TCTCAAAGTAGAATATTCCCTTCTGAAAATTGTGTATAAAAAACAAATATGCTATTTCAGTTCTGCATGTTATGA
GCGTGAAATACCTTCTACTTTAATTTGCAAGTTTTTTCAAATTTTGCACTTATTGGTCCAACTACAGCATATGAT
ATTgtgTTATTAAACTGCATCGATTGTccgCgtgtaTaACTTATATTCcttttTTTTTAAAAAAAAAAttCTTTGC
TCTtGa > SEQ ID NO:1204 48443 57577_300138_1
GCCATTACGGCCGGGGGATTTGGTTTAATTGGATGGCTGGCACCTTCAAGCATTCCAGCAATTAATGGCAAAAGT
TTAAGTGGTCTCTTTTTTGAGAGTATTGGCACTGAGCTCTCTCATTTCCCTACTGGCCCTGGTGTCACTTCTCAA
TTCTGGCTATGGATGGTCTGTTGGCACCTGGGCTTGTTCCTCTGCCTCACTTTTGGGCAAATTGGATTCAAAGGA
AGGACTGAGAAATATTTTTAAATGGAATTTTTTCTGATAATTTGTGTATAATGAAGAATCTTTTAATGTCTTAAC
TCTCCTTTCTCAATCTTCAGAATATAATAGGAGACAAACCCCTTCTACTTTTT > SEQ ID NO:1205 48443 262877_301719_1
acgcgtcgatcgagatcgatcgagggttgcgaaaatcccacatctccttttcatcgctcgattcaaggttctac
ctcccATCTCACGACCCCTCTCTCTCTCTTTTTCGTTTAGAGAGAGCTCATATTGGTTAGGGAAAAGGGAGAAG
GAAGAAGAGAGAGAATGGCGAGTATGGTGGCATCTAGTGCATTGAGGACCCCTGTGGTCGGCTTGGGGGATTCGA
ACCTCCGACTCAGACGGAGCAACCCCACCCCTCTCCGCTCATCTTTCCTCCGACCTGTCGCAAGAACTGTTAACC
CATTGGGTTCGCATGGCAATGCTCGGGTCACCTGCTTTAACCGAGATTGGCTCCGGAAGGATCTGTCCGTGATCG
GATTTGGCCTCATCGGGTGGCTAGCGCCTTCTAGTATCCCAGCCATCAATGGCGACAGCCTTTCAGGGCTCTTCT
TtagcaGCATAGGGACAGAGCTAGCCCACTTCCCAACCGGGCCCGCCCTTACGTCCCCTTTCTGGTTATGGCTGG
TCACATGGCATTTTGGTTTATTTGTTGTTCTAACTTTCGGACAAATCGGATTCAAGGGAAGGAAGGACGCGTACT
GGTAATAATAATAATAAATCCTTTGCGCGATCATTGTCAGATGCTCGGCTTAGAAGCTAGAAAAAGAATCTGTAA
CTCAATGTAGCTTTCCCTTCTgttgttGGCTATTGTTTGATTACACTATCCTTTGATAGCTGCGAGGGATGATGT
CTTCTTTTATGTAATCCTGcacttaaaaTTtgagttT > SEQ ID NO:1206 48469 57860_300037_1
GCCATTACGGCCGGGGAAGCACCAAGTGAATGGAGATGGTGGCAATGATAGCCACAGTAAGAAACGAAAGAAGCC
GCGTAGTGCTGATAAAAAGAAGCATACCCGTGCTGAAAGAAAGAAGCGGAAGAAGCAAAGACAAGAGAAAGAAGC
GGAAGAAGCAAAGACAAGAGACAGTAGTGTGCTAGCTTCGTTGGAATCACCAAGCATTGTATTAGAAAACTGTTT
CCTGAAGCATCAAGTGAATGGAGATGGTGGCAATGACAGCCACAGTAAGAAACGAAAGAAGCCGCGTAGTGCTGA
TAAAAAGAAGCACACTGGTGCTGAAAGAAAGACGCGGAAGAAGCAAAGACAAGAGAAAGAAGCGGAAGAAGCAAA
GACAAGAGACAGTAGTGTGCTAGCTTCGTTGGAACCACCAAGCATTACACCAAGCCTTTCCTTGATGATTATTGG
TGCAACTTGTAGTTAACATTGAGTGTCATTTGCTTATTGCATCAAATTAGGATAGAGGCCTCGGCAGGATGATGA
GGAGGGCCTAAATACGAGGCTGATCTCCACGTAGATCTGGTGACACCAGAAATCCCACAAAAGTGCGAAGGGTGT
AATCACTTATAGCTCCTAATTCATTTGTCATTCTACTTTTCCTTTTCAATCTT > SEQ ID NO:1207 57821 146017_301063_1
aagaaagagaaaagtgggaatgctaaaaactctataaccggtgacaacaagacgacggcaagaagaagaagaagc
agcagCAGCCAAGTGACAGTGAGCCATGGTCTCAGCAGCCACCTGGATCCGATACGTTGTCAGCAAACTTGAATA
CTCCGCCTCTGTTGGCTGGAAGAACTACAAAGGAGGTCAAATTACAGATAGAGAATTAGGCGATACCATATGGAA
GAATTTCTTTCAGGGTAAATTGACATTTATGCACTTTAACAAAGGAGAGGAGATGGCACCAACACTCGGAGCTCA
GGGCGGCACACTTCTTGTTCGGAAGATACCTTGGGTTGATCCAACGAAAGTATTTGTTGGAGATGTTGTGGTTCT
CAAGGACCCTGTAAAGTCAGATGATTATCTTGTCCGTAGATTGGCTGCTGTTGAAGGCTATGAGATGGTGTCCAC
TGATGAAAAGATGAGCCCTTTGTCCTTGAAAAAGATCAATGTTGGGTGCTGGCTGACAATGAAAATGTGAAACC
TAAGCAGGAAGCCAAGGATAGCAGAACCTTTGGCCCTGTTTCCTTGACGGACATAGTTGGCAGAGCTATATATTG
CCTGAGGACAGCAGTGGACCATGGTCCTGTTAACAACAGTCACTTTAGCGtccagaAGGATTCACCAGTCCTtga
ggttGAACTGGATGttGATGAGaTggcACGAAgtcaCaaagcATaggCTGtgTgTGCTCTCtg

Figure 2 continued

> SEQ ID NO:1208 57821 225203_300985_1
ggggcgggttTAAGGCGCTGGCGATGTGGATCAGGTATTTCCtcgtcAAGCTCGCGCATTCGGTGGCCACTGCTG
CCAAGAGCTATGACAAGGGACAGATCAGTGAGAAGCAGCTAGGCGATAGAATCTGGAAGAATTTGTTCCaagngg
cGGCTTACATTCTTCCACCATGTCAAGGGAGAGCAAATGGCGCCCACATTCAAGAGCCagggagaGACTCTACTC
GTGAGATCGGTGTATTTTTATCGGTGATGTTGTGGTCTTTAAAGATCCGCAGGACACTGCAGAGAGTTTAGTACG
TAGGGTGGCGGCTCTGGAAGGTGACGAGCTTGTATCCACCGATGAGAAGGACGAGCCTTTCTTTCTCGAGGAAGG
CCAGTGCTGGGTGGTCGCGGATAACGAGTCTTTAAGTCCAAAGGAAGCGAATGATAGTAGAAGTTTCGGACCATT
GCCCATGAAGAACATCTTTGGACGGGCAATCTACTGCAGTCACTCGGCTGTGGATCACGGTCACGTACTTAATAG
TTCCGAGGCTATGCACAAAGATACTCCTGTTGTTGCCGTGGAGCTGGATTTGGAGGAGCTCAAGAAGCAAGCCTG
AAGAAAAATCGAGCTGGTAAT > SEQ ID NO:1209 57821 243372_301338_1
AAGCATCGGCTATGGCGGGCGGGGTTTAAGGCGCTGGCGATGTGGATCAGGTATTTCCTCGTCAAGCTCGCGCAT
TCGGTGGCCACTGCTGCCAAGAGCTATGACAAGGGACAGATCAGTGAGAAGCAGCTAGGCGATAGAATCTGGAAG
AATTTGTTCCAAGGGCGGCTTACATTCTTCCACCATGTCAAGGGAGAGCAAATGGCGCCCACATTCAAGAGCCAG
GGAGAGACTCTACTCGTGAGATCGGTACCTCTTCCATCTCCTAGGTGTATTTTTATCGGTGATGTTGTGGTCTTT
AAAGATCCGCAGGACACTGCAGAGAGTTTAGTACGTAGGGTGGCGGCTCTGGAAGGTGACGAGCTTGTATCCACC
GATGAGAAGGACGAGCCTTTCTTTCTCGAGGAAGGCCAGTGCTGGGTGGTCGCGGATAACGAGTCTTTAAGTCCA
AAGGAAGCGAATGATAGTAGAAGTTTCGGACCATTGCCCATGAAGAACATCTTTGGACGGGCAATCTACTGCAGT
CACTCGGCTGTGGATCACGGTCACGTACTTAATAGTTCCGAGGCTATGCACAAAGATACTCCTgttgttgccgtg
gagctgGATTt > SEQ ID NO:1346 103532 107124_300263_1b
TGTCTCTCTTCTACAGTCCCAAAAACATTGATCTGATCTGAGGGAATCAAAGGTTGTTGCTGGAACTCTTTAACA
AGAGAGAATTTGAGATATGGGTCGTGGAGTCAGCTATGGAGGAGGGCAAAGTTCACTGGGATACTTATTTGGGGG
TGGTGAAGCGCCAAAATCAACCACGGAAAATGTCCAAGCTGTTCAAAGTGAAGGACAGGCAATAAATAAAGAGCC
AGCTTCAAAGCCTGCTGTTTCTGCTCCAGTTGATGCTACTAAGCAGATTCCTGCCGGTATTCAGAGCACCCATTC
ATTTAACCATTTCAGGAGAGATGGTCAAAACACAGGAAATTTTATCACGGACCGACCATCTACCAAAGTCCATGC
TGCTCCTGGAGGTGGATCTTCTTTGGGATATCTCTTCGGCGATGGCAGCAGCTAAGCAATTCTCCAACCTACAGT
TGGATAATTGTCTTATCGCTTCTTTACCTTTTGCTTTTCGACTATGTTGTAATTCTAATTGCGAGTATTTCAGGT
CGTTGTGAAGTGTTAATTGGATAAACTTTCGTCTAAAGTCCCAGTTGACACTTGAAACTAAAGTTACTACTATCT
GATGTAATTTGTTACTTTTGTTGATTGATCATTTGATTGAACAGCTTTTGTTGCCTAAATTTCATATGTTCTTGA
TTTTAT > SEQ ID NO:1347 103578 103703_300027_1b
TGGTATGAACGCAGAGTGGCCATTCGCCGGGGGCCCACATTACAGAGAAATTCAATTCTTTCAAGCACAAAGCAA
AGATTGTTGTTTTACAGTAACAAAATAGTATTAATGGCTGGTAGAGGAAAAACCCTAGGTTCCGGTGCTGCAAAG
AAAGCTACGTCCCGTAGCAGCAAAGCCGGTCTCCAATTCCCCGTTGGTCGTATCGCCCGTTTCCTCAAAGCCGGC
AAGTATGCCGAGCGTGTCGGCGCCGGCGCTCCCGTTTACCTTGCTGCCGTCCTTGAGTACCTTGCAGCTGAGGTA
CTTGAATTGGCTGGAAATGCGGCGAGGGATAACAAGAAGACGAGGATTGTACCAAGGCATATTCAGTTGGCTGTG
AGAAACGATGAGGAATTGAGCAAGTTGCTTGGAGATGTGACAATTGCTAATGGTGGTGTTATGCCCAACATTCAC
AACCTTTTGCTGCCTAAGAAGACTGGTGGATCCTCAAAGCCCTCTGCTGATGAGGATTAAATAGATGGCCAATTT
GGAATTGAGAGCTATATGATGTTTTTGTTAGTCTATAGAGAGATTTAGATCATGAAATTAAGCCCCCACCCCCAA
ATGTGGAATGTTATTTCCTTAGTTCTGCTAGTTGTCAAGGTTTATGTTAGTATGTGAATACAAATTAAGGGATGT
ATGAAAACATCTTTTTTTGATTTTTGAATTCTATCTGTTCCAGT > SEQ ID NO:1348 103578 109225_300044_1b
TCGAAATCTCATCTCTCTGTAAAACAAAATCCATTTAATTCCTGTGTTTAACAGTAACAACAATCAAATGGCAGG
TAGAGGAAAAACCCTAGGATCTGGAGCAGCAAAGAAGGCTACATCCCGTAGTAGCAAAGCCGGTCTTCAATTCCC
CGTCGGTCGTATCGCCCGTTTTCTCAAAGCCGGGAAATATGCTGAGCGAGTTGGTGCCGGTGCCCCTGTTTACCT
TGCTGCCGTCCTCGAATACCTTGCTGCTGAGGTGCTTGAATTGGCTGGAAATGCTGCGAGGGACAACAAGAAGAC
TAGGATAGTACCAAGGCATATACAGTTGGCAGTCAGAAATGACGAGGAATTGAGCAAGTTGCTTGGAGATGTCAC
TATTGCCAATGGCGGTGTTATGCCCAATATTCATAACCTTTTGCTGCCTAAGAAAGCTGGTGGCTCCTCAAAGCC
CTCTGCTGATGAGGATTAGATTGGAAGGACAATAGGGAGTTTCAAGTGTTAAGCCTTAAATTTGGTTTTTGACT > SEQ ID NO:1349 103578 1101306_301475_1b
TCTCCCTCTCTCATCTGCGCATCTCTTGTCGGAGAAGCTAACTCTCTAACCCTAGCTATGGCCGCTGGAGGGGGA
GGTCGTGGCAAGCCTGCCGGAAAGAAGTCCGTCTCTCGTAGCAACAAGGCGGGCCTGCAGTTTCCTGTTGGTCGA

Figure 2 continued

ATTGCCCGCTTCCTGAAGGCTGGGAAGTATGCAGAGAGAGTTGGGGCGGGGGCCCCTGTCTACCTTGCAGCTGTC
CTTGAGTACCTCACTGCGGAAGTCCTGGAGCTTGCTGGGAATGCTGCGCGGGACAACAAGAAGAACAGGATAGTC
CCCCGCCACATCCAGCTTGCTGTGAGGAATGATGAGGAGCTTAGCAAGCTCCTTGGCCAGGTCACTATTGCCAAT
GGAGGTGTCCTCCCCAATATCCATAATGTCCTCCTTCCCAAGAAAGCAGGATCGAGCTCCAAGGTGGCGGCAGCA
GATTCTGAAGCCTGAAAAGGGGGAAAAAAAAAGAAGACTTACTGAAGAAACTTGGTGTTTGTTGACACCACTGAT
GCTCTGTGAAGATTTAGGCTCTGAGAATG

> SEQ ID NO:1350 103578 11598_300292_1b
TGGTATCAACGCAGAGTGGCCATCGGCCGGGGACTCAACACTCAAATTACAATCCAAAAGCTTATATTTTTTCTG
TTACTTCTCTGTACTCAAGCTTTGTTAACAGTTCGTTCACAACAATGGAAGCAGCAACCAAGACGACCAAAGGTG
CCGGAGGAAGGAAAGGCGGAGGCCCAAGAAAGAAGGCTGTAACCAAATCTGTCAAGGCTGGTCTTCAGTTCCCAG
TTGGTCGTATTGCTCGTTTCCTGAAGAAGGGTCGTTATGCTCAGCGTGTTGGAAGTGGTGCTCCAATTTACCTCG
CTGCTGTTCTTGAATACCTTGCTGCTGAGGTGTTGGAGTTGGCTGGAAATGCAGCGAGAGATAAT

> SEQ ID NO:1351 103578 27307_300098_-1b
CCGAAATATCATATCATGCGCTAATTAAACATACTTAGGCAAAAGCCAAATATACTTAGCTTTAAAACCTAATTT
GATCCCCAAAAAACACCATCAGGGTCTATTTTACAAGTTCCGAATCCAAACAAGAGAACTGAACTAAGAAGTCTA
AGAACCTCAGAACTCCTGAGAAGCAGATCCAATATCTCCTTTGTTCTTGCCAACCTTGGATGGCAAAAGAGTCTG
ATGAATATTTGGCAAAACTCCTCCATTCGCAATCGTCACACTTCCCAGAAGTTTGCTTAACTCTTCATCGTTCCT
CACTGCAAGCTGAATGTGTCTTGGTACTATACGTGTCTTCTTGTTATCCCTTGCTGCGTTTCCCGCCAGCTCCAA
CACCTCGGCGGCGAGGTACTCGAGAACAGCGGAGAGATAGACCGGAGCTCCGGCACCGACACGCTCGGCGTATTT
ACCGGATTTGAGGAATCTAGCGATTCTTCCGACGGGGAATTGAAGACCGGCTTTAGATGATCGAGAGACGGATTT
GGTGGCCTTTGGCTTTCCTCTGCCACCTTTGGTTGTTCCGCTTCCTGCGCCTGTACTCATCGTCTTCTTCGAAAT
TTAGAACAGATAAACGATTTGATGAGAGTTTGAAGAAATCGAAGAGAAATGACTATTGTAGATGATCTCCGAATT
GCGGACGCGTGGG

> SEQ ID NO:1352 103578 271390_200033_1b
CCCTCGACCACGCGTCCGCAAGCAGCAGTTGATTATCTCAGCTGACTTTCCCACAAATCGAGAGTTAGGGTTAGG
GTTTTGTGTTTCATCTGAAAATGAGTTCTGATGGAGGATCGGGTAAGGGCAAGGGTGGCGCAGGTAGAGGAAAAC
CTAAGGCATCAAAATCGGTGTCTCGGTCTTCAAAAGCGGGGCTACAATTCCCCGTTGGTAGGATCGCTCGTTTCC
TTAAGGCTGGAAAGTATGCTGAACGTGTTGGTGCTGGTGCGCCAGTTTACCTATCTGCTGTCCTTGAATACCTAG
CAGCTGAGGTGTTAGAGTTGGCAGGGAATGCAGCAAGGGATAACAAGAAGAATCGTATTGTGCCGAGGCACATTC
AGTTGGCTGTGAGGAATGATGAGGAGCTGAGCAAGCTTTTGGGTCAAGTTACTATTGCCAATGGAGGTGTTTTGC
CCAACATTCACCAGAATCTTTTTGCCTAAGAAAGCTGGCTCTGGGAAGGGTGATATTGGCTCTGCATCCCAGGAGT
TTTAGATGTAAAAATGAAGCTTTTGTTTTCCTAAAGGATTAGGGGAAATGAGTAGACTTCCTTTATGTAATATAT
AAAAATACCCTTTCTAGTTTGTTA

> SEQ ID NO:1353 103578 48682_300033_1b
GCCATTACGGCCGGGGATACCGGGAAAACAATTCAAATTTGAACACGTCAACATGCCTTCAACAACAGCAACCAA
ATCGGTGGGTGGTAGAGGAAAACTCCAAAAAGCTACAAAATCCATCTCCAGATCTCAAAAGGCGGGTCTCCAATT
CCCTGTTGGCCGAGTTGCTCGGTTTTTGAAAAAGGGTCGTTATGCTCAGCGAGTTGGCTCCGGTTCACCGGTTTA
TCTCTCAGCGGTTCTTGAGTACCTTACTGCTGAGTTGTTGGAACTTGCTGGGAATGCTGCAAGAGACAACAAGAA
GAACAGAATTGTTCCTAGGCATATACAGCTTGCTGTGAGGAACGATGAGGAATTGAGCAAGTTGTTGGGGTCTGC
AACAATTGCTAATGGTGGGGTTCTGCCCAATATTCACCAGAATTTGCTTCCTAAGAAGATTGGCAAAGGGAAACC
TGAAGTGGGGTTCCGCTTCACAGGAATTTTAGATCTTTAGGTGTAGTATTAAGGGATTGGGTAGTGAAATTTTATT
TGTTCATAATGGTTCAAACGTGGGGATGTAGCTCAAATGGTGGAGCGCTCGCTTTGCATGCAAGAGGCACGGGCG
GGGTTCGATCCCCCGCATCTCCATATTTTAGGTTTCTGCAATTTCGTTTTTCCTCAGCATTTTTCTCGAAGCAA
AGTCGTCTTTACACCAAC

> SEQ ID NO:1354 103578 226535_300998_1b
ACTTTTATTTCCACTCCTCACTAACACTTTTATCTAACAACAACAACAACACACAATGTCTTCCGGTGGAAAGTC
CGGTGGCAAGGCCGCCTCCTCTTCTAAGACCTCCAAGTCTCGATCCGCTAAGGCCGATCTTACCTTCCCCGTTGG
TCGAGTCCACCGACTCCTGCGAAAGGGAAACTACGCCCAGCGAATTGGTGCTGGTGCCCCCATCTACCTCGCTGC
CGTCCTTGAGTACCTCGCCGTCGAGATTCTCGAGCTGTCCGGTAACGCTGCCCGAGACAACAAGAAGAGTCGTAT
CGTTCCCCGACATCTGCAGCTCGCCATCCGAAACGATGAGGAGCTGAACAAGCTGCTTGGCCACGTCACCATTGC
TCAGGGTGGTGTTCTCCCCAACATCCACCAGAACCTTCTGCCCCGAAAGTCCGCCAAGGGCGCCAAGGGTGCTTC
TCAGGAGCTCTAAGTCTCTTGAAGGCTTTATATTTTATCTATTGGGTTAAGGGTTGTTTTAATGTCCATTAAAAC
TGTTTACAGTGTACTATAATGAATGACATGTATTGTATTT

Figure 2 continued

> SEQ ID NO:1355 103578 195978_300639_1b
CACTATCCACGCTGCACGTTTACCATTCCGACATTTGCCGCATCTCGCACCTTACATCTACTTTCGAGTAATTTT
TCGTTAACCCAAAAACCAACTTCAAAATGACTGGCGGCGGCAAATCTGGCGGCAAGGCCTCTGGCTCCAAGAACG
CTCAATCCCGATCCTCCAAGGCGGGTCTTGCGTTCCCCGTTGGTCGTGTCCACCGTCTTCTCCGAAAGGGCAACT
ACGCTCAGCGTGTCGGTGCCGGTGCTCCCGTCTACCTCGCTGCCGTTCTCGAGTACCTCGCTGCCGAAATCCTCG
AGTTGGCTGGTAACGCCGCTCGTGACAACAAGAAGACCCGTATCATCCCTCGTCACCTCCAGCTCGCCATCCGAA
ACGATGAGGAGTTGAACAAGCTGCTGGGACACGTCACCATCGCTCAGGGTGGTGTTCTGCCCAACATCCACCAGA
ACCTCCTCCCCAAGAAGACGACTGGCAAGACTGGCAAGGGTTCCAGCCAAGAATTGTAATTTTTTCGTTGGTCGT
TTGCGCTTTCTTTCGAGGTCGTTTTGGTTGTCATAAAGGGGTCAAGGGATAAGGTTTACGGTTGCTTTTGTACGT
CTGGGTTGTACATTAATCCCCCACGGCTATGATCATGAATCAATTAGGGTTTTTTTCAAATGCACTTCATTAAAA
CGT

> SEQ ID NO:1356 103578 187685_300679_1b
CCCACGCGTCCGCGGACGCGTGGGAAAAAAATCCTCCTCGCCTTCGACAGCAGCAGCAACCAGCTTAGCTAGGCT
AGCCATGGACGCCGCCGGAGCCGGAGCGGGTGGGAAGTTGAAGAAGGGAGCCGCCGGGAGGAAGGCCGGTGGGCC
GAGGAAGAAGGCGGTGTCGCGCTCCGTCAAGGCCGGGCTCCAGTTCCCCGTCGGCCGTATCGGCCGCTACCTCAA
GAAGGGCCGCTACGCCCAGCGCATCGGCACCGGCGCCCCGTCTACCTCGCCGCCGTCCTCGAGTACCTCGCCGC
CGAGGTGCTGGAGCTCGCCGGGAACGCGGCCAGGGACAACAAGAAGAACAGGATCATCCCGCGCCACGTGCTGCT
GGCGATCAGGAACGACGAGGAGCTCGGCAAGCTGCTGGCCGGCGTGACCATCGCGCACGGAGGCGTGCTGCCCAA
CATCAACCCGGTGCTGCTGCCCAAGAAGACGGCGGAGAAGGCCGCGCCGCCGGCAAGGAGGCCAAGTCGCCCAA
GAAGGCCGCCGGGAAGTCCCCCAAGAAGGCCTAGGCGTCGGCGCCTCGCTTTGCTTGTTTAGCTGGAGTAGATTG
GACGGGATGTGTGTCTGTTAGTAGTCTAATGCTGTTGATTTAATCTATGGTGGTGTCGTTGAACCTTGTGATCTG
TGCTTGTGTCTGTTCAAGAAGATAAATTTAAGAGATGTTAAATTTTTCTTC

> SEQ ID NO:1357 103578 155536_301357_1b
CAACAATCAACTATAATATCAATTCTTTTTCACCAATCACAACTTTGCTCTTTCTCATTTCCAAATGGATACTGC
CGGGAAAGCAAAAAGGGTGCCGGCGGCAGAAAGGCTGGTGGCCAATCGAAGAAGCCGGTTTCTCGGTCCGTCAA
AGCCGGTCTTCAATTCCCGGTCGGTAGAATTGGTCGTTATCTGAAGAAGGGTCGTTACGCTCAACGCGTTGGAAG
TGGTGCTCCGGTTTATTTGGCTGCTGTTCTTGAGTATTTGGCCGCTGAAGTGTTGGAATTGGCTGGAAATGCAGC
GCGTGACAACAAGAAGAACAGAATTATTCCAAGGCATGTTCTGTTGGCTGTGAGGAACGATGAAGAGCTAGGGAA
GCTTCTTGCTGGTGTGACAATTGCTCATGGTGGTGTGCTTCCAAATATCAACCCGATTTTGTTGCCTAAGAAAAC
TGGCGGAGCTGAAAAGGAACCGAAATCTCCTGCTAAGGCCACAAAATCTCCCAGGAAAGCTGTAGCTTAGACCTT
TTAAGTGACTGCTGAAACTCAAACTTCTTTTGGTTTGTTTTTCTTTTGTATGTAATTGTAATTTTTGAACTTTGT
GCCCGTGCCAGTTGTTCTTCATAGTCAAATCATTGAAACCCCTTGTTTCTAAAAA

> SEQ ID NO:1358 104251 11667_300291_1b
TGGTATCAACGCAGAGTGGCCATTACGGCCGGGGGAAATGTCCAGGTAGCTAAAATTGAAACTGAGAAAATGCTT
ATTCAAATGGTTGAAACTGAATTAGGTCAGAGGAAGCAGAAGGGTGGATATAATGCTCAATTTAAAGGACAATCC
CACTTTTTCGGTTATGAAGGAAGGTGTGGCTTGCCATCCAATTTTGATTCCACATACTGTTACGCGTTGGGATAC
GGTGCAGGAGCACTGCTGCAAAGTGGGAAGACAGGGCTGATATCATCGGTTGGCAACTTGGCTGCTCCAGTTGAA
GAATGGACCGTTGGTGGAACAGCACTCACTGCATTGATGGACGTGGA

> SEQ ID NO:1359 104251 124622_300424_1b
CAAGGTCCCTGATGCTCAGATAATTACTGAACATCCTGTAGGTAGGGTTGGGGTGCTATTTTGTGGTAGACAATC
TCCTGGAGGACACAATGTGCTATGGGGTCTTCATGATGCTCTTAAGGTTCACAACCCCAATAATACCTTGCTTGG
GTTTTTGGGTGGTTCTGAAGGTTTATTTGCGCAGAAAACTCTAGAGATCACCACTGACGTTCTTGCTACATATAA
GAATCAAGGTGGATATGACATGCTGGGACGGACAAAAGATCAAATTAGAACGACTGAGCAAGTAAATGCTGCAAT
GGCTGCATGCAAAGCTTTGAAATTGGATGGCCTTGTCATTATTGGAGGAGTGACATCAAATACTGATGCTGCTCA
GCTGGCAGAAAAATTTGCAGAAGCAAAATGCCCTACAAAAGTGGTTGGTGTTCCTGTTACATTAAATGGGGATCT
CAAGAATCAGTTTGTTGAAGCAAATGTTGGCTTTGACACAATATGCAAGGTTAACTCCCAACTCATTAGCAATAT
GTGCACTGATGCACTCTCAGCAGAGAAGTATTACTATTTCATCAGACTCATGGGGCGAAAGGCATCACATGTTGC
CTTAGAATGCACTCTGCAGTCGCATCCTAATATGGTGATTCTTGGGGAGGAGGTAGCTGCGTCAAAGCTAACCCT
CTTTGACATCACAAAACAAATTTGTGATGCAGTTCAGGCTAGGGCTGAACAT

> SEQ ID NO:1360 104251 246152_301575_1b
ACGCGTCGGATTTGACACTGTTTGCAAGGTCAACTCCCAGCTCATCAGTAACATAAGCACGGACGCACTGTCAGC
TGAGAAGTATTACTACTTCATCAGGTTGATGGGACGGCGAGCATCTCATGTATCACTGGAATGCGCATTGCAATC
GCATCCGAACATGGTTATCCTTGGAGAGGAAGTTGCGACGTCTAAAATGACTCTCTTTGATGTCACAAAGCAAAT
CTGCCGATGCTATTCAATCGAGGGCGCAGCAAGAGAAGTATCATGGAGTTATCCTTCTTCCGGAAGGCCTTATAGA

Figure 2 continued

GAGCATTCCTGAAGTCTATGCACTTTTGCAAAATCCACGGTCTCCAAAAGCAAGATGTTGAGATCGAGCACATTC
CAGCACGTCTGTCCCCCTGGGCGTCGGCTCTTCTACGAATTTCTGCCCCCATTTAT

> SEQ ID NO:1361 104251 248582_301584_1b
ATGGCGCTGATACTTATCCCCGAGGGCTTGATTGATTTCATTCCAGAGATTCACGCACTTGATTTCGGAGTTGAA
TGAGATCTTGGCGACTGGTACAGTGGATGAAGAGGGACACTGGAGGCACAAGTTATCTGAACAATGCCATGCGCT
CTTCGACTCATTGCCGCATAGTATCCAAGAAGAGCTGCTCCTGGAGCGGGATCCCCATGGAAACGTTCAGGTTGC
CAAAATTGAAACCGAGAAAATGTTGATCTCTATGGTGGAGACCGAACTTTCTCAAAGGAAGCACGAAGGATCGTA
CAAATGGGAACTTCAAGGGGCAGTCTCACTTTCTCGGATATGAAGGCCGGTGTGGTCTTCCGACAAACTTCGATT
CAACGTACTGCTATGCCCTTGGCTATGCTGCGGGAGCGCTCCTTCACGCTGGACAAACGGGATTGATTGCCTCGG
TGGGAAACTTGTCAGCTCCTTCAAAGGACTGGACTGTGGGAGGAACGGCATTGACAGCATTGATGGATGTTGAGA
GGCGAAGAGGCAAGAACAAGCCGGTTATAAAGAAAGCCATGGTTGAACTTGATGGTGCACCTTTC

> SEQ ID NO:1362 104421 128880_300478_1b
CCCGGCTCTTAGTTTTAGTTAAATTCAACTGGAAATTTTCTCTGTGGGTTTTGCTCAAAACAAAGCTGAGACTCT
CTGATTTTGACTTTTAAGAATGGCAAGTCCTATGGAGAAGGAGAGTCATAACGTAATTAATGATGAAATTGTGTC
GGTGGAGCTTCCTGCACCTCCTTCCTGGAAAAAGTTGTTCATTCCAAAGCAAGGGAGTACACCAAAGAGGAATGA
GGTTGTATTTATTGCTCCAACTGGAGAGGAGTTCAAGAACCGCAAACAGTTGGAGCAGTATCTCAAATCACACCC
TGGTAACCCTGCAATATCAGAATTTGATTGGAGTACCGGCGAGACTCCAAGGAGATCAACAAGGATCAGTGAGAA
GGCAAAGGCAATGAGACCACAATCACTACTTGAATCACCAATGAAAAGACGCCGAACATCATCTGGTGTAAAGAA
AGATAGCAAGGAAGCGGAAGCTGCAAAAGTTGACCAGGAAAGTTCTGAAACGAAAGAGATGGAATCTGCCAAAGA
AGAAAATGAGAACTTGGAGAAGAAAGATGGAGGAGCAGAAGCTGAAATGAACAAGGGGAAGAAAGAGGTGGAAGC
TGCGGATGAAGAGGCAGAGGGCATGAAGGGTGCTGAACTACACCCGGAGGAGAAGCCAGAAATGGATGAC

> SEQ ID NO:1363 104423 103534_300363_1b
TGGTATGAACGCAGAGTGGCCATTACGGCCGGGGACAGCTATTTTCTCTATTACTTCAGCCATCAAAAAACACTT
ATTTCTCCTTATTAAACCATGGCTGCTTCTACAATGGCTCTCTCTTCCTCTTCTTTTGCCGGAAAGGCAGTAAAA
CTATTACCGTCTTCCTCTGAAATCACCGGAAATGGGAAAGTTACCATGAGGAAGACTGCTAGCAAGCCCAAGCCT
GTCTCTTCTGGCAGTCCATGGTATGGCCCTGACCGTGTCAAGTACTTGGGCCCATTCTCTGGTGAGTCCCCAAGC
TACTTGACTGGTGAGTTCCCTGGTGACTACGGTGGGACACTGCTGGACTTTCAGCTGATCCAGAAACTTTTGCC
AAGAACCGTGAGTTGGAGGTGATCCACTGCAGATGGGCAATGCTTGGAGCTCTTGGTTGTGTCTTCCCCGAGCTC
TTGGCCCGTAACGGTGTCAAGTTTGGTGAGGCTGTATGGTTCAAGGCTGGATCCCAAATTTTTAGCGAGGGTGGA
CTTGACTACTTGGGTAACCCAAGTTTGGTCCATGCTCAAAGCATCTTGGCCATTTGGGCTTGTCAAGTTGTGTTG
ATGGGAGCCGTTGAGGGTTATCGTGTTGCTGGTGGACCTCTCGGTGAGGTTGTTGACCCACTTTACCCCGGTGGT
AGCTTCGACCCATTGGGCCTCGCTGAAGACCCAGAGGCTTTTGCTGAGCTCAAGGTAAAGGAGATCAAAAATGGT
AGACTTGCCATGTTCTCCATGTTTGGATTCTTTGTTCAGGCTATCGTAACTGGAAAGGGCCCATTGGAGAACCTT
GCCGATCACCTTGCAGACCCAGTTAATAACAACGCTTGGGCCTACGCAACAAACTTTGTCCCTGGAAAGTGAGTT
AACAAAAGTTGATCTTTAATCTTTAAGTAGTGTGAGACTGAACATGTAGCTTGTGAGTGATGAACCCAAAGAAGG
GTCAGAGTTTATTTTTAGCATTCTGGGTTATGGGTTCATTAAAGGGATTGTGTAAATTGGTTTGGATTAATTAAT
GAAGAACATGTGGATCTTTTCAT

> SEQ ID NO:1364 104423 1102024_301529_1b
ACTCACACATTGACAGGCTTGCTAGTAAATTGGTCTGATCAAGGAGGCAGAGCCCAGCCATGGCTTCGGTGACAG
CAGCGCTTTCTTCCTCCCTGGCCGGGCAAGTAGTGTTGAAGCCACAGAGCGAGCTAGCAGCGAAGGTGGGCAACA
ATGTGCTGGGCGAGGCAAGGATTAGCATGAGGAAAACTGCCTCCAGAGTGTCGGTGCCAGACAGCCCATGGTACG
GCCCAGAGCGGGTCAAGTACCTAGGCCCATTCTCCGGCGACTCTCCCTCATACTTGAATGGGGAGTTCCCCGGCG
ACTACGGCTGGGACACTGCCGGGCTCTCTGCTGACCCCGAGACATTTGCCCGCAACAGGGAGTTGGAGGTTATCC
ACTGCCGCTGGGCCATGTTGGGCGCTCTAGGCTGTGTCTTCCCCGAGCTCCTCGCCAAGAATGGCGTCAAGTTCG
GAGAAGCTGTCTGGTTCAAGGCTGGGTCCCAAATCTTTGCTGAGGGTGGTCTTGACTACCTAGGTAACCCTAGCC
TTGTCCATGCCCAGTCTATCCTTGCCATCTGGGCTTGCCAGGTCATCCTTATGGGTGCTGTTGAAGGCTACCGTG
TTGCTGGTGGTCCCCTTGGTGATGTGACTGACCCCATCTACCCTGGTGGAAGCTTTGACCCCCTTGGCCTAGCTG
ATGACCCCGAGGCCTTCTCTGAGCTCAAAGTGAAGGAGATTAAAAATGGTCGGTTGGCTATGTTCTCCATGTTCG
GATTCTTCGTGCAGGCCATCGTGACTGGCAAGGGCCCAGTCGAAAACTTGGTTGACCACCTTGCTGACCCTGTTA
ACAACAATGCCTGGGCATTCGCCACCAACTTTGTCCCCGGGAATTAGAGTGTAGTCTGCTACTTGTTTGAATGAT
CTTTTCCTATAATG

> SEQ ID NO:1365 104423 147021_200015_1b
AGAAAGAAAGAGAGAATGGCATCAATGGCAGCAACCGGCAGCTCCGCCACTGTTGTTAGAGCAACTCCATTCTTG
GGCCAGACCAAATATGCCAACCCTCTTAGAGATGTAGTTCCCATGGGCTCTGCCAAATTCACCATGAGTAATGAT

Figure 2 continued

TTGTGGTATGGACCTGACCGTGTCAAGTACTTGGGACCCTTTTCTGCTCAAACTCCTTCCTACTTGACTGGAGAA
TTCCCTGGTGATTACGGATGGGACACAGCCGGTTTATCTGCTGATCCTGAGGCCTTTGCCAAGAACAGAGCTCTT
GAGGTCATCCATGGGAGATGGGCCATGCTTGGGGCACTGGGTTGCATTACTCCAGAAGTTCTCGAGAAATGGGTG
AAAGTGGACTTCAAGGAACCAGTATGGTTCAAAGCTGGAGCCCAAATCTTCAGTGAAGGAGGACTCGACTATTTG
GGCAACCCAAACCTTGTCCATGCTCAGAGCATTCTAGCAGTGTTGGGCTTCCAAGTAGTTCTAATGGGCCTTGTA
GAAGGTTTTAGAATTAATGGGCTTCCTGGAGTTGGTGATGGCAACAATCTCTACCCAGGTGGTCAGTACTTTGAC
CCACTTGGCCTAGCTGATGACCCAACTACTTTTGCCGAGCTCAAGGTTAAGGAGATCAAGAATGGAAGATTGGCT
ATGTTCTCCATGTTTGGATTCTTTGTTCAAGCTATTGTCACTGGCAAAGGTCCTCTTGAGAACCTTTTGGATCAC
CTTGACAACCCTGTTGCTAACAATGCATGGGTTTATGCAACTAAGTTTGTTCCTGGATCTTAAATTTTACATTTT
GACTTCCTCCACAAGAGGCTTGTACCACTGAGTCATTCAGAATGCAAATATTTGGCAGATGAAAACTATTTTGCC
ATGTGATAAATACTCTTTTAGCCACTAACATTTCATTAACTCTTGTGGTAAGGACTATGCCTCAATCCCAAGCAC
CCAAGCAA

> SEQ ID NO:1366 104423 135477_300414_1b
CGGACGCGTGGGAAAAACCAACCCAACCGCCGCCGCATCGCCCTCGTTAGAACGATGGCCGCGTCGGCGCTGCAC
CAGACCACCAGCTTCCTCGGCACCGCCCCTCGCCGGGATGAGCTCGTCCGCCGCGTCGGCGACTCCGGTGGCCGC
ATCACCATGCGCCGCACCGTCAAGAGCGCGCCCCAGAGCATCTGGTATGGACCTGACCGTCCCAAGTACCTGGGC
CCGTTCTCGGAGCAGACGCCATCGTACCTGACCGGAGAGTTCCCGGGAGACTACGGGTGGGACACGGCGGGGCTA
TCGGCCGACCCGGAGACGTTCGCGAGGAACAGGGAGCTGGAGGTGATCCACTCGCGGTGGGCGATGCTGGGGGCG
CTGGGCTGCGTCTTCCCGGAGATCCTGTCCAAGAACGGGGTGAAGTTCGGGGAGGCGGTGTGGTTCAAGGCCGGC
GCGCAGATCTTCTCCGAGGGGGGGCTCGACTACCTGGGGAACCCCAACCTGGTGCACGCGCAGAGCATCCTCGCC
ATCTGGGCGGTCCAGGTGGTGCTCATGGGATTCGTCGAGGGCTACCGCGTCGGCGGCGGCCCGCTCGGCGAGGGC
CTCGACAAGGTGTACCCAGGTGGCGCCTTCGACCCACTCGGCCTCGCCGACGACCCTGACACCTTCGCCGAGCTC
AAGGTGAAGGAGCTCAAGAACGGCCGCCTCGCCATGTTCTCCATGTTCGGCTTCTTCGTCCAGGCCATCGTCACC
GGCAA

> SEQ ID NO:1367 104423 135406_300414_1b
CGCGGCCACCATGGCGCTCTCCTCCCCGGTGATGGCCCGCGCGGCGCCGTCGACCTCCTCCGCGCTCTTCGGCGA
GGCGCGGATCACCATGCGCAAGACCGCCGCGAAGCCCAAGCCGGCGGCGTCGTCGGGGAGCCCGTGGTACGGCGC
CGACCGCGTCCTCTACCTCGGCCCGCTCTCCGGCGAGCCGCCGAGCTACCTCACCGGCGAGTTCCCGGGCGACTA
CGGGTGGGACACCGCGGGGCTCTCCGCCGACCCGGAGACGTTCGCCAAGAACCGGGAGCTGGAGGTGATCCACTC
CCGGTGGGCGATGCTGGGCGCGCTCGGTTGCGTCTTCCCGGAGCTCCTCGCCCGGAACGGCGTCAAGTTCGGCGA
GGCGGTGTGGTTCAAGGCGGGTCGCAGATCTTCAGCGAGGGCGGGCTCGACTACCTCGGCAACCCGAGCCTGAT
CCACGCGCAGAGCATCCTCGCCATCTGGGCGGTCCAGGTGGTGCTCATGGGCGCCGTCGAGGGGTACCGCATCGC
CGGCGGGCCGCTCGGCGAGGTCGTCGACCCGCTCTACCCCGGCGGCAGCTTCGACCCGCTCGGCCTCGCCGACGA
CCCGGAGGCCTTCGCGGAGCTCAAGGTGAAGGAGATCAAGAACGGCCGCCTCGCCATGTTCTCCATGTTCGGCTT
CTTCGTCCAGGCCATCGTCACCGGCAAGGGCCCCCTCGAGAACCTCGCCGACCACCTCGCCGACCCCGTCAACAA
CAACGCCTGGGCCTACGCCACCAACTTCGTCCCCGGCAAGTGAGCGCCGCCGCCGCCGTGCTGCCATGGCGACGC
ATCGCCTTCAGCTAAGCTAGCTAGGTTGACGACGATGCGCGTCTCTGCAGGAGAGTGTGCGTGTGTGTACGCGGT
GCAGTAGATGTACGTACGTGTACCGTATAGATGTACGTATTCGTGTGGACCGCGTGGATGGATGTA

> SEQ ID NO:1368 104423 13179_300271_1b
CCCACGCGTCCGACTTGGGGAACCCGAGCTTGGTCCACGCTCAGAGCATCTTAGGCATTTGGGCTACTCAAGTTA
TCCTCATGGGAGCTGTTGAAGGCTACAGAGTCGCCGGAGATGGTCCATTGGGAGAAGCAGAGGACTTGCTTTACC
CAGGTGGCAGCTTCGACCCATTGGGCCTCGCTACTGACCCCGAGGCTTTCGCAGAGTTGAAGGTGAAGGAGCTCA
AGAACGGAAGGTTGGCTATGTTCTCTATGTTTGGATTCTTCGTTCAAGCCATCGTCACCGGAAAGGGACCTTTGG
AGAACCTCGCCGACCATTTGGCCGACCCAGTCAACAACAACGCTTGGGCCTTCGCCACCAACT

> SEQ ID NO:1369 104423 131129_300511_1b
GAATCCGAATGATTTGTGGTATGGACCACACAGAGTTAAGTACTTGGGTCCATTCTCTGCTCAAACTCCATCGTA
CCTAAAAGGAGAATTTCCTGGTGATTATGGATGGGATACCGCTGGATTATCTGCTGATCCAGAGGCCTTTGCTAA
GAACAGGGCTCTTGAGGTTATTCATGGAAGATGGGCTATGTTGGGAGCACTCGGATGCATAACCCCCGAAGTACT
ACAGAAATGGGTTAAGGTCGACTTTAAGGAACCCGTATGGTTCAAAGCTGGTTCACAAATCTTCTCACAAGGCGG
TCTTGACTACTTGGGAAACCCAAACCTTGTCCATGCCCAGAGTATCTTGGCTGTTTTAGGTTTCCAAGTTCTGCT
TATGGGTCTTGTCGAAGGTTTCCGTATTAACGGATTACACGGAGTTGGTGAGGGAAACAACTTGTACCCTGGTGG
AACCTACTTCGACCCATTGGGACTTGCTGATGACCCTGTTACCTTTGCTGAATTGAAGGTGAAGGAAATTAAGAA
TGGACGTCTTGCTATGTTTTCTATGTTTGGCTTCTTTGTTCAAGCCATTGATACCGGAAAAGGTCCTCTTGAGAA
CCTCTTTGATCACCTTGACAACCCTGTTGCTAACAATGCTTGGGTTTACGC

Figure 2 continued

> SEQ ID NO:1370 104423 130831_300491_1b
GAATTCGGGCACAGCTGTAGCTTTGAACGCACAGGGGAAATTCCCAACCAATGTTAGATCCAGTAGCAATGGAAT
GATTGTGATGAGGAAGACATCAGCAAAGAAGCCTGCTGCTTCTTCAGGAAGCCCATGGTACGGTCCAGACCGTGT
CAAGTACCTTGGACCCTTCTCTGGTGAGTCTCCATCTTACCTAACTGGTGAGTTCCCTGGTGATTACGGCTGGGA
TACTGCTGGACTATCTGCAGACCCAGAGACCTTTGCCAAGAACAGGGAATTGGAAGTGATTCATTCCAGGTGGGC
TATGCTTGGCGCTTTGGGATGTGTTTTCCCTGAACTTCTCTCTAGAAATGGAGTTAATTTTGGAGAAGCAGTCTG
GTTCAAAGCTGGTTCTCAGATTTTCAGTGAAGGTGGACTTGACTACTTGGGAAACTCCAGCCTGGTTCATGCACA
GAGCATCTTAGCTATTTGGGCAACCCAAGTTATCCTTATGGGAGCTGTTGAGGGATACAGAGTTGCCGGTGGTCC
ACTAGGTGAGATCGTCGACCCACTTTACCCAGGTGGTAGCTTTGACCCCTTAGGACTTGCAGAGGACCCAGAGGC
ATTTGCTGAGCTGAAGGTAAAGGAACTTAAGAACGGGAGACTTGCTATGTTCTCCATGTTCGGATTCTTCGTTCA
GGCTATTGTTACCGGCAAAGGTCCTTTAGAGAATCTGGCAGATCACCTGTCTGACCCTGTGAACAACAATGCTTG
GTCATATGCTACCAATTTTGCTCCAGGAAAGTGAGAATGTACATGATAGTCAACTAAGATGATTTCATTTCCTTC
AAAAGGCGAAGGAGATGGCTTTTCTTATCTTTCAACTTTTGTACATACATCCATTTAGCTTGTAAAACAATCTGG
CATTCGGATTAATTTGTACTTAA

> SEQ ID NO:1371 104423 130252_300486_1b
GAATTCAATGGCTGCTTCAACAATGGCTCTCTCTTCTCCTTCTCTTGCTGGAAAGGCAGTGAAGCTAACTCCATC
CATTCCAGAAGGCGAAGGAAGAATTACCATGCTCTTCCAGAAAAAGACACCGGCAAAAGCAGCTAAATCATCCAA
ACCCGCAGTTTCATCTAACAGCCCATGGTATGGTCCTGACAGAGTTAAGTACTTGGGACCTTTCTCCGGTGAGGC
ACCATCATATCTCAATGGTGAATTTCCTGGTGACTATGGTTGGGATACCGCTGGGTTATCTGCTGATCCTGAAAC
TTTCGCCAAGAACCGTGAGCTTGAAGTGATCCATTGCAGATGGGCTATGCTCGGAGCTCTAGGATGCATCTTCCC
TGAATTGCTCTCGCGCAATGGAGTTAAATTCGGTGAAGCCGTTTGGTTCAAAGCCGGAGCACAGATTTTCAGCGA
GGGAGGATTGGACTACTTAGGTAACTCAAGCTTAGTACATGCTCAAAGCATTTTAGCTATTTGGGCGACACAAGT
TATCCTGATGGGTGCAGTGGAAGGTTACCGTGTCGCCGGTGGACCTCTTGGTGAGATTGTCGACCCACTGTACCC
CGGTGGCAGCTTCGACCCTCTTGGACTTGCTGATGACCCAGAGGCTTTTGCTGAATGGAAGGTGAAGGAGATTAA
GAACGGAAGATTGGCGATG

> SEQ ID NO:1372 104423 11980_300283_1b
TGGTATCAACGCAGAGTGGCCATTACGGCCGGGGCCCTTTCTCTGGTGAGTCTCCAAGCTACTTGACTGGTGAGT
TTCCTGGTGACTACGGATGGGACACTGCCGGACTTTCAGCTGATCCAGAAACTTTTGCCAAGAACCGTGAGTTGG
AGGTGATCCACTGCAGATGGGCCATGCTTGGAGCTCTTGGATGTGTCTTCCCCGAACTCTTGGCCCGTAACGGTG
TCAAGTTCGGTGAGGCTGTATGGTTCAAGGCTGGATCCCAAATTTTCAGCGAGGGTGGACTTGACTACTTGGGCA
ACCCAAGTTTGGTCCATGCACAAAGCATCTTGGCCATTTGGGCTTGCCAAGTTGTATTGATGGGAGCCGTTGAGG
GTTACCGTGTTGCTGGTGGGCCTCTTGGGGAGGTTGTTGATCCACTTTACCCCGGTGGCAGCTTCGACCCATTGG
GCCTCGCTGAAGACCCAGAAGCTTTTGCTGAGCTCAAGGTAAAAGAGATCAAGAATGGTAGACTTGCCATGTTTT
CTATGTTTGGATTCTTTGTTCAGGCTATCGTAACTGGAAAGGGTCCATTGGAGAACCTTGCCGATCACCTTGCAG
ATCCAGTAAACAACAATGCTTGGGCCTACGCTACAAACTTTGTCCCCGGAAAGTGATTTAACAAAAGTTCATAAT
CTCTAATCTTCAAGTAGCTAGTGTTTGATATGTAGCTTGTGAGTGATGAACCCAAAGAAGGGTCAGGTTTATTTT
GAGCATTCTGGGTTATGG

> SEQ ID NO:1373 104423 118146_300064_1b
CTAAGCATCAGCACAAATAAGATTAAAAATCTTACAAATGGCTACTTCTGCAATTCAACAATCTGCATTTGCTGG
ACAGACAGCTCTTAAGTCACAGAATGAGCTCGTTAGGAAGATTGGTAGCTTTAATGGTGGACGTGCCACTATGCG
ACGTACGGTTAAAAGTGCCCCACAAAGCATTTGGTATGGAGAAGACAGACCAAAGTACTTGGGACCATTCTCCGA
GCAAACTCCTTCTTACTTGACTGGTGAGTTTCCGGGTGATTATGGGTGGGATACCGCGGGACTTTCAGCTGACCC
TGAAACATTCGCCAGGAACCGTGAGCTTGAGGTGATCCATTGCCGTTGGGCCATGCTTGGTGCTTTGGGTTGTGT
CTTCCCTGAAATCCTTTCCAAGAATGGTGTTAAATTTGGTGAGGCAGTTTGGTTCAAGGCTGGATCCCAAATCTT
CTCAGAAGGCGGTCTTGACTACCTTGGTAACCCAAACCTTATTCATGCACAAAGCATTCTTGCTATTTGGGCATC
CCAAGTTGTGCTCATGGGCTTAATTGAAGGATACAGAGTTGGCGGAGGCCCACTGGGTGAAGGTCTTGACAAGAT
CTATCCGGGAGGAGCTTTTGACCCACTAGGGCTCGCTGATGATCCCGAGGCATTCGCTGAGTTGAAGGTGAAGGA
AATCAAGAACGGCCGATTGGCTATGTTCTCAATGTTTGGATTTTTCGTTCAAGCCATTGTCACAGGAAAGGGACC
AATTGAAAACCTTTACGATCATATTGCTGACCCTGTTGCCAACAACGCATGGGCTTTTGCCCACTAACTTTGTACC
CGGAAAATGAAATGAATAGCCTGTAATATGTAAAATTTGTGGAGCTAGTTGTTTCATATTCTTGATGTGATATGA
ACTTGCTAATATATATGCAAAAGCCAATATCCCATAAAAAAAAA

> SEQ ID NO:1374 104423 1171461_302055_1b
TATTGTTCAACTCATCAAGAGGTAGCAACTGCAATGGCTTTCTCTTCCTCCCTGGCCGGTCAAGTAGTGTTGAAG
CCACAGAGCGAGCTAGCAGCGAAGGTGGGCAACAATGTATTGGGCGAGGCAAGAGTTAGCATGAGGAAAACTGCC
TCTAGAGTTTCGGTGCCAGACAGCCCATGGTATGGCCCAGAACGGGTCAAGTACCTAGGCCCATTCTCCGGTGAC

Figure 2 continued

TCACCCTCATACCTGACCGGGGAGTACCCTGGCGACTATGGCTGGGATACTGCTGGCCTTTCTGCTGACCCCGAG
ACCTTTGCCCGCAACAGGGAGCTAGAGGTCATCCACTGCCGATGGGCCATGTTGGGCGCACTGGGCTGTGTCTTC
CCCGAGCTCCTCTCAAAGAACGGTGTCAAGTTTGGCGAAGCTGTCTGGTTCAAGGCTGGGTCTCAGATCTTTGCC
GAGGGTGGGCTTGACTACCTGGGTAACCCTAGCCTGGTCCATGCCCAGTCTATCCTTGCCATCTGGGCTTGCCAG
GTCATCTTGATGGGTGCTGTTGAAGGCTACCGTGTTGCTGGTGGGCCCCTTGGCGATGTAACTGACCCCATCTAC
CCTGGTGGCAGCTTCGACCCCCTAGGGCTAGCTGATGACCCCGAGGCCTTCTCTGAGCTGAAAGTGAAGGAGATA
AAGAATGGACGGCTGGCTATGTTCTCCATGTTTGGATTCTTCGTGCA

> SEQ ID NO:1375 104423 6251_300336_1b
CCCACGCGTCCGGGCAGGCTCTCAGATTTTCTCAGAAGGAGGTCTTGATTACCTCGGAAACCCTAACTTGATCCA
CGCGCAAAGCATCTTAGCCATCTGGGCTGTTCAAGTTGTGCTCATGGGGTTCATTGAAGGCTACAGAATCGGAGG
TGGACCACTCGGAGAAGGACTTGACCCGCTTTATCCCGGAGGTGCGTTCGACCCATTGAACTTGGCTGAGGATCC
AGAGGCTTTCTCTGAGCTGAAGGTGAAGGAGCTCAAGAACGGTCGTCTTGCCATGTTCTCTATGTTTGGATTCTT
TGTCCAAGCCATTGTTACTGGTAAAGGTCCCATTGAGAACTTATTTGATCATTTGGCTGATCCTGTGGCTAACAA
CGCCTGGTCTTACGCTACT

> SEQ ID NO:1376 104423 254023_301631_1b
GTCAAGGGAAGAAGAGGAGGAAGGTCTTGGCTATGGCTTCCGCAGTGTGTGCATCGCTCACCTCGTCCTTGGTCG
GTCAGATTGAGCTTAAACCTCAGAATGAGCTCTCAAGGAAGGTTTCCCATGGCGAAGCTAAAGTTACTATGAGGA
GAACTGTCAAGACTGCCCCTGAGAGTATCTGGTATGGGTCGGATCGTCCCAAGTTCTTGGGTCCATTTTCAGAGA
GCACACCGTCATATTTGACAGGCGAGTTTCCAGGCGATTATGGGTGGGACACAGCAGGGCTATCAGCAGATCCGG
AAACATTTGCCCGGAACCGCGAGTTGGAGGTGATCCACTCACGCTGGGCAATGTTGGGGGCCTTGGGTTGCGTAA
CCCCGGAGCTACTCGCAAAGAATGGGGTGAAGTTTGGCGAGGCGGTGTGGTTTAAGGCGGGCTCGCAAATCTTCT
CCGAGGGGGGCCTTGACTACCTTGGAAACCCCAACTTGATCCACGCCCAGAGCATCCTCGCCATCTGGGCTTGCC
AGGTGGTCCTCATGGGTGCTGTAGAAGGCTACAGGGTTGGTGGTGGCCCCCTCGGTGAAGGTTTGGACCCAATCT
ACCCCGGAGGTGCCTTTGACCCACTTGGTCTTGCCGATGACCCCGACTCCTTTGCTGAATTGAAGGTGAAGGAGT
TAAAGAATGGGAGATTG

> SEQ ID NO:1377 104423 251963_301662_1b
AGGAGGGTGGACTCGACTACCTGGGCAACCCCAGCCTGATCCACGCCCAATCCATTCTCGCCATCTGGGCCTGCC
AGGTCATCCTCATGGGCGCAGTGGAGGGCTACCGCGTCGCCGGGGGCCGTTGGGCGAGGTGACGGACCCGATCT
ACCCAGGTGGCAGCTTCGACCCCCTCGGATTGGCAGAGGATCCCGAGGCGTTTGCGGAGCTCAAGGTGAAGGAGA
TCAAGAACGGACGGCTGGCGATGTTCTCCATGTTTGGGTTCTTCGTCCAGGCCATCGTCACCGGCAAGGGACCGT
TGGAGAATCTGTCCGACCACCTGGCCGATCCGGTGTCTAACAATGCCTGGGCATATGCCACCAACTTCACCCCCG
GGTCCTAGACGGATGCCAAGGGGATCTTCCAGGGCATGGTGGCAAAAAGAGGCGAATCTTTTCGTTGGCGACGAC
ATTGGCTGGGGGTTCTGTTTCTTTTCTTCTTCTA

> SEQ ID NO:1378 104423 247540_301621_1b
GCTCTTCATTGCCCTCTCTCTCAATCTCTAGCTCGCTATAGAAATGGCCGCATCGATCAGCAGCTCCTCATTCTC
CGGCCAGACCGCGCTCAAGTCTCCCAATGAGCTCGCCAGGAAAGTCGGGAATCTGGGAGAAGCGCGCACCGTGAT
GCGAAGAACCAGAGCAAGCACTCCGGAGAGCATTTGGTACGGTCCAGACCGACCAAAGTTCCTCGGACCTTTCTC
CGAGCAGACCCCCTCCTATCTCACCGGTGAGTTCCCCGGTGATTACGGCTGGGACACCGCTGGGCTTTCCGCCGA
TCCGGAGACGTTTGCACGGAACCGGGAGCTGGAAGTCATCCACTGCCGCTGGGCCATGCTTGGAGCTCTCGGCTG
CGTCACCCCGGAGCTGCTGTCCAAGAACGGCATCAAGTTTGGAGAGTCGGTGTGGTTCAAGGCCGGGTCACAGAT
CTTCAAGGAAGGTGGTCTGGACTACTTGGGAAATCCAAACCTTGTCCATGCACAGAGCATCCTTGCTATCTGGGC
TTCCCAGGTTATTCTTATGGGTCTTGTGGAAGGATACAGAGTTGGAGGTGGACCTCTAGGTGAGGGGCTTGACAA
GATCTATCCCGGGGGTGCGTTTGATCCACTGGGACTTGCTGATGATCCGGATAGCTTTGCTGAGCTCAAAGTGAA
GGAGGTGAAGAATGGAAGGC

> SEQ ID NO:1379 104423 215969_300886_1b
GCGCCATCTCTCTCAGCTCTCACAGCTCACTGCATCAATGGCCGCGGCCACCATGGCGCTCTCCTCCCCGGTGAT
GGCCCGCGCGGCGCCGTCGACCTCCTCCGCGCTCTTCGGCGAGGCGCGGATCACCATGCGCAAGACCGCCGCGAA
GCCCAAGCCGGCGGCGTCGTCGGGGAGCCCGTGGTACGGCGCCGACCGCGTCCTCTACCTCGGCCCGCTCTCCGG
CGAGCCGCCGAGCTACCTCACCGGCGAGTTCCCGGGCGACTACGGGTGGGACACCGCGGGGCTCTCCGCCGACCC
GGAGACGTTCGCCAAGAACCGGGAGCTGGAGGTGATCCACTCCCGGTGGGCGATGCTGTGCGCGCTCGGCTGCGT
CTTCCCGGAGCTCCTCGCCCGGAACGGCGTCAAGTTCGGCGAGGCCGTGTGGTTCAAGGCGGGCTCGCAGATCTT
CAGCGAGGGCGGGCTCGACTACCTCGGCAACCCGAGCCTGATCCACGCGCAGAGCATCCTCGCCATCTGGGCGGT
GCAGGTGGTGCTCATGGGCGCCGTCGAGGGGTACCGCATCGCCGGCGGGCCGCTCGGCGAGGTCGTCGACCCGCT
CTACCCCGGCGGCGCCTTCGACCCGCTCGGCCTCGCCGATGACCCCGAGGCGTTCGCGGAGCTCAAGGTGAAGGA

Figure 2 continued

GATC

> SEQ ID NO:1380 104423 201255_300714_1b
GCAGCAGCAGCAGCAGCTGAGCTTGAAGCAGCAGAGCGAGGTAGACATGGCCGCCGCCACCATGGCCCTCTCGTC
CCCGGCGCTGGCCGGCAAGGCCGCCGCGAAGGTGTTCGGCGAGGGGCGCATCACCATGCGCAAGTCGGCGGCGAA
GCCCAAGCCCGCCGCGTCGGGGAGCCCGTGGTACGGCGCCGACCGCGTGCTCTACCTCGGCCCGCTCTCCGGCGA
GCCGCCGAGCTACCTGACCGGCGAGTTCCCCGGCGACTACGGGTGGGACACCGCGGGGCTCTCCGCCGACCCGGA
GACGTTCGCCAAGAACCGGGAGCTGGAGGTGATCCACTCCAGGTGGGCGATGCTCGGCGCGCTGGGCTGCGTGTT
CCCCGGAGCTCCTCGCCCGCAACGGCGTCAAGTTCGGCGAGGCGGTGTGGTTCAAGGCGGGGTCGCAGATCTTCAG
CGAGGGCGGGCTCGACTACCTCGGCAACCCGAGCCTGATCCACGCGCAGAGCATCCTCGCCATCTGGGCGGTCCA
GGTGGTGCTCATGGGCGCCGTCGAGGGGTACCGCATCGCCGGCGGGCCGCTCGGCGAGGTCGTCGACCCGCTCTA
CCCCGGCGGCAGCTTCGACCCGCTCGGCCTCGCCGACGACCCGGAGGCCTTCGCGGAGCTCAAGGTGAAGGAGAT
CAAGAACGGCCGCCTCGCCATGTTCTCCATGTTCGGCTTCTTCGTCCAGGCCATCGTCACCGGCAAGGGCCCCCT
CGAGAACCTCGCCGACCACCTCGCCGACCCCGTCAACAACAACGCCTGGGCCTACGCCACCAACTTCGTCCCCGG
CAAGTGAGCGCCGCCGCCGCCGTGCTGCCATGGCGACGCATCGCCTTCAGCTAAGCTAGCTAGGTTGACGACGAT
GCGCGTCTCTGCAGGAGAGTGTGCGTGTGTGTACGCGGTGCAGTAGATGTACGTACGTGTACCGTATAGATGTAC
GTATTCGTGTGGACCGCGTGGATGGATGTACGAGTATTGGAGAGAAGGTGAGATCTGTACCGGTAGTGTGTATTT
CTGTGCAGGTTCTGAACCTGATCAATGAAATATGGTGTTGTGAATTAATTATAAAAACAAAAAAAAA

> SEQ ID NO:1381 104423 201223_300714_1b
CCCACGCGTCCGAAAAACCAACCCAACCGCCGCCGCATCGCCCTCGTTAGAACGATGGCCGCGTCGGGGCTGCAC
CAGACCACCAGCTTCCTCGGCACCGCCCCTCGCCGGGATGAGCTCGTCCGCCGCGTCGGCGACTCCGGTGGCCGC
ATCACCATGCGCCGCACCGTCAAGAGCGCGCCCCAGAGCATCTGGTATGGACCTGACCGTCCCAAGTACCTGGGC
CCGTTCTCGGAGCAGACGCCATCGTACCTGACCGGAGAGTTCCCGGGAGACTACGGGTGGGACACGGCGGGGCTA
TCGGCCGACCCGGAGACGTTCGCGAGGAACAGGGAGCTGGAGGTGATCCACTCGCGGTGGGCGATGCTGGGGGCG
CTGGGCTGCGTCTTCCCGGAGATCCTGTCCAAGAACGGGGTGAAGTTCGGGGAGGCGGTGTGGTTCAAGGCCGGC
GCGCAGATCTTCTCCGAGGGGGGGCTCGACTACCTGGGGAACCCCAACCTGGTGCACGCGCAGAGCATCCTCGCC
ATCTGGGCGGTCCAGGTGGTGCTCATGGGATTCGTCGAGGGCTACCGCGTCGGCGGCGGCCCGCTCGGCGAGGGC
CTCGACAAGGTGTACCCAGGCGGCGCCTTCGACCCGCTCGGCCTCGCCGACGACCCTGACACCTTCGCCGAGCTC
AAGGTGAAGGAGCTCAAGAACGGCCGCCTCGCCATGTTCTCCATGTTCGGCTTCTTCGTCCAGGCCATCGTCACC
GGCAAGGGCCCCATCGAGAACCTCTTCGACCACGTCGCCGACCCCGTCGCCAACAACGCCTGGGCATACGCCACC
AACTTCGTCCCCGGCAAGTGAGCACAACGACACGATCGAGATGGTGCCAACCAACGTACCATGTGTACACTTGTA
GTAGCCACGCACCGACCCTGCAGTTGCAGTTGCAGCAGTGCATGTATGTATGTACCTTAATTGTGTGTGTGTGTG
TGATCGATCGAGGAGATTTCTAGCTTAATTAATTTCTGTCTGTCATCATCTTTGCTTCTTTGGATCGAGATTTAA
TGTAAGCCGCAGGCCGCATCCAAGGGATGATCGAATTAATG

> SEQ ID NO:1382 104423 272804_200132_1b
AAAAAAGAAGCTTCTTTAGCTCACCAATTAAACAAATGGCCACTTCTGCAATTCAAGAATCTGCATTTGTTGGCC
GGACAGTGGCTAAATCACAAAATGAGCTTGTTAGGAAAATTGGCAGCTTTGGCGGAGGCCGTGCTACCATGAGAC
GTACTGTTAAAAGCGCTCCTCAAAGCATCTGGTATGGAGAAGACCGTCCAAAATATTTGGGCCCATTCTCTGAGC
AAACTCCATCTTACCTTACTGGTGAATTTCCCGGTGATTACGGATGGGATACTGCTGGACTCTCAGCTGACCCAA
AGACATTTGCCAAAAACCGTGAACTTGAGGTGATCCATTGTCGTTGGGCCATGCTTGGTGCTTTGGGTTGTGTCT
TCCCTGAAATTCTATCAAAGAATGGTGTTAAATTCGGTGAAGCAGTTTGGTTCAAGGCAGGAGCCCAAATCTTTT
TAGAAGGTGGACTTGACTACCTTGGCAACCCAAACCTTGTCCACGCCCAGAGCATCCTCGCCATTTGGGCTTGCC
AAGTTGTCCTAATGGGCTTGATTGAAGGATACAGGGTTGGTGGAGGCCCACTTGGTGAAGGTCTTGACAAGATCT
ATCCGGGAGGTGCCTTCGACCCACTTGGCCAGCTGATGATCCCGAGGCTTTTGCTGAGTTGAAGGTTAAGGAAA
TCAAGAATGGACGATTGGCTATGTTTTCAATGTTCGGATTCTTTGTTCAGGCTATTGTTACAGGAAAAGGCCCAA
TCGAGAACCTTTACGACCACATTAATGACCCAGTAGCCAACAATGCTTGGGCTTTTGCTACCAACTTTGTACCCG
GAAAGTGAAATGTTTAGTCTGTGCTATATGTAAAAATTAGGGCTAATGAAGTTCTCTGCTTGTAAAAGATTGGGC
TGTTCCTACTATTTAACATGCTGATGTTTCTGCAGAAGATACTGAATATT

> SEQ ID NO:1383 104423 1928_300335_1b
AATTCGGCACGAGGTGATCTTGAGGTGATCCATTGCCGTTGGGCCATGCTTGGTGCTTTGGGTTGTGTCTTCCCT
GAAATCCTTTCCAAGAATGGTGTTAAATTTGGTGAGGCAGTTTGGTTCAAGGCTGGATCTCAAATCTTCTCAGAA
GGCGGTCTTGACTACCTTGGTAACCCAAACCTTATTCATGCACAGAGCATTCTTGCTATTTGGGCATCCCAAGTT
GTGCTCATGGGTTTAATTGAAGGATACAGAGTTGGTGGAGGCCCACTTGGTGAAGGTCTTGACAAGATCTATCCG
GGAGGAGCTTTTGACCCACTAGGGCTCGCTGATGATCCCGAAGCATTTGCTGAATTG

> SEQ ID NO:1384 104423 181959_300658_1b

Figure 2 continued

GAATTCAGGTAAGAATGGCAACCATGGCTCTGTCTTCTCCATCATTTGCAGGCAAAGCTGTGACTCTAAACCCGG
GAACAGAATTCCCAACCAATGTAAGATCTGGCAGCAACAGCAAGATCTCGATGAGGAAGACATCCGCAAAGAAGC
CTGCTGCTTCTTCAGGAAGTCCATGGTATGGTCCAGACCGTGTCAAGTACCTCGGTCCCTTCTCTGGTGAGTCTC
CATCCTACTTAACTGGTGAATTCGCTGGTGACTATGGCTGGGACACTGCTGGACTATCAGCTGATCCAGAGACCT
TTGCCAAGAACCGCGAACTTGAGGTGATCCATTCAAGGTGGGCGATGCTTGGCGCTTTGGGCTGTGTCTTCCCTG
AACTCCTCTCGAGAAATGGAGTCAAATTCGGCGAAGCAGTTTGGTTCAAAGCCGGCTCTCAGATATTCAGTGAAG
GAGGACTTGACTATTTGGGAAATTCCAGCTTGGTTCATGCACAGAGCATCCTGGCTATATGGGCCACTCAAGTCA
TCCTTATGGGCGCCGTCGAAGGCTACAGAGTTGCTGGCGGTCCACTAGGTGAGGTTGTTGATCCCCTTTACCCAG
GTGGAAGCTTCGATCCATTAGGCCTCGCAGAGGACCCAGAGGCATTTGCCGAGCTAAAGGTAAAAGAACTAAAGA
ACGGGCGACTTGCTATGTTCTCCATGTTTGGGTTCTTCGTTCAGGCTATTGTGACGGGCAAAGGTCCTCTAGAGA
ACCTGGCAGACCACCTTGCCGACCCAGTGAACAACAATGCCTGGTCATATGCTACGAACTTCGCTCCCGGGAAGT
GAGCATAAGCATAGCAAAGGCAAAATGGAGTTTGATTTCCTACTTTTTTTCTGTAATATCCTCTGTACATTCATT
TAGCTTGTAAAATTGTGTAGAATGTAGCTGCGGTTGGTCT

> SEQ ID NO:1385 104423 175573_300545_1b
ACGCGTCGCCACGCGTCGGCATCTCTCTCAGCTCTCACAGCTCACTGCATCAATGGCCGCGGCCACCATGGCGCT
CTCCTCCCCGGTGATGGCCCGCGCGGCGCCGTCGACCTCCTCCGCGCTCTTCGGCGAGGCGCGGATCACCATGCG
CAAGACCGCCGCGAAGCCCAAGCCGGCGGCGTCGTCGGGGAGCCCGTGGTACGGCGCCGACCGCGTCCTCTACCT
CGGCCCGCTCTCCGGCGAGCCGCCGAGCTACCTCACCGGCGAGTTCCCGGGCGACTACGGGTGGGACACCGCGGG
GCTCTCCGCCGACCCGGAGACGTTCGCCAAGAACCGGGAGCTGGAGGTGATCCACTCCCGGTGGGCGATGCTGGG
CGCGCTCGGCTGCGTCTTCCCGGAGCTCCTCGCCCGGAACGGCGTCAAGTTCGGCGAGGCCGTGTGGTTCAAGGC
GGGCTCGCAGATCTTCAGCGAGGGCGGGCTCGACTACCTCGGCAACCCGAGCCTGATCCACGCGCAGAGCATCCT
CGCCATCTGGGCGGTGCAGGTGGTGCTCATGGGCGCCGTCGAGGGGTACCGCATCGCCGGCGGGCCGCTCGGCGA
GGTCGTCGACCCGCTCTACCCCGGCGGCGCCTTCGACCCGCTCGGCCTCGCCGATGACCCCGAGGCGTTCGCGGA
GCTCAAGGTGAAGGAGATCAAGAACGGCCGCCTCGCCATGTTCTCCATGTTCGGCTTCTTCGTCCAGGCCATCGT
CACCGGCAAGGGCCCCCTCGAGAACCTCGCCGACCACCTCGCCGACCCCGTCAACAACAACGCCTGGGCGTACGC
CACCAACTTCGTCCCCGGCAAGTGAAGTGGGGACCGTAGCTTAGCAGTGGTTAATTGTGGTTGGATGGATTTGT
GGCCAGCGAGTTCGTTGTCTTTGGGTTGGGGAAGATGGGTTTAGTGCGACGAGATGATGATCGAGTTGGTGTTGT
GTACACTAAGAAGATGAAGAAGAAGATGATGTTTTTGCAATAATGATTTTATTCGTTTCCCAACTAATGGTCTAG
GTACTTATCCGTGGTGTTATTCTGGTTAGCGGATTTCTCATCTCTATTAGATCGGAAACAAATACTTCCCTCGAT
CCCAAAATAT

> SEQ ID NO:1386 104423 167530_300548_1b
GAATTCACTAGAAAAGAGAGTCATGGCCACCTCTGCCATTCAAAGGTCTGCATTCGCTGGTCAAACTGCTTTGA
AGCAACAAAATGAGTTCATCCGCAAAGTTGGCAATGTGGAAGGTGGTCGTATCTCCATGCGCCGACTGTAAAAA
GCATTCAGTCAAGCATGTGGTATGGACCAGACAGACCTAAGTACTTGGGACCATTCTCAGAACAGACCCCATCTT
ACCTCACTGGTGAATTTCCAGGTGACTACGGTTGGGACACAGCCGGGTTATCTGCTGACCCAGAGACATTTGCAA
AGAACCGTGAACTCGAAGTGATCCACTGCAGGTGGGCTATGTTGGGTGCCCTAGGATGTGTCTTCCCTGAGGTTC
TCTCAAAGAACGGTATCAACTTTGGCGAGGCAGTATGGTTCAAAGCTGGATCACAGATCTTCTCTGAGGGAGGTT
TGGACTACCTTGGAAACCCTAACTTGGTACATGCCCAAAGCATTCTTGCAATCTGGGCTACTCAGGTTGTGCTAA
TGGGGTTTGTTGAGGGATACAGAGTTGGTGGTGGTCCACTTGGAGAAGGACTAGACAAACTTTACCCCGGTGGAT
CTTTTGACCCTCTAGGATTAGCTGATGACCCAGAGTCATTCTCTGAATTGAAGGTAAAGGAAATCAAGAATGGAA
GACTTGCTATGTTCTCTATGTTTGGGTATTTCGTTCAGGCTATTGTTACCGGAAAGGGTCCAATTGAAAACCTTT
ATGACCACGTCGCCGATCCTGTTGCAAATAACGCATGGGCTTACGCTACTAACTTTGCTCCTGGAAAATGAATGT
AAATTTTCCTAGGGTGTATCA

> SEQ ID NO:1387 104423 116605_300079_1b
GTCAAGTTCGGCGAGGCCGTGTGGTTCAAGGCGGGCTCGCAGATCTTCAGCGAGGGCGGGCTCGACTACCTCGGC
AACCCGAGCCTGATCCACGCGCAGAGCATCCTCGCCATCTGGGCGGTGCAGGTGGTGCTCATGGGCGCCGTCGAG
GGGTACCGCATCGCCGGCGGGCCGCTCGGCGAGGTCGTCGACCCGCTCTACCCCGGCGGCGCCTTCGACCCGCTC
GGCCTCGCCGATGACCCCGAGGCGTTCGCGGAGCTCAAGGTGAAGGAGATCAAGAACGGCCGCCTCGCCATGTTC
TCCATGTTCGGCTTCTTCGTCCAGGCCATCGTCACCGGCAAGGGCCCCCTCGAGAACCTCGCCGACCACCTCGCC
GACCCCGTCAACAACAACGCCTGGGCGTACGCCACCAACTTCGTCCCCGGCAAGTGAAGTGGGGACCGTAGCTT
AGCAGTGGTTAATTGTGGTTGGATGGATTTGTGGCCAGCGAGTTCGTTGTCTTTGGGTTGGGGAAGATGGGTTTA
GTGCGACGAGATGATGATCGAGTTGGTGTTGTGTACACTAAGAAGATGAAGAAGAAGATGATGTTTTTGCAATAA
TGATTTTATTCGTTTCCC

> SEQ ID NO:1388 104423 113177_300022_1b
TCAAACCAAGAATGCTAACCCTCTTAGGGATGTTGTCCGTATGGGCTCTGCCAAATTCACTATGGGAAATGACTT

Figure 2 continued

ATGGTATGGACCAGACCGTGTCAAGTACTTAGGACCCTTTTCTGCTCAAACTCCTTCATACTTGACCGGAGAATT
CCCTGGTGACTATGGTTGGGACACTGCTGGTTTATCTGCTGATCCTGAAGCCTTCGCGAAGAACAGAGCTCTTGA
GGTTATCCATGGGAGATGGGCAATGCTTGGAGCACTAGGTTGCATCACCCCAGAAGTTCTTGAAAAATGGGTGAA
AGTAGACTTCAAAGAACCAGTATGGTTCAAAGCAGGAGCTCAAATCTTCAGCGAAGGCGGACTTGACTACTTAGG
CAACCCTAACCTTGTGCATGCTCAGAGTATTCTAGCTGTGCTAGGTTTCCAAGTTGTGCTCATGGGACTTGTTGA
AGGTTTTAGAATTAATGGACTTCCTGGAGTTGGAGAAGGCAATAACTTATACCCTGGTGGTCAATATTTTGACCC
ACTTGGCCTAGCCGATGACCCCACAACCTTTGCTGAGCTTAAGGTAAAGGAGATCAAGAACGGAAGGTTGGCAAT
GTTCTCCATGTTCGGATTCTTTGTTCAAGCTATTGTTACCGGCAAAGGCCCTCTTGAGAACCTATTGGACCACCT
TGACAACCCTGTTGCTAACAATGCTTGGGTTTATGCCACAAAGTTTGTTCCTGGAGCTTAAGATGATTTTGTCTT
ATGTCTCAATTCTAGTGTTTTGTGTAATTGTATCTTCAGAAATGCAAATATGGTGTAGATG

> SEQ ID NO:1389 104423 1115751_301911_1b
TGGCGATTTGGGCATGCCAGGTGGTGCTGATGGGAGCTGTGGAAGGGTACAGAGTTGGTGGCGGCCCGCTAGGAG
AAGGGCTCGACCCAATATACCCCGGGGGTGCATTCGACCCACTCGGGCTGGCCGACGACCCCGAGTCGTTTGCCG
AGTTGAAAGTGAAGGAGATTAAGAACGGGAGGCTAGCGATGTTCTCGATGTTTGGGTTCTTCGTGCAGGCGATAG
TGACAGGGAAGGGACCGATCGAGAACCTTTCCGACCACTTGGCGGATCCCGCGATCAACAACGCATGGGCTTACG
CCACCAACTTTGTCCCTGGAAAGTAGGCCATTATCTTTTATTAGCCCCACCTCTCTCTCTCTTCTTCTGTACAAA
AGACATCTCAGATTTAGGCTTCATATGTTTCATCATGAGTTTTTTTTAGCCCCTCCTTGCAAAGAGGGGAAGCT
CCTATTTGGAATTGTTTCTCCTCTTTTTTAATCATTAATCCTATGAATCAATGAAACTCTTTGATGG

> SEQ ID NO:1390 104423 103543_300363_1b
TGGTATCAACGCAGAGTGGCCATTACGGCCGGGGATCACAACTAACTTTGACATCTCAAACTAGCAACCTCTCAC
TTTCCTCTTGATAAACCATGGCTGCTTCTACAATGGCTCTTTCTTCCCCTTCTTTCGCTGGACAGGCAGTGAAAC
TCTCCCCATCTGCCTCAGAAATCACTGGAAATGGAAGGGTCTCCATGAGAAAGACTGTCGCCAAACCCGTCGCAT
CTAGCAGCCCATGGTACGGTCCAGACCGTGTTAAGTACTTGGGCCCATTCTCCGGTGAGGCCCCAAGCTACTTGA
CCGGTGAATTCCCAGGTGATTACGGGTGGGATACTGCTGGACTTTCAGCAGATCCAGAAACTTTTGCCAAGAACC
GTGAACTCGAGGTGATCCACTGCAGATGGGCTATGCTTGGTGCTCTTGGATGTGTCTTCCCTGAGCTTTTGGCTC
GTAACGGTGTCAAGTTTGGTGAGGCTGTGTGGTTCAAGGCTGGATCACAAATCTTTAGTGAGGGTGGACTTGACT
ACTTGGGCAACCCAAGCTTGGTCCATGCACAAAGCATCTTGGCAATCTGGGCTTGCCAAGTTATCTTGATGGGAG
CCGTTGAGGGTTACCGTGTTGCTGGTGGGCCTCTTGGTGAAGTTGTCGACCCACTCTACCCTGGTGGCAGCTTTG
ACCCATTAGGCCTTGCTGATGACCCAGAGGCATTTGCCGAGCTCAAGGTAAAGGAGATCAAGAATGGCAGACTTG
CCATGTTTTCTATGTTCGGATTCTTTGTTCAGGCCATTGTTACCGGAAAAGGTCCATTGGAGAACCTTGCTGACC
ACCTTGCAGACCCCGTTAACAACAATGCGTGGGCCTACGCCACAAACTTTGTTCCCGGAAAGTGAATCTTAAAAC
ATTCTCAAAATTCTGATTGTTTGATGGCCTTGTAAAGCTGTTGTGAGTTACCTGACAATATAATGCGATTTTGTT
TGTG

> SEQ ID NO:1391 104874 11522_300292_1b
TGGTATCAACGCAGAGTGGCCATTACGCCGGGGGGGATTGATCCAGTCACACACCAGCCAATTACTGTTAACCAA
CCAAACATAGAACAGCCAACAAAAAATCAACCAATTATTCAACAAGAAAAACAAACAACAATGCCAATTTCCCCA
TCTCATGTTGTCCCAGAAATAATGGATATTCTTGATCACAACAAGGAGCTGGTTGAAACTCCTATATTATCAACA
ATCACAGATATCAAATTAGACGACGACAACAACAATAACAGCAATATCAACAATAATAAGAATAC

> SEQ ID NO:1392 104874 190435_300818_1b
CCCCGGAAACAGCAGCGGCTCCAGCTCGCCGTGGTCGACTTTCCCGGCGGCGATCACCGGCAGCGGAGGAGGAGC
AGTACGTGTGTATATATAAAGGATGGGGAGGCAGCCGTGCTGCGACAAGCTGGGGGTGAAAAGGGGGCCGTGGAC
GGCGGAGGAGGACAAGAAGCTGATGAGCTTCATCCTGACCAACGGCCATTGCTGCTGGCGCGCCGTGCCGAAGCT
CGCCGGGCTGCTCCGCTGCGGCAAGAGCTGCCGCCTCCGGTGGACAAACTACCTCCGCCCCGACCTCAAGCGCGG
CCTCCTCACCGACGCCGAGGAGCAGCTCGTCATCGACCTCCACGCCAAGCTCGGCAACAGATGGTCCAAGATTGC
TGCCAAGCTACCGGGCAGGACGGACAACGAGATCAAGAACCACTGGAACACGCACATCAAGAAGAAGCTCATCAA
GATGGGCATCGACCCGGTGACGCACGAGCCCCTCGACCGGAAGCAGGAGAGCCCGGCCACCACCTCGCAGTCCAC
CGTCACGGCGGAGTCGTCCAAGTCCGGCGAGGCGACCAGGCAGCAAAGCCG

> SEQ ID NO:1393 105059 138543_300774_1b
GCTGTTTGTTTTGGCGATACCATTTGCATGGCTTGCCCAGCATCGTCGTCGTCGTCGTCGGGAGCAAGGAGGAGG
AGAGACCATCGATCTTGATTGATTTGAAGCTAGATGGCGGAGGAGGCGAAGAAGGTGGAGGTGACCAAGGACATC
GCCGAAGAGAAGGCAGTGGTGCCGCTGCCGACGCCGCCGGCCACCGAGCACGACGACTCCAAGGCCATCGTCCTC
GTCAAGGAAGCTGAGGCTACAGGAGGTTCAGCTGAAAGAGATGCTTATCTCGCAAAAATTGTGTCGGAGAAGAGA
TTGGTACTGATCAATGCCTGGGAGGAAAGCGAGAAAGCTAGAGCAGAGAACAGGGCGGCCAAGAAGCTGTCATAC
ATCACTTCATGGGAGAATGCAAAGAAAGCAGAGATGGAGGCTGAGCTGAAAAGGATCGAGCAAGAACTGGAGAAG

Figure 2 continued

AAGAAGGCGGCGTACGAAGAGAAGCTGAAGAACAAGCTGGCATTGCTGCACAAGACGGCGGAGGAGAAGAGGGCG
CTCACCACGGCGAAGCGTGGCGAGGAGCTGATCATGGCGGAGGAGATGGCCGCCAAGTACCGTGCAAAGGGCGAG
GCTCCGACGAAGCTGTTCGGGCTCTTGAA

> SEQ ID NO:1394 105059 141906_300430_1b
CCGAGAGGGAACACTCGAGCGATCCGTCCGTCCGCCCGCCCGTCGTCGTCGCGCGCCAGGGCTGAGGAGGAGGCC
AAGAAGGTGGAGGTGGAGGTCACCGAGGCGCCACCCGCCGCTGCCGCTGCCGCGGGAGACGGAGCCGGCTGCCAAG
GACGTCGCCGAGGAGAAGGCCGTCATCCCCGCCCCCGCGCCGCCGGCCGAGGAGGAGAAGCCTCCCGTCGACGAC
TCCAAGGCTCTGGCCATCGTCGAGAAGGTTGCAGATGAACCTCCTGCCGAGAAACCTGCTCAAGGGGGCTCTAAT
GACAGAGATGTTGCTCTTGCAAGGGTGGAAACTGAGAAGAGGAACTCATTGATCAAAGCATGGGAGGAAAATGAG
AAGACAAAAGCTGAGAACAAGGCTTCGAAGAAGCTATCTGCTATTCTTTCCTGGGAGAACACAAAGAAAGCAAAC
ATAGAAGCTCAACTGAAGAAGATTGAGGAGCAACTGGAAAAGAAGAAGGCTGAATATGCAGAGAAGATGAAGAAC
AAAGTCGCGATCGTCCACAAGGAAGCTGAGGAGAAGAGAGCAATGGTCGAGGCAAAGCGCGGCGAGGAAGTCCTA
AA

> SEQ ID NO:1395 105059 270343_200125_1b
GGGCGGACGCGTGGGCGGACGCGTGGGAAAAGATCTTTCATCTTTCATTTCTGAGACTCTGATTCTGTTCCAAAT
CCTAGAATTCTTCTTTTTTCTGAATTCTGTTTGTAGCCATGGCAGAAGTAGAAGCTACGAAAGTGGAGACTGAGA
AAGTTGTGGACCCTACTCCCCCTGCACCTGAGGCTCCTGCACCTGTTAAAGAAGCAGAACCTGTTGTTGAAACTC
CTAAAGAAGTGGCTGATGAGAAAGCTATAGTTGCACCAGCTCTGCCTCCTCCTGAACAAGTCAAAGAAAAATCCG
ATGATTCTAAAGCACTAGTTGTCGTTGAAGATAAACCTGCTGAGGAGAAAAAGGAGGGATCTATTGACAGAGATG
CTGTGCTTGCTCGAGTTGCAACAGAGAAGAGACTGTCACTAATCAAAGCATGGGAGGAAAGTGAGAAATCAAAAG
CCGAAAACAAAGCTCAGAAAAATGTATCAGCAATTGCTGCATGGGAGAATAGTAAGAAAGCAAACCTGGAGGCTG
AGCTAAAAAAGATGGAGGAGCAGCTGGAGAAAAAGAAGGCAGAATATATTGAGAAAATGAAAAACAAAATCGCTC
TACTCCACAAGGAAGCTGAAGAAAAGAGAGCGATGATTGAAGCTAAACGTGGAGAAGATCTTCTTAAGGCAGAGG
AATTGGCAGCAAAATACCGCGCCACTGGAACTGCTCCCAAGAAACTCCTTGGATGTTTTTGAAGCAGCAAACATT
AGACCTGCATCGATGGTGATTGAAAATGCTTTTGTAAAGTTTGTGCAATTGGAATTTTTTTCTTCTTATTAGATA
CATTGTGTGATTATGTATTTTAGAATCAATCATTGTTTATTATTATGTGTGCATAGTGATGTATTCCATTGTAT

> SEQ ID NO:1396 105059 279832_200065_1b
TTTTTGGATTCCTTCTATTTATATAAATAAATATATTCGTTTAACAATATGGCAGAAGCAATTCCAGTACCTCAA
GAACCAGCTGTTGATAGTTCTCCAGCTGCCATGGCTACCAAAGCTGATGATTCTAAAGCTCTCGCCACTGTTCCT
CCACCAAAGACTGATTCTTCAACAAAGAAGAGTTCAAAGGGATCCCTCGATAGAGACATTGCTCTCGCACACCTT
GAAACAGAGAGAAGGAATTCTTATATTAAGGCATGGGAAGAAAGTGAAAAAAGCAAGGTGGAAAACAAGGCCGAA
AAGAAGCTCTCTGCAGTTGGGACATGGAGAACACCAAGAAAGCAAATCTTGAAGCTAAACTGAAGAAACTTGAG
GAGCAACTAGAAGAAAAGAAAGCAGAATATGCGGAGAAGATTAAAAATAGAGTAGCCGCAGTTCACAAGGAGGCT
GACGAAAAGAGAGCTATGGTTGAAGCCAGAAAGGGAGAAGAACTTCTTAAAGCAGATGAGATGGCTGCAAGTAT
CGCGCCACCGGACAAGCCCCTAAGAAGTTGCTTGGATGCCTTGGATGCTAAAGCTGTGAAAAGTTTGTTTCTCTT
TTGTAAATTTTCAGGCTTGTTGCTCTTTATTGGGTGTTTCAAACATGTCGAGTTTCCTATTTGTGTATGAAAAGC
ACTCATGAAAATTTTAAGTGTTACGATAATTATAACTCCACTTCAGATGTTTCTACTAGA

> SEQ ID NO:1397 105059 258950_301701_1b
GCAGCATGGCGGAGGAACAGAAGATAGCGTTAGAATCAGAATCTCCGGCGAAGGTTACGACTCCTGCTCCAGCAG
ATACACCGGCTCCAGCTCCGGCAGAGATTCCGGCTCCAGCTCCAGCTCCGACTCCGGCTGATGTCACGAAAGACG
TTGCAGAGGAGAAAATTCAAAACCCACCTCCGGAGCAAATTTTCGATGACTCCAAAGCCCTTACTGTTGTTGAGA
AACCTGTAGAAGAGCCTGCACCGGCGAAACCTGCGTCTGCATCGCTCGATAGAGATGTTAAGCTAGCTGATTTGT
CAAAGGAAAAGAGATTGTCTTTCGTCAGAGCGTGGGAAGAAAGCGAAAAGAGCAAAGCAGAGAACAAAGCTGAGA
AGAAGATTGCAGATGTTCATGCTTGGGAAAACAGCAAGAAAGCAGCTGTCGAAGCGCAACTCAAGAAAATCGAGG
AGCAACTAGAGAAGAAGAAAGCAGAGTATGCAGAGAGGATGAAGAATAAGGTTGCAGCGATTCACAAGGAAGCAG
AAGAGAGAAGAGCAATGATTGAAGCTAAGCGTGGAGAAGACGTTCTTAAAGCAGAAGAAACGGCTGCTAAATACA
GAGCCACTGGAATTGTTCCAAAGGCAACTTGTGGATG

> SEQ ID NO:1398 105059 139161_300407_1b
CCCGAACACTCGAGCGATCCGTCCGTCCGGCCGCCCGTCGTCGTCGCGCGCCATGGCTGAGGAGGAGGCCAAGAA
GGTGGAGGTGGAGGTCACCGAGGCGCCACCCGCCGCTGCCGCTGCCGCGGGAGACGGAGCCGGCTGCCAAGGACGT
CGCCGAGGAGAAGGCCGTCATCCCCGCCCCCGCGCCGCCGGCCGAGGAGGAGAAGCCTCCCGTCGACGACTCCAA
GGCGCTGGCCATCGTCGAGAAGGTTGCAGATGAACCTCCTGCCGAGAAACCTGCTCAAGGGGGCTCTAATGACAG
AGATGTTGCTCTTGCAAGGGTGGAAACTGAGAAGAGGAACTCATTGATCAAAGCATGGGAGGAAAATGAGAAGAC
AAAAGCTGAGAACAAGGCTTCGAAGAAGCTATCTGCTATTCTTTCCTGGGAGAACACAAAGAAAGCAAACATAGA

Figure 2 continued

AGCTCAACTGAAGAAGATTGAGGAGCAACTGGAAAAGAAGAAGGCTGAATATGCAGAGAAGATGAAGAACAAAGT
CGCGATCGTCCACAAGGAAGCTGAGGAGAAGAGAGCAATGGTCGAGGCAAAGCGCGGCGAGGAAGTCCTAAAGGC
CGAGGAGATGGCAGCCAAGTACCGTGCCACCGGCCATGCTCCCAAGAAACTCATCGGGTGCTTTGGGGCCTAAAG
AAATTTTCGATTCACAACGAGCAAACGTGAAAGTGTTCATCAGTGGTTGCTTTGCTTCTTTCACCCTCCCAAGTG
CGTAGTGTGTTTGTTGGTGCAAGAAAGGTCGTGCCTGGTGTGTAAAGTCTGGTGTTGCTGTATATAACATATTAC
TCCCAAGACAGATATGTTTGGTGCTGTACATGTTTGATGCTTGACAGGCAACATTCTTATGTGTAGTTAAGAAGC
CACATTGTTATTGTTATTGACAGTAAGCTGTTTGTTCTTTT

> SEQ ID NO:1399 107031 168110_300553_1b
GAATTCATGAAGAACAAATCTCAGTATAAACGAGAAAAATCTACTACGTAGAGCCGTTCTAAAGCTCGGTTAAGA
ATACAAATGGAAAATCAAACCCTATGCTTAAAAATATTCTTCCTTTTGTTACATAAATTTTAGGAAGAAAATGAA
GAACAAGAGCCATACAAATTCTCATGTGTCCTCTATGAATGGCTTCTCTTGCAACCTTAGCTGTTGTACAACCTA
CCGTCGTTAAAGGCCTCGGAGGAAGCTCCATCACCGGAACCAAGCTTTCGGTTAAGACTACTGCTCGTCGTAGTC
TGAGACAAACTAAAATCAGGACTGGTGCCGTGGTTGCCAAATACGGTGACAAAAGTGTGTACTTCGACTTGGAAG
ACATCGGTAACACTACCGGACAATGGGACTTGTACGGTTCTGATGCACCATCTCCCTACAACTCTCTCCAGAGCA
AATTCTTTGAGACATTTGCAGCTCCATTCACCAAGAGAGGTTTGTTGCTCAAGTTCTTGATAATTGGAGGAGGTT
CAACACTTGCATACTTGAGTTCAACAGTCTCAGGTGACATCTTACCAATCAAGAAGGGTCCTCAATTGCCTCCTA
AGATGGGTCCACGTGGAAAGATCTAAATGCTGAAAATGGAAACTCGACATCCTTTGTGGTTGAGTTACAGTTTAT
CTTAATTTTCAGAATTTGTAACTATGACATTGGTTTATAACTAGTCTTGTTTTCGTGTGTACATCATAAACGATT
CGGTTCGAAGGCAATTTAAGATCATTTTATGATATAAAAAAAAAAA

> SEQ ID NO:1400 107031 25414_300074_1b
ACAAAAGAATAGTGATCGAAGCTCATGGCGGGGCTTGCAACCGTCGCCGCTGTGAAACCATCCGCCGCCATAAAA
GGACTCGGCGGCAGCTCACTCGCCGGAGCTAAGCTCTCCATCAAGCCTTCCCGCCTGAGCTTTAAACCCAAATCC
ATCCGGTAACTAAAACTTTTCATTTATTCATTAATTAGGATCAAAATGCCACTATAACCACCATATAAATTCAAA
ATATATTAATAGATTTTTGCTGGCTGAAGTGTGTTTTAAACGATAGATATAGTGATGATTAATTAGCTTTAAAAG
GATTAAATTCTGATAATTTCATCTCTTGGTTGGGATTAAATTAGCTTGAGGGTGGTGTGTTCATGTGTAATAGGG
CTAATGGTGTGGTGGCTAAGTATGGAGACAAAAGTGTCTACTTTGACTTAGAAGATTTGGGTAACACAACAGGTC
AATGGGACGTATACGGCTCTGATGCTCCTTCTCCTTACAATCCTCTTCAGAGCAAGGTCTTTGAGACATTCGCTG
CCCCATTCACAAAGAGAGGATTGCTCCTCAAGTTCTTGATCCTTGGAGGAGGCTCTTTGCTTACTTATGTCAGCG
CTACCTCTACCG

> SEQ ID NO:1401 107031 237328_301286_1b
AACGGATAGAAGAACACTCTTGTAAGAGGCGATGGCCGCCGCAACAGCAGCAGCATTGGTACCGTCTGGACTTGC
CAACAGCAGCTTGAATGGAACGAAGCTGCGAATCAAGCCTGCAGGACAAGTCTCAATGAGAAGATCCACTGCCAA
GCTCGGTGTATCGGCAAAGTATGGAGAAAAGAGCATCTACTTCGATCTTGGAGATATCAACAACACCACCGGAGC
TTGGGACTTGTATGGATCTGATGCACCTTCTCCTTACAACGGACTCCAGAGCCGATTCTTCCAAATCTTCGCTGG
TGCTTTCACCAAAAGGGGCCTGTTGCTAAAGTTTCTGCTGCTTGCCGGTACCGGTGCTGTCGCTTACGCTGGAGT
TAAGGCATCCCCGACTTACCTCCCTGTCAAGAAAGGAGCCGTCGGGCCGCCAACGCCAGGTCCCAGAGGAAAGAT
CTAAACTCCATTCCAAATTACCGAGACCATCCCTGTTCTGTAAGTTCGCCACCAGGAATGTAATCTTCTTCCTTC
TAGTGGATATAGATCGAAAGCTTGCAGGGAGAGTCTGCGGCAATGCAGCTTC

> SEQ ID NO:1402 107031 8030_300286_1b
AATTCGGCACCAGAAAATTCCCACTCACCACACACAACAAAAGAATAGTGATCGAAGCTCATGGCGTCTCTTGCA
ACCGTCGCCGCTGTGAAACCATCCGCCGCCATAAAAGGACTCGGCGGCAGCTCACTCGCCGGAGCTAAGCTCTCC
ATCAAGCCTTCCCGCCTGAGCTTTAAACCCAAATCCATCCGGGCTAATGGTGTGGTGGCTAAGTATGGAGACAAA
AGTGTCTACTTTGACTTAAAAGATTTGGGTAACACAACAGGTCAATGGGACGTATACGGCTCTGATGCTCCTTCT
CCTTACAATCCTCTTCAGAGCAAGTTCTTTGAGACATTCGCTGCCCCATTCACAAAGAGAGGATTGCTCCTCAAG
TTCTTGATCCTTGGAGGAGGCTCTTTGCTTACTTATGTCAGCGCTACCT

> SEQ ID NO:1403 107031 46960_300175_1b
GCGCTTACTTTGGCAACAAACAAACAACAACAAAGAGAGAAATTAACATGGCGTCTTTTGCAACCATCGCCGCCG
TACAACCTTCTGCCGCCGTGAAAGGACTTGGAGGTAGCTCTCTTGCCGGAGCTAAGCTCTTCATCAAACCTTCTC
GCCAAAGCTTCAAAACCAAATCCACCAGAGCTGGTGCTGTGGTGGCTAAGTATGGAGACAAAAGTGTATACTTTG
ATTTAGAAGATTTGGGTAACACAACAGGACAATGGGATGTGTATGGATCTGATGCTCCTTCTCCTTATAACCCAC
TTCAGAGCAAGTTCTTTGAGACATTTGCT

> SEQ ID NO:1404 107031 44003_300028_1b
GCCATTACGGCCGGGGAGTAAACCACATAATTAATTAGGGACAGCTTTCCTAGTTTGGACAGAAAACTATGGCGT

Figure 2 continued

CTTTGGCAACTCTTACTGCAGTTCAGCCCACCACCACAATCAAAGGACTAGCTGGAAGCTCCATTGCTGGAACAA
AGCTTCATGTTAAATCATCTCGTCTCAATTTGAAGCTCTCTAAATCCAGGGCTGGTGCTGTGGTAGCAAAATATG
GTGACAAGAGTGTATATTTTGACTTGGAGGATTTGGGCAACACCACTGGCCAGTGGGACTTGTATGGATCAGATG
CGCCTTCACCCTACAACTCCCTTCAGAGCAAGTTCTTTGAGACATTTGCTGCTCCTTTCACAAAGAGAGGTCTGT
TGCTCAAGTTCTTGATTTTGGGAGGTGGCTCAACTCTTGCTTACTTCAGTTCAACTGCATCAGGGGATATCCTAC
CAATCAAGAAAGGGCCTCAACTTCCACCAAAGCTCGGGCACGTGGCAAGATCTAATTGCTTTTCGATCCAAATT
TCTTGACCTTCATTTCATAATTGATGTACTATCTATCACAGCTTGTAAGTATAAATTAAAGCCTTTCTCAGACCT
CTTTTCAACAAGTAAATCTTCTAGAAAATTTGATGCATTGCTTTC

> SEQ ID NO:1405 107031 255260_301647_1b
AAGGATAGCAGAGAGAGAGAGAGAGAGCCATGGCAGGATTAGCATCGACATCTTCCGCCGTAGCATGCGGTGT
GACCTCGTCTTCTCTCTCTGGCCAGAAGCTTGCTATTGCGCACTCCAACCTCTCTCTTCCCAGGGCTAGCCCAAG
AGCGGGAGTAGCTGTCGCTAAATATGGTGAGAAGAGTATGTACTTTGACCTTGAAGATATCGGTAGCACTACCGG
TTCTTGGGACCTCTATGGAGCCGATGGACCTTCCCCCTATAATGGATTGCAGAGCAAGTTCTTTGAGACAACTGC
AGGAGCATTTACCCGTCGAGGCATTCTTTTGAAGTTCTTGGTCTTGGGTGGAGGCGGCACTCTTGCCTACGTTAG
CTCCACTGCAGGAAAAGTTGTCCTGCCCATCAACAAAGGACCTCAGGAGCCCCCTAAGGTTGGACCCCGAGGCAA
GATCTGAGTATTAACTCTATGTATCAAATCTATCTCTCATGTGGATTCCAAAAGAACTGATAAATCCAGATAAGT
TGGCTTTTCTGTGTAATTAGTTTTTGTTCCTGTTAGTTGTGAATGCAACAAATTCTATGAATTGGGTGACCAAAA
AAAAAAAACA

> SEQ ID NO:1406 107031 174936_300528_1b
CCCCCCGGCCGCCGCAGATAGTACACCGGCTATCTATCCATCTATCTACTCAGCTTTGCGTCCTCCCGCGAATTC
ACCGCAGCAATGGCGTCCCTCGTCGCCGTCCAGCCGGTCGCCGTGAAGGGCCTCGCCGGCAGCTCCATCTCCGGC
AGGAAGCTCGCCGTCAGGCCGTCGCCCCGGGCGCTCTGCCGCACCACCCGCAGGCCGCGCGCCGCCGTGGTGGCC
AAGTACGGCGAGAAGAGCGTCTACTTCGACCTCGAGGACATCGGCAACACCACCGGGCAGTGGGACCTGTACGGC
TCCGACGCGCCGTCGCCGTACAACCCTCTCCAGAGCAAGTTCTTCGAGACGTTCGCGGGGCCCTTCACCAAGAGG
GGGCTCCTGCTCAAGTTCCTGCTGCTCGGCGGCGGATCGCTGGTGGCCTACGTCAGCGCGTCGGCGTCGCCGGAC
CTGCTTCCGATCAAGAAGGGCCCGCAGCTGCCGCCGACGCCCGGCCCACGCGGCAAGATCTGAATTAAATTCCTC
GTCTCTGCCTCACCTTCTTCTTGATCCGATCCATCCATGCAAATCCTCTGTACTGTACTGCTAGTCCCCCATGGC
CGGATCGCCATGGATTAATTCCCCCTGTTTATGATGTTGATATAATTGTACTATTCCTATGGCTATATAAGTT

> SEQ ID NO:1407 107031 119383_300019_1b
GGCCCCAAATTCAGCTAAAAAAAAAACTGGTTATAAGGGAAAGCCCCCAATTATACATACTTACCCAAACGGGGA
AACATACATCAATTACAAAAAAAAGGTGGATAATGGGACCAAAAATTAATTAAATCTTGCCACGGGGCCCAAGCT
TGGGGGGAAGTTGGGGACCTTTCTTGATGGGGAGGAAATCCCCTGATGCTGCCAAACTGAAGTAGGCAGGGGGGG
ACCCCCCTCCCAATATCAAAAATTTGACCAAAAAACCTTTTTGGGGGAAGGGACCACCAAATGTCTAAAAAAACT
TGCTCTAAAAAAAGTTGTATGGGGAAGGGGCATTTGATCCATACAGGCCCCACTGGCCAGGGGGGTTGCCCAAAT
CCTCCAAATCAAAGTATACCCTCTTGCCACCATATTGGGCGACCACAAACCCAGCCCTGGATTAAGGGGGCTTCA
AATTGAGGCGAGATGATTTGAAATAAAGTTTATTCCCAGAAAGGGACCTTCCAGCTAGGCCCTTGACATTGGCCG
AAGGT

> SEQ ID NO:1408 107031 122230_300017_1b
CGTGCACGTACGTGTAGCCGCCGCCGCAGATAGTACACCGGCTATCTATCCATCTATCTACTCAGCTTTGCGTCC
TCCCGCGAATTCACCGCAGCAATGGCGTCCCTCGTCGCCGTCCAGCCTGTCGCCGTGAAGGGCCTCGCCGGCAGC
TCCATCTCCGGCAGGAAGCTCGCCGTCAGGCCGTCGCCCCGGGCGCTCTGCCGCACCACCCGCAGGCCGCGCGCC
GCCGTGGTGGCCAAGTACGGCGAGAAGAGCGTCTACTTCGACCTCGAGGACATCGGCAACACCACCGGGCAGTGG
GACCTGTACGGCTCCGACGCGCCGTCGCCGTACAACCCTCTCCAGAGCAAGTTCTTCGAGACGTTCGCGGGGCCC
TTCACCAAGAGGGGGCTCCTGCTCAAGTTCCTGCTGCTCGGCGGCGGATCGCTGGTGGCCTACGTCAGCGCGTCG
GCGTCGCCAGACCTGCTTCCGATCAAGAAGGGCCCGCAGCTGCCGCCGACGCCCGGCCCACGCGGCAAGATCTAA
ATTAAATTCCTCGTCTCTGCCTCACCTTCTTCTTGATCCGATCCATCCATGCAAATCCTCTGTACTGTACTGCTA
GTCCCCCATGGCCGGATCGCCATGGATTAATTCCCCCTGTTTATGATGTTGATATAATTGTACTATTCCTATGGC
TATATAAGTTGTAAAGGATCCAATTCGATGCTGCATG

> SEQ ID NO:1409 107031 11831_300290_1b
TGGTATCAACGCACAGTGGCCGTTACGGCCGGGGATCTAAAGCTAGCTTTGCTAGTTTTAACTTGAAGTGAAGAC
TATGGCATCTTTGGCAACTCTTGCTGCAGTACAACCCACAACTGCCGTCAATGGGCTAGCTGGAAGCTCCATTAT
TGGAACTAAGCTACATGTTAAATCATCTCGCTTTAATTTGAAGTCTACTAAATCCAGGGCTGGCTCTGTGGTAGC
TAAGTATGGAGACACGAGTGTATACTTTGATTTATAGGACTTGGGCAACACCACTGGGCAGTGGGACTT

Figure 2 continued

> SEQ ID NO:1410 107031 1113830_301841_1b
GGAACAAGGATAGCAGAGAGAGAGAGAGAGAGCCATGGCAGGATTAGCATCGACATCTTCCGCCGTAGCATGC
GGTGTGACCTCGTCTTCTCTCTGGCCAGAAGCTTGCTATTGCGCACTCCAACCTCTCTCTTCCCAGGGCTAGC
CCAAGAGCGGGAGTAGCTGTCGCTAAATATGGTGAGAAGAGTATGTACTTTGACCTTGAAGATATCGGTAGCACT
ACCGGTTCTTGGGACCTCTATGGAGCCGATGGACCTTCCCCCTATAATGGATTGCAGAGCAAGTTCTTTGAGACA
ACTGCAGGAGCATTTACCCGTCGAGGCATTCTTTTGAAGTTCTTGGTCTTGGGTGGAGGCGGCACTCTTGCCTAC
GTTAGCTCCACTGCAGGAAAAGTTGTCCTGCCCATCAACAAAGGACCTCAGGAGCCCCCTAAGGTTGGACCCCGA
GGCAAGATCTGAGTATTAACTCTATGTATCAAATCTATCTCTCATGTGGATTCCAAAAGAACTGATAAATCCAGA
TAAGTTGGCTTTTCTGTGTAATTAGTTTTTGTTCCTGTTAGTTGTGAATGCAACAAATTCTATGAATTGGGTGAC
GAACA

> SEQ ID NO:1411 107031 8193_300304_1b
AATTCGGCACGAGGAGAAATTAACATGGCGTCTTTTGCAACCATCGCCGCCGTACAACCTTCTGCCGCCGTGAAA
GGACTTGGAGGTAGCTCTCTTGCCGGAGCTAAGCTCTTCATCAAACCTTCTCGCCAAAGCTTCAAAACCAAATCC
ACCAGAGCTGGTGCTGTGGTGGCTAAGTATGGAGACAAAAGTGTATACTTTGATTTAGAAGATTTGGGTAACACA
ACAGGACAATGGGATGTGTATGGATCTGATGCTCCTTCTCCTTATAACCCACTTCAGGTTTTTTGTACACTCTTAA
ATCTTTAGATCTATATGCTTCTTCAAATTCTAAGACTTTGTGATTATGTTGCTTGCAGAGCAAGTTCTTTGAGAC
ATTTGCT

> SEQ ID NO:1412 107690 1113936_301907_1b
TCTAAATCAAGGATATCAGAGGTGCTAGTGGTGCTATCGTTGTAAAGGGAAGATGGCTCAAGCAGTAGCGATGGC
CGGGCTTTGCTCATCCCTCTCCTCGGCCGCTTCCTCGCTCGACGGGGCCGGCTCTCGCCTCTTGGCCTCCTCCCC
TTCTTCCTCTGCCCCCTCTAAACCATCCCTTCGCCTCCCTTTAATCCGCGCTAGCTCGTCGAATCCCTCAGAAGA
CGCTTCTGCTAAATCTAGTACTAGACGCCAAATCTTGTCCCTCGTTGCTGTCTCTGCTTTGCTTGTCTCTAAACA
AGCCCTCGCCGACCCTAGCCCTATCAAGCTCTTTGGCCCTCCCGCCCCTTCTGGTGGCCTCCCTGGGACTGAAAA
TGCCGACGAAGCTCGAGATCTAGACTTGCCATTGAAGAATAGATTTTACCTGCAACCTCTTCCTCCCGTGGAAGC
GATCGCCAGGGCGAAGGAATCTGCCAAAGAGATTGTGAATGTGAAGGCATTGATCGACAAGAAGGCTTGGCCCTA
TGTCCAGAACGGGCTCCGATCACAGGCTTCCTACCTGCGCTTTGACCTCAACACTGTTATCGCTTCCAAGCCGAA
GGATGAAAAGAAAGCTCTCAAAAGCCTTAGCACTAAGCTCTTTAACACTATCAATAATCTGGACTATGCTGCTAG
AAGCAAAAGTACCACCCAGGCGGAGAAATATTATGGAGAAACTG

> SEQ ID NO:1413 107690 55916_300129_1b
TGTTGGATGGTCAGCTCTGTGGTTCAGCCCGTTTGAGCACTGTTAGCACCAGCAGAATTGCCTTGGCTAGACCAG
GTCTCAGCATTAGAGCCCAACAGGGGTCTGCTGACACTGAAACTAGCCGTAGAGCCGTCATCGGTCTTGTTGCTG
CTGGCCTTGCTGGTTCCTTTGCTCAAGCAGCCTTTGCTGCAGCTAAATCAATCAAGATTGGTGGCGCTCCTCCTC
CCTCCGGTGGATTACCTGGAACTTTGAACTCGGATGAGGCAAGGGACTTTGGTCTACCAC

> SEQ ID NO:1414 107690 2796_300392_1b
CCCACGCGTCCGAAAAAAAATGGCTCAAGCAGTGACTTCGATGGCTGGCTTACGTGGAGCATCTCAGGCTGTCCT
TGAAGGAAGTTTACAGATCAACGGCTCAAACCGTTTGAACATCTCAAGAGTCTCGGTTGGGTCTCAGAGAACCGG
ACTTGTGATCAGGGCTCAGCAGAACGTGTCAGTACCAGAAAGTAGTCGCCGGTCAGTGATTGGACTCGTGGCGGC
TGGTTTAGCCGGTGGTTCATTCGTTAAAGCTGTTTTCGCCGAAGCTATTCCGATCAAAGTTGGTGGTCCTCCACT
TCCTTCCGGTGGCCTACCTGGAACAGATAACTCAGACCAAGCAAGAGACTTTTCATTGGCATTGAAAGATAGATT
TTACATACAACCATTGTCACCAACAGAAGCTGCAGCTAGAGCCAAAGATTCTGCTAAAGAGATCATCAACGTTAA
GTCATTTATCGACAAAAAAGCTTGGCCCTATGTTCAGAACGATCTCCGTTTAAGAGCATCGTACCTCCGTTACGA
TCTCAACACCGTTATCTCCGCTAAGCCTAAGGAAGAGAAGCAAAGCCTTAAAGATCTCACCGCAAAGCTTTTCCA
AACCATTGACAACTTGGACTATGCGGCGAGATCAAAGAGTAGCCCAGATGCTGAGAAGTATTACTCAGAAACTGT
CTCGAGTTTGAACAATGTTCTTGCCAAGCTCGGTTAATGAAGAAAGACTTGCGTTGTAATCTGTTGATGTCGATG
TTATTATAATTACTGCTATCCAAGTACTTTGTCTTTCTCCTTCTCTTCTTGTCTGATCAAATCGGTTATCTCTAA
TTTCAGTTTCAAGTTTTAACCAATATATTGGCTGGCTCTTTAGCAAAACATTATATATTCGTCCTCGAGCTGACC
CCTTTGTAC

> SEQ ID NO:1415 107690 27215_300394_1b
CCGGGGGCGTCCGAAAAAAAATGGCTCAAGCAGTGACTTCGATGGCTGGCTTACGTGGAGCATCTCAGGCTGTCC
TTGAAGGAAGTTTACAGATCAACGGCTCAAACCGTTTGAACATCTCAAGAGTCTCGGTTGGGTCTCAGAGAACCG
GACTTGTGATCAGGGCTCAGCAGAACGTGTCAGTACCAGAAAGTAGTCGCCGGTCAGTGATTGGACTCGTGGCGG
CTGGTTTAGCCGGTGGTTCATTCGTTAAAGCTGTTTTCGCCGAAGCTATTCCGATCAAAGTTGGTGGTCCTCCAC
TTCCTTCCGGTGGCCTACCTGGAACAGATAACTCAGACCAAGCAAGAGACTTTTCATTGGCATTGAAAGATAGAT
TTACATACAACCATTGTCACCAACAGAAGCTGCAGCTAGAGCCAAAGATTCTGCTAAAGAGATCATCAACGTTA

Figure 2 continued

AGTCATTTATCGACAAAAAAGCTTGGCCCTATGTTCAGAACGATCTCCGTTTAAGAGCATCGTACCTCCGTTACG
ATCTCAACACCGTTATCTCCGCTAAGCCTAAGGAAGAGAAGCAAAGCCTTAAAGATCTCACCGCAAAGCTTTTCC
AAACCATTGACAACTTGGACTATGCGGCGAGATCAAAGAGTAGCCCAGATGCTGAGAAGTATTACTCCAAAACTG
TCTCGAGTTTGAACAATGTTCTTGCCAAGCTCGGTTAATGAAGAAAGACTTGCGTTGTAATCTGTTGATGTCGAT
GTTATTATAATTAC

> SEQ ID NO:1416 107690 246011_301574_1b
AAAGAAGAGGAGACAGAAGAAGAAGAAGAAGAAGAAAAGAAGAAAGAGAGATGGCGGCAATCTCGTCGTCTCTGG
GCCTCAGCAAGGCACAGTTCTTCGGCTCATTCGATGCTAGCGATGCGGCGAGAGGCTCTTCTTCTCGCGTTGGAA
TCGCGAGATCGAAGTGTGTGATCCGCGCGATGCAGCAAGAACACGATCCGTCGAGACGAGCAGCAGTCTTTGGCC
TGGTCGCAGTGGCCGCGGGCGTACTGGCCGTGGAGGAATCGCGAGCAGTGAGTGGAATCAAGATCAATGGCCAC
CTCCACCATCCGGAGGACTTCCTGGGACGGAGAACGCCGATCAGCCGCGCGACTTGGATCTGCCACTCAAAGAGC
GATTTTTCATCCAGCCGCTGTCGCCAGCCGAGGCAGTGGATAGAATCAAGGACGCGTCGAAGGACATTGTGGGAG
TAAAGGAGCTGATCGAGAAGAAGAGCTGGCCGTATGTCCGCAACGATCTTCGCAGCAAGGCGACTTACTTGAGGT
ATGACATCAAAACCATCCTGGATGCCAAGCCCAAGGCCCAGCGCAAAGAGCTCAAGAAATACACGGACAGTCTCT
TCGACACAATTGACAAGCTTGACTATGCAGCTCGAGCAAAGGATCCCGCAGCCGCGAGCAAGTGCTACAGCGACA
CCGTAGCTGCATTGGACACTGTTATTGCCAAAATCTCGGCATAAATATATA

> SEQ ID NO:1417 107690 183015_300665_1b
GAATTCAGTAGCTCACAAGCTGTCTTGGAAGGTAGCCTTCAACTCAACAGCTCTACCCGCTTGAGTGGAGTTAGT
AACAACCGAGTAAGCGTGATCAGTCGATCTAGTTTCACAGTTAAAGCTCAGTCATCGGACAATGAAGCCGTAGCT
CAGAGTAGTCGCAGAGCTGTCTTGGGACTAGTAGCTACCGGATTGGTAAGTGGCTCATTCATTCAGCGTGTGCTT
GCTGAAGCAAGGCCAATTAAGGTCGGATCACCTCCCAAGCCATCCGGTGGATTGCCTGGAACTCTTAACTCAGAC
CAGGCTAGAGACCTTGATCTACCATTGAAGGAGAGGTTCTTCCTTCAACCACTGTCTCCAACAGAGGCTACACAA
AGAGCTAAAGAAGCTGCTAAAGAGATTCTTAACGTGAAGAGTAACATAGACAAGAAGGCATGGCCTTACGTTCAG
AACGATCTTCGTTCCCAGGCTGGATATCTTCGTTATGACCTCAAAACTATAATTTCTTCAAAGTCCAAGGATGAG
AAGGCTTCGCTTACAGATCTCACCAACAAACTCTTTATTTCCCTTGACAAACTGGACAATGCAGCAAAGATCAAA
AGCAGTGAAGCAGCAGCAAAGAGTTATGCCGATGCTGTAGTGTCTTTG

> SEQ ID NO:1418 107690 141975_300430_1b
CCCGATCTGAAGAGAGAAATTCTCAGCTTATAGTCAGGTGAGGTCTGAGCTGAGGTTGGGAGATGGCACAGGCAA
TGGCGTCCATGACCGGGCTGTCGCAGGGCGTGCAGCTGCCGGCCGGGCCCAGGCGCGCCGGCGGCAGGTCCAGGC
TCGCCGTCGTCAGGGCCGACGCCGCCGCCGCCGACGTCCAGACCGGCCGCCGCGCCGTGCTCGGCCTCGTCGCCA
CCGGGATCGCCGGCGGCGCCCTCGCGCAGGCGGCGCTCGCCGAGGCCGCCAAGCCCATCAAGCTCGGCCCCCCGC
CACCGCCCTCCGGTGACTCCCTGGGACGCTGAACTCGGACCAGGCGAGGGACACGGACCTGCCGCTGAGGGAGA
GGTTCTACCTGCAGCCGCTGCCGCCGGCGGAGGCGGCGGCGAGGGCGAAGGAGTCGGCCCAGGACATCATCAACC
TCAAGCCGCTCATCGAGAAGAAGCAGTGGCCGTTCGTCAGGGACGACCTCCGCCTCAGGGCCTCCTACCTGCGCT
ACGACCTCAAAACCGTCATCAACTCCAAGCCCAAGGCCGAGAAGAAGGGCCTCAAGGACCTCACCGGCAAGCTCT
TCGCCACCATTGACGGGCTTGACCATGCAGCCAAGATCAAGAGCCCCGAAGAGGCGGAGAAGTACTACACGTTGA
CCAAATCTGCTCTTGGCGATGTCCTCGCCAAGCTAGGCTAGGATCGGCATAATGGCCATATGGGGTTTCGGTGTT
TTTATGTTTGTTCATATGGAACCGGCAATGTACCCTCCATGTTGATATTGTATCAGCAAGCACTTACGTATGATT
CAATCTTGAGTTGTTGTTGACGGCTAAATCTCCAAGCAGGCGCGATTA

> SEQ ID NO:1419 107690 130502_300488_1b
GAATTCAATGGCGCAAGCTATAGCATCAGTATCTGGCTTAAGCAGCTTCTCGCAAGGTACAAACAGATTGAATGT
GGCTACTACCAACAGCCGAACGGCCAGAAGTCGTGTTGGTTTCAGCGTTAGATCTGAGAAGAAGTCGGAATCGGA
GACTGCTCAGAGTAGCCGTAGAGCACTATTGGGTGTCTTAGCTGTGGGACTAACCACTGGATCTTTCGTGAAGAA
TGTGCTTGCTGATGCTAGGCCTATTGTAATCGGGCCACCTCCCGCTCCTTCCGGTGGTTTACCGGGGACTCTAAA
TTCTGATGAAGCAAGGGACTTAGATCTACCCCTAAAAACAAGGTTTTTCCTACAGCCTAAGACTCCAGAAGAAGC
AGCTCAAAGAGTAAAAGAATCAGCGCAAGCGATCCTAGGTGCCAAGGCACAGATAGACAAAAAGGCATGGCCGTA
TGTCCAGAATGAACTACGATCCAGCGCCGAATATCTTCGTTACGATCTCAGAACTATCATCTCTGCAAAGCCCAA
GGATGAGAAGAAACCACTCAAAGAACTGTCTGACAAGCTTATCCAAAACCTCAATAGTCTGGACTATGCTGCAAA
GGTTAAGAGCACTCCTGAAGCAGAGAAGTACTATGCCGAAACAGCAGCATCATTAAAAGAAGTTCTAGCAAAGAT
TGGTTAAGAGATACTTGTCAAGAGCTGAACATCAATTATTTTATTCTTCTTCCTGATGAAACTGAGTGACGATTT
TGTCATTCCCGAACAATCATTGCTGTATTACTTTTTTTGGTATGATCAAAGGATGAATATAACCATATA

> SEQ ID NO:1420 107690 127727_300472_1b
GTACCACAACATTAACTTATAATTTCCCCCACGCTACTTCTATCACCCTGCCTAAAACAAATTTCAGAAGGTTCA
CCAAAATGGCTCATGCTATGGCTTCAATGGGTGGCCTAATTGGTTCTTCTCAAACTGTGTTGGATGGTCAGCTCT

Figure 2 continued

GTGGTTCAGCCCGTTTGAGCACTGTTAGCACCAGCAGAATTGCCTTGGCTAGACCAGGTCTCAGCATTAGAGCCC
AACAGGGGTCTGCTGACACTGAAACTAGCCGTAGAGCCGTCATCGGTCTTGTTGCTGCTGGCCTTGCTGGTTCCT
TTGCTCAAGCAGCCTTTGCTGCAGCTAAATCAATCAAGATTGGGGCGCTCCTCCTCCCTCTGGTGGATTACCTG
GAACTTTGAACTCGGATGAGGCAAGGGACTTTGGTCTACCATTGAAGAAGAGGTTTTACCTTCAACCATTGACTC
CAGCTGAAGCAGCCCAGAGAGTTAAGGATTCAGCCAAGGAGATTGTTAGCGTCAAGAATTTCATCGACAAGAAGG
CCTGGCCATATGTCCAGAATGACCTTCGTCTCAGAGCAGAATACCTTCGCTATGACCTTAAAACCGTCATCTCTG
CTAAGCCAAAAGAAGAAAAGGGAAAACTCCAGGACCTGACTGGAAAGCTCTTCAAGACCATTAGTGATCTGGACC
ATGCAGCAAAGACCAAGAACAGCCCTGAAGCAGAGAAGTACTATGCTGAAACTGTATCTACCTTAAATGATGTTT
TGGCCAAACTTGGTTAAAAAGCTTTTCTGAACTAGTATGTTATTACTTCCTGTAACTTATCGAATACTTCTTGAA
TCCAATTGTGAAGAATGATTTTGGAAAAATTGTTTAAAAATCCG

> SEQ ID NO:1421 107690 11894_300290_1b
TGGTATCAACGCAGATGGCCATTACGCCGGGGGCCTGAAACAAATTTCAGAAAGTTCACCAAAATGGCTCATGCT
ATGGCTTCAATGGGTGGCCTAATTGGTTCTTCTCAAACTGTGTTGGATGGTCAGCTCAGTGGCTCAGCCCGTTTG
AGCACTGTTAGCACCAGCAGAATTGCCTTGGCTAGACCAGGACTCAGCATTAGAGCCCAACAGGGGTCTGCTGAC
ACTGAAACTAGCCGTAGAGCCGTCATCGGTCTTGTTGCTGCTGGCCTTGCTGGTTCCTTTGCTCAAGCAGCCTTT
GCTGCAGCTAAATCAATCAAGATTGGGGCGCTCCTCCTCCCTCTGGTGGATTACCTGGAACTTTGAACTCGGAT
GAGGCAAGGGACTTTGGTCTACCATTGAAGAAGAGGTTTTACCTTCAACCATTGACTCCAGCTGAAGCAGCCCAG
AGAGTTAAGGATTCAGCCAAGGAGATTGTTAGCGTCAAGAATTTCATCGACAAGAAGGCCTGGCCATATGTCCAG
AATGACCTTCGTCTC

> SEQ ID NO:1422 107690 116442_300068_1b
AAATTCTCAGCTTATAGTCAGGTGAGGTCTGAGCTGAGGTTGAGAGATGGCACAGGCAATGGCGTCCATGACCGG
GCTGTCGCAGGGCGTGCAGCTGCCGGCCGGGCCCAGGCGCGCCGGCGGCAGGTCCAGGCTCGCCGTCGTCAGGGC
CGACGCCGCCGCCGCCGACGTCCAGACCGGCCGCCGCGCCGTGCTCGGCCTCGTCGCCACCGGGATCGCCGGCGG
CGCCCTCGCGCAGGCGGCGCTCGCCGAGGCCGCCAAGCCCATCAAGCTCGGCCCCCCGCCACCGCCCTCCGGTGG
ACTCCCTGGGACGCTGAACTCGGACCAGGCGAGGGACACGGACCTGCCGCTGAGGGAGAGGTTCTACCTGCAGCC
GCTGCCGCCGGCGGAGGCGGCGGCGAGGGCGAAGGAGTCGGCCCAGGACATCATCAACCTCAAGCCGCTCATCGA
GAAGAAGCAGTGGCCGTTCGTCAGGGACGACCTCCGCCTCAGGGCCTCCTACCTGCGCTACGACCTCAAAACCGT
CATCAACTCCAAGCCCAAGGACGAGAAGAAGGGCCTCAAGGACCTCACCGGCAAGCTCTTCGCCACCATTGACGG
GCTTGAC

> SEQ ID NO:1423 109076 1170608_302038_1b
GGAAAGAAAAGCTTGACGACGGAGCTATGGCGAAGCCTGTGGGGGGAGGAGCGAAGAAGGCGAGGGCATCCCGGA
ATAGGGAGGTGGTGCGGGGAGTCGGGCGGTGTAGCCGGTCCCAGATGTACCACAAGAGGGGCTTGTGGGCCATCA
AGGCCAAGAACGGTGGGTCCCTCCCTGCCCATGGTAAGACCCAGGTCGCCCCTCAAGCCCCCTTAGCCAAGGCCC
CCAAGTTCTACCCTGCCGACGATGTCAGAAAACCCCTCTGCAATAAGCGCATTGCTAAGCCTACTAAGCTCAGAT
CCAGCATTACACCCGGAACTGTTCTAATTCTCCTTGCTGGACATTTCAAGGGAAAGAGAGTTGTCTTCCTGAAGC
AACTTGAGTCTGGATTGCTTCTTGTCACTGGCCCTTTCAAGATTAATGGGGTTCCTATTAGGCGTGTGAATCAGG
CATATGTGATTGCAACCTCGACTAAGCTCGACACAAGTTCCGTCGACACCAGCAAGTTCACCGATGCATATTTCA
AGAGGGAGGTTGAGAAAAAGAAGAAGGGCGAGGCTGAGTTCTTTGAGGCTGAGAAGGAGAAGAAGACCCTCCCTC
CTGCAAGGAAGGAGGATCAGAAAGAGCTCGACGCTAAGCTGGTTCCAGTCATAGAGAAGATTCCAGACATGAAGG
CATATTTGATGGCTAGATTCAGTCTCAAA

> SEQ ID NO:1424 109076 47327_300170_1b
CCCACGCGTCCGAATGCCGGCGGCGAAGAGGACTCCCAAGGTTAACCGTAACCCTGACCTAATCAGGGGAGTTGG
AAAATATTCGAGGTCTCAGATGTACCACAAGAGAGGTTTGTGGGCTATCAAGGCCAAGAACGGTGGCGTTTTCCC
TCGTCACGATGCTCAGCCAAAGGTCGACGCTCCGGTTGAGAAGCCTGCCAAGTTTTATCCGGCGGAAGACGTCAA
GAAGCCGCTTGTTAACAGACGCAAGCCTAAGCCTACCAAGCTAAAAGCCAGCATCACTCCAGGAACTGTGTTGAT
CATTCTTGCTGGTAGATTCAAGGGTAAGAGAGTTGTCTTCCTCAAGCAACTTTCTTC

> SEQ ID NO:1425 109076 258156_301689_1b
AGCAATTCGAAATGGCGGACACCAACCCCACGACCCAGAAGTTCTCCAAGGGCGAGAGGTCGATCCCGCACCACT
CGCAGAAGGCCAGCAAGTACTACCCTGCTGAGGACGTCGCCGTCCCCAAGAAGGCCCGTAAGAGTGTTCGCCCTG
CGAAGCCCCGTGCCTCCCTCCAGCCCGGTTCCGTCGTCATCCTCCTCGCTGGTCGTTTCCGTGGCAAGCGTGTCG
TTCTCCTCAAGCACCTTCCCCAGGGTGTTCTCCTCGTCACCGGTCCCTTCAAGGTTAACGGCGTTCCTCTGCGAC
GAGTCAACGCCCGCTATGTCATCGCTACCTCGACCACTGTCGACATCAAGGGTATCGATGAGGGTGTCCTGAAGA
AGGCCTCCGAGGAGGGTTACTTCACCAAGGACAAGGCCGCACACAAGCCCGGAGAGGATGCTTTCTTCAAGCAGG
GCGAGAAGCCCGAGAAGAAGGAGACCTCTAAGGACCGCGTCGAGGACCAGAAGGCCGTCGACAAGGCCCTTCTTG

Figure 2 continued

CCAACATCAAGAAGGAGGCTCACCTCGTTGACTACCTTGCCTCTAGCTTCAGCCTCCGCACCTCCGACAGGCCAC
ACCAGATGCAGTTCTAAGCGTAGGGTCAAGACGGGATT

> SEQ ID NO:1426 109076 253805_301630_1b
CATTTGGAGAGGAGGCAGGAAGAAGGAAGGACGAGAGAGAGAGAGAGAGAGAGAAAGAGGGAGAGGGAGAGATGGCA
AAGCCTGAGGGAGGAGCGAAGGGGCCAAGGGCATCCCGGAACAAGTCACTGGTTCGAGGCGTGGGGCAATGCAGC
AGGTCGCAGATTGTACCACAAGAGGGGTCTATGGGCGATAAAGGCGAAGAACGGGGGCTGTCTACCGGGTCCAAA
CCAAGCCCAAAGCGATGGACACCTCGGACTCCAAGGCCCGCGGCAAAAACCCCAAATTCTAACCCGGCGACGACG
TTGCCAAATCCCTGGTTAACAAGCGGTATATCAAGCCCAACAAACTCAGAGCTTAGCATTACCCTGGAACTGTGT
TGATCCTCCTTGCTGGACACTTTAAGGGAAAGCGAGTTGTATTCTTGAAGCAGCTTGAGTCTGGACTACTTCTTG
TGACAGGTCCGTTCAAGATTAACGGTGTCCCCCTCAGGCGTGTGAATCAAGCATATGTGATTGCAACCTCCACAA
AGCTTGATATCAGCTGCGTCAATGCTAGCAAGATCACTGATGCGTACTTCAAGAGAGAGGTAGAGAAGAAGAAGA
AGGGCGAAGCAGAGTTCTTCGAGGCTGAGAAGGAGAAG

> SEQ ID NO:1427 109076 252006_301668_1b
AGCGTCGCAAATCAAAGATGCCTCCTAAGGATAAGAAAGCCGCTTCCACCGGTGCTAAGACCGAAGCCGCAGGTA
CTAAAAAGGCTGGTTCCGTCAGAATCTCCAAGTGGTACCCAGCTGATGATGTCAGACGTATCCGCAAAAACCCTG
CTAAAGCTCCCAAGCCTGTCGCCCTCAGAAAGAACATTGCTCCAGGACAGGTTTTGATCCTTCTTGTAGGCAGGT
TTAAGGGAAAGAGAGTTGTCTTCTTGAGACAACTCAAGTCTGGTCTACTCTTGGTCACTGGTCCTTATAAGATTA
ATGGTGTTCCTCTTAGAAGAGTTAATCAAAGCACTGTCATCCACACCTCTACTAGAGTTGACCTTGGTCAAGCTA
AATTCGATAAGATTGATGATGATTACTTCAAGAGAATAAAGGCCAAGAGAACCAAGAAGACTGAAGAAGCTTTCT
TCTCTGCTGGTACCCAAGAAAAACCCCAAGAAGAGAAAGACAAGCTTAATGAGAAGAAAAAGACTCAGGTCGAAG
TAGATACTCCTATTCTAGCCGCTGTTAAGAAGACCGAACTCTTAAGACAATATCTCAGAACAAGATTCACCCTCT
CTAAATACACTAAGCCTCATGAATTGGTCTTCTAAGGGTTCAGAGACCTGCTCCAAAAACATGTGGATATGCTTG
TATGAAATAGCGAAGTATCTATCCTCG

> SEQ ID NO:1428 109076 229051_301039_1b
TTCCCCGCAGCGATGGTGAAGGCGGCGAAGGATGCTGCGGCTAAGCCCAAGTCCAAGTACTACCCAGCCGACGAT
GCTCCTGTGCCGCGGGCGATCCGGCGCAAGATCCGCCCGACGAAGCTAAGGGCGAGCATCACACCTGGAACGGTT
CTCATCCTTCTCGCCGGGAAGTACAAGGGCAAGCGCGTAGTCTTCCTCAACCAGCTCCCGTCGGGATTATTGCTC
GTCACTGGTCCTCGCTCGTTCAATGGCGTCCGGCTCAAGAGGGTGAACCAGGCTTACGTGATCGCAACATCGACC
AAGATCGACGTCTCTTCCGTGGACGTGGCCAAGTACGACGACAGCTTCTTCAAGAAGTTGAAGAAAGACGAGGAG
GTGACCCCGGAGATGAAGAAGGCAAAGAAGGAAGCTCAAGAGGCCGTGGACAAGGTCGTGATCGAGGTGATAAAG
AAGGGAGAGCCGGAGCTAGCTCAGTACATCTCCGCCAGGTTCAGCTTGAAGCGTGGAATGAAGCCTCACGAGCTA
GTGTTTTAAACGAGGCCTTTTTTTCCTAATCAAAAATCAATCGTGAAGAATATTCCACC

> SEQ ID NO:1429 109076 217172_300905_1b
ACATATCAGACACCCGAGAGAGTCAATATGTCGGCCAAGCCCACGACCAAGCAGTTCGGGAAGTCGACCCGGGAG
GTTCCCGCCTCCGCGGACCAGGCGAAGAAGTGGTACCCTGCCGACGACGAGAGCGCCCCGAAGAAGGTTCGCAAG
TCCGTCCGAACTTGGGCCCCCCGAAAGACCCTCCAGCCTGGTACCGTCCTGATCCTCCTCGCTGGCCGCTTCCGC
GGCAAGCGTGTCGTCCTTCCTCAAGACTCTTGACCAGGGTGTTCTCCTCGTCACTGGTCCCTTCAAGATCAACGGC
GTTCCCCTGCGAAGAGTCAACGCCCGATACGTCATCGCCACCTCCTACAAGGTCGACATCTCCGGCCTTGACGCC
GCCAAGATTGAGGAGATCTCTCAGCCCAAGTACTTCACCGCCGAGAAGGCCAAGGAGAAGGCTTCCGCTGAGGCT
TTCTTCAAGCAGGGAGAGAAGCCCCAGAAGAAGGAGATCAACAGCTACCTCGCCAGCACCTTCAGCTGCGGAAG
GGTGACAAGCCTCACGAGATGGCGTGGTAAATTTGATTCAAACACAAAATCTCTCTGGCAGGTCCAAAGCACGGG
GTGGAGTTTACTGGGGTGTTGGTCAAGATGCGGGTTGTAAAACGGAAAGG

> SEQ ID NO:1430 109076 1170836_302040_1b
GGCAGGAAGAAGGAAGGAGGAGAGAGAGAGAGAGAGAGAGAGGGAGAGGGAGAGGGAGAGATGGCAAAGCCTGAG
GGAGGAGCGAAGGGGCCAAGGGCATCCCGGAACAAGTCACTGGTTCGAGGCGTGGGGCAATGCAGCAGGTCGCAG
ATGTACCACAAGAGGGGTCTATGGGCGATAAAGGCGAAGAACGGGGGCTGTCTACCGGTCCTCACCAAGCCCAAA
GCGATGGACACCTCGGACTCCAAGGCCGCCGCCAAAACCCCCAAATTCTACCCCGCCGACGACGTGCCCAAACCC
CTGGTTAACAAGCGTATAATCAAGCCCACCAAACTCAGAGCTAGCATTACCCCTGGAACTGTGTTGATCCTCCTT
GCTGGACACTTTAAGGGAAAGCGAGTTGTATTCTTGAAGCAGCTTGAGTCTGGACTACTTCTTGTGACAGGTCCG
TTCAAGATTAACGGTGTCCCCCTCAGGCGTGTGAATCAAGCATATGTGATTGCAACCTCCACAAAGCTTGATATC
AGCTGCGTCAATGCTAGCAAGATCACTGATGCGTACTTCAAGAGAGAGGTAGAGAAGAAGAAGAAGGGCGAAGCA
GAGTTCTTCGAGGCTGAGAAGGAGAAGAAG

> SEQ ID NO:1431 109076 128551_300476_1b

Figure 2 continued

CCGCTCAAAAACTAGGGTTTACTCTCTCGCCAGAGCAGCTTCTCTTCTCCAATGGCGCCCAAGAAAACTCTCCGT
AACCCAGAACTAATTCCTGGCCTGGGAAAATTCTCACGTTCTAAAATGTACCACAAGAAAGGTCTCTGGGCAATC
AAAAAGAAAAACGGCGGCACATTTCCATCCCACAGCAAAAAACCTGCCGCCGCCGCTCCGGTAATAAAACCCCCA
AAGTTTTATCCCGCCGATGACGTAGCAAAACCGCTTGTGAACAAACACAAGCCAAAACCTACAAAACTCAGAGCA
AGCATTACACCTGGAACCGTTTTGATTATCCTAGCTGGTAAGTTTAAGGGGAAAAGAGTTGTGTTCTTGAAACAG
CTTGCGTCTGGGCTTCTGCTTGTTACTGGACCGTTTAAGCTTAATGGAGTTCCTTTAAGACGTGTGAATCAAGCT
TATGTTATTGGTACCTCGACTAAGGTTGATGTTTCGGGTGTGAATGTGGAGAAGTTTGATGATAAGTATTTTGCT
AAGCAGGTTGAGAAGAAGCAGAAGAAGGGAGAAGAGGAGTTTTTTGAAGACAAGAAAGAGGAGAAGAATGTGCTT
CCACAAGTAAAGAAAGATGACCAGAAAACCGTAGATGCAGCTTTGCTCAAGGCCATTGATGGAGTTCCTGAATTG
AAGGCTTATTTGTCCGCGAGGTTCTCACTCAAGGCAGACATGAAACCACATGAACTTGTCTTTTAGAGGAACAAC
ATCTACAACACTTTTTTTTGGATAAATTGATTTTGTTACGCTCTATTTTTCTGTTTTGTTCGGTTTGAACCTGCG
TTTATAGGTCATATTGAGGATTTGCTGATTATAAACATCTTTAATTAGAATATATATGCAATATGAGAGTTTTCT
TGTTGAAAACAAAAAAGTTAGACGTTTTAAAGCTGGTGATATTCTTGCTTTGCCTGCTGGTGTTACACACTGGAC
TTACAATGATG

> SEQ ID NO:1432 109076 194843_300767_1b
CCGGCTCTCGCCCTCTCCGCACCAGCTCCCCGCCGAGAGCGCCGCGAGCTGATCCAATGGCGCCGACGTCGAAGC
TGTCGCAGGGCATCAAGAAGGCGTCGCGGTCGCACACGTACCACCGCCGCGGGCTGTGGGCCATCAAGGCCAAGC
ACGGCGGCGCCTTCCCCAAGGCCGAGAAGCCCGCCGCCGCAGCCGCCGCCGCCGCGCCCAAGTTCTACCCCGCCG
ACGACGTCAAGCCCCGCCAGCCCAGCACCCGCAAGCCCAACCCTACCAAGCTCAGGTCGTCCATCACGCCTGGGA
CAGTGCTGATCCTGCTCGCCGGGAGGTACATGGGGAAGCGCGTCGTGTTCCTCAAGCAGCTCAAGTCCGGCCTGC
TCCTCATCACCGGACCTTTTAAGATCAATGGAGTGCCCATCCGCCGTGTGAACCAGGCCTACGTCATTGCCACAT
CCACGAAGGTTGACATCTCTGGTGTTAAGGTGGATAAGTTTGATGACAAGTACTTTGCCCGGGACAAGAAGGCAA
AGGCCAAGAAGACCGAGGGTGAACTTTTTGAGACAGAGAAGGAGGCAACCAAGAATCTGCCCGACTTCAAGAAGG
ATGACCAGAAGGCTGTGGATGCTGAGTTGATCAAGGCTATCGAGGTTGTCCCAGACCTGAAATCCTATCTTGGTG
CCCGGTTCTCTCTCAGGTACGGCGACAAGCCCCATGAGATGACATTCTAAGTTAGTCGGTACAAGTTTCAAGTTC
TGAGGAAGTCTTTTT

> SEQ ID NO:1433 109576 104492_300410_1b
AATTCGGCACCAGAAAAAAGGAAAAGAGAGAAAGAGAAATCTTTCTGTCTTAAGTGTAATTAACAATGGCTTCCT
CAGTTCTTTCCTCAGCAGCAGTTGCCACCCGCAGCAATGTTGCTCAAGCTAACATGGTTGCACCTTTCACTGGTC
TTAAGTCTGCTGCCTCATTCCCTGTTTCAAGGAAGCAAAACCTTGACATCACTTCCATTGCCAGCAACGGCGGAA
GAGTGCAATGCATGCAGGTGTGGCCACCAATTAACATGAAGAAGTATGAGACTCTCTCATACCTTCCCGATTTGA
GCCAGGAGCAATTGCTCTCCGAAATTGAGTACCTTTTGAAAAATGGATGGGTTCCTTGCTTGGAATTCGAGACTG
AGAAAGGATTTGTCTACCGTGAACACCACAAGTCACCAGGATACTATGATGGCAGATACTGGACCATGTGGAAGC
TACCTATGTTCGGATGCACTGATGCCACCCAAGTGTTGGCTG

> SEQ ID NO:1434 109576 271223_200032_1b
TGGTATGAACGCAGAGTGGCCATTACGGCCGGGGAAAAAAAAAGGAAAAGAGAGAAAGAGAAATCTTTCTGTCTT
AAGTGTAATTAACAATGGCTTCCTCAGTTCTTTCCTCAGCAGCAGTTGCCACCCGCAGCAATGTTGCTCAAGCTA
ACATGGTTGCACCTTTCACTGGTCTTAAGTCAGCTGCCTCGTTCCCTGTTTCAAGGAAGCAAAACCTTGACATCA
CTTCCATTGCCAGCAACGGCGGAAGAGTGCAATGCATGCAGGTGTGGCCACCAATTAACAAGAAGAAGTACGAGA
CTCTCTCATACCTTCCTGATTTGAGCGTGGAGCAATTGCTTAGCGAAATTGAGTACCTCTTGAAAAATGGATGGG
TTCCTTGCTTGGAATTCGAGACTGAGGTCAATATTTGTTCTAAATTTTGCATACTCCTTCAATTTTATGCTCACA
TTTTTTTTTCCTTCTATTTGTTCCTAAAAAAAGAGTGACATATTTATACATTTAGAAAAAAATTAACTTTTAACTT
TAATATATTATTTCACATGTTGCAGCGCGGATTTGTCTACCGTGAACACCACAAGTCACCAGGATACTATGATGG
CAGATACTGGACCATGTGGAAGCTACCTATGTTCGGATGCACTGATGCCACCCAAGTGTTGGCTGAGGTGGGAGA
GGCGAAGAAGGAATACCCACAGGCCTGGGTCCGTATCATTGGATTTGACAACGTGCGTCAAGTGCAGTGCATCAG
TTTCATTGCCTCCAAGCCTGACGGCTACTGAGTTTCATATTAGGACAACTTACCCTATTGTCTGTCTTTAGGGGC
AGTTTGTTTGAAATGTTACTTAGCTTCTTTTTTTTCCTTCCCATAAAAACTGTTTATGTTCCTTCTTTTTATTCG
GTGTATGTTTTTGGATTCCTACCAAGTTATGAGACCTAATAATTATGATTTAAAAAAA

> SEQ ID NO:1435 113128 107472_300264_1b
CTTTAATATCTTCTCTACACAACAATAATAATCATGGGTTCTAGCTGGCTCTCTTTCTCCTTGAGTTTCCTACTG
GTGTTGCACGGTACCTTTGCTCAGCAGAGATACCAGCAGCGGCAAGGCGAATGCCAACTCAATAGACTTAGCCCT
CAGGAACCCACCACCCGCATTCAAGCCGAAGCTGGAGTCACCGAGTTGTGGGACCAAAACAACCAGCAGTTCCAA
TGTGCTGGCGTCTCGCTAATTCGCCACGTCATCCAGTCTAGAGGCATGCTGTTGCCTTCTTATGTCAACACTCCC
CTACTTGCCTATGTTGAACGAGGTCGGGGATTTTATGGCATCATGCAATCTGGATGCCCTGAAACATTCCAGTCG
TCCTTGCAAATGCAGCAAGGTGAAAGGGGTGCAGGCTCAAGATTCCAAGATCGCCATCAGAGGATTGGACAGTTC

Figure 2 continued

```
AGACAGGGTGACATTATTGCCTTCCCTGCTGGAGCTGCTCACTGGGCCTATAACGAAGGAAATGAGGAGCTTGTT
CTTGTTTGTTTAGAAGACAGCAGTAACAATGCCAACCAACTTGGTCAATTTTCAAGGAGATTCTTCATAGCTGGA
AACCCACAACAAGGACAGCAACAACAGGGACAATACGGTGGCAAAAGCTTGCGCAGGGAACGATTCGAATCTGGA
AATGTTTTCAATGGCTTTGACGTAGAGGTCTTGGCCGAGGCATTTGGTGTAGACAGGGAGATAGCAAGGAGACTT
CAAGGACAGGACGACCAGCGAGGCCACATTGTAAACATTGAGCAAGGACTCAGAGTTGTGAGGCCACCATTCTCA
CAAGAACAAGAGGATCGCGAGGAGAGACAAGAGCAAGGACAATACGGTCCTCGCATGAACGGAATTG
```

> SEQ ID NO:1436 113128 267271_200116_1b
```
ACCACTCAAATATCACTAATATGGAATTGCGTTCTCTTCTTCCTCTTGCCCTTTGCTTTTTTCTCCTCTTTAATG
GTTGTTTTGCTCAAATAGAGCAACAGCAACGATTCTTATGGCAGAAACTTCAGCAACAGCAACAACACAGTCGTG
GCCGAGCTAGAACTGAGTGTCGGATCCAGAGCCTTAACGCTCGGGAACCGACTTATAAATTTGAATCGGAGGCTG
GAACCACTGAGTTTTGGGACCGTAATAATGAGGAATTCGAATGTGCTGGAGTTGCTGCTGTTAGAAATGTTATTC
AACCTCAGGGCTTGCTCTTGCCTCATTACAATAATGCTCCTCAACTCCTCTACATTGTCCAAGGGAGTGGACTTC
TGGGTACTGTAATACCTGGATGTGCTGAAACATATGAATCACCACGAAGAGAGAGAGGCATGAGGGGAGAAGAGA
GCAGAGAGGGAGAAAGCCAGTTCAGAAGTGGTGGTGATCAACATCAGAAAGTCAGGCAATTTAGACAAGGTGATG
TATTAGCATTACCAGCAGGTCTTACTCTTTGGTTTTATAACAATGGTCAAGAACGTCTTGTTACTGTCGCCTTGC
TTGATACCAGCAATCCTGCTAACCAGCTTGATCTCCAATTCAGGCATTTCTTCCTAGCTGGAAACCCAAACCCTA
GAGGACAAAGTGGAAGCAGGTACGAAGAAGAAATCCGAGGAAGAAGAGAACAAGAACAAGGCGAACA
```

> SEQ ID NO:1437 113128 197846_300701_1b
```
TCAACCAGCCCAAGTTTCCAATAACATCCTCAAATAGCTATGGCGACCATAGCTTTCTCTCGGTTATCTATCTAC
TTTTGTGTTCTTCTCCTATGCCATGGCTCTATGGCCCAGCTATTTGGTCCGAACGTAAATCCATGGCACAACCCT
CGGCAAGGAGGTTTTAGGGAGTGTAGATTTGATAGACTACAAGCATTTGAACCACTTCGGAGAGTGAGGTCAGAA
GCCGGGGTTACAGAGTACTTTGATGAGAAGAATGAACAATTCCAGTGCACAGGTACATTTGTCATCCGACGTGTC
ATTGAGCCTCAAGGCCTTCTGGTACCTCGATACAGCAATACTCCTGGCATGGTCTACATCATCCAAGGGAGAGGT
TCTATGGGATTAACTTTCCCCGGCTGCCCAGCAACCTACCAACAACAATTCCAACAATTCTTGCCTGAAGGCCAA
AGCCAGAGCCAAAAATTTAGGGATGAGCACCAAAAGATCCACCAATTTAGACAAGGAGATATCGTTGCACTGCCA
GCTGGTGTTGCGCATTGGTTCTACAATGAAGGCGATGCACCAGTTGTTGCTCTATATGTCTTCGACTTAAACAAC
AACGCTAATCAGCTTGAACCAAGGCAGAAGGAGTTCTTATTGGCGGGTAACAACAACAGGGAGCAACAAATGTAT
GGTCGCTCAATCGAGCAACACTCTGGGCAAAACATATTTAGCGGTTTCAACAATGAGCTACTAAGTGAGGCCTTA
GGCGTCAATGCATTGGTAGCAAAGAGGCTACAAGGCCAAAACGACCAAAGAGGAGAGATCATACGGGTAAA
```

> SEQ ID NO:1438 113128 196591_300704_1b
```
AAAAAGCATTCAGTTCATTAGTCCTACAACAACATGGCATCCATAAATCGCCCCATAGTTTTCTTCACAGTTTGC
TTGTTCCTCTTGTGCGATGGCTCCCTAGCCCAGCAGCTATTAGGCCAGAGCACTAGTCAATGGCAGAGTTCTCGT
CGTGGAAGTCCGAGAGGATGCAGGTTCGATAGGTTGCAAGCATTTGAGCCAATTCGGAGTGTGAGGTCTCAAGCT
GGCACAACTGAGTTCTTCGATGTCTCTAATGAGTTGTTTCAATGTACCGGAGTATCTGTTGTCCGCCGAGTTATT
GAACCTAGAGGCCTACTACTACCCCATTACACTAATGGTGCATCTCTAGTATATATCATCCAAGGGAGAGGTATA
ACAGGGCCGACTTTCCCAGGCTGTCCTGAGACCTACCAGCAGCAGTTCCAACAATCAGGGCAAGCCCAATTGACC
GAAAGTCAAAGCCAAAGCCATAAGTTCAAGGATGAACATCAAAAGATTCACCGTTTCAGACAAGGAGATGTTATC
GCGTTGCCTGCTGGTGTAGCTCATTGGTGCTACAATGATGGTGAAGTGCCGGTTGTTGCCATATATGTCACTGAT
ATCAACAACGGTGCTAATCAACTTGACCCTCGACAGAGGGATTTCTTGTTAGCTGGAAATAAGAGAAACCCTCAA
GCATACAGGCGTGAAGTTGAGGAGTGGTCACAAAACATATTTAGTGGCTTTAGCACTGAACTGCTTAGCGAGGCT
TTTGGCATAAGCAACCAAGTTGCAAGGCAGCTCCAGTGTCAAAATGACCAAAGAGGAGAAATTGTCCGCGTTGAA
CGCGGGCTCAGTTTGCTGCAACCATATGCATCATTGCAAGAGCAGGAACAAGGACAAATGCAATCAAGAGAGCAT
TATCAAGAAGGACGATATCAGCAAAGTCAATATGGGAGTGGCTGGCCTAACGGTTTGGATGA
```

> SEQ ID NO:1439 113128 196254_300707_1b
```
GGTTCGTTAGCCCAACTTCTTAGCCAAAGTACTAGTCAATGGCAAAGTTCTCGCCGTGGAAGTCCAAGAGAGTGC
AGATTTGATCGGTTGCAAGCATTTGAGCCGATTCGCACTGTAAGGTCCCAAGCTGGTACAACTGAGTTTTTTGAT
GTCTCTAATGAGTTGTTTCAATGTACTGGAGTATTTGTTGTCCGTCGAGTTATCGAACCTAGAGGTCTTCTGTTA
CCTCACTACTCCAATGGAGCAACTTTGGTATATGTCATCCAAGGCAGAGGTATAACAGGACCAACTTTCCCAGGA
TGTCCTGAGACCTATCAACAACAGTTTCAGCAATCCGAGCAAGACCAACAATTGGAAGGCCAAAGCCAAAGCCAT
AAATTTAGAGATGAACATCAAAAGATCCACCGTTTTCAACAGGGGGATGTAGTTGCATTGCCTGCTGGTGTTGCT
CATTGGTGCTACAATGATGGTGATGCACCAATTGTTGCCATATATGTCACTGATATATACAATAGTGCTAACCAA
CTTGATCCTAGACACAGGGATTTCTTTTTAGCTGGCAACAATAAGATAGGTCAACAATTGTAT
```

> SEQ ID NO:1440 113128 196016_300708_1b
```
CTATTAGCTTAAGTTTCCATAAGCAAGTACAAATAGCTATGGCGAGTTCCGTTTTCTCTCGGTTTTCTATATACT
```

Figure 2 continued

TTTGTGTTCTTCTATTATGCCATGGTTCTATGGCCCAGCTATTTAATCCCAGCACAAACCCATGGCATAGTCCTC
GGCAAGGAAGTTTTAGGGAGTGTAGATTTGATAGACTACAAGCATTTGAACCACTTCGGAAAGTGAGGTCAGAAG
CTGGGGTGACTGAGTACTTCGATGAGAAGAATGAATTATTCCAGTGCACGGGTACTTTTGTGATCCGACGTGTCA
TTCAGCCTCAAGGCCTTTTGGTACCTCGATACACAAATATTCCTGGCGTGGTCTACATCATCCAAGGGAGAGGTT
CTATGGGTTTAACCTTCCCCGGTTGCCCTGCGACTTACCAGCAACAATTCCAACAATTTTCATCTCAAGGCCAAA
GTCAGAGCCAAAAGTTTAGGGATGAGCACCAAAAGATTCATCAATTTAGGCAAGGAGACATTGTTGCACTCCCAG
CTGGTGTTGCACATTGGTTCTACAATGATGGTGATGCACCTGTTGTTGCCGTATATGTTTATGACGTAAACAACA
ACGCCAATCAGCTTGAACCCAGGCAAAAGGAGTTCCTATTAGCCGGCAACAACAATCGGGCTCAACAACAAGTAT
ATGGTAGCTCAATTGAGCAACACTCTGGGCAAAACATATTCAGCGGATTTGGTGTTGAGATGCTAAGTGAGGCTT
TAGGCATCAACGCAGTAGCAGCAAAGAGGCTACAGAGCCAAAATGATCAAAGAGGAGAGATCATACATGTGAAGA
ATGGCCTTCAATTGTTGAAACCGACTTTGACACAACAGCAAGAACAAGCACAAGCACAAGATCAATATCAACAAG
TTCAATACAGTGAACGACAGCAAACATCTTCTCGATGGAACGGATTGGAGGAGAACTTTTGCACGATCAAGGCGA
GAGTAAACATTGAAAATCCTAGTCGTGCTGATTCATACAACCCACGTGCCGGAAGGATAACAAGTGTCAATAGTC
AGAAGTTCCCCATCCTTAACCTCATCCAAATGAGCGCTACCAGAGTAAACCTATACCAGAATGCTATTCTCTCGC
CGTTCTGGAACGTCAATGCTCAT

> SEQ ID NO:1441 113128 110870_300047_1b
AATATCTTCTCTACTCAATAATAATAATCATGGGTTTTAGCTGGCTCTCTTTCTCCTTGAGTTTCCTTCTGGTGT
TGCACGGTACCTTTGCTCAGCAGAGATACCAACAGCAGCAAGGCGAGTGCCAACTCCATAGACTTAGTCCTCAGG
AACCCACCGTCCGCATTCAAGCCGAAGCTGGAGTCACTGAGTTATGGGATCCAAATAACCAGCAGTTCCAATGTG
CTGGTGTCTCCCTAATTCGCCACGTCATCCAGTCTAGGGGAATGCTGTTGCCTTCCTATGTTAACACACCCCTAC
TTGCCTATGTTGAACGAGGTCAGGGATTTTATGGCATCATGCAATCTGGATGCCCGGAAACATTCCAGTCATCCC
AGCAATTGCAGCAAGGTGAAAGGGGTGCCGGTTCAAGATTTCAAGATCGCCACCAGAGGATTGGACAGTTTAGGC
AGGGTGACATTATTGCCTTCCCTGCTGGAGCTGCTCACTGGGTTTATAACGAAGGAAATGAGGAGCTTGTTCTTG
TTGTTCTTGAAGATAGCAGTAACAATGCCAACCAGCTTGGTCGAACTTCAAGGAGGTTCTTCATAGCTGGAAACC
CACAACAAGGACAGCAACAACAGCAACAAGGACAATACGGTGGCCGCAGCTTGCGCAGGGAACAATTCCAATCTG
GAAATGTTTTCAATGGCTTTGACGTACAGGTCTTGGCTGAGGCATTTGGCGTAGACCAGGAGACAGCCAGGAGAC
TTCAGGGACAGGAAGACCAGAGAGGCCACATTGTAAACAT

> SEQ ID NO:1442 113128 274469_200057_1b
GGGAAAAATGGCTTCTAACTCCTCTCTCATTTGTTTTAGCCTTTGTTTCCTCTTTCTTTTTCATGGTACTTTTGC
TCAGATCTTTGAGCACCAGCAAGTTTGGCAGAGGATGCAACAGCAGCAGCAACATCGGGCGCTCAGGTCCAGAAC
TGAGTGCCGAATTGAGCGCCTGAATGCTCAAGAGCCTACTCGTAGGTTCGAGTCTGAGGCTGGTGTCACCGAGTT
CTGGGATCACACTCAGGAACAATTTGAGTGCGCCGGAGTCCAAGCAGTTAGGCATGAAATCCGACGAAATGGGCT
TTTGTTGCCTTACTACAGCAACACTCCCCAGCTCATCTATATAATTCAAGGAAATGGAGTGCATTCGGCTGTGTT
CCCGGGTTGTGCTGAGACATTCGAGACAGAGTCAGCACAATCGAGGAGGGGAGAAAGGGGAGAAAGAGGAGAAGC
AGGACAAAGATTCAATGACCGTCACCAGAAAGTTAGACGTTTTAGAGCTGGTGATATTCTTGCTTTGCCTGCTGG
TGTTACACACTGGACTTACAATGATGGTGAAGAACCAATTATCAGTGTCTCTCTTATTGACACTTCTAACCAGGC
CAATCAACTTGATCTCACCTTCAGGAAATTTTTCCTTGCTGGAAATCCTCAACGTGGTGTACAACAACAAATGTT
AGGAAGGCAACAGGAGGGAGCTCCTGGCCTAGGAAGAAGAGGTAGTGAACAAGAGAGAGGAAGCAACATCTTGAG

> SEQ ID NO:1443 113718 1008449_301415_1b
GAGAGAGAGAGAGCTTGGATTTTTTGGAAAGGAGAGAGAGAGAGAGAGGGTGCACCTCTTTTTTTTCACTCTTAA
GTTTATTTTTGCTCTATTTTTATATTTCCTCTTCTTCGATCCGCATCGCTCTGCTCTGCTCTGCTCCTCCCTCGT
CAGAACTTTGTGCAGAACCTAGGGTCCTTTCGGGGGGAAAGGGGGGGGCAGAGAAGGACCCATCATGGCCTACAG
AGCAGATGAAGAGTATGACTATCTATTCAAGCTTGTGCTCATTGGAGACTCTGGAGTGGGCAAGTCAAACCTCCT
CTCTAGATTCACTCGGAACGAATTCAGTCTCGATTCCAAATCGACTATTGGTGTTGAGTTTGCCACGCGTAGTCT
AAACGTCGACGGGAAGATGATCAAAGCCCAAATTTGGGACACCGCCGGCCAAGAAAGGTATAGAGCCATCACAAG
TGCATACTATCGGGGCGCAGTTGGCGCATTGCTTGTGTTTGATGTGACTAGGCATGTCACCTTCGAGAATGTCGA
GAGGTGGTTAAAAGAGCTTAAAGATCACACTGACGCGAATGCGGTTGTCATGCTTGTTGGGAACAAGAGCGATCT
CCGCCACCTTCGGGCGGTTTCAACG

> SEQ ID NO:1444 113718 1008561_301416_1b
TCTGATTCTTTCGCCTCTGTCGAGAATCATCATAAATGGCGGCGGCCGGCTCTACCAATCTGCAAGCTAAATTGG
TGCTTCTAGGCGATATGGGAGCGGGAAAATCCAGCCTAGTTTTGCGGTTTGTGAAAGACCAGTTTCACGAATACC
AGGAGTCAACAATTGGTGCAGCTTTCTTTTCGCAAACTTTAACTGTGGATAGCACAACTGTGAAGTTTGAAATTT
GGGATACAGCAGGTCAGGAAAGGTATCACAGCTTGGCACCTATGTATTACCGGGGAGCTGCTGCAGCTATTATAG
GATATGACATCACAAATCTTGATTCATTTACTCGAGCAAAGAAGTGGGTACAAGAGCTTCAAAAGCAAGGTAACC
AAAATCTGGTCATGGGCCTCGCTGGAAACAAGGGCGATCTAACATCCAAAAGAAAAGTTGAATC

Figure 2 continued

> SEQ ID NO:1445 113718 1109772_301524_1b
GCCCAAGCCTTGAGATTCCCAAGCCAGATCTCAGCAGCTAGGCAGTAGCAGCTTGGCAGTGTGGAAGTCATGGCA
TCAGAGTTCGATCATCTATTTAAGTTGCTTCTTATAGGAGATTCGGGTGTAGGCAAGAGTAGTTTGCTCTTGCGC
TTTACATCGGGCACCTTTGATGACCTTTCGCCTACTGTTGGTGTTGATTTTAAGCTGAAAACAATGACTTTGGAG
GGGAAGAGGTTAAAGCTCACAATTTGGGATACAGCTGGCCAGGAGCGATTTCGTACACTTACAAGCTCTTATTAT
AGAGGTGCACAAGGGATAATACTCGTTTATGATGTGACAAGACGGGAGACATTCACTAACCTTTCAGATGCATGG
TTGAAAGAAGTTGAGCTATACTCTACCCACCAAGATTGTATCAAGATGCTTGTTGGTAATAAAGTTGACATGGAG
TCGGAGCGTGTCGTCACCAAAAGGGAGGGTATAGCATTCGCAAGGCAACATGGCTGCTTATTCATTGAAAGCAGT
GCTAAAGCAAGAGTTAATGTTGAGCAATGCTTTGAGGAGC

> SEQ ID NO:1446 113718 1118778_301858_1b
TTCCTCGATTCGAAGAACAAGAAGCAGAAGGAGAAGAAGAGGAAGAAGGAATAGCCCTACCCTTATCGCTCAACG
GAAAATAATTCCTGCCCCCCATAATAATAATAATAATAATACCTTTCAATCCATTCAATTGCTTCCGATAATTCC
CCTCTCTTCCCAATTCGCCGGCCATCCGGGTTCAAAACTCCCGTGGGGAACGCGCAGCACTGTTTTTCAGCCTA
CCCATCGACGACCCTTGTGAAGATGTCCTACCAGTATCTCTTCAAGTATATCATCATTGGCGACACAGGCATTGG
CAAATCATGCCTCTTGTTGCAGTTTACAGACAAGAGATTTCAACCTGTACATGATCTTACCATTGGAGTTGAGTT
TGGGGCTCGTATGATCACAATTGGGAACAAGCCTATTAAGTTGCAGATTTGGGATACTGCAGGACAAGAATCATT
TCGATCTATCACCAGATCATACTACCGCGGTGCTGCGGGTGCATTGCTGGTCTATGATATCACCAGGCGAGAAAC
TTTCAACCATCTTGCAAGCTGGCTGGAAGATGCTCGGCAACATGCCACTACAAATATGGTTATCATG

> SEQ ID NO:1447 113718 1118070_301852_1b
AATTAATTTTTAAAAATTTCCCTTGCTCCTTCCGGCAGATCGATCCCCTTTCCTTCCTTCTTTTTCTCTTTCTAT
CTCTTCTTCTTTTCTCTCTCCCGTCTTTGCTCTGCCTTGTTGTTGACGAGAAGAAGAAGAAGAAGGAGAAGGAGG
TGGAGAGTAAGGATCGATGGCCGCCTCTGGAGCAGCTCGAGCTCGTGACCATGACTACCTCGTCAAGCTGCTCCT
CATCGGGGATAGCGGTGTTGGCAAGAGTTGCTTGCTTCTCCGATTTTCTGATGACACGTTCACTACAAGTTTCAT
CACGACCATAGGAATTGATTTTAAGATCAGAACTATTGAGATGGATGGAAAAAGAGTAAAGCTCCAAATATGGGA
CACTGCCGGACAAGAGCGCTTTAGGACAATTACTACAGCCTATTACAGAGGCGCTATGGGTATCATTCTTGTGTA
TGATGTAACAGATGAGTCGTCTTTCAACAATATTCGCAATTGGATTAGGAATATAGAACAGCATGCTTCTGACAA
TGTCAACAAGATATTAGTAGGCAACAAAGCTGATATGGATGAGAGCAAGCGGGCAGTGTCACATGAACGCGGTCA
AGCACTTGCCAATGAATATAACTTGAACTTCTTCGAGACAAGTGCCAAAACAAATATGAACGTGGAGCAGGTCTT
TTTCACCATTGCAAGAGATATCAAGCAACGGTTAACGGATGCTCCTTCGAAGACTGAGGCGGCGGCAATCAGCAT
TTCAAAGCCGAACCAACAAGACAAC

> SEQ ID NO:1448 113718 231343_301083_1b
AAAGAGGGAAGATCATCGTGCATCGCGCGGAGGTCTGGATCGGCAGCGCTAATGGCGGCGGGGAGAGCGCGGGCG
GACTATGACTACCTCATCAAATTGCTGCTCATCGGCGACAGCGGTGTGGGGAAGAGCTGCCTTTTGCTGCGCTTC
TCGGACGATTCCTTCACGACGAGCTTCATCACGACGATAGGCATTGACTTCAAAATCAGGACCGTTGACCTGGAT
GGCAAGAGGATCAAGCTTCAAATTTGGGACACTGCTGGGCAAGAACGCTTCCGGACGATCACAACTGCATACTAC
CGAGGAGCTATGGGCATTCTCCTCGTCTACGATGTGACGGATGAATCATCATTCAACAGAATATCGAGCAGCACG
CGTCGGACAATGTGAACAAGATCCTGGTCGGCAACAAGGCCGACATGGACGAAAGCAAGAGGGCCGTATCAACAG
AAAGAGGGCAAGCTCTTGCGAACGAGTTTGGTATCAAGTTCTTCGAAACCAGCGCGAAGACGAACATGAACGTGG
AGAACGTCTTCTTCACAATCGCGGGAGACATCAAGCGGAGACT

> SEQ ID NO:1449 113718 225723_300990_1b
GAGCAACGTTGGCGAATCCACGAAGAAAGAAGGGAAAGCGGTGCCATCGCGGGCAGGAGCAGGGCCAGATCTGAG
CTGCGCCGCCATCGATCGACGACCCAATCCACTGCCGCAGCTAAGGCGCCGCGAGATCCGGAGGTCTTTTGCAGG
GATTTCGGGGATTTTCGCTGGTTTTTCTTGATCTCTTCCTCGGTTCTGCGAAGAAGACGCATCGGCAGCAATGAA
TCCCGAGTAGGTTTCGATTCGCGAGCGATTGACCTCGCCCTCTTTGCAGTGACTATCTCTTCAAACTCCTCCTAA
TTGGCGACTCTGGCGTCGGGAAATCGTGCCTGCTGCTACGATTCGCGGATGATTCTTACCTTGAGAGCTACATCA
GCACCATCGGGTGGACTTCAAAATCCGAACAGTGGAGCTGGAAGGGAAGACTATCAAGCTCCAAATCTGGGACA
CTGCTGGGCAAGAGCGCTTCAGGACTATCACGAGCAGTTACTATCGTGGAGCTCATGGCATAATCGTCGTGTACG
ACGTGACTGACCAGGAAAGCTTCAACAACGTCAAGCAGTGGCTCAACGAGATTGATCGCTACGCGAGCGAGAATG
TGAACAAGCTCCTCGTCGGGAACAAGTCGGATCTCACTGCCAAGAAGGTGGTCGACACTCAG

> SEQ ID NO:1450 113718 223774_300975_1b
GCAAATACGATGAATACCGAATACGACTACCTCTTCAAGCTGCTTCTCATTGGAGATTCTGGTGTTGGCAAGTCT
TGTCTTCTGCTTCGATTCGCCGACGATACCTACACTGACTCTTACATTTCCACTATCGGTGTTGATTTTAAGATC
AGAACTTTAGAGCTGGAAGGAAAGACCGTCAAGCTGCAGATTTGGGATACTGCCGGACAGGAGCGTTTCCGAACC

Figure 2 continued

ATCACTTCTTCATACTACCGAGGAGCCCACGGTATCATTGTCGTCTACGATGTGACTGACCAGGACACATTCAAC
AACGTCAAGACTTGGTTCCACGAGATTGACCGATACGCCACCGAGGGCGTCAACAAGCTGCTTGTGGGTAACAAG
TCCGATATCACCGACAAGAAGGTCGTAGAGTACACTGTGGCCAAGGAGTTTGCCGACTCTCTGGGCATCCCTTTC
CTGGAGACCTCGGCTAAGAACGCCACCAACGTTGAGCAGGCATTTTTGACCATGGCACGTCAGATCAAGGAGCGA
ATGGGCGGAGCTGCCGAGAACACCGCCGCCAAGGCCAATGTCAACCTCCGAGGCCAGAATGTCTCTCAAGGTTCC
AGCAGCTCTTGCTGTTAAC

> SEQ ID NO:1451 113718 209276_300813_1b
CACGCAGACGCGCACCAACCCGCCGGCATGCGCGTCCGGATGCTTTGCTTTGCCCGCCGCGATTCGATCCACGCC
TGAGCGAGCGAGCGGGGCGAGCAACGCGCCCTTCCTTCCCTTGCCATGGCCTCTTCACCGGCGAGCAGCTACGAC
TGGTCCTTCAAGATCCTGCTCATCGGGGACTCGGCCGTCGGCAAGAGCAGTCTGCTCGTCAGCTTCGTCTCCGCC
TCCCACATCGACGACGAAATCGCTCCCACCATAGGGGTTGACTTTAAAATCAAATTTCTCACTGTCAATGGGAAG
AAACTGAAGCTAACAATATGGGACACTGCTGGCCAGGAAAGGTTTAGGGGAATCACAAGTTCTTACTACAGAGGT
GCCCATGGCATCATTCTAGTGTATGATGTCACAAAGAGAGAAAGTTTCACAAATTTGGCTGATGTATGGGCCAAG
GAAATAGAATTGCATTCGACAAATAAAGAGTGCATCAAAATGCTTGTCGGGAACAAGGTGGACAAGAATGAGGAA
AGGATGGTGACAAGGGAAGAAGGTCTTGCCTTTGCCCAGGAATCTGGATGTCTTTTTCTT

> SEQ ID NO:1452 113718 209274_300813_1b
CTTTCCTAGTCTTCTTCTCCGCCACTCCGAGGCGGCAAGGAGGAAGATCTCGGAGGCGGTGCCCGGAGGAGGTGA
GGCGAGATGGGCGGGCGGGTGGATCACGAGTACTCGTACCTGTTCAAGATGGTGCTGATCGGCGACAGCGGCGTC
GGCAAGTCTAATATCCTCTCCCGCTTCACCCGCAACCACTTCTCCCTCGACTCCAAGTCCACCATCGGCGTCGAG
TTCGCCACCAAATCCCTGCAGATGGAGGGCAAAACAATAAAGGCTCAGATCTGGGACACAGCAGGACAGGAGAGA
TATCGTGCCATCACAAGTGCTTACTACCGTGGCGCTGTTGGGGCTCTCCTTGTTTACGACATCACAAAGAGGCAG
AGCTTCGACAATGTCCACAGGTGGCTTCGTGAGCTCCGCGACCATGCCGACTCGAGCATTGTTATCATGATGGTC
GGTAATAAGTCTGATTTGATTCATCTAAGGGCTGTCTCCGAGGATGAAGGTAAGGCATTGGCTGAAAAGGAGGGG
CTGTTTTTTCTTGAGACATCAGCTATGGAGGCCGTGAATGTGGAGGAAGCCTTTCAGACTATCATCACAGAGGTC
TATGGCATT

> SEQ ID NO:1453 113718 8095_300316_1b
AGCTCTGGAAACAAGAACATCAACGCCAAATTGGTATTACTAGGAGATGTTGGAGCTGGAAAATCAAGTCTTGTG
CTACGGTTTGTGAAAGATCAGTTTGTTGAATTTCAGGAATCAACCATTGGTGCAGCTTTTTTCTCTCAAACATTG
GCTGTGAATGATGCGACTGTGAAGTTTGAGATATGGGATACAGCTGGTCAGGAACGATACCACAGTTTGGCTCCA
ATGTACTACAGGGGTGCAGCTGCTGCTATTATTGTCTTTGACATTACTAATCAAGCCTCATTTGAGAGGGCGAAG
AAATGGGTTCAGGAACT

> SEQ ID NO:1454 113718 7863_300306_1b
CCCACGCGTCCGCTACAATTCCTCTGTCGCTCTCACCAGTTAACAGCTACAGCACAAAACTGTAACCACGCTTCC
GATCTCTAAAACCTGAGAGAGAGAGAGAGAGAGAGAGACAGAGAGAAGTGTTTCAATAGTTTGGCGTGAAGAT
GGCCGGAGGAGGCGGATACGGCGGCGCATCGGGGAAAGTTGATTACGTCTTCAAAGTTGTTCTAATCGGAGATTC
GGCTGTTGGGAAATCGCAACTACTTGCTCGATTCGCTAGAGACGAATTCAGCATGGATTCTAAAGCCACCATCGG
CGTCGAGTTCCAAACTCGTACCCTCTCCATTGAACAAAAAAGCATTAAGGCTCAGATCTGGGATACCGCTGGTCA
GGAAAGATACAGAGCCGTTACAAGCGCATACTACAGAGGAGCAGTTGGCGCAATGCTGGTTTATGATATGACGAA
ACGTGAGACCTTTGAGCATATT

> SEQ ID NO:1455 113718 38533_300201_1b
CCCACGCGTCCGCTCTGGCTCTGTATCGCTCGCTGCTCTTCCTCCCACAGATCGAAAACCATGAATCCTGAGTAC
GACTATCTTTTCAAGCTCCTGCTTATCGGGGATTCTGGCGTAGGCAAGTCTTGTCTTCTTTTGAGATTCTCTGAT
GATTCTTATGTAGAAAGTTACATTAGCACTATTGGAGTCGATTTAAAATTAGGACTGTGGAACAAGATGGCAAA
ACAATTAAGCTCCAAATTTGGGACACTGCTGGTCAAGAACGGTTCAGGACTATTACTAGCAGTTACTACCGTGGG
GCACATGGAATTATTATTGTCTACGATGTCACAGATGAAG

> SEQ ID NO:1456 113718 259823_301709_1b
ACGCGTCGAGGCTGGAAGCAAGCGATCTTTTATTTCTCTTCTCCTCTCGCCAGATCGATCGCCGCCGGCTCAGGC
CAGTTCTTCCGGGAGATCCAGCGCTATGGCCTACAGATCGGACGAGGACTACGACTATCTCTTCAAGGTAGTGTT
GATTGGCGACTCGGGCGTCGGCAAATCCAACCTCCTCTCCAGATTCACGCGCAACGAATTCAGCCTCGAATCCAA
GTCCACCATCGGGGTCGAGTTCGCGACCCGTAGCATCAACGTCGACGGCAAGCTCGTCAAGGCACAGATTTGGGA
CACCGCCGGGCAGGAGAGATATCGAGCGATCACCAGCGCCTACTACCGCGGCGCCGTTGGCGCTCTCCTCGTCTA
CGACATCACCCGGCCGGTGACGTTCGAGAACGTGGAGCGGTGGCTCAAGGAGCTCAAGGACCACACCGATTCCAA
CATCGTGGTGATGCTGGTGGGGAATAAGTCCGACCTGCGCCACCTCCGGGCCGTGTCCACCGAGGACGGCCAGGC

Figure 2 continued

CTTCTCCGAGCGCGAGGGGCTCTACTTCATGGAGACGTCGGCCCTCGAGTCGACCAACGTGGAGAATGCGTTCAA
GCAGATACTGACGCAGATTTACCGGGTGGTGAGCAA

> SEQ ID NO:1457 113718 25975_300103_-1b
CCCACGCGTCCGCTACAATGCCTCTGTCGCTCTCACCAGTTAACAGCTACAGCACAAAACTGTAACCACGCTTCC
GATCTCTAAAACCTGAGAGAGAGAGAGAGAGAGAGAGAGACAGAGAGAAGTGTTTCAATAGTTTGGCGTGAAGAT
GGCCGGAGGAGGCGGATACGGCGGCGCATCGGGGAAAGTTGATTACGTCTTCAAAGTTGTTCTAATCGGAGATTC
GGCTGTTGGGAAATCGCAACTACTTGCTCGATTCGCTAGAGACGAATTCAGCATGGATTCTAAAGCCACCATCGG
CGTCGAGTTCCAAACTCGTACCCTCTCCATTGAACAAAAAAGCATTAAGGCTCAGATCTGGGATACCGCTGGTCA
GGAAAGATACAGAGCCGTTACAAGCGCATACTACAGAGGAGCAGTTGGCGCAATGCTGGTTTATGATATGACGAA
ACGTGAGACCTTTGAGCATATTCCGCGTTGGCTTGAAGAACTGAGGGCGCACGCTGATAAGAACATTGTCATCAT
CCTTATTGGAAACAAGTCTGATCTAGAAGATCAAAGAGCTGTTCCCACTGAAGACGCTAAAGAGTTTGCTGAGAA
GGAAGGACTCTTTTTCCTCGAGACCTCTGCTTTAAACGCAACCAATGTCGAAAACTCCTTCAACACTCTAATGAC
TCAGATATACAATACCGTGAACAAGAAGAATCTTGCATCTGAAGGCGACTCAAATAACCCCGGTTCATTGGCTGG
TAAGAAGATTCTCATCCCAGGTTCTGGACAGGAGATTCCCGCTAAGACCAGCACTTGTTGTACTTCTTCTTGATC
TGTCTCCTACTCAAGCAAGATTCATTTTTTTTCCTCCTGAAATTTGTGATAGAGAATGCTACTTTCATTGTATAT
TCTTTTTCGAATCTGGCTTGTTTGCTAGTTCATTAAACATTGGTGTGCAATTGGACACCGATAGAAAGTATTGGA
ACAAATAGCTTTTGAATGAAATATGAAACAAACAGTCTTTGAGAGTTAAAAAA

> SEQ ID NO:1458 113718 258548_301697_1b
AATACAACATGGCCACCCCAAGAACGTCTTGTCAAGAGCGATTTGCACAGTTCAAACTCGTGTTATTAGGTGAGT
GAGAGAGGGTCTATGCTACTCTCTTCTGGCTTCTTTCAGCGACTCCACCACAAGAAGAAAATGGGAATGGAGCAA
AGCATCTTTGGTGTGATCTTTGGGTACAAGAAAGGGTGCAAGCTAGGTCAGATTCGTATCAGAACCGCTTTGCCT
GTCACTTGCTTGATGTTACTAACACAGGTGAATCGTTTGTGGGTAAATCCTCGCTGGTGACCCGGTTCGTCAAGG
ACGAGTTTCTCGAGCAGAGAGAATCAACTATCGGAGCAGCCTTCCTGACCCAGACTGTCTCTCTGGAAGACAACA
AGACAGTCCGGTTCGAGATTTGGGATACTGCCGGACAGGAGCGATACAAGTCGCTGGCCCCATGTACTACCGGA
ACGCCAATTGTGCTGTGGTGGTCTATGACATTACACAGGCCTCGTCATTGGAGCGATCTAAGGCATGGGTCAAGG
AGCTCCAGCACCGAGCTGCTGACGGAATCATTATTGGCCTTGCCGGAAA

> SEQ ID NO:1459 113718 255860_301645_1b
CCCACGCGTCCGGAGAGAGAGAGAGAGCTTGGATTTTTTGGAAAGGAGAGAGAGAGAGAGGGTGCACCTCTTTTTTT
CACTCTTAAGTTTATTTTTGCTCTATTTTTATATTTCCTCTTCTTCGATCCGCATCGCTCTGCTCTGCTCTGCTC
CTCCCTCGTCAGAACTTTGTGCAGAACCTAGGGTCCTTTCGGGGGGAAAGGGGGGGGCAGAGAAGGACCCATCAT
GGCCTACAGAGCAGATGAAGAGTATGACTATCTATTCAAGCTTGTGCTCATTGGAGACTCTGGAGTGGGCAAGTC
AAACCTCCTCTCTAGATTCACTCGGAACGAATTCAGTCTCGATTCCAAATCGACTATTGGTGTTGAGTTTGCCAC
GCGTAGTCTAAACGTCGACGGGAAGATGATCAAAGCCCAAATTTGGGACACCGCCGGCCAAGAAAGGTATAGAGC
CATCACAAGTGCATACTATCGGGGCGCAGTTGGCGCATTGCTTGTGTTTGATGTGACTAGGCATGTCACCTTCGA
GAATGTCGAGAGGTGGTTAAAAGAGCTTAAAGATCACACTGACGCGAATGCGGTTGTCATGCTTGTTGGGAACAA
GAGCGATCTCCGACACCTTCGGGCGGTTTCAACGGAGGACGGCCAAGCCTTCTCCGAGAGAGAGGGCCTC

> SEQ ID NO:1460 113718 249503_301593_1b
AGAATGAACCTGTTTGCGAATCCACGAAGAAAGAAGGGAAAGCGGTGCCATCGCGGGCAGGAGCAGGGCCAGATC
TGAGCTGCGCCGCCATCGATCGACGACCCAATCCACTGCCGCAGCTAAGGCGCCGCGAGATCCGGAGGTCTTTTG
CAGGGATTTCGGGGATTTTCGCTGGTTTTTCTTGATCTCTTCCTCGGTTCTGCAAGAAGACGCATCGGCAGCAA
TGAATCCCGAGTATGACTATCTCTTCAAACTCCTCCTAATTGGCGACTCTGGCGTCGGGAAATCGTGCCTGCTGC
TACGATTCGCGGATGATTCGTACCTTGAGAGCTACATCAGCACCATCGGGGTGGACTTCAAAATCCGAACAGTGG
AGCTGGAAGGGAAGACTATCAAGCTCCAAATCGGGACACTGCTGGGCAAGAGCGCTTCAGGACTATCACGAGCA
GTTACTATCGTGGAGCTCATGGCATAATCGTCGTGTACGACGTGACTGACCAGGAAAGCTTCAACAACGTCAAGC
AGTGGCTCAACGAGATTGATCGCTACGCGAGCGAGAATGTGAACAAGCTCCTCGTCGGGAACAAGTCGGATCTCA
CTGCCAAGAAGGTGGTCGACACTCAGACTGCCAAGGCTTTTGCAGACGAGATAGGAATCCCGTTTCTAGAAACCA
GTGCCAAGAACGCGACCAACGTAGAGCAGGCATTCATGACCA

> SEQ ID NO:1461 113718 247978_301578_1b
GAGCAAGGCCTCCAGAGGAGAGAGATATATAGTAGAGAGCGCTGGTGTGATTAGATCGCCATAGCCGGATCGA
GTGATTGGGATGAGGAATTCATAGTTTTTCTTCCGGGAGAGCAGGTTTTGGCAGCGCAATGAAGCCTGGAGGATC
TCCTTTCAAAGTTGTTCTTCTGGGAGACGGTAGAGTCGGGAAGACTTCTCTCGTCCTGCGGTACGTGAATAATCA
CTTCTCCGATAGTCAAAGTGCTACGATACAGGCTTCCTACTTGACCAAGCGCTTGAGCGTCGATGGCACTGTGGC
AACGCTATCAATATGGGATACAGCAGGCCAGGAACGCTTCCATGCATTAGGTCCGATCTACTACAGGGACGCTGA
TGCTGCATTGCTTGTCTATGACATTATGGATAAAGATAGCTTTACTCGTGTGAAGAATTGGGTAAAGGAGCTGCG

Figure 2 continued

GAAGATGGCATCCAACAAGCACATCGTCCTGACGATCGCTGGAAACAAGAGTGATATGGACAAGCTGCGGCAAGT
TGATCTCCAGGACTCTGAGAGATACGCTGCGTCGATTGGAGCAAACCATTTCGTCACCTCTGCGAAGCTAAACAG
TGGGATAGACGACGCTTTCATGGACATAGCTACACGTTGCATGGAACAGAGAAGAAAGGCTGCTGCGGACTCTAG
CAATGGCAGCGTGC

> SEQ ID NO:1462 113718 245456_301568_1b
GTCAATTAGGTCTTTTGGATCAGGGAGCTCGTCCGCGATGTCGTATGCCTATCTCTTCAAGTACATCATCATCGG
CGACACGGGTGTAGGGAAATCGTGCCTGCTGCTCCAGTTCACGGACAAGCGATTCCAGCCGGTCCACGACTTGAC
GATTGGCGTCGAGTTTGGGGCGCGGATGATCACAATCGATAACAAGCCCATCAAGCTCCAAATCTGGGACACAGC
AGGCCAAGAGTCTTTCAGATCGATCACGAGGTCGTACTACCGCGGTGCCGCCGGTGCCTTGCTTGTGTACGACAT
TACCAGGCGAGAGACTTTCAGTCATCTGGCAAGCTGGCTGGACGACGCTCGGCAGCACGCGAACTCCAACATGAC
GATCATGCTCATTGGTAACAAGGCCGATCTGGCTCACAGGCGAGCAGTGAGCACGGAAGAAGGCGAGCAATTCGC
CAAGGAACACGGGCTCATCTTCATGGAGACGTCGGCCAAGACCGCTCAAAACGTCGAGGAGGCTTTCATTAACAC
AGCATCGAAGATCCACCAGAAGATTGAAGAAGGCGTGTTCGACGTTTCAAACGAGGCGTCGGGAATCAAGATCGG
AGTTCTACCAAATAATCCCCACAGAGGTGATTACCCGGGTCCTCAAGGTGGTGGCTGCTGCAGCTAGAAGGCGGG
TATAAGTTCTCATTAAAAAATGATTTACCATGTCGTGAATAATTTTCCCTCCTGTACAAAGCTATCGTG

> SEQ ID NO:1463 113718 242554_301330_1b
CTCAGTCGTGTCTTGTCACTTAATTATCTCGACCACGCGTCGGGTGGATCTGGGAGATCTAGCTCGCGAATTGGT
CGCGCGATCCGCGTAGATAGATCTGGAGCTGCTCCTTGGATGTGGAATGCCGTGGTCCAAGCTTTTGGGGAATAG
GTCGTGAGCGGCAGCGCGGCAAAATAGGTCTTGATCGAGAGTGATTTGCGAGAAATGGGTGTGCCAACCGCGACG
GTGTCGCCGCTCGCCAAGTACAAGCTTGTGTTCTTGGGCGATCAATCGGTGGGGAAGACGAGCATCATCACGCGT
TTCATGTATGATAAGTTTGACAACACGTACCAGGCAACCATTGGGATCGACTTCTTGTCGAAGACCATGTACCTG
GAAGATCGCACTGTTCGCTTACAGCTCTGGGATACTGCTGGCCAGGAACGTTTTCGCAGCCTAATTCCCAGCTAC
ATACGGGATTCGTCCGTGGCGGTGGTCGTGTACGATGTTGCGAATCGCCAGTCGTTCCTAAACACGGCCAGATGG
GTGGAAGAAGTCCGCACCGAGCGTGGTAGCGATGTGATCATCGTTCTCGTCGGGAACAAGACCGACTTGGTTGAC
AAAAGGCAAGTCTCGATCGAGGAGGGGGATGCCAAAGCCCGGGAATTTGGAGTCATGTACATCGAAACCAGTGCC
AAGGCCGGATTCAACATCAAGGCTCTCTTCAGAAAAATCGCTGCCGCA

> SEQ ID NO:1464 113718 239387_301303_1b
GGCAACACGAGGAGGTCGTAGGGTTTGCGGGAGAGCTCTCGCCGAAGGCCTGATCTGTGCTGGGATCTACACCAG
GAGCTCAAGCATGGCATCCAGGAAGCGAACTCTCCTCAAGGCGATCATTCTCGGCGACAGCGGCGTCGGCAAGAC
ATCGCTCATGAATCAATACGTGAACAAGAAATTTAGCAACCAGTACAAGGCGACCATTGGAGCTGATTTTCTCAC
CAAGGAAGTCCAAGTGGAGGATAGGCTAGTGACGATGCAGATATGGGATACAGCCGGTCAGGAGCGATTCCAAAG
CCTTGGTGTGGCCTTCTATCGAGGGGCTGATTGCTGTGTGTTGGTATACGACGTGAATGTGATGAAGTCGTTCGA
TAATCTGGACAACTGGCGCGACGAGTTTCTTATCCAGGCAAGTCCTTCTGATCCAGAGAACTTCCCTTTTATTGT
TCTCGGCAACAAGGTCGATGTAGACGGGGGGAACAGCAGAGTGGTATCCGAGAAGAAAGCCAAGGCCTGGTGCGC
GTCGAAGGGAAACATTCCATACTTTGAGACGTCTGCCAAAGAAGACTACAACGTTGAGGCTGCTTTTCAATGTAT
AGCGAAGAATGCCTTGAGGAGTGAACCCGAAGAAGACTTCTACCTTCCGGACACGAATGACCTCGCAAACAACAA
CAGAGTGACGAGATCATCTGGGTGT

> SEQ ID NO:1465 113718 253174_301628_1b
AAAAAGAGAACCATGCTGAAGGTCGTCATCCCTCGGCGACTCCGGCGTTGGTAAGTCGTCGTTGATGCAACAGTAC
GTCAACAACAAGTTCAGCACACAATACAAGGCCACGATCGGGAGCCGACTTTCTCAACAAAGAGCTGACTCTCGAG
GGCCGAAAAGTCAACATGCAAATCTGGGACACGGCCGGTCAGGAACGGTTCCAATCCCTCGGTCTGGCTTTCTAC
CGAGGCGCCGACTGTTGCGTTCTGGTCTACGATGTCAACAACTCCAAGAGTTTTGATGCCCTGACTCTGTGGCGA
GATGAGTTCCTTCTCCTTGCCAACCCCCGAGACCCAGAAAACTTTCCTTTTGTGGTGATCGGTAACAAGGTGGAT
GTGGAGGAGAGCAAGCGGGCAGTTTCCGCCAAGCGAGCCCAGGCCTTCTGCAAGGCAACCGGCAACATTCCCTAT
TTTGAGACCAGTGCCAAGGAGGACACTGGTGTAGACCAGGCTTTCGAGACCGTTGCTCGAAACGCCATGGCACAG
GTGGACTCAGAGGACTACACGGACGATTTCGCCGACATCATCAACATCCATCTGGATAATGAGCAGTCCAACTGT
GCTT

> SEQ ID NO:1466 113718 251026_301653_1b
GGATCGAGCAGAGGGGGACGGACTCTTCCTGGATACGAGGTCATGGCGAACGGCTTCGTGGATTTCAATCAGAAG
ATCGACTATGTCTTCAAGGTGGTGCTGATTGGGGACTCGGCGGTGGGGAAGTCACAGCTGCTTGCCAGGTTCTCC
AGGAACGAGTTCACTCTGGAATCCAAGGCAACCATCGGCGTCGAGTTTCAGACCCGGACCATGGTGGTGGATCAC
AAGAACGATCAAGGCACAGATCTGGGACACCGCCGGTC

> SEQ ID NO:1467 113718 157979_301396_1b

Figure 2 continued

GAGAGTGCTCTCAAGCAAAGGATTTCTCTAGAGAGAGAGAGCGAGAGAGTGTGTCTGTGTGAGTGTGAGAAAG
AGAGAGAGAAATAGAGATGGCAAGGAGACCGGACGAGGAGTACGATTACTTGTTCAAGATAGTGTTAATCGGAGA
TTCAGGAGTAGGCAAATCCAACTTGCTCTCCAGATTCACTAGAAATGAGTTTTGCTTGGAGTCCAAATCTACTAT
CGGCGTTGAATTCGCCACTCGTACTCTCCAGGTTGAGGGAAGGATCATTAAGTCTCAGATCTGGGACACTGCTGG
ACAGGAGAGATATAGAGCCATTACAAGTGCTTACTATAGAGGTGCACTTGGAGCTCTTCTGGTATACGATGTGAC
AAAACCTATGTCCTTTGAAAATGTCAGCCGATGGTTAAAGGAACTGAGGGATCATGCAGACTCCAACATTGTGAT
TATGCTCATTGGAAACAAGACTGATCTGAAGCATCTCCGAGCAGTTCCTACAGAGGATGCTCAGGGCTATGCTGA
AAGAGAAGGGCTTCTTTCATTGAAACATCTGCTTTGGAGGCAACGAACGTAGAAAAAGCTTTCCAGATGAATCTT
TCAGAAATCTATCGGATAATCAGTAAGAAGTCACTT

> SEQ ID NO:1468 113718 157926_301396_1b
ACCTTGCTCTCCGTCATTTTCCGGCGACGATCCCTTTTTCCGCTATTTCCGGCCGTAAGGAACAGAAACATCCCC
GTTCCCTTCGCCCTTTGGATCAGTCAGCTTCGCAAAATCATGAATCCCGAATATGACTACTTGTTCAAACTTTTG
TTAATAGGAGATTCAGGTGTTGGAAAGTCATGTCTTCTCCTGAGATTTGCTGATGATTCTTATTTGGACAGCTAT
ATCAGCACAATTGGTGTTGACTTTAAAATACGTACAGTGGAGCAAGATGGGAAGACTATTAAACTTCAAATTTGG
GACACTGCCGGACAAGAACGTTTCAGGACAATTACAAGTAGTTACTACCGTGGAGCACATGGCATTATAATAACT
TATGATATAACTGATCAAGAAAGCTTCAACAATGTTAAGCAATGGTTGAGTGAAATTGATCGCTATGCAAGCGAA
AACGTAAACAAGCTTCTGGTTGGAAATAAGTGTGACCTAACTGACAACCGAGCTGTGTCATATGATACAGCAAAG
GCGTTTGCTGATGAAATCGGCATCCCGTTTATGGAGACTAGTGCAAAGAGTGCCACTAATGTTGAGCAAGCGTTC
ATGGCAATGGCAGCTGAAATAAAGAATAGGATGGCGAGCCAGCCGACATCAAACAATGCA

> SEQ ID NO:1469 113718 157891_301743_1b
GTTGGAAAGTCATGTCTTCTCCTGAGATTTGCTGATGATTCTTATTTGGACAGTTACATCAGCACAATTGGTGTT
GACTTCAAAATACGCACTGTGGAGCAAGATGGGAAGACAATGAAACTTCAAATTTGGGACACTGCTGGACAAGAA
CGCTTCAGGACGATTACCAGTAGTTACTACCGTGGGGCACATGGCATCATTATAGTTTATGATGTAACTGACCAA
GAAAGCTTTAACAATGTTAAGCAATGGTTGAGTGAGATTGATCGTTATGCAAGTGACAATGTAAACAAGCTTCTG
GTTGGGAATAAGTGTGACCTGGCTGACAACCGTGCTGTGTCTTATGATACAGCAAAGGCTTTTGCTGATGAAATT
GGTATTCCATTCATGGAGACTAGTGCAAAGAATGCCACTTATGTTGAGCAGGCCTTCATGGCAATGGCAGCTGAC
ATAAAGAATAGGATGGCAAGCCAGCCAGCATCGAATAATGCAAAGCCTCCAACAGTCCAGATACGAGGTCGACCT
GTTTCCCAGAAGAGTGGTTGCTGTTCTAGTTAGAATCACTTTTCAGGCCTTCTCCTGGTTGTATTGTGCCAGATA
TATTCTTTTTAATCTGCCAGTATTCTGGTGGCCTGTACAAATCATAAGGGTTACTCCTTAAGATTTTTCTTTCCT
CTTTGA

> SEQ ID NO:1470 113718 157256_301736_1b
CCCAACTCTCTCTCTCTCTAGATCACCATTTCCACTTTCTGCCTCTTCCCCCGAAGACTCTTACACTTTTCACAA
CTTCAAAAATGGATTCATCAGATGATGAAAGTGGTGAGGAATATCTTTTCAAGATTGTAATAATTGGTGATTCAG
CAGTTGGAAAATCAAATTTGTTAACACGTTATGCAAGAAATGAATTCAACTTGCATTCAAAGGCAACAATTGGAG
TTGAGTTTCAGACCCAAACTCTTGAAATTGACGGTAAAGAAGTAAAAGCTCAGATTTGGGATACTGCTGGTCAAG
AAAGATTTAGAGCTGTTACTTCTGCTTATTATCGTGGTGCTTTTGGTGCTCTTGTTGTTTATGATATTACTAGAC
GTACCACTTTTGATAGCATCCCTCGTTGGCTTGATGAGATCAAAACGCATTCTGATACCACGGTTGCAAGGATGC
TCGTGGGAAATAAATGTGATTTGGATAACATAAGAGCTGTGAGCGTAGAAGAAGGCAAAAGCTTGGCAGAATCGG
AAGGAATGTTCTTCATGGAGACATCTGCCCTCGATGCAACAAACGTAAACAAGGCTTTCGAGATGGTGATTCGAG
AGATCTACAATAGTGTTAGCAGAAAGGTTTTGAATTCTGATTCTTATAAAGCTGAATTGTCTGTCAACAGAGTTA
GCCTCGTCGATAATGGTACCGATGGATCAAAACAAAATCAAGGCTATTCTTGTTG

> SEQ ID NO:1471 113718 208694_300807_1b
TGCAAAGAACTCGCCCGCAGCTGAGAGGGGGGAATAATCCATAATCCGCCAGCCCACGCACATCGCCAGGCAAAT
CTGCACTCTTCTGCACCTCCAAGAGGAGTCGCTTTTGCTGCATCTCCAAAGTCGCAAGCAGACGCCGCCGAAACG
AGCCGGTAAAAGATGGCGGAAGCTCCCAAACCCAGCAGCAGCGTCAAGCTGGTGCTCCTCGGTGAAGCCGCAGTC
GGAAAGTCATCCCTCGTCTTGCGATTCGTCAACAACGACTTCCAAGAGAACAAGGAGCCGACTATTGGTGCGGCG
TTCCTGACGCAAAAATGCAACCTGGCCACCCGAACCATCAAGTTTGAGATTGGGATACCGCTGGTCAAGAGCGA
TTTGCCTCTCTGGCGCCCATGTACTACAGAAACGCCCAGGCCGCCCTTGTCGTCTACGACATCACCAAGCCCACA
TCCCTCGTCAAGGCCCGACACTGGGTCGCCGAGCTCCAACGACAAGCCTCACCCGGTATCGTCATCGCCCTGGTA
GGAAACAAGCTAGATTTGGCTGGCGAATCGAATGGTGCAAGCGAGGAAGCCGAGGGCGGGGAAGACGGCGATGCC
CGCAAAGTGTCAACAGAAGAAGCCCAGTCGTATGCCGAAGAGGAGAGTCTGTTGTTTTTCGAGACGAGTGCAAAG
ACGGGCCACAACGTTACCGAAGTCTTCACAGCTATTGCAAATGCGATCCCCGAGACGTCTCTCAAGAGTGCTAGG
GGAGCCGGCGCAGCGGGCACGGCCAACCGGGCTGGAGACGAGCAGAGAGTGAACCTATCAGGACCAAGGGATGCC
GGAGCAAAGGACGGATGTGCCTGTTAGATGGGAGATATTTGAATTGTTATACAAGGTACAAGCACCATGTTGTCG
GTTGCTACCGCTGCTGCGCTACCCGTCAGATGAGGTCGGATTTGTTATGGCATGTCATTCGGGAGTCAGAGTCTT

Figure 2 continued

GCG

> SEQ ID NO:1472 113718 204974_300794_1b
CACAACCACACATCTCAGCGTCACAGCTTCCCTTGTCTGCACAGCATCAAACCACCTTTTCTCACCTGCGCGCAT
CGACTCGTTCTGCTGCTACCATGGCCAACGACGAATATGATGTAGGTTCCGCCCCCTTCTCGCACTGCAACGAAA
TGAACACCTGGCGGAACGCTAACGGCGATGCTTCAACCCCCACTAGTTCCTCTTCAAAGTTGTCTTGATTGGTGA
CTCTGGAGTCGGAAAGTCCAATCTTCTCAGCCGATTCACTCGCAACGAATTCAACCTCGACTCCAAGTCAACTAT
CGGTGTCGAGTTTGCCACTAGATCGATCCAGGTCGACTCCAAGACCATCAAGGCGCAGATTTGGGATACAGCCGG
TCAGGAGCGTTACCGTGCCATTACTTCCGCATACTACCGTGGTGCAGTCGGCGCCCTCCTCGTCTATGACATCAG
CAAGCACCAAACCTACGAGAACGTCACGAGATGGCTAAAGGAGCTTCGGGACCATGCCGATGCGAACATTGTCAT
CATGCTGGTTGGCAACAAGAGCGATTTGAGACACCTGAGGGCTGTGCCCACGGATGAGGCCAAGGGCTTTGCTAG
CGAGAACCATCTTTCTTTCATCGAGACGTCCGCCCTCGACGCCAGCAACGTTGAACTTGCCTTCCAGAACATCCT
TACTGAGATCTACCGAATCGTAT

> SEQ ID NO:1473 113718 201174_300713_1b
GTCTTCCTCTCTCTCCCCCGTCTTCGCCTCGCGCTCGCGTCTCCCTCCCTCCCTCCTTCCGTCCAGATCCGCGTG
GGCTCGAAGAAGCGGCGGGCGATCCACGGCGAGCGTCCGCGGTCACTCCCCCCGTCTCCGTCCGGCATGAATC
CCGAGTACGACTACCTTTTCAAACTTCTCCTCATTGGTGATTCTGGTGTTGGGAAATCGTGCTTGCTTCTCAGAT
TTGCGGATGATTCATACCTGGACAGCTACATCAGCACAATTGGAGTTGATTTTAAAATACGGACAGTAGAGCAGG
ATGGGAAGACCATCAAGCTTCAAATCTGGGATACTGCTGGACAAGAACGTTTCAGGACAATTACAAGCAGCTATT
ACCGGGGAGCTCATGGAATTATTATTGTATATGATGTGACAGACCAAGAAAGCTTCAACAATGTGAAGCAGTGGT
TGAATGAAATTGATCGTTATGCAAGTGACAATGTTAACAAGCTCCTCGTTGGGAACAAGAGCGACCTAACTGCCA
ACAAAGTTGTGTCATCTGAAACAGCT

> SEQ ID NO:1474 113718 193939_300777_1b
GGCGGATCGGTGGGTTGCGGGCTTGCACGTAGTCGAGGCTCGAGAGGAGGGGGGATGGCGGCGGCGGCGGCGGC
GGCGGGGTACAGGGCGGAGGAGGAGTACGACTATCTGTTCAAGGTGGTGCTGATCGGGGACAGCGGCGTGGGGAA
GTCGAACCTGCTGTCGCGGTTCGCGCGGGACGAGTTCAGCCTGGAGACCAGGTCCACCATCGGCGTCGAGTTCGC
CACCAAGACCGTCCGCGTCGACGACAGGCTCGTCAAGGCCCAGATCTGGGACACCGCCGGCCAAGAGAGGTACCG
CGCCATCACGAGCGCCTACTACCGCGGCGCGGTGGGCGCGCTGGTGGTGTACGACGTGACGCGCCGCATCACGTT
CGAGAACGCGGAGCGGTGGCTCAAGGAGCTCCGCGACCACACGGACGCCAACATCGTCGTCATGCTCGTGGGCAA
CAAGGCCGACCTGCCGCACCTCCGCGCCGTCCCCGCGGAGGACGCCAGGGCGTTCGCCGAGGCGCACGGGACCTT
CTCCATGGAGACGTCGCGCGCTGGAGGCCACCAACGTGGAGGGCGCCTTCACCGAGGTGCTCGCGCAGATCTACCG
CGTCGTCAGCCGGAACGCGCTCGACATCGGCGACGACCCCGCCGCGCCGCCCCGGGGGCGGACCATCGACGTCAG
CGCCAAGGATGACGCCGTCACCCCCGTGAACAGCTCAGGGTGCTGCTCGTCTTGACTTTGACTCGCTCAAACTCA
TCGTCGTCGAGCTATGCAAATTGCCACCGTTCACAGCTTTG

> SEQ ID NO:1475 113718 190764_300779_1b
CCCCCGAGCAACTCATCTCATCTTCAGAGAAGCAAAGCCAACAAAAAGAAAAAGAATTTTCAGGTTTTCTTCTCG
CTTTCACCGGAGAAGGAGAAAGAGAGGAAGGTGTTGATCGAATCCTCCTCCAATCGCGCGCGATTCGATCCCCGT
TGCTGGCTCGCTCGCTCCGCCGATCCCTCATCCGATCTGAATCCCCGATCTGATGGCGGCCAACCCCGGCAACAA
GATCCGCAACGCCAAGCTGGTTCTTCTTGGAGATGTGGGCACGGGCAAGTCGAGCCTCGTTCTCCGGTTTGTGAA
GGGCCAGTTTGTTGAGTTCCAGGAGTCCACCATCGGCGCGGCCTTCTTCTCGCAGACCTTGGCGGTTAACGACGA
GACGGTGAAGTTCGAAATCTGGGATACTGCAGGGCAGGAGAGGTATCATAGCTTGGCTCCGATGTACTATCGTGG
TGCGGCTGCCGCAATAGTTGTCTACGACATCACAAATGCGGCCTCTTTCACACGTGCAAAAAAATGGGTTCAAGA
ACTTCAAGCGCAAGGAAACCCAAACACGATAATGGCTCTTGCTGGTAACAAGGCTGATATGGTACAGGCGAGGCA
GGTGC

> SEQ ID NO:1476 113718 187968_300682_1b
AAGAATTTTCAGGTTTTCTTCTCGCTTTCACCGGAGAAGGAGAAGGAGAGGAAGGTGTTGATCGAATCCTCCTCC
AATCGCGCGCGATTCGATCCCCGTTGCTGGCTCGCTCGCTCCGCCGATCCCTCATCCGATCTGAATCCCCGATCT
GATGGCGGCCAACCCCGGCAACAAGATCCGCAACGCCAAGCTGGTTCTTCTTGGAGATGTGGGCACGGGCAAGTC
GAGCCTCGTTCTCCGGTTTGTGAAGGGCCAGTTTGTTGAATTCCAGGAGTCCACCATCGGCGCGGCCTTCTTCTC
GCAGACCTTGGCGGTTAACGACGAGACGGTGAAGTTCGAAATCTGGGATACTGCAGGGCAGGAGAGGTATCATAG
CTTGGCTCCGATGTACTATCGTGGTGCGGCTGCCGCAATAGTTGTCTACGACATCACAAATGCGGCCTCTTTCAC
ACGTGCAAAAAAATGGGTTCAAGAACTTCAAGCGCAAGGAAACCCAAACACGATAATGGCTCTTGCTGGTAACAA
GGCTGATATGGT

> SEQ ID NO:1477 113718 155872_301360_1b

Figure 2 continued

TCTTTTATTTACAGAAAAACAGCATAAGTGTTCTCCTCTCACGGCCTCAAAAACTCCGAACAGTCGAAAGAAACA
CACAAAGACAAAATCCTCCGGGGAAAAAGAATATGAGCAACGAATATGATTACTTGTTCAAACTATTGCTAATCG
GAGATTCTTCTGTTGGCAAATCTTGTCTTCTTCTCAGATTCGCTGATGATTCGTACGTTGAAAGTTACATAAGCA
CAATTGGGGTTGATTTCAAAATTAGGACCGTGGAGCTGGATGGAAAGACAATCAAGCTGCAAATTTGGGATACTG
CTGGGCAGGAACGGTTCCGGACTATAACAAGCAGTTACTATCGTGGAGCACATGGGATTATTATTGTTTATGATG
TAACTGAAAAGGAGAGCTTCGACAATGTCAAGCAATGGCTGAGTGAAATTGATAGATATGCAAATGAAAGTGTTT
GCAAGCTTCTGGTTGGAAACAAATGTGATTTGGTAGAAAATAAGGTTGTGGACACACAGACAGCAAAGGCATTTG
CAGATGAGTTAGGTATCCCTTTCATTGAGACAAGTGCAAAAGATTCCATTAATGTGGAGCAGGCTTTCTTGACGA
TGGCTGGAGAGATTAAGAAAAAAATGGGTAGCCAACCTGCTGGAGCAAAGAACTCAGGTGGCG

> SEQ ID NO:1478 113718 139292_300408_1b
CGAGTTGGGGAGAGGAGAGAAACCGAGATCGATCCGCACCCACCGCGACAAACGCTCTCCCCTCCCCTCCCCCTC
CGCCCTTCGCTCCCATCCGCTCCGCCCCCTCGCCGCGCAGCGCCGGCGGCGAGAAGGTTGAGTTCGTGGGGGGTG
TGACCGAACGATGGCGTACCGGGCGGACGACGACTACGACTACCTCTTCAAGGTGGTGCTCATCGGGGACTCCGG
GGTCGGGAAGTCGAACCTGCTGTCCCGCTTCACGCGCAACGAGTTCAGCCTCGAGTCCAAGTCCACCATCGGCGT
CGAGTTCGCCACCCGCAGCATGCACGTCGACGACAAGGTCGTCAAGGCCCATATCTGGGACACCGCCGGGCAAGA
AAGATATCGAGCTATTACAAGCGCATACT

> SEQ ID NO:1479 113718 130110_300485_1b
GAATTCTAAATCAATTGATTTACCGAAGAACGTGAGAATAATTTTAATTTAATCGATTCATCAATATTTTCTAAG
TTGTAATATCTTCAATGGCTACAATTGGGAACAACAATCTTAATGCGAAACTTGTTTTGCTTGGTGATATGGGAG
CAGGTAAATCAAGTCTTGTTTTGCGATTCTTCAAAGGTCAATTTCTCGAGTTTCAGGAATCAACAATTGGAGCAG
CGTTTTTCTCACAGACGTTGGCCGTGAATGATGCGACTGTTAAATTTGAGATTTGGGATACCGCTGGTCAGGAGA
GATATCATAACTTGGCTCCTATGTACTACACAGGAGCTGCTGCTGCAATAATTGTTTACGACATAACTAGCACGG
AGTCTTTCACGCGTGCAAAGAAGTGGGTGCAAGAACTACAGAAACAAGGTAATCCCAACATGGTTATGGCACTTG
CTGGAAATAAAGCCGACTTATAAGAAAAAGGAAAGTGACAGCTGAGGAAGCACGTGTGTATGCTGAATAGAATG
GTCTTTTCTTCATGGAGACCTCTGCAAAGACTGCTATCAACGTCAACGACATATTCTATGAAAT

> SEQ ID NO:1480 113718 126840_300467_1b
GCCATTACGGCCGGGGAAAGGAAAAGTAGGTAAACCAATGGTCAGACAGCAAGATCCCAGCAAAGACTAGCCAAG
ATCTGCGTCTCCTCTCTCTCTCTCTCTCTCTCTCTCTAACTTTCAACTGCTGATTGAGTGTACAGAAGCTT
AGTGTTCTGGTTTAAAAAAAGATGGCGAGTGGGTATGGGGATGCGAGCCAGAAGATAGATTATGTATTCAAAGTG
GTGTTAATCGGCGACTCAGCTGTAGGCAAGTCTCAGATACTGGCTCGATTTGCTCGTAATGAATTTAGCCTGGAT
TCTAAGGCCACGATTGGGGTTGAGTTCCTGACCCGAACCCAGTCATTCAACACAAGTCTGTTAAAGCTCAGATC
TGGGATACTGCTGGTCAAGAACGATATAGAGCTGTCACAAGTGCATACTACAGGGGCGCAGTTGGAGCTATGTTG
GTTTATGACATAACGAAACGGCAAACCTTTGATCACATACCCCGTTGGCTGGAAGAGTTGCGTGCACATGCCGAT
AGGAATATCGTGATCATGCTGATCGGAAACAAAACAGATCTTGAAGACCAACGAGCTGTCCCTACCGAAGATGCT
AAAGAATTCGCCCAGAAAGAAAGATTATTCTTCTTGGACACTTCTGCAATGGAAGCCACACACGTGGAGGATGCA
TTCTTGACTGTTTTGAC

> SEQ ID NO:1481 113718 125556_300632_1b
GGGAGAGAAAAGTAGTGAATCATGCCATAAGCATTCACAATACTTTTACTGGCCGCCTTCTCTCTCTGTATCAC
ATTGCACTGTTACATAGTGGCACTTTCTTTGTGAAGTCTTTTTAGAGAGAGAAAGTACGTATTTTTTTTGTATCG
GAGGAACTTTTGGAGAGAGAAAGTTGAGAAAAGGAGTCGTCGGAGAGTTAGCTGATGGCGACGACGGGGCAGAGC
AATAGCAGTTACGATCTGTCATTTAAGATATTGTTGATCGGAGATTCCGGAGTAGGCAAAAGTAGCCTGCTCGTT
AGCTTCATTTCTAATGCCGTCGACGATCTTGCCCCTACCATTGGTGTTGATTTAAGATAAAGACGCTCACTGTT
GGTGGGAAAAGACTGAAGCTTACCATTTGGGACACAGCTGGACAGGAGAGGTTCAGGACACTGACAAGCTCCTAC
TACAGAGGTGCTCAAGGGATCATTCTTGTCTATGATGTAACAAGAAGAGAGTCCTTCACAAACTTGTCTGATGTT
TGGGCAAAAGAGGTGGAGTTGTACAGTAATAATCAGGATTGTGTGAAGATGCTGGTTGGAAATAAAGTTGACAAA
GAATCTGAGAGAGCTGTGAC

> SEQ ID NO:1482 113718 1171156_302052_1b
TCTCTCTCTCTCTCTTCTCTTTCGCAAATCTGAGCTGGTCATCCATGGCCACCCGCAAGCGTACCCTCCTCAAAG
TCATCATCCTCGGAGATAGCGGGGTTGGAAAGACATCTCTCATGAATCAATATGTAAACAAAAGTTTAGCAATC
AGTACAAGGCTACAATTGGTGCTGATTTCTCACTAAAGAGGTTCAAGTTGAATATAGACTTGTCACCATGCAGA
TTTGGGATACTGCTGGTCAAGAGCGCTTTCAAAGCCTTGGAGTTGCTTTCTACCGTGGTGCAGACTGCTGTGTTC
TAGTTTATGATGTGAATGTCACTAAGAGTTTTGACAATCTAGACAATTGGCGAAATGAGTTTCTTATCCAGGCCA
ACCCTTCTGATCCAGAGAACTTTCCGTTTGTGCTGCTTGGCAATAAAGTTGATATCGACGGTGGTAATAGCAGGG
TGGTGTCGGAAAAGAAAGCAAAAGCATGGTGTGCAAATAAAGGCAACATTCCATACTTTGAAACTTCTGCCAAGG

Figure 2 continued

AAGACATAAATGTTGACGCAGCATTCCAATGTATTGCTAAAAATGCATTGAAGAATGAGACAGAAGAGGA

> SEQ ID NO:1483 113718 1111080_301537_1b
TCTTTTTTTAGCGCGGGTTTGGACGGGATCTCTCTCCTCTTTCGGCAGAAGAAGAAGAAGAAGAGGAGGAGCCAT
CTCGCTTCCGGGGATCCAAGATCAACCTTTCTTCTTCCAAAATGAATCCTGAATATGATTATCTTTTCAAGCTTC
TATTGATCGGGGATTCTGGTGTTGGCAAGTCTTCGCTTCTTCTGCGATTTGCTGATGACACCTATGTAGAGAGCT
ACATAAGCACTATTGGGGTTGACTTTAAAATTCGAACTGTGGAACTTGATGGAAGACAATCAAGCTTCAAATTT
GGGATACTGCTGGACAAGAGAGGTTCAGAACAATCACAAGTAGCTATTACCGCGGAGCACATGGGATCATTATTG
TCTATGATGTGACTGATGAGGAGAGCTTCAACAATGTGAAACAATGGTTGAATGAAATTGAGAGATATGCAGGCG
ACAATGTGAATAAACTTCTTGTGGGTAATAAATGTGACCTCACAGAAAAGAAGGTGGTTGAATACCAGACTGTGA
AGTCATTTGCTGATGCAATGGGAATCCCTTTCCTGGAGACAAGTGCCAAGAGTGCAACTAATGTGGAGCAGGCTT
TTATGACAATGACTGCCGAAATTAAGAACAGGATGGTATCTCAGCCAGCCATG

> SEQ ID NO:1484 113718 1108745_301520_1b
TATTTGAAAGTAGAGAGAGACAGAGAGATTCCGATGGCAGGTGCACCCGGCTCTGCCAGTCTCCAAGCCAAATTG
GTGCTTCTCGGGGATATGGGAGCAGGAAAATCCAGCTTGGTTTTGCGGTTTGTGAAAGATCAGTTTCACGAGTAT
CAGGAGTCAACAATTGGTGCGGCTTTCTTTTCACAAACCATTGTTGTGAACAACACAACAGTGAAATTTGAAATT
TGGGACACAGCAGGTCAAGAAAGGTATCACAGTTTGGCTCCTATGTACTACCGTGGGGCTGCTGCAGCTATCATA
GTATTTGACATTACAAATCCTGATTCATTTAATCGAGCAAAAAAGTGGGTACAAGAGCTTCAGGGACAAGGAAAT
CTGAATTTGGTCATGGCACTTGCAGGAAACAAATCTGATTTAGCATCCAAAAGAAAAATTGAAGCAGAGGAAGCT
CAATCCTACGCTGATGAAAATGGATTGTTTTTAATGGAAACATCAGCGAAGACTGCACAGAATGTTAGTGAAATT
TTTCAAGAGATCGCAAAGAGACTACCTAGAGCTCAATCTGCTCAAAATCCTGCCGGGGTTTCACTTACTGATAGG
CCTGTGGACAGAGCATCAAGTCTCTCCTCATGTTGCTCTT

> SEQ ID NO:1485 113718 107130_300263_1b
CTTTTTTTCTCTTCCTCAATTTTCTCTCTTCTCTCTCTTTCCGCCGATTCCAGATCTCATTTTCGAGAGAGTGAA
GAAGAAGAAGAGAACCAGAATTGAATAAAATGGCGGCAGTATCGCCATTAGCAAAATACAAGTTGGTTTTTTTGG
GAGATCAATCTGTTGGAAAAACTAGCATCATTACTCGCTTCATGTACGATAAATTCGACACCACCTACCAGGCTA
CAATTGGTATCGATTTTTTGTCGAAGACAATGTACCTTGAAGATCGAACAGTTCGCTTGCAGCTCTGGGATACTG
CTGGTCAGGAGAGATTTAGGAGTCTTATTCCGAGCTACATCAGAGATTCTTCTGTTGCTGTAATTGTCTATGATG
TTGCCAACCGCCAATCATTTCTAAACACTTCAAAGTGGATTGAGGAAGTACGTACTGAACGGGGCAGTGATGTCA
TAATCGTTCTTGTTGGGAACAAAACTGATCTTGTTGATAAAAGGCAAGTATCCATCGAAGAAGGCGAAACCAAGG
CTCGTGAATTTAACGTAATGTTCATAGAAACCAGTGCTAAAGCTGGATTCAATATCAAGCCTCTGTTCCGAAAGA
TTGCTGCTGCTTTACCGGGAATGGAAGCCCTTTCGT

> SEQ ID NO:1486 116525 1100211_301458_1b
ACCCTAGTTCGAGGTCTCTCAGAGCAGTGTGCTCGCGTGTGCCCACCACGAGCCTGTAGCGATTCCCTCAGCAGC
AGCAGCGATGGCCATGTCTGCGCACGCCTCCCAGGCGGCAGTCATTGCAGCAACCGCCAAAGCAGTGCCATCAGC
ATCAGCTTACCCCGCCTCTACTGCCACGGTATCCCTTCGCCAATCCTCGATGCGCGGCATGAAGCTTGTTACCCC
TTCTCTCTTGTCGTTGTCTTCTTCCTCTCCTCGCATCCGCATGGCAGCAGCTGATGCTCCTGCTGCGCCAGCAGA
GGAGGCACCTGCTGGGTTCACCCCCCCCGAGCTCAAAGCCGACACCCCATCCCCCATCTTCGGCGGTAGCACTGG
GGGCCTCCTCCGCAAGGCGCAGGTGGAGGAGTTCTACGTCATCACCTGGGAATCCCCAAAGGAGCAGATCTTCGA
GATGCCCACGGGGGCGCTGCCATCATGCGGCAGGGCCCGAACCTCCTGAAGCTGGCTCGCAAGGAGCAGTGTCT
CGCACTGGGATCCAGGCTGCCGTCCAAGTTCAAGATCCAGTATCAGTTCTACCGTGTGTTCCCGAATGGGGAGGT
TCAATACCTGCACCCAAAGGATGGCGTGTACCCGGAGAAGGTGAATGCTGGCAGGAAGGGCGTCGGGGTGAACTT
ACGGTCGATCGGCAAGAACAAGAATCCGGT

> SEQ ID NO:1487 116525 50666_300172_1b
AACAGAGAAAAAAAAAAACAATGGCAACTCAAGCCGCCGGGATCTTCAACTCCGCCATAACAACCGCCGCAACCT
CCGGCGTCAAGAAACTCCACTTTTTCTCAACAACCCACCGTCCCAAATCCCTCTCCTTCACCAAAACCGCAATCC
GCGCCGAGAAAACAGATTCCTCCGCCGCCGCTGCTGCAGCCCCGCCACGAAAGAAGCTCCCGTGGGATTCACGC
CACCGCAGCTAGACCCAAACACACCGTCTCCGATCTTCGCTGGAAGCACCGGTGGTCTTCTACGTAAAGCGCAAG
TGGAAGAGTTCTACGTTATCACGTGGAACTCACCGAAAGAACAGATCTTTGAGATGCCGACAGGAGGAGCAGCGA
TCATGAGAGAAGGTCCGAATCTTCTGAAGCTAGCGAGGAAAGAGCAGTGTTTAGCTTTGGGGACAAGGCTTAGAT
CCAAGTACAAGATCACTTACCAGTTTTACAGAGTGTTTCCTAACGGTGAGGTTCAATATCTTCATCCTAAAGATG
GTGTTTATCCAGAGAAGGCGAATCCAGGAAGAGAAGGTGTTGGTCTCAACATGAGATCTATTGGGAAAAATGTTA
GTCCCATTGAAGTTAAGTTTACTGGCAAACAAAGTTATGATTTGTAAGATCTGTAAACTAAAAAAACCAAAAACT
ATGT

Figure 2 continued

> SEQ ID NO:1488 116525 245554_301569_1b
GGTTGTTTCTCAGGCCCAGCATTTGATACATCAAAGATGCAGGCCTTGGCAATGCAAGCGTCTCCAATGAGCCTG
CGCTCCACGAGCAGCGCCGGCAGCAGCACCAGCAGCTTCTTCCAAGGTCAGTCCAAGATCTCCATGGCGGCGGCT
CCTGCGCGAGTGAGCATGATGGCGACGGCAGATAAGGCAGATAAGGCAGATAAGGCAGCTAAGGCAGATAAGGCA
GATAAGGCAGCTAAGGCAGATAAGGCAGATAAAGCAGCACCTGCACCCGCGGGATTTACCCCACCAGAGCTCAAG
GCCGATACCCCGTCCCCAATCTTTGGTGGCAGCACGGGCGGACTGCTGCGCAAGGCACAGATCGAGGAGTTCTAC
GTCATCACCTGGGAATCACCCAAGGAGCAGATATTTGAGATGCCAACCGGAGGTGCTGCAATCATGCGCTCCGGC
CCGAACTTGCTCAAGCTGGCTCGTAAGGAGCAGTGCATGGCGCTGGGCACGCAGCTGCGCTCCAAGCTCAAGATC
AACTACCAGTTCTATAGGGTGTTCCCCAACGGTGAGGTGCAATACTTGCATCCCAAGGACGGAGTCTACCCCGAG
AAGGTTAACCCCGGGCGGAAGGGCGTGGGTGTCACTCTCAGGTCCATTGGCAAGAATTGCAACCCCGTCGATCTC
AAGTTCACAGGCAAGGCTGCATATGATGTGTAACGCTTTTGCGCCTTTGGTGA

> SEQ ID NO:1489 116525 226822_301005_1b
ACTCGAATCGAATCCACCACACGGTACCCTCCTCTCTCCTCCTCCGACCACCATGGCCATGGCCACGCAAGCCTC
CGCCGCCAAGTGCCACCTCCTCGCCGCGGCGGCGACGGAGGAGAAGAAGCCAGCCCCCGCGGGGTTCGTGCCGCC
GCAGCTGGACCCCAACACGCCGTCCCCGATCTTCGGCGGGAGCACGGGGGGACTCCTCCGGAAGGCGCAGGTGGA
GGAGTTCTACGTCATCACATGGACGTCGCCCAAGGAGCAGGTGTTCGAGATGCCCACGGGCGGCGCCGCCATCAT
GCGCGAGGGCCCCAACCTGCTGAAGCTGGCCAGGAAGGAGCAGTGCCTGGCCCTGGGCACCAGGCTCCGCTCCAA
GTACAAGATCAACTACCAGTTCTACCGCGTCTTCCCCAATGGCGAGGTGCAGTACCTCCACCCCAAGGACGGCGT
CTACCCGGAGAAGGTCAACGCCGGCAGGCAGGGCGTCGGCCAGAACTTCCGCAGCATCGGCAAGAACGTCAGCCC
CATCGAGGTCAAGTTCACCGGCAAGAACGTCTTCGACATCTAGACTTCTTCTTCTTCTTCTTCTCTCATAAT
CGACCTATTAATTACTTGTGTTTTGGGTGGATGGACATGTAATTTTAATCATCTGTCAGGCTGCTCTCCAA

> SEQ ID NO:1490 116525 191511_300702_1b
CCCCCCGATCTCTCTCCTCCACACCACACCACTCGAATCGAATCCACCACACGGTACCCTCCTCTCTCCTCCTCC
GACCACCATGGCCATGGCCACGCAAGCCTCCGCCGCCAAGTGCCACCTCCTCGCCGCCTGGGCACCGGCGAAGCC
GCGCTCATCCACCCTCTCCATGCCCACCTCGAGGGCACCCACCTCCCTCAGAGCGGCGGCGGAGGATCAGCCCGC
CGCGGCGGCGACGGAGGAGAAGAAGCCAGCCCCCGCGGGGTTCGTGCCGCCGCAGCTGGACCCCAACACGCCGTC
CCCGATCTTCGGCGGGAGCACGGGGGGACTCCTCCGGAAGGCGCAGGTGGAGGAGTTCTACGTCATCACATGGAC
GTCGCCCAAGGAGCAGGTGTTCGAGATGCCCACGGGCGGCGCCGCCATCATGCGCGAGGGCCCCAACCTGCTGAA
GCTGGCCAGGAAGGAGCAGTGCCTGGCCCTGGGCACCAGGCTCCGCTCCAAGTACAAGATCAACTACCAGTTCTA
CCGCGTCTTCCCCAATGGCGAGGTGCAGTACCTCCACCCCAAGGACGGCGTCTACCCGGAGAAGGTCAACGCCGG
CAGGCAGGGCGTCGGCCAGAACTTCCGCAGCATCGGCAAGAACGTCAGCCCCATCGAGGTCAAGTTCACCGGCAA
GAACGTCTTCGACATCTAGACTTCTTCTTCTTCTTCTTCTCTCATAATCGACCTATTAATTACTTGTGTTTT
GGGTGGATGGACATGTAATTTTAATCATCTGTCAGGCTGCTCTTCAGTTATTGATGATGGTGTAATCGATCGATG
GTGGGATATAATCTCTTCTTATAATATTGTAGTATATGTTTGGTGAATTTTGATGCGTGTTC

> SEQ ID NO:1491 116525 16253_300230_1b
CCCACGCGTCCGATCCATTTACTCCACAGAGAAAGATTCAGAGAAAACAGAAGAAACTATGGCAACTCAAGCCGC
CGGAATCTTCAGCCCCGCCATAACAACCACTACTTCCGCCGTCAAGAAACTCCACCTCTTCTCATCAAGCCACCG
TCCCAAGTCTCTCTCCTTCACCAAAACCGCCATCCGCGCCGAGAAAACAGAGTCCTCCTCTGCTGCCCCAGCCGT
GAAAGAAGCTCCAGTTGGATTCACTCCCCCGCAGCTAGACCCAAACACACCATCACCAATCTTCGCCGGAAGCAC
AGGAGGTCTCCTCCGTAAAGCACAAGTAGAGGAATTTTACGTGATCACATGGAACTCACCGAAAGAACAAATCTT
TGAGATGCCAACAGGAGGAGCTGCGATAATGAGAGAAGGACCGAATCTA

> SEQ ID NO:1492 116525 129891_300482_1b
TTTTTTTTTTTGGGGGGAAATTATACAGTAATCCACATGTTTAATGGTACCTTTGGAACAGGAAAATACAAATTA
AGTTCAAACAATAATTTCATTACATAACCACACAACCTACTGCAGCTCGAGGAAATCAACTACCCCTTGAATATT
CCATGGCTATGGCAACTCAAGCAGCTCTTTTTACCCCAACTCTTTCCACCTCAAAATCAAGCAATTTAGCATGGA
AACAATCCTCAACTGTGTCATTCGCCAGCCCTAAACCATTCAACTTTGCTGCACCACAACGTTCCATTAAGGCCT
CAGCTGCTGAAGGAAAGACAGAAGCTCCAGCGAAAGAAGCCCCAGCAGGTTTCACCCCACCAGAATTGGACCCAA
ACACACCATCTCCAATATTCGGAGGTAGTACTGGTGGATTGTTGCGTAAAGCTCAAGTAGAGGAGTTTTACGTGA
TCACTTGGGATTCTCCTAAAGAACAAGTATTTGAAATGCCAACTGGAGGTGCAGCTATCATGAGACAAGGACCTA
ACTTGCTTAAGTTGGCAAGGAAAGAACAGTGTTTAGCTCTTGGAACCAGATTGAGATCCAAGTACAAGATCAAGT
ACCAGTTTTACAGGGTTTTCCCAAATGGTGAAGTTCAATATCTTCATCCTAAAGATGGTGTGTACCCAGAGAAGG
TGAACCCAGGACGTCAAGGAGTCGGACAAAACTTCAGGTCTATCGGAAAGAATGTCAGCCCTATTGAAGTTAAGT
TCACTGGAAAACAAGCATATGATTT

> SEQ ID NO:1493 116525 126718_300466_1b

Figure 2 continued

ATTCTGCACAAATACATCTCCATTTCCTCCACTTTTGTAAGCCAATAATTCTACAATGGCCATGGCAACTCAAGC
TTCTCTCTTCACTCCAGCTCTCTCTGCCTCAAAATCTTCAGCCCCATGGAAACAATCCCTTGCTTCCTTCTCTCC
TAAGCAACTCAAATCCACTGCTTCCACTCCCCGTCCCATTAGAGCCATGGCCGAAGAAGCCGCCGCCGCCGCCAC
AACAAAAGCAGAGGCTCCAGTGGGCTTTACCCCACCACAATTGGACCCAAACACACCTTCCCCAATCTTCGGTGG
CAGCACCGGCGGGCTTCTCCGCAAGGCCCAAGTTGAGGAGTTTTACGTAATTACTTGGGAATCACCTAAAGAACA
GATCTTTGAGATGCCAACTGGTGGTGCAGCTATTATGAGGGAAGGTGCTAATTTGCTGAAATTGGCGAGGAAAGA
GCAGTGTTTAGCACTTGGTACTAGGCTTAGGTCAAAGTACAAGATTAACTACAGGTTTTACAGGGTGTTTCCTAA
TGGTGAGGTTCAATACCTGCACCCTAAGGATGGTGTGTACCCAGAAAAGGTGAACGCTGGCCGTGAAGGAGTTGG
ACAGAACTTCAGATCCATTGGTAGGAACAAGAGCCCAATTGAGGTCAAGTTCACTGGCAAACAAGTGTATGATTT
GTAAGCTGATTATGGTATTTTGTGCCTTTTCGTGTAATGTGATGAATTTGTGATTATTTAGTGCATCATTTCATG
TAATTTTATTTGCCACTACAAAATACAGCATGGGATTCTATTATTCCTCCCGTATTATC

> SEQ ID NO:1494 116525 1119024_301893_1b
AACTATTATTACTACTACTCTTCATCTCTACTGATTGATAGAGGAACCTCAGCTATGGCCATCCAGGCATCCTCC
CAGTCAGTCATGGCAAGAGCAGTAGCCCCGTCCATGGCCTCCACCCTCCCCCTCTCGCCCCCTCTGTGCGCTTG
TCGGCGTGGAGTAGCTCCGCCGTCCATGGCATCCAGCTCCGCCTCCCCGCCTGCTTGCCGTGTCCGCATGGCT
TCTGAAATCCCTGCCCCGGCACCCAAAGAAGAGGAGAAAGATGAGGCGCCCAAAGGTTTCACCCCGCCTACTCTC
AACCCGGAGACGCCCTCGCCAATCTTCGGGGTAGCACAGGTGGCCTCCTCCGTAAGGCCCAAGTCGAGGAATTC
TACGTGATCACGTGGGAGTCCCCGAAAGAGCAGATATTTGAGATGCCCACCGGCGGCGCCGCCATCATGAGGGAG
GGACCTAACCTCCTCAAGCTCGCGCGCAAGGAGCAATGCCTTGCACTTGGCTCCCGCCTCCGATCCAAGTTCAAA
ATCACCTACCAATTCTACCGCGTCTTCCCGAATGGGGAAGTGCAATACCTCCACCCCAAGGATGGTGTCTACCCC
GAAAAGGTCAACGCTGGAC

> SEQ ID NO:1495 116525 116523_300078_1b
CGGAATCGAATCCACCACACGGTACCCTCCTCTCTCCTCCTCCGACCACCATGGCCATGGCCACGCAAGCCTCCG
CCGCCAAGTGCCACCTCCTCGCCGCCTGGGCACCGGCGAAGCCGCGCTCATCCACCCTCTCCATGCCCACCTCGA
GGGCACCCACCTCCCTCAGAGCGGCGGCGGAGGATCAGCCCGCCGCGGCGGCGACGGAGGAGAAGAAGCCAGCCC
CCGCGGGGTTCGTGCCGCCGCAGCTGGACCCCAACACGCCGTCCCCGATCTTCGGCGGGAGCACGGGGGGACTCC
TCCGGAAGGCGCAGGTGGAGGAGTTCTACGTCATCACATGGACGTCGCCCAAGGAGCAGGTGTTCGAGATGCCCA
CGGGCGGCGCCGCCATCATGCGCGAGGGCCCCAACCTGCTGAAGCTGGCCAGGAAGGAGCAGTGCCTGGCCCTGG
GCACCAGGCTCCGCTCCAAGTACAAGATCAACTACCAGTTCTACCGCGTCTTCCCCAATGGCGAGGTGCAGTACC
TCCACCCCAAGGACGGCGTCTACCCGGAGAAGGTCAACGCCGGCAGGCAGGGCGTCGGCCAGAACTTCCGCAGCA
TCGGCAAGAACGTCAGCCCCATCGAGGTCAAGTTCACCGGCAAGAACGTCTTCGACATCTAGACTTCTTCTTCTT
CTTCTTCTCTCATAATCGACCTATTAATTACTTGTGTTTTGGGTGGATGGACATGTAATTTTAATCATCT

> SEQ ID NO:1496 120380 11134_300288_1b
CTCGAGCTTGCGGCCGCATCCTTCTCTTCATTCATTTTCTTGCTCAACTTGAGTTGCTTCCAACATCTTGCAAGA
TTGTCTTTGAGTTCATTCAGGTCTTGAAGAAGAGCACTCTTTTAAGCTGTGTGAAACTTGCGCCGTTCCTGTGAA
GAACTACTTTTGGCATTGCAGATTTCAGAGAGCTGTGATTTGTGCTATCTTAAAAACGGACAAGTTCTATGTTGT
GGCGGATGAGATGAGGGATGCTATCTGGGTTGATGAATTTTCTGAATGCCTGTCTCTGGCCACGGTCAGATCAGC
AGGCTCGTTCTGCCTCAGATTCTGGTGGCCGCCAAGAGGGTTTGCTCTGGTTCAGAGACTCCGGCCAGCACGTCT
TTGGTGACTTCTCCATGGCCGTCGTTCAAGCCAACAGCTTGCTAGAGGACCAGAGCCAGCTCGAGTCTGGCTCTC
TTAGCTCCCACGACTCTGGTCCCTTTGGCACCTT

> SEQ ID NO:1497 120380 43454_300031_1b
GTTCATCAATGAACACCTCTTTCAAAATCTCAAGAGGTTGACATCTGAGCACCAATCTATGTCTGTTGAGGTGAT
TAAGAAAGCATTTCAAGCAACAGAAGACGGTTTCCTCTCGGTTGTGACTAGGCAATGGCCCACAAAACCACAGAT
TGCTGCAGTTGGATCATGCTGTCTTGTTGGAGTTATCTGCAGTGGAACCTTATATATCGCCAACCTTGGCGACTC
AAGGGCAGTCTTAGGGAGACTTGTCAAGTCTACTGGAGAGGTTCTCTCGATTCAGCTCTCTGCAGAACACAATGT
TAGCATTGAATCTGTAAGACAAGAGTTGCAAACTTTGCATCCAAATGACTCACAAATTGTAGTTTTAAAGCACAA
TGTCTGGCGCGTGAAGGGGCTTATACAGATTTCAAGATCCATTGGCGATGTATATTTAAAAAAAGCTGAATTCAA
CAAGGAGCCATTATATGCAAAGTTTCGTCTTCGAGAACCGTTTGTCAAGCCCATATTGAGCTCTGATCCAACAAT
TTCAGTGCACCATCTGCAACCTGATGACCAGTTTATCATATTTGCATCAGATGGTCTCTGGGAGCATCTAACTAA
CCAAGGAGCAGTAGACATTGTACAAAATCACCCA

> SEQ ID NO:1498 120380 209253_300813_1b
CACAGATTGAGAGCAAGCAGCGTGGCGAGGCCCAAATCGCGCGATTCGATCGAGGCAACCCTCCCCAATTCCCTC
AAATCCCCTATCCGAAATCCGCCAATTGGCCGCGTCCGCCACGCCAAGAGAATAAAGGAAAACATCGGCGTATCA
ACAAGTGAAGCTGCATTTTCTTAGAGCTCAGATGAAGCGGCCTCGAAGGCGTCTGTGGTGGGATGACTGATGAGG

Figure 2 continued

GATGATAGTGACATTGATGAACTTGTTACGGGCATGCTGGAGACCATCATCCAACCAGCATGCCCGGGCAGGCTC
AGATGTTGCCGGCAGGCAGGATGGACTTCTATGGTACAAGGACACTGGTCAGCATGTAAATGGGGAATTCTCTAT
GGCTGTGGTCCA3GCCAACAACTTACTTGAGGATCAGTGCCAGATTGAATCGGGTCCATTGAGCTTTCTTGACTC
TGGTCCATACGGAACTTTCGTCGGGGTTTATGATGGACATGGTGGCCCAGAGACGGCTTGCTATATCAACGATCA
CCTATTCCACCATCTGAAAAGGTTTGCATCTGAACAGAATTCGATGTCTGCTGATGTGCTGAAGAAAGCATATGA
AGCTACA

> SEQ ID NO:1499 120677 1097462_301444_1b
TTGGATTTGGCGTCGCCCTATTTTAGTTTTGATCTCTTTTTGTGGATCGCCTTCTGACGGTGCCCATCCCGTCCA
TCATCAGCAGATCCGGAAAAATGATGATCAGAAGTGTGGGCCGACGGTTGGCTTTATTTTCGCGTGATGCATCGT
CCTCTTCAATCCCCGGGGGCTCGATTGCAAGGGGGATCTGCTCAGCTGGATGCTTGGAGAACAAGAATCACGTTT
TTTCTGGCCCGGATGTTGTCAATGGTCATTTTTCGCGTAGCAAAGAGTTTGGGCCATGGATTCTCCAACGAGATT
TTTCAACGGATGCGTTAACTCAAGGTTCCGATTCAGCTCTTCCCCCAACTTTAGCGGCATTGAGAAACTCATCTG
CAAGCATATCGTACGATGAGTCAGTACACCAGCGCTATCCACCAGGTGACCCTGGCAAGCGCGCCTTCACTTACT
TTGTACTGACGGGTGGGAGATTCATTTATGCGTCTGCTATACGCTTCCTAATTCTGAAGGCCGTTCTAAGCATGT
CTGCTAGCAAGGATGTTCTGGCCATGGCCTCATTGGAAGTTGATTTGTCCTCAATCGAGCTGGGCTCCACAGTCA
CTGTGAAGTGGAGGGGGAAGCCCGTGTTCATTCGGAGGCGCACCGAGAGCGACATACAGCTAGCCAATAGTGTTA
GCCTAAGCGAGTTGCGGGACCCACAAGAAGA

> SEQ ID NO:1500 120677 253365_301625_1b
TCGACTGAACAATGAGCCTGCTTCGAACCGCCGCCCAGGCCGTCAAGGCCCCCAAGGGCTACACTCCTCTTGTGG
CCGCAAAGGCCTTTGCTCAGACCCGATCTGTCTCTTCACAGCCCATTGGTGGCAAGTCCACATACAAGATCCCCG
ACTTCACTCCTTACCTCAAGAAGGACCGAAACACAGATGCCAACCGTCTCTTCTCCTACTTCATGATTGGATCGT
TTGGCATGCTCTCCGCTGCCGGCGCCAAGGCCACCGTCCAGGACTTCCTTTCCAACATGTCTGCTTCCGCTGACG
TTCTGGCCATGGCCAAGGTCGAGGTCAAGCTCGGTGCCCATTCCCCTCGGTAAGAACGTCATCATCAAGTGGCGAG
GAAAGCCCATTTTCATCCGACACCGAACCTCCGAAGAGATTGAAGAGGCCAACGAGGTCAACGTTGCTACCCTGC
GAGACCCCCAGACTGACGACGAGCGAGTGCAGAAGCCCGAGTGGCTGGTCATGATCGGAGTCTGCACCCATCTGG
GTTGTGTG

> SEQ ID NO:1501 120677 238171_301292_1b
AGGGCATTGGGTTTCTTGAGGGCTGCTCGGGCGCCATGGCTGCGTCACTGATCCGGGATCTAGGGAAGAAGATAG
CTCCGCGCATCGCGGCGGCAGCGTCGGCGTCTTCTTTCCACACTTGCTCGTCCGGCGCCTCCAGGGGCGCGGCGT
TGGGCGCTAGCAACGTAATGGCGCATTGGGACTGGGACAGGGAAGACGGCAAAACCACCCCATGGAGCCACTCCA
CTACACGAGGATGCGCCGTCACCACCCGGGCGCCGATCTAAGCACACGAAACGAAGACTCGGCTTTCCTCCAGG
CTCTCCGCAACCCCACGGCCAACATCACCTACGACGAGGAGGTGGTGGAGCGGTTCCCGCCGGGAGACCCGGACC
GAGCAGCATTCGTCTACTTCATCGTCACGGGCTCCCGCTTCGCATACGCCGCCGCCATCCGCGTCTTCATCCTCC
GCATGATCATGACCATGTCCGCCAGCGCCGACGTCATGGCCCTCTCCAGCCTCGAGGTTGACCTCAGCAACGTCG
TCGAGGGGGCGACCATCACCGTCAAGTGGCGAGGCAAGCCGGTGTTCATCCGCCGCCGGACCTCAGACGAGGTGG
CGGAGGCAAACAGCGTTTCGGTGAATTCCCTGCGCGATCCACAGCCGG

> SEQ ID NO:1502 120677 226964_301006_1b
CAAGGAACCAAGATACTGGCTTGGCTGAACTACCTGCAACCGTTGCTGCACTGAAGAATCCCAACCCAAAGGTGG
TGTACGATGAGTACAACCATGAGAGGCATGCACCTGGGGATCCCAGCAAGCGTGCATTTGCTTACTTTGTTCTAA
GTGGTGGGAGATTCATCTATGCATCGTTGCTGCGGCTCCTCGTATTGAAATTCGTGCTGAGCATGTCTGCAAGTA
AGGACGTGCTTGCGCTTGCTTCCCTGGAGGTGGATCTCTCAAGCATTGAGCCTGGTACCACAGTGACGGTGAAGT
GGCGTGGGAAGCCAGTTTTCATCAGAAGGAGGACAGAGGACGACATAGCGCTGGCCAATAGCGTGGACGTTGGGT
CCCTGCGCCATCCCCAGCAGGACGCAGAGCGTGTGAAGAACCCAGAGTGGCTAGTGGTCATTGGCGTCTGCACCC
ACCTTGGTTGCATTCCTCTCCCCAATGCTGGAGATTTCGGAGGTTGGTTCTGCCCGTGCCATGGCTCCCACTACG
ACATCTCTGGCAGGA

> SEQ ID NO:1503 120677 220723_300938_1b
GGCGAGGCCGGTGACTTTGGTGGCTGGTTCTGCCCCTGCCACGGCTCCCACTACGACATCTCTGGCCGGATACGA
AAGGGCCCCGCGCCTCTCAACCTGGAGATTCCCGAGTACGACTTCCCCGAGGATGACAAGCTTGTCATTGGTTAA
AAATCGCGAATACATGTATAAAGAATCGGGGGAGACAAAAGAGAGGGGGGAGACTGTCCTGTCACAAACGATGT
AACAGTATCAGAGGGGGGAGTCTTGGGAACTAAAATGGGTGAAAGATGAGACAGCTCCCGGACAAAAATACATA
ATTCGTCTCGGAATTACAAAAAACATAGATTCTCTCTGGGCGGTCAAGTCTATCGGCGGGATGGGAGGTTGGAAT
GAAGAAATGGAAGAATGGTGTCTCATGATGCTGGGAATGGGACACACAAACTCCTTGTTTCTTAGACGTGGGCCA
TGTGCAGCATTGTATAAATAAAAACGTTTTACTAAAAAA

Figure 2 continued

> SEQ ID NO:1504 120979 116840_300515_1b
GTAGCCCTGTGTGCAACGGCGCAAGTGCTTGTACGCTTTCAGCTAGCGTAGCCATGGCTTCCAGGGCATTCCTCC
TCCTGGCTCTAAATCTGGTCCTCTTCTTCACCGTGGCCAGCGCCTGCGGCAAGTACTGCCCGACGCCTTCGACGC
CGTCGACGACGCCATCGACGCCGTCCTACAACACCAAGTGCCCCAAGAACGCGCTCAAGTTCGCGGCGTGCGCCG
ACGTGCTGGGCCTCGTCAGCGCCGAGGTCGGCCAGCCGCCGTACGAGCCGTGCTGCGGCGTCCTCGGCGGCCTCG
CCGACCTTGAGGCCGCCGTCTGTCTCTGCACCGCCATCAAGGCCAACGTGCTCGGCATCACCCTCGACATCCCCG
TCAAGCTCAGCCTCCTCGTCAACTACTGCGGCAAGAACGTCCCTAGTGGCTTCATCTGTGCTTAAGCTACGTAAC
GCGCGTACGGTGTAACGACGTGCTAGCTTTGCATGCATGCAGCACGCATGCACGAACACATCGTTCGTTCTTGAG
TGCCTGCATGCATATCGGTCGAGTCTTTACTTACTCTGTTATTAGTTCTGAATGTAGAACTGCTTCAGATATCAA
T

> SEQ ID NO:1505 120979 137838_300705_1b
CATCTCCAGAAGATCAAGAGCTCTTAATTAGCTAGCTAGTGATTAGCTGCGCTTGTGATCGATCGATCTCGGGTA
CGTAGCAATGGCGTCCAAGGCGTCGCTCTGTTCCTGGCCGTGAACCTCGTCGTGCTCGGGGTGGCAAGCGCCTGC
GGCGGCAGCCCGTCGTGCCCGACGCCGACGCCGTCGACCCCGACATTGTCAACGCCGACGCCGACGCCGTCGGCG
TTCGGGAGGGGGTGGCCCNCNNCGCGACGCGCTGAAGCTGGGCGTGTGCGCCAACGTGCTGGGCNCTGATCAAGG
CCAAGGTGGGCGTGCCTCCGGCGGAGCCGTGCTGCCCGCTGCTGGAGGGGCTCGTCGACCTCGAGGCGGCGGTGT
GCCTCTGCACGGCCATCAGGGGCAACATCCTCGGAATCAACCTCAACCTCCCCATCGACCTCAGCCTCATCCTCA
ACTACTGCGGCAAGACCGTCCCCACCGGCTTCAAGTGCTAAGCAGCGTGCATATGCAATGCCTGCATGGGTTGAT
CCTACGTACGGTGATTAGTTGGCTTTGACGACTCTTGATTTGATTTGCTTGCTGCTCTGTTTATTTGCTACTACG
TTACGTACGTACTTTGCATGCAACGCAACGCATGA

> SEQ ID NO:1506 120979 175095_300529_1b
GCTGAAGCTGGGCGTGTGCGCCAACGTGCTCAACCTGCTCAAGCTCAAGGTGGGGGTGCCGGCGAGCGAGGAGTG
CTGCCCGCTGCTGGGGGGGCTCGTCGACCTCGACGCCGCCGTCTGCCTCTGCACCGCCATCAAGGCCAACGTCCT
CGGCATCAACATCAACGTCCCCGTCGACCTCGTCCTCCTCCTCAACTACTGCCACAAGACCTGCCCTTCCGACTT
CTCCTGCCCACTCATCTGATTCTTAATCTTCATTACCACCACAACCCTAGCTACCTAATTAAGGCTTAAGCTTTG
CATGGCTTAGTCTGTGTGTTGCAGTTGTGTCATACATATATACTTATCTCGATCTATCAGTGTGATTATTGATGA
TCAGATCTATCATCTAATATATGTATCTTGTTATTTTAATGCGTACTGTCAAATAAAAGTTTCCTCCAGTGTACG
TACGTTCTATCT

> SEQ ID NO:1507 127573 1108973_301544_1b
GTCCTTTGACTGCTTTTGTCCTTCCCATGGCCGCCTCTGGACCAGCCCGCGCTCGTGACCACGACTACCTCATCA
AGCTGCTGCTCATCGGGGATAGCGGTGTTGGCAAGAGTTGCTTGCTTCTACGATTTTCTGATGATACATTCACTA
CAAGTTTCATCACAACCATAGGAATTGATTTCAAGATAAGAACCATTGAGATGGATGGAAAGAGAATAAAGCTCC
AAATATGGGATACAGCTGGGCAAGAGCGCTTTAGGACAATTACTACAGCATACTACAGAGGCGCCATGGGTATTA
TTCTTGTGTATGATGTAACGGATGAATCATCTTTCAACAATATTCGCAATTGGATTAGGAATATAGAACAACATG
CTTCAGATAATGTCAACAAGATATTAGTGGGTAACAAAGCTGATATGGATGAGAGCAAGCGGGCTGTGCCACATG
AACGTGGTCAAGCACTTGCCAATGAATATAACTTGAAGTTCTTTGAGACAAGTGCCAAAACAAATATGAATGTTG
AAGAAGTCTTTTTTTCCATTGCAAGAGATATCAAGCAGCGGTTATCA

> SEQ ID NO:1508 127573 1112368_301802_1b
AAAGAGGAAGGAAGGAAGGAAAGGATGTCCATCGCCGCCGACCTGCCGTTCCCTGCTATGGCGACCGTCGTCTGA
TCTACCCCTTTCCTTTCCCTCCTCGCCGATATGGCGTCCCGCCCCGTGCAGACTATGACTTCCTCGTCAAGCTC
CTTCTCATCGGGGACAGCGGTGTTGGAAAAGTTGCCTTCTTCTCCGATTCTCTGATGATTCTTTCACCACAAGC
TTTATTACTACAATTGGAATTGATTTCAAGATTAGAACGGTGGAGATAGATGGGAAACGGATCAAATTGCAAATC
TGGGACACAGCTGGGCAGGAACGCTTTCGAACAATAACCACAGCATACTACAGGGGTGCCATGGGGATTATCCTT
GTGTACGATGTTACAGACGAGTCTTCATTTAACAACATTGGGAACTGGATCAGGAACATTGAGCAACATGCCTCT
GAGAATGTCAACAAAATATTGGTGGGCAACAAGGCTGATATGGATGAAAGCAAGAGGGCTGTTTCATTTGCAAAA
GGCAAAGCTCTTGCCGATGAGTTTGGTATCAAGTTTTTTGAAACGAGTGCGAAGACAAACATGAATGTGGAGGCG
TCCTTTGTCACAATTGCAAGGGATATCAAACAGCGGCTTTCGGAGTCAGACTTCAAACCACAGCCC

> SEQ ID NO:1509 127573 270855_200128_1b
TTTTCCCCTTTCAGCCCAATGTTGCCGACGACTTTCTGACCTTCTCAAAAACCTCTGTGTTTCTCTCACATTTCT
GGTGCCAATCTCTTGATATTTATTGGAGAAGACGATGGCAGCTCCACCAGCGAGGGCTCGAGCAGATTATGATTA
TCTTATCAAGCTCCTCCTCATTGGTGATAGCGGTGTGGGAAAGAGTTGTTTGCTGCTGAGGTTCTCAGATGGTTC
CTTTACAACAAGTTTCATCACCACTATTGGAATTGACTTTAAGATAAGAACAATTGAACTTGATGGCAAGCGGAT
TAAATTACAAATTTGGGATACAGCTGGTCAGGAGCGTTTCCGCACTATCACGACAGCATATTATCGAGGAGCCAT
GGGTATTCTGCTGGTGTACGATGTCACGGACGAGTCATCTTTCAATAACATCAGGAACTGGATTCGCAACATAGA

Figure 2 continued

GCAGCATGCTTCTGACAATGTCAATAAGATTTTGGTTGGGAACAAGGCTGATATGGACGAAAGCAAAAGGGCTGT
GCCAACTTCCAAGGGTCAAGCTCTTGCTGATGAATATGGCATTAAGTTCTTCGAAACAAGTGCAAAAGACAAACA
TGAATGTGGAAGAAGTTTTCTTTTCAATTGCTAGGGATATCAAAC

> SEQ ID NO:1510 127573 241818_301323_1b
AGGGAAGATCATCGTGCATCGCGCGGAGGTCTGGATCGGCAGCGCTAATGGCGGCGGGGAGAGCGCGGGCGGACT
ATGACTACCTCATCAAATTGCTGCTCATCGGCGACAGCGGTAAGAGAAAGAATTTCGATCCGGCGGGGGAAGTCT
TTGTCTAGCAGCTAGATCTCTGCTCGATCTGCACGAAATATCGATGAGCTGATGGATTTGGTCGCCGCATTTCTC
TCTGCCCGCAGGTGTGGGGAAGAGCTGCCTTTTGCTGCGCTTCTCGGACGATTCCTTCACGACGAGCTTCATCAC
GACGATAGGCATTGACTTCAAAATCAGGACCGTTGACCTGGATGGCAAGAGGATCAAGCTTCAAATTTGGGACAC
CGCTGGGCAAGAACGCTTCCGGACGATCACAACTGCATACTACCGAGGAGCTATGGGCATTCTTCTCGTCTACGA
TGTGACGGATGAATCATCGTTCAACAACATCCGGAACTGGATCAGGAATATCGAGCAGCACGCGTCGGACAATGT
GAACAAGATCCTGGTCGGCAACAAGGCCGACATGGACGAAAGCAAGAGGGCCGTATCAACAGAAAGAGGGCAAGC
TCTTGCGAACGAGTTTGGTATCAAGTTCTTCGAAACCAGCGCGAAGACGAACATGAACGTGGAGAACGTCTTCTT
CACAATCGCGGGAGACATCAAGCGGAGACTAGCGGAAACAGACTCCAGACCCGAGCCTCCCAGGATCAACAACGT
AATACTAGACCCGTCGAAGGATCAGAACAACAACAAAGACAAGTCATCATGTTGCACCTGAGAGCAAG

> SEQ ID NO:1511 127573 241125_301320_1b
TTATGTGGATCGATTCGTGAGCTACTTACTAGGCGAGAATCAAATGGCACTGTCTTCCTCCTCCGTCAGCGGCAA
CGAGTTTGATCACCTCTTCAAGATACTGCTCGTCGGGGACTCGGGTGTCGGCAAGAGCAGCCTGTTGCTGCGATT
CACCGCCGACACTTTCGACGATCTCTCCCCCACAATCGGTGTGGATTTCAAGCTCAAGCTTATGACGCTGGAAGG
CAAGAGGCTCAAGCTCACCATCTGGGACACAGCCGGGCAGGAAAGGTTTAGAACGCTTACGAGCTCGTACTACCG
AGGGGCACAAGGCGTCATTCTTGTTTACGATGTTACAAGAAGAGATACGTTCACGAATCTCTCGGAAGTTTGGCT
CAAGGAGGTCGAGCTCTACTCCACCAACCAGGACTGCGTCAAGCTCTTGGTGGGGAACAAAGTCGACAGGGATTC
CGAGCGTGCGGTGACGAAGCACGAAGGCATGGCTTTCGCCCGGAAGTATGGCTGCCTGTTCCTGGAGAGCAGTGC
CAAGACGAAGATCAACGTCCAACAATGCTTTGAAGAGCTGGTCAGGAAGATTCTGGAAACTCCCAGCTTGGTAGC
CGAGGCCAAGTCGGTGAAGAAAAACATCATCAGACCAAGCAACGATGAGGAGCCGCCTGCAGCTGGCGATAACTC
TGGTAGCTGCGCGTGTTGATAGAGAG

> SEQ ID NO:1512 130630 182215_300659_1b
GAATTCAGGGGCGAATATACCAAAAATCAAATGGAGGCACATAACAAGAAAATAAAATCGGTTGGCGGATGCATG
GGCGTTTATTCCAAGCATGATGATAAATCCAAGCATGAAGAGTATAGATATCCAAACAATTAAATCTCCATCAAT
AAACAAGGAAGAGGAAGAAACAGAAGCAATTACAATGGAAGTGGAAAGAAGTTCACGAGAACAAGGTTCGCAAGA
TTGGAGAAAAGAGATTCACGCATATTTTGCAAAGGGGGAGTTGCCAGGGAATAAATTAGAAGCTCATAAAGTTAG
AAGCCGTTCTACAAATTACGAGTTAAGGGAGGGTTTTCTATACAGGAGATCTTTCACAGGACCATATCTCAGGTG
TATAACTCGCGAAGAAGGAGAAAAGATATTAAAAATGTTGCATGGAGGGGAAGCTGGAAATCATGGTGGAGGAAG
GTCATTGGCATATAAAGCAAAAGTTCAAGGGTATTATTGGCCGTATATGCATACTGATGCAAAGGTATTAGTAAG
AAGATGCAAAGAATGTCAAAAGTTCGCAAAAAGAATTCATGCACCAGGAGCTCCTTTAACATCCTCAACAAGTGG
CTGTCCCTTTGGAAAATGGGGCT

> SEQ ID NO:1513 130744 1107230_301505_1b
ATTTCCCACTCTCACATTGGAGGGACGAGGACTTCGATCCACTGAGAGGAACTACAGCTCCGGCTGTCCCGTGA
TCGCCCACTATGGCGCGAGGTTTGAAGAAGCATTTGAAGCGGCTCAATGCCCCCGTCACTGGATGCTCGACAAA
CTTGGCGGAGCTTTCGCCCCCAAGCCATCGTCCGGCCCGCACAAGGAGAGGGAGTGCCTGCCCCTCGTCGTTCTC
CTCCGGAACCGGTTGAAATACGCCCTGACCTACCGTGAGGTCGTCGCCATCGTTATGCAGCGACTCATCTCCGTC
GACGGGAAGGTCCGGACCGACAAATGCTACCCGGCTGGATTCATGGACGTTGTCTCCATTGCCCGCACCAATGAA
AACTT

> SEQ ID NO:1514 130744 121575_300358_1b
CCCCCCCCGGTCATCTCGGCGGCGGCGCGGCGCGGAGCAGAGGAGGACGAAGCAGCAGGCGGCGGCGGCAGAGCA
CGGCGACCTAGCCCGACCTCGCAACCATGGCAAGGGGTTTGAAGAAGCATCTGAAGAGGCTCAATGCGCCCAAGC
ATTGGATGCTCGACAAGCTTGGTGGAGCTTTTGCCCCCAAGCCATCTTCTGGTCCTCACAAGTCCAGGGAGTGCC
TGCCTCTGATCCTCATTATCAGGAACAGGCTCAAGTATGCTCTGACATACCGTGAGGTTATTTCTATCCTCATGC
AGCGCCATGTCTTGGTTGATGGCAAGGTCAGGACTGACAAGACCTACCCAGCTGGTTTCATGGATGTCATTTCCA
TCCCCAAGACTGGTGAGAACTACAGGCTTCTGTACGACACCAAGGGACGTTTCCGCCTTCAGTCTGTCAAGGATG
AGGATGCTAAGTTCAAGCTTTGCAAGGTTCGGTCTGTGCAGTTTGGCCAGAAGGGAATCCCCTACCTGAACACCT
ATGATGGTCGCACCATCCGCTACCCTGACCCGATCATCAAGGCAAACGACACAATCAAGATCGATCTGGAGACCA
ACAAGATTGTCGACTTCATCAAGTTTGATGTTGGCAATGTTGTCATGGTGACTGGAGGAAGGAACACAGGCCGTG
TTGGTGTGATCAAGAACAGGGAGAAGCATAAAGGCAGCTTCGAGACCATCCACGTTGAGGATGCCCTGGGCCACC

Figure 2 continued

AATTCGCCACCCGTCTGGGCAATGTG

> SEQ ID NO:1515 130744 1119537_301898_1b
GATGGGCGGACGATCCGCTATCCTGATCCTCTCATCAAGGCCAATGACACTGTCAAGATCGACCTAGAGACAGGG
AAGGTTGTTGACTTCATCAAATTTGACCTTGGCAATCTTGTCATGGTTACAGGTGGGAGGAACAGAGGGAGGATT
GGAGTAATCAAGCATCGTGAGAAGCATAAAGGAAGTTTTGAGATTATCCACGTTCAAGATTCTGTCGGCCATGAA
TTTGCGACCAGATTGGGGAACGTGTTTACCATTGGAAAAGGGACCAAGCCTTGGGTGACACTGCCCAAAGGTAAA
GGTATTAAACTTTCCATCGTCGAGGAGGCGAGGAAGAGAACAGCCACGCTCAAAGCTGCCTCTGCTTAGAGAGGA
TCCTTTCTCATATAGCAACTGAAGTTTAGATGCGTATGGAGTTTTGCATTCTTGCTTGGATGCAGTTTGAGTTTG
CTTAGTAATTAGAGTCTAGCGGTTTTCTTTTATACTGTAGTTGTGCCTCTGAAGTTCACCTTCCGGAAACAATGA
TGGGAATTTTGCAAATTTTTTTCTTCATTCTATTCTATTTGGAAAAATTGATTACTCTGTTTTAGT

> SEQ ID NO:1516 130744 116853_300515_1b
GGGGTTTGAAGAAGCATCTGGGGAGGCTCAATGCCCCCAGCCATTGGATGCTTGACAAGCTTGGTGGAGCATTTG
CACCCAAGCCTTCTTCTGGTCCCCACAAAGCTCGGGAGTGCTTGCCTTTGATCCTTATCCTCAGGAACAGGTTGA
AGTATGCTCTGACCTACCGTGAGGTTATTTCCATCTTGATGCAGCGGCATGTTATGGTTGATGGAAAGGTCAGGA
CTGACAAGACTTATCCGGCTGGATTCATGGACGTTGTGTCAATTGCAAAGACTGGGGAGAATTTCCGCCTTCTGT
ATGACACCAAGGGTCGCTTCCGTCTCCACAGCATCAAGGATGAGGACGCTAAGTTCAAGCTCTGCAAGGTCCGGT
CTGTACAGTTTGGACAGAAGGGTATTCCTTTCCTGAACACCAATGACGGGCGCACGATCCGCTACCCAGACCCAC
TCATCAAGGCCAACGACACCATCAAGATTGACTTGGAGACCAACAAGATCATGGACTTCATCAAGTTTGATGTTG
GAAATGTCGTGATGGTGACCGGTGGGAGGAACACGGGGCGCGTCGGGG

> SEQ ID NO:1517 130744 39439_300196_1b
CCCACGCGTCCGGCTGCAAACATGGCAAGAGGATTGAAGAAGCATCTAAAGAGGCTCAATGCTCCTAAGCATTGG
ATGCTTGACAAACTTGGTGGTGCCTTCGCTCCCAAACCATCTTCTGGACCTCACAAGTCGAGGGAGTGTCTTCCT
CTTGTCCTGATCATCAGGAACAGGTTGAAGTATGCTTTGACTTACCGTGAAGTTATCTCTATCTTGATGCAAAGG
CATATCCAAGTTGATGGCAAAGTCAGGACTGACAAGACTTACCCTGCTGGTTTCATGGATGTTGTATCCATCCCC
AAGACCAATGAGAACTTCCGTCTTCTCTACGACACCAAGGGACGTTTCCGTCTCCACTCCATCAAGGATGAGGAA
GCAAAGTTCAAGCTTTGCAAGGTTAGATCTATCCAGTTTGGTCAGAAGGGAATTCCATACCTGAACACTTATGAT
GGTCGCACCATCCGTTACCCTGACCCGCTCATCAAGCCAAATGACACCATCAAGCTGGACCTTGAGGAGAACAAG
ATTGTTGAGTTCATCAAGTTTGACGTGGGTAACGTTGTGATGGTGACTGGAGGCAGAAACAGAGGGCGTGTGGGT
G

> SEQ ID NO:1518 130744 255625_301644_1b
ACGCTGCCGAAGCTGGAGCTGGAGCAGGAGGAAGAAGAAGGAGAAGGAGGAGGAGGAGCAGCAGTCCAGCTA
TGGCGCGAGGATTGAAGAAGCACTTGAAGCGGCTCAATGCCCCCCGCCACTGGATGCTCGACAAACTTGGCGGTG
CCTTCGCCCCCAAGCCCTCAGCAGGTCCCCATAAAGAGAGGGAGTGCCTGCCCCTTGTTGTTCTTCTCAGGAACA
GGTTGAAATATGCACTCACATACCGTGAGGTTGTTGCAATTGTCATGCAACGACTTGTCTCCGTTGACGGAAAGG
TCCGTACTGACAAATGTTACCCTGCTGGATTTATGGATGTCGTTTCAATTGCCCGAACCAACGAGAATTTCAGAC
TCTTGTATGACAGCAAGGGGAGGTTCACTGTCCACTCGTCTTGGTGTGGAAGAAGCCAGGTACAAGCTCTGTAAGG
TGAAAGCAGTGAGGTTTGGCGATAAAGGAATCCCCTTCCTCACTACCAACGATGGGCGGACGATCCGCTATCCTG
ATCCTCTCATCAAGGCCAATGACACTGTCAAGATCGACCTAGAGACAGGGAAGGTTGTTGACTTCATCAAATTTG
ACCTTGGCAATCTTGTCATGGTTACAGGTGGGAGGAACAGAGGGAGGA

> SEQ ID NO:1519 130744 252102_301699_1b
GACCAGACCGGCAACAACAGGCAAGATGGGCAAGGGACTCAAGAAGCACCAGAAGCGCCTCAGCGCGCCTTCGCA
CTGGCTCCTCGACAAGCTGTCGGGCACCTACGCCCCCGCCCCTCGGCCGGTCCCCACAAGCTCCGCGACTGCAT
GCCCCTGATCATCTTCATCCGCAACCGCCTCAAGTACGCCCTCAACTACCGCGAGACCAATTTGATCATGATGCA
GCGCCTCGTCAAGGTTGACGGCAAGGTCCGCACCGACATCGGCTTCCCCGCCGGCTTCATGGACGTCATCACCAT
CGAGAAGACCGGCGAGAACTTCCGCCTCGTCTACGACACCAAGGGCCGCTTCACCGTCCACCGCATCCAGGCCGA
GGAGGCCGAGTACAAGCTGGGCAAGGTCAAGCGCGTCCAGGTCGGCCGCGGCGGAGTCCCATTCTTGGTCACGCA
CGATGCGAGGACCATCCGCTACCCCGACCCTCTGATCAAGGTCAACGACACCGTCAAGATCGATCTCGCCACCGG
CAAGATCACCGACTTCATCAAGTTCGACACCGGCGCCATCGCCATGGTCACCGGTGGTCGCAACATGGGTCGTGT
CGGCGTCATCACCCACCGTGAGCGCCACGACGGTGGTTTCAACATCGTCCACATCAAGGACGCCATCGACAACAC
CTTCGCCACCCGTGAGAGCAACGTCTTCGTCATCGGCTCCGAGAAGCCTGGATCTCCCT

> SEQ ID NO:1520 130744 245990_301573_1b
GTTAGGTCAGTGCTGAGGATCAGGCGGCGGCGATGGCGCGGGGACCGAAGAAGCATCTCAAGGTGCTCAATGCGC
CCAAGCATTGGATGCTCAGCAAGCTCGGCGGTGCCTTTGCTCCAAAGCCATCGTCGGGCCCTCACAAGGAGAGGG

Figure 2 continued

AATGCCTGCCTCTGGTCATTCTTCTGCGGAACAGGCTCAACTACGCCCTGACGTACCGCGAAGTCATGTCCATTG
TCATGCAGAACCTCATCTCGATTGATGGCAAGGTCCGCACGGATAAGTGTTTCCCTGCTGGATTCATGGATGTCG
TGACTATCGGCAAGGTCAATGAGAACTATCGTCTTCTCTATGACAACAAGGGCCGGTTCACTCTGCATTCCATCT
CTGCTGAGGAGGCTAAGTTCAAGCTCTGCAAGGTCCGTGCTGTCAAGTTCGGCGACAAGGGAATTCCCTTCCTCA
CGACTTACGACGGGAGGACCATCCGCTACCCGGACCCGCTGATCAAGGCCAACGACACCATCAAGATCGACCTTG
AGACGGGAAGATCAAGGAGTTCATCAAGTTCGACATCGGCAACATCGCGATGGTCACCGGCGGGCGCAACAGGG
GCCGGATTGGCACCATCCAGCACCGTGAGAAGCACAAGGGATCCTTCGACATCATCCACGTCAAGGACGCTGTGG
GCCAGGACTTCGCCACCCGC

> SEQ ID NO:1521 130744 233640_301092_1b
GGGCGGACGCGTGGGCGGACGCGTGGGGATGAAAATGGTGCGGGGACCGAAAAAAACATCTCAAGGTGCTGAATGC
ACCCCGCCATTGGATGCTCAGCAAGCTGGGCGGTGCCTTCGCTCCAAAGCCATCGTCGGGTCCTCACAAGGAGAG
GGAATGCATCCCCCTGGTAATTCTCCTCCGGAACAGGCTCAACTATGCCTTGACGTACCGGGAAGTCATCTCTAT
CGTCATGCAAAACCTCATCTCCATCGATGGCAAAGTTCGCACAGAAAAATGCTTTCCCGCTGGTTTCATGGATGT
GGTGACTATCGGGAAGGTGAATGAGAACTACCGCCTTCTTTACGATACAAAAGGCCGGTTCACTCTCCAGCCGGT
CACCGACGATGAGGCAAAGTACAAGCTTTGCAAGGTTCGTGCCGTGATGTTCGGATCTAAGGGAATTCCTTTCCT
CACGACTTACGACGGGAGGACCATCCGCTACCCCGATCCTCTGATCAAGGCGAACGACACCATCAAGATCGACTT
GGAGACTGGGAAGATCAAAGAGTTCATCAAGTTCGAGGTTGGCAACATCGCCATGGTCACGGGTGGCCGCAACAG
GGGAAGGATTGGAACCGTCCAGCACCGCGAGAAGCATATGGGAAGCTTTGATATAATCCACATCAAGGACGCTGC
CGGCC

> SEQ ID NO:1522 130744 228334_301020_1b
CCCACGCGTCCGGGAGAATTTCCGCCTTCTGTATGACACCAAGGGTCGCTTCCGTCTCCACAGCATCAAGGATGA
GGACGCTAAGTTCAAGCTCTGCAAGGTCCGGTCTGTACAGTTTGGACAGAAGGGTATTCCTTTCCTGAACACCAA
CGACGGGCGCACGATCCGCTACCCAGACCCACTCATCAAGGCCAACGACACCATCAAGATTGACTTGGAGACCAA
CAAGATCGTGGACTTCATCAAGTTTGATGTTGGAAACATCGTGATGGTGACCGGTGGGAGGAACACGGGGCGCGT
CGGGGTGATCAAGAGCAGGGAGAAGCACAAGGGCAGCTTTGAGACCATCCATGTCGAGGATGCCCTCGGCCACCA
GTTCGCGACTCGCATGGGCAACGTCTTCACCATCGGCAAGGAGAGGAAGCCGTGGGTATCTCTCCCAAGGGCAA
GGGCATCAAGCTCAGCATCATTGAGGAGGCGAGGAAGCGCAATGCCGAGGCTGCCGCTGAGGCTTGATTTCTGAA
AATCTCCATGAATGAAACTGTTGATTTGAGCAGTCTATTTATATAGATTATTTAGCTCTTAAGATCATATGTCCA
TTGGAGA

> SEQ ID NO:1523 130744 226476_300997_1b
AAAAATGGCCCGAGGACCCAAGAAGCATCTCAAGCGACTCGCAGCTCCCTCCCACTGGATGCTGGACAAGCTGTC
CGGCACCTACGCTCCCCGATCGTCTGCCGGTCCCCACAAGCTGCGAGAGTCTCTGCCTCTCGTCATCTTCCTGCG
AAACCGTCTCAAGTACGCCCTGAACGGCCGAGAGGTTAACGCCATTCTCATGCAGCGACTGGTCAAGGTCGACGG
CAAGGTCCGAACCGACTCCACTTTCCCCGCTGGCTTCATGGATGTCATCCAGCTCGAGAAGACCGGCGAGAACTT
CCGACTTGTCTACGACGTCAAGGGCCGATTTGCCGTCCACCGAATCACCGATGAGGAGGCTGCTTACAAGCTCGG
CAAGGTCAAGCGAGTCCAGGTTGGCAAGAAGGGTATCCCCTACCTCGTCACCCACGACGGCCGAACCATCCGGTA
CCCCGACCCTCTCATCAAGGTCAACGACACCGTCAAGATCGACCTGGCCACCGGCAAGATCACCTCTTTCGTCAA
GTTTGAGAACGGTAACATTGTCATGACCACCGGAGGTCGAAACATGGGCCGAGTCGGCACCATCACCCACCGAGA
GCGACATGAGGGTGGCTTCGATATCGTCCACATCAAGGACGCTCTTGACAACCAGTTTGTTACCCGACTCACTAA
CGTTTTCGTTATCGGTGAGGGCAACAAGTCTCTCATCTCTCTGCCCAAGGGCAAGGGTATCAAGCTCTCCATTGC
TGAGGAGCGAGATGCCCGACGAGCCAAGCAGGAGTAAGTTCAGATTGAACACATTGTTTAGCTAAAAAAAAGATT
CATGTATAGCATGTTGTAAAAAA

> SEQ ID NO:1524 130744 210744_300892_1b
GCACCGTCGAGAAAACAGCCAGTCGTCACCATGGCCCGAGGAATCAAGAAGCACCAGAAGCGCCTTAGCGCCCCC
TCCCACTGGCTGCTGGACAAGCTGTCCGGTCTCTATGCCCCAAGCCTTCTGCCGGTCCTCACAAGCTCCGTGAC
TGCATGCCCCTGATCGTCTTCATCCGCAACCGTCTCAAGTATGCCCTCAACTACCGCGAGACCAAGGCCATCATG
ATGCAGCGCCTGGTCAAGGTTGACGGCAAGGTCCGCACCGACATCACCTACCCGCCGGCTACATGGACGTCATC
ACCATCGAGAAGACTGGCGAGAACTTCCGTCTCATCTACGACACCAAGGGCCGCTTCACCGTCCACCGAATCCAG
GCCGAGGAGGCCGAGTACAAGCTGGGCAAGGTCAAGCGCGTTCAGCTCGGCCGTGGTGGAATCCCATTCTTGGTC
ACGCACGATGCGAGAACGTGAGTTCTGTCAGACATCATTCAGCCGTTGGATCAAGCTTTGGTCGATTCGGGAAAA
AAGGAAGGAGAAAAATTCAAAAAATTCACCTCCCTTGATTTGTTTTCATCTTTTCTCATTTTCCCTCTTCTCACA
GAGAGAGAAAAAAGGAAGAAGAAACAGAGACGACGACGACGGAAGCTTTATTTGAC

> SEQ ID NO:1525 130744 195968_300639_1b
CCCACGCGTCCGACGCCCAACCTTTCCGTCGTTTTCATCACCGTCGAGAAAACAGCCAGTCGTCACCATGGCCCG

Figure 2 continued

AGGAATCAAGAAGCACCAGAAGCGCCTTAGCGCCCCTCCCACTGGCTGCTGGACAAGCTGTCCGGTCTCTATGC
CCCCAAGCCTTCTGCCGGTCCTCACAAGCTCCGTGACTGCATGCCCCTGATCGTCTTCATCCGCAACCGTCTCAA
GTATGCCCTCAACTACCGCGAGACCAAGGCCATCATGATGCAGCGCCTGGTCAAGGTTGACGGCAAGGTCCGCAC
CGACATCACCTACCCCGCCGGCTACATGGACGTCATCACCATCGAGAAGACTGGCGAGAACTTCCGTCTCATCTA
CGACACCAAGGGCCGCTTCACCGTCCACCGAATCCAGGCCGAGGAGGCCGAGTACAAGCTGGGCAAGGTCAAGCG
CGTTCAGCTCGGCCGTGGTGGAATCCCATTCTTGGTCACGCACGATGCGAGAACCATCCGTTACCCTGACCCCCT
GATCAAGGTCAACGACACCGTCAAGATTGACCTCGCCACCGGCAAGATCACCGACTTCATCAAGTTCGACACTGG
CGCCGTCGCCATGGTCACTGGTGGTCGTAACATGGGCCGTGTTGGTGTCATCACCCACCGTGAGCGTCACGACGG
AGGCTTCAACATTGTCCACAT

> SEQ ID NO:1526 130744 187412_300677_1b
GCGACGCATACGGACGGCGTGGTGGTCTCCCCCTCCGGCGACGTAGCTCGAGCTCGCAACCATGGCGAGGGGATT
GAAGAAGCATCTCAAGAGGCTCAATGCGCCCAAGCACTGGATGCTCGACAAGCTCGGCGGAGCTTTTGCCCCCAA
GCCATCGTCTGGACCTCACAAGTCCAGGGAGTGCCTGCCCCTGATCCTCATCATCAGGAACAGGTTGAAGTATGC
GCTGACATACCGTGAGGTTATCTCTATCCTGATGCAGCGGCATGTCTTGGTTGATGGGAAGGTCAGGACTGACAA
GACCTACCCTGCTGGTTTCATGGATGTGATTTCCATTCCAAAGACTGGTGAGAACTACAGGCTTCTCTATGACAC
CAAGGGTCGCTTCCGCCTTCAGTCCGTCAAGGATGAGGATGCCAAGTTCAAGCTTTGCAAAGTTCGGTCTGTCCA
GTTTGGACAGAAGGGCATTCCCTATCTGAACACCTATGATGGACGCACCATCCGCTACCCGGACCCTTTGATTAA
GGCTAACGACACAATCAAGATTGATCTTGAGACCAACAAGATTGTTGACTTCATCAAGTTTGATGTGGGCAATGT
CGTTATGGTCACAGGAG

> SEQ ID NO:1527 130744 187280_300675_1b
GCGGCGCGGAGCAGAGGAGGACGAAGCAGCAGGCGGCGGCGGCAGAGCACGGCGACCTAGCCCGACCTCGCAACC
ATGGCAAGGGGTTTGAAGAAGCATCTGAAGAGGCTCAATGCGCCCAAGCATTGGATGCTCGACAAGCTTGGTGGA
GCTTTTGCCCCCAAGCCATCTTCTGGTCCTCACAAGTCCAGGGAGTGCCTGCCTCTGATCCTCATTATCAGGAAC
AGGCTCAAGTATGCTCTGACATACCGTGAGGTTATTTCTATCCTCATGCAGCGCCATGTCTTGGTTGATGGCAAG
GTCAGGACTGACAAGACCTACCCAGCTGGTTTCATGGATGTCATTTCCATCCCCAAGACTGGTGAGAACTACAGG
CTTCTGTACGACAC

> SEQ ID NO:1528 130744 175324_300541_1b
CCCCCCCCGATCCCTCTCTCCTCTTTGGCGGCGGCGCGGAAGAGAGCGACGCAGACGGACGGCGTGGTGGTCTC
CCCCTCCGGCGACGTAGCTCGAGCTCGCAACCATGGCGAGGGGATTGAAGAAGCATCTCAAGAGGCTCAATGCGC
CCAAGCACTGGATGCTCGACAAGCTCGGCGGAGCTTTTGCCCCCAAGCCATCGTCTGGACCTCACAAGTCCAGGG
AATGCCTGCCCCTGATCCTCATCATCAGGAACAGGTTGAAGTATGCGCTGACATACCGTGAGGTTATCTCTATCC
TGATGCAGCGGCATGTCTTGGTTGATGGGAAGGTCAGGACTGACAAGACCTACCCTGCTGGTTTCATGGATGTGA
TTTCCATTCCAAAGACTGGTGAGAACTACAGGCTTCTCTATGACACCAAGGGTCGCTTCCGCCTTCAGTCCGTCA
AGGATGAGGATGCCAAGTTCAAGCTTTGCAAAGTTCGGTCTGTCCAGTTTGGACAGAAGGGCATTCCCTATCTGA
ACACCTATGATGGACGCACCATCCGCTACCCGGACCCTTTGATTAAGGCTAACGACACAATCAAGATTGATCTTG
AGACCAACAAGATTGTTGACTTCATCAAGTTTGATGTGGGCAATG

> SEQ ID NO:1529 130744 15504_300353_1b
CGCTCCAAGTTGATGGCAAAGTCAGGACTGACAAGACTTACCCTGCTGGTTTCATGGATGTTGTATCCATCCCCA
AGACCAATGAGAACTTCCGTCTTCTCTACGACACCAAGGGACGTTTCCGTCTCCACTCCATCAAGGATGAGGAAG
CAAAGTTCAAGCTTTGCAAGGTTAGATCTATCCAGTTTGGTCAGAAGGGAATTCCATACCTGAACACTTATGATG
GTCGCACCATCCGTTACCCTGACCCGCTCATCAAGCCAAATGACACCATCAAGCTGGACCTTGAGGAGAACAAGA
TTGTTGAGTTCATCAAGTTTGACGTGGGTAACGTTGTGATGGTGACTGGAGGCAGAAACAGAGGGCGTGTGGGTG
TGATTAAGAACCGTGAAAAGGCAATTCTCGAGC

> SEQ ID NO:1530 130744 126767_300466_1b
GCCATTACGGCCGGGGAGGGCTGTTAAGGTGGCTTTCACATGAGCGGAGCAGCAGGTAAGCTTAGTTACTGCAGA
AAGTGGCGGAGCTGTGACGCTGCTGATTCAAATCTAAAGACCACCAAAATGGCTAGAGGTTTGAAGAAACATTTG
AAGAGGCTCAATGCCCCAAAGCATTGGATGCTTGACAAGCTTGGAGGAGCTTTCGCTCCCAAGCCCTCGTCTGGT
CCGCACAAATCAAGGGAGTGTTTGCCATTGATCATTATCATGAGAAACAGGCTGAAGTATGCCCTGACATATGGC
GAGGTCATTTCAATTTTAATGCAACGACTTGTTATGGTTGATGGGAAAGTTAGGACAGATAAGACTTACCCCGCC
GGCTTTATGGATGTTGTTTCAATTCCCAAGACAAATGAGAACTTCCGCCTCATGTATGACACAAAGGGCCGATTT
CGTCTTCACTCAGTTAGGGATGAGGAAGCCAAGTTTAAGCTGTGCAAGGTCCGATCTGTGCAGTTTGGACAGAAG
GGTATTCCATACCTCAACACTTATGATGGAAGAACAATCCGCTACCCCGATCCTCTCATCAAGGCCAATGATACC
ATCAAACTGGACTTAGAGAACAATAAGATTGTTGACTTCATCAAGTTTGATGTCGGAAATGTTGTCATGGTGACT
GGTGGTAGAAACAGGGGGCGTGTTGGTGTTATTAAAAACAGGGAAAAGCATAAGGGTAGTTTCGAGACAGTTCAC

Figure 2 continued

ATTCACGATGCCCAAGGGCATGAGTTTGCTACCCGCTTGGGTAATGTGTTCACTCTCGGAAAAGGTACTAAGCCA
TGGGTTTCCCTCCCTAAAGGAAAAGGTATCAAGTTATCCATCATTGAAGAGGCACGGAAGAGACTTGCTGCTCAA
TCAGCAACCACTACTTAAAATGTGTGGTCGAGCTATAGACTGATCAAACTTTTTTGCTGGTTGGACCTAATGTTT
ATTTTTATTTTAGCAATACCAATTTTATTTTTACTACCCTGCAAACATTTGTGTTCTATGTTTTTGTGAACCTAT
AGCTTTTTGTTAGGATAAAAACCCTGAAGACTTTT

> SEQ ID NO:1531 130744 1171739_302057_1b
TGCCCACGCGTCTGCCCACGCGTCTGCCCACGCGTCTGGGCAGTAGTTCTTTTACTGCCATAGCCACGCTGCCGA
AGCTGGAGCTGGATGCATGGAGGAAGAAGAAGGAGAAGGAGGAGGAGGAGGAGCAGCAGTCCAGCTATGGCGCGA
GGATTGAAGAAGCACTTGAAGCGGCTCAATGCCCCCGCCACTGGATGCTCTTTAAACTTGGCGGTGCCTTCGCC
CCCAAGCCCTCAGCAGGTCCCCATAAAGAGAGGGAGTGCCTGCCCCTTGTTGTTCTTCTCAGGAACAGGTTGAAA
TATGCACTCACATACCGTGAGGTTGTTGCAATTGTCATGCAACGACTTGTCTCCGTTGACGGAAAGGTCCGTACT
GACAAATGTTACCCTGCTGGATTTATGGATGTCGTTTCAATTGCCCGAACCAACGAGAATTTCAGACTCTTGTAT
GACAGCAAGGGGAGGTTCACTGTCCACTCTGTTGGTGTGGAAGAAGCCAGGTACAAGCTCTGTAAGGTGAAAGCA
GTGAGGTTTGGCGATAAAGGAATCCCCTTCCTCACTACCAACGATGGGCGGACGAT

> SEQ ID NO:1532 130744 112169_300040_1b
CCAACTTCTCCCGGGCAGCTGTTCAAATCGGAAAACCGCCGAAATGGCAAGAGGGTTGAAGAAACATTTGAAGAG
GCTCAATGCGCCGAAGCATTGGATGCTTGATAAGCTTGGTGGGGCCTTTGCTCCCAAGCCTTCTTCTGGTCCACA
TAAGTCAAGGGAGTGTTTGCCATTGATTATTATCCTCAGGAACAGACTGAAATATGCTTTGACATACCGTGAGGT
CATCTCAATTTTGATGCAACGACAAGTTATGGTTGATGGGAAAGTTAGGACTGATAAGACTTACCCTGCTGGTTT
CATGGATGTTGTTTCCATTCCAAAGACAAATGAGAACTTCCGATTGCTTTATGACACTAAGGGTCGCTTCCGTCT
CCACTCACTCAGGGATGAGGAAGCGAAGTTCAAACTTTGTAAGGTTCGATCGGTGCAGTTTGGACAGAAGGGGAT
TCCATATCTCAACACTTATGATGGAAGAACAGTTCGCTACCCAGATCCCCTCATCAAGGCCAATGACACCATTAA
GTTGGATTTAGAATCCAATAAAATTGTTGACTTCATCAAATTTGATGTTGGAAATGTGGTCATGGTGACTGGTGG
TAGAAATAGGGGGCGTGTTGGAGTTATTAAGAACAGGGAGAAGCATAAGGGTAGCTTTGAGACCGTTCACATTCA
GGATGCCCTGGGGCACGAGTTTGCTACCCGCTTGGGAAATGTGTTCACTCTTGGTAAAGGTACTAAGCCATGGGT
ATCTCTTCCTAAAGGAAAAGGTATCAAGTTATCTATCATTGAAGAGGCTCGCAAGAGGCTGGCTGCTCAATCAGC
TACAGCTGCTTAAAAAC

> SEQ ID NO:1533 131003 1096769_301433_1b
TGCCTTTGCTCATTCCTTTCCCTCCTCTACCCCCTATGGCTGCCCTTGAGGCCTCCTGTGTTGCTCAGAGTCTGT
CTGTAGTGAGCTGCCAAGCATCTGGCAATGTCCGTCCATCCTCGGCTTTCTTGGGTTTAGGCCTAAAGAAGGGGG
GGTCTTCTTCTGGGAATGCAAAGAAGGCTTCATTGCAGAAGATTGCAGCATCGGTAGACGGGGATGAAACAAAGC
AGACGAAAACGGACAAATGGGCCGGTCTGGCCTTCGACACCTCGGACGACCAGCAGGACATCACCCGAGGGAAGG
GTATGGTGGACCCACTCTTCCAAGGTGCTGTGGGTTTGGGCACCCAAGAAGCTGTCATGAGCACCTATGACTACA
TTAGCACCGGTCAGAGGACGTTACAATGGGACAATATGAAAGATGGTTTCTACATTGCCCCTGCATTCATGGACA
AGCTTGTCGTCCACATTACTAAGAATTTCATGAATCTTCCCAACATCAAGGTGCCATTGATCCTTGGTATCTGGG
GAGGCAAAGGTCAAGGGAAATCATTCCAAGCTGAGCTTGTCTTCGCCAAGATGGGGATTAACCCAATCATGATGA
GTGCGGGTGAGTTGGAAAGCGGGAATGCTGGTGAGCCAGCTAAACTAATCCGACAAAG

> SEQ ID NO:1534 131003 44720_300030_1b
GCCATTACGGCCGGGGAACCAATTTTTGAATATATTGAGCAAATCAAGAAAGCTCAATCCTTAGCTTCTTTGATC
AAGTTGTCATCACAGTAGTCAAGATAATGGCTACCTCTGTGTCAACCATTGGAGCTGCCAACAAAGCACCGTTGA
GTTTGAACAACTCAGTTGCTGGAACTTTAGTTCCAAGCACAGCCTTCTTTGGCAAAACTTTGAAGAAAGTGTATG
GAAAAGGTGTTTCAAGCCCCAAGGTTACAAACAGGAGCTTGAGGATTGCAGCTGAAGAGAATAAAGATGCTGATC
CCAAGAAACAGACCGATAGTGACAGATGGAAGGGTCTTGTCCAAGACTTTTCTGATGATCAACAGGACATCACCC
GGGGTAAGGGTATGGTTGACAGTCTTTTCCAGGCTCCAACAGGTACTGGCACTCACCATGCTGTTTTGCAATCCT
ACGAATATGTCAGCCAAGGTCTTCGCCAATACAACATGGACAACACATTGGACGGATTCTACATCGCTCCTGCTT
TCATGGACAAGCTTGTTGTTCACATCACCAAGAACTTCTTGAAATTGCCCAACATCAAGGTTCCACTTATCTTGG
GTATCTGGGGAGGCAAAGGTCAAGGTAAATCTTTCCAGTGTGAGCTTGTCTTCAGAAAGATGGGAATCAACCCCA
TTATGATGAGTGCTGGAGAATTGGAAAGTGGAAATGCAGGAGAGCCTGCAAAATTGATTAGGCAAAGGTACAGAG
AGGCAGCAGAAATCATCAGGAAAGGAAACATGTGTTGCCTCTTCATCAACGATCTCGATGCAGGAGCTGGTAGAA
TGGGTGGAACTACCCAATACACTGTCAACAACCAGATGGTGAATGCCACTCTCATGAACATTGCTGATAACCCGA
CAAACGTCCAGCTCCCCGGTATGTACAACAAGCAAGAGAACGCCAGGGTCCCCATTGTTGTCACTGGTAACGACT
TCTCCACACTGTATGCTCCTCTTATCCGAGATGGTCGTATGGAGAAGTTCTATTGGGCACCAACTAGGGAAGACA
GAATTGGTGTTTGCAAGGGTATTTTCAGGACCGACAACGTGCCTGAGGAAGCCGTTATAAAGATTGTTGATACCT
TCCCTGGACAATCTATTGACTTCTTCGGTGCTCTGAGGGCACGAGTATACGATGATGAGGTGAGGAAAT

Figure 2 continued

> SEQ ID NO:1535 131003 255661_301644_1b
ATTGGATAGTCAGCTCAGCTCAAGAGGAAGACATGGCCATGGCTACCACACTCCTCGAGGCTTCGTGTGCTACTT
TGGGATCTCCTCTAGGTGGTCAACCAGTTGCGAGTTCTAAGTCTGGTGGCCCTGTGTCTCTGTTTTTGGGGCGG
GTCTGAGGAAGTGCTGCAGCGTGCACATGCGCAGAAGCAGGAGCAGAGCAGTGAAGGTTGTGGCGTTGGAGGATG
AGACGAAGCAGACAAAGACAGACCGATGGGCGGGGCTTGCGACGGACATATCGGATGACCAGCAGGACATTGCAC
GAGGGAAGGGCATGGTGGACGCACTCTTCCAGGGCCCCAGTGGTGAAGGCACCCAGCATGCCGTCATGAGTTCCT
ATGAGTACATTAGCTCTGCTCAACGCACGCTTAACTGGGACAACATTAAAGATGGATACTACATCTCACCATCCT
TCATGGACAAGCTGGTTGTTCATGTCACTAAAAACTTCCTTACACTTCCGAACATTAAGGTTCCTTTGATTCTGG
GTGTATGGGGAGGGAAAGGGCAAGGGAAGTCTTTCCAGTGCGAGCTGGTCTTCGCTAAGCTCGGAATTACGCCCA
TAATGATGAGTGCTGGAGAATTGGAGAGTGGAAATGCAGGTGAACCCGCCAAGCTTATCCGGC

> SEQ ID NO:1536 131003 254836_301639_1b
GACTTCTCTAAGCCTTCTCTTGGATCTTGCCTTTGCTCATTCCTTTCCCTCCTCTACCCCTATGGCTGCCCTTG
AGGCCTCCTGTGTTGCTCAGAGTCTGTCTGTAGTGAGCTGCCAAGCATCTGGCAATGTCCGTCCATCCTCGGCTT
TCTTGGGTTTAGGCCTAAAGAAGGGGGGGTCTTCTTCTGGGAATGCAAAGAAGGCTTCATTGCAGAAGATTGCAG
CATCGGTAGACGGGGATGAAACAAAGCAGACGAAAACGGACAAATGGGCCGGTCTGGCCTTCGACACCTCGGACG
ACCAGCAGGACATCACCCGAGGGAAGGGTATGGTGGACCCACTCTTCCAAGGTGCTGTGGGTTTGGGCACCCAAG
AAGCTGTCATGAGCACCTATGACTACATTAGCACCGGTCAGAGGACGTTACAATGGACAATATGAAAGATGGTT
TCTACATTGCCCCTGCATTCATGGACAAGCTTGTCGTCCACATTACTAAGAATTTCATGAATCTTCCCAACATCA
AGGTGCCATTGATCCTTGGTATCTGGGGAGGCAAAGGTCAAGGGAAATCATTCCAAGCTGAGCTTGTCTTCGCCA
AGATGGGGATTAACCCAATCATGATGAGTGCGGGTGAGTAGGAAAGCGGGAATGCTGGTGAGCCAGCTAAACTAA
TCCGACAAAGGT

> SEQ ID NO:1537 131003 25021_300072_1b
CCCACGCGTCCGTCGCACAGAGCAACAAGAAGAGCAACGGATCATTCAAGGTGTTGGCTGTGAAAGAAGACAAAC
AAACCGATGGAGACAGATGGAGAGGTCTTGCCTACGACACTTCTGATGATCAACAAGACATCACCAGAGGCAAGG
GTATGGTTGACTCTGTCTTCCAAGCTCCTATGGGAACCGGAACTCACCACGCTGTCCTTAGCTCATACGAATACG
TTAGCCAAGGCCTTAGGCAGTACAACTTGGACAACATGATGGATGGGTTTTACATTGCTCCTGCTTTCATGGACA
AGCTTGTTGTTCACATCACCAAGAACTTCTTGACTCTGCCTAACATCAAGGTTCCACTTATTTTGGGTATATGGG
GAGGCAAAGGTCAAGGTAAATCCTTCCAGTGTGAGCTTGTCATGGCCAAGATGGGTATCAACCCAATCATGATGA
GTGCTGGAGAGCTTGAGAGTGGAAACGCAGGAGAACCCGCAAAGCTTATCCGTCAGAGGTACCGTGAGGCAGCTG
ACTTGATCAAGAAGGGAAAGATGTGTTGTCTCTTCATCAACGATCTTGACGCTGGTGCGGGTCGTATGGGTGGTA
CTACTCAGTACACTGTCAACAATCAGATGGTTAACGCAACACTCATGAACATTGCTGATAACCCAACCAACGTCC
AGCTCCCAGGAATGTACAACAAGGAAGAGAACGCACGTGTCCCCATCATTTGCACTGGTAACGATTTCTCCACCC
TATACGCTCCTCTCAT

> SEQ ID NO:1538 131003 248955_301588_1b
TGTTCGATCAGTCTATGGCGGCATCGTCAATGCAGCTCCTAACCCAGGCCTCCGCCCATCCGATCGGCGCGAGAT
CGTCGCTGGCATCGGCATTCTTGGGGAGCGGCATCCATCAGCACGAATCCAGTGCGCGAGCTGGAAACCTCCGGG
CTAGATGCCGGGTAGTGTGTGAATTGGAGGAATCCTCGAAGGAGGTCGATCGATGGCAGTCTCTGGGGACCGATA
CGTCGGACGATCAACAAGATATCACCAGGGGAAAGGGAATGGTGGATAATCTGTATCAAGGGCCTCAAGGGGGAG
GAACACAGACTGCCGTTATGTCGAGTCTAGAGTATATCAACACTGCCCAGCGCATGTACTCTATGGACAACACCA
AAGATGGATTTTACATCGCCCCAGCGTTCATGGAGAAGCTAGTTATTCACATATCAAAAAATTTCATGACACTTC
CAAATGTAAAGGTTCCTCTTATACTTGGTGTCTGGGGTGGCAAAGGTCAAGGAAAGTCGTTCCAGTGCGAACTGG
TGTTCTCCAAGCTGGGAATTAATCCTATCACGATGAGTGCTGGAGAGCTTGAGAGCGGGAATGCTGGAGAGCCTG
CAAAGCTTATCCGGGAGCGGTATCGCGAAGCAGCAGATATTATC

> SEQ ID NO:1539 131003 233722_301093_1b
AGGCAAGACCTAGCTAGCTCTTCGTCCTCGCGGTACATCGCAATGGCGTCGTCTCTCCAGGCGGTCCCCGTTGCT
CAGGCGATGAGCTTGCCAGCAGCACAGAAGTCCTCGTCCAAGGTTTCATGCCTCAACTCCCAGTTCCTGGGCCTC
AACGTCAAGAGAAAGACCGTGTTCCAAGCTTCTCTGTCCGGTGCCGCTGGACGCGGCCGGGTGGTCTGCGAGAAA
GTTAAGGACACAGAGGACGAGACCAAGCAGACGGCCAAGGATCGCTGGGGAGGCCTGGGCACCGATATCTCGGAC
GACCAGCAAGACATCACCCGTGGTAAGGGAATGGTTGACACCCTTTACCAAGGAGCTATCGGAATGGGAACCCAG
CATGCCATCATGAGCAGCTATGAGTACATTAGCACTGCCCAGCGCCACTTTGCGTTTGATAACACCAAGGATGGC
TTCTACATCGCACCCGCATTCATGGAAAAACTTATGATCCATATCGCCAAGAACTTCATGACACTTCCAAACATC
AAGGTGCCGCTGATTCTTGGTATCTGGGGAGGCAAAGGTCAAGGAAAATCATTCCAGTGCGAGCTTGTCTTCTCC
AAGCTCGGTGTCAACCCGATCATGATGAGCGCTGGAGAACTCGAGAGCGGAAACGCCGGAGAGCCCGCCAAGCTC
ATCAGGCAGAGGTACCGTGAAGCTGCCGATATCATCAAGAAGAAAGGCAAGATGTGCTGCCTCTTCATCAACGAT
CTCGACGCCGGCGCCGGACGAATGGGTGGAACGACGCAATACACGGTTAACAACCAGATGGTGAACGCGACGCTG

Figure 2 continued

ATGAACATCGCCGACAATCCCACGAATGTACAGCTCCCCGGAATCTACAAC

> SEQ ID NO:1540 131003 2192_300348_1b
GACCATGGCTACCTCTGTCTCAACCATTGGAGCTGTTAACAAAGCACCGTTGAGTTTGAACAACTCAGTTACTGG
AACTTCAGTTCCAAGCACAGCTTTCTTTGGCAAAACTTTGAAGACAGTGTATGGGAAAGGTGTTTCAAGCCCCAA
GGTTACAAACAAGAGCTTGAGGATTGCAGCTGAAAAAATAGATGCTGATCCCAAGAAACAGACCGACGGTGACAG
ATGGAAGGGTCTTGTCCAAGACTTTTCCGATGATCAACAGGACATCACCCGGGGTAAGGGCATGGTTGACAGTCT
TTTCCAGGCTCCAACCGGTACTGGCACTCACCATGCTGTGTTGCAATCCTACGAATATGTCAGCCAAGGTCTTCG
CCAATACAACTTGGACAACAAGTTGGACGGATTCTACATCGCTCCTGCTTTCATGGACAAGC

> SEQ ID NO:1541 131003 141839_300429_1b
CCCTTAGGGGAAGGGGTTTCTCCAATTCCTTTTTCAAGCTTCCACCGGTGAATGCACCGAACAAGCCCTCCTTAA
CTTCTAACAATACCTTAACCCAGGGCTTAAAACCTACCAATTTCACCACCCCCTTGGAAGGTTTTTCCTTCCCCC
TTGTTTTATTGACCAACTTGGTGGCCCCATTTTCAAAAACTTTATTAACCTTCCCAACATTAAGGGCCCAATTAT
TCTTGGTATTTTGGGAAGCCAGGGTCAAGGAAAAATCTTTCCAGGGGAACTTCTTTTTCCCCAAAAGGGGAATAA
CCCCATTATTAATAACCCCCGAAAACTTGAAAACCGCAACCCCCGAAAACCCGCCAAACTTA

> SEQ ID NO:1542 131003 139274_300408_1b
CCCGGAGCAGCAGCGGCCGGCCATCATCAGTGATCCTCTACAATCATCGACTTTCAGCAAATTAAGATGGCTGCT
GCCTTCTCCTCCACCGTTGGAGCTCCGGCGTCCACTCCGACCAACTTCCTGGGGAAGAAGCTGAAGAAGCAGGTG
ACATCGGCGGTGAACTACCATGGCAAGAGCTCCAACATCAACAGGTTCAAGGTGATGGCCAAGGAGCTGGACGAG
GGCAAGCAGACCGACCAGGACAGGTGGAAGGGTCTCGCCTACGACATCTCCGATGACCAGCAGGACATCACCAGG
GGGAAGGGTTTCGTCGACTCCCTTTTCCAGGCTCCCACGGGTGATGGCACCCACGAGGCCGTCCTCAGCTCCTAC
GAGTACCTCAGCCAGGGTCTCAGAACGTACGACTTCGACAACACCATGGGAGGCTTCTACATCGCCCCTGCTTTC
ATGGACAAGCTCGTCGTCCACATCTCCAAGAACTTCATGACCCTCCCCAACATCAAGGTCCCACTCATCCTGGGT
ATCTGGGGAGGCAAGGGTCAGGGAAAATCCTTCCAGTGTGAGCTCGTCTTCGCCAAGATGGGGATCAACCCCATC
ATGATGAGCGCCGGAGAGCTGGAGAGCGGCAACGCCGGAGAGCCGGCGAAGCTGATCAGGCAGCGGTACCGTGAG
GCGGCAGACATCATCAAGAAGGGGAAGATGTGCTGCCTCTTCATCAACGATCTGGACGCGGGTGCAGGTCGCATG
GGAGGCACCACCCAGTACACGGTGAACAACCAGATGGTGAACGCCACCCTGATGAACATCGCCGACAACCCAACC
AACGTGCAGCTCCCCGGGATGTACAACAAGGAGGACAACCCCCGTGTCCCCATCATCGTCACCGGCAACGACTTC
TCCACGCTGTACGCGCCGCTCATCCGTGACGGGCGTATGGAGAAGTTCTACTGGGCTCCCACCCGCGACGACCGT
GTCGGCGTCTGCAAGGGTATCTTCCGCACCGACAACGTCCCCGACGAGGACA

> SEQ ID NO:1543 131003 129566_300480_1b
GAATTCAACTCTCCTGCTATCTTTTTACAGAAAGTAGTACTCAGATTGCAGAAGTCTGATCAGACATGGCTGCTGC
TTTCTCAACCGTTGGAGCAGTTAACAGAGCACCTTTGAGCTTGCCAAGCTCTGGCCAAAGCTCTGCCTTCTTGGG
CAGCAGCTTGAAGAAGGTCAATTCTTCTGTTGCACCAAAACCATCATCAAGAAGCTTCAAAGTTGTTGCTGCACA
AGAGGTTGATCCTAAAAAGAATGAGGACAAATGGGCCGGTCTTTACTACGACCAGTCTGATGATCAACAAGACAT
CACCAGAGGGAAAGGGAATGGTTGACTCCCTTTTCCAAGCTCCTATGGATACCGGAACTCACAATGCTATCATGAG
TTCTTATGAATACGCCAGCAAGGGACAAAGAACATACGACTTTGACAACACCATGAGTGGATTCTACATTGCTCC
AGCTTTCATGGACAAGCTTGTTGTTCACATTACCAAGAACTTCATGACCCTTCCCAACATCAAGGTTCCTCTAAT
TTTGGGAGTCTGGGGAGGAAAGGGACAAGGAAAATCATTCCAGTGTGAGCTTGTCATGGCCAAGATGGGAATCAA
CCCAATCATGATGAGTGCCGGAGAGCTTGAGAGTGGAAACGCAGGAGAGCCCGCAAAGTTGATCAGGCAACGTTA
CCGTGAAGCAGCTGACATTATCAAGAAGGGAAAAATGTGTTGTTTATTCATCAACGATCTTGATGCAGGAGCTGG
ACGTATGGGTGGAACCACTCAATACACAGTTAACAACCAGATGGTTAACGCCACCCTCATGAACATTGCTGATAA
CCCAACAAATGTCCAGCTCCCCGGTATGTACAACAAGGAGGAGAATCCTCGTGTACCAATCATCTGTACCGGTAA
CGATTTCTCCACTTTGTATGCTCCTCTTATCCGTGATGGACGTATGGAGAAGTTCTACTGGGCACCTACTCGTGA
TGACCGTATTGGTGTCTGCAAGGGTATCTTCAAGACTGATAACATTTCTGATGAAGCTATCATCAAGATTGTTGA
TACCTTCCCAGGGCAATCTA

> SEQ ID NO:1544 131003 1096793_301433_1b
GTCAGCTCAGCTCAAGAGGAAGACATGGCCATGGCTACCACACTCCTCGAGGCTTCGTGTGCTACTTTGGGATCT
CCTCTAGGTGGTCAACCATTTGCGAGTTCTAAGTCTGGTGGCCCTGTGTCTCTGTTTTTGGGGGCGGGTCTGAGG
AAGTGCTGCAGCGTGCACATGCGCAGAAGCAGGAGCAGAGCAGTGAAGGTTGTGGCATTGGAGGATGAGACGAAG
CAAACAAAGACAGACCGATGGGCGGGCTTGCGACGGACATATCGGATGACCAGCAGGACATTGCACGAGGGAAG
GCATGGTGGACGCACTCTTCCAGGGCCCCAGTGGTGAAGGCACCCAGCATGCCGTCATGAGTTCCTATGAGTAC
ATTAGCTCTGCTCAACGCACGCTTAACTGGGACAACATTAAAGATGGATACTACATCTCACCATCCTTCATGGAC
AAGCTGGTTGTTCATGTCACTAAAAACTTCCTTACACTTCCGAACATTAAGGTTCCTTTGATTCTGGGTGTATGG
GGAGGGAAAGGGCAAGGGAAGTCTTTCCAGTGCGAGCTGGTCTTCGCTAAGCTCGGAATTACGCCCATAATGATG

Figure 2 continued
AGTGCTGGAGAATTGGAGAGTGGAAATGCAGGTGAACCCGCCAAGCTTATCCGGCAAAGGTACCGGGAAGCAGC > SEQ ID NO:1545 131272 1046487_301923_1b
GGAAGAGAGAGAGAGAGAGAGACAGATAGAGATAGATAGATAGAGAGAGAGAGAGAGAGAGAGGGCGCCTCTCTT
AGCTTTTTTTTTTTTCATCTACCGGCCTTCTCACCCTTTTCTTCTTCTTCTTCTTCTCTCTCTCTCTCCTCTCTC
TGGCTGGCTGGACTGGATCTATCTATCATCGATCCATCATGGGTACCCGGAAGCGCACCCTCCTCAAAGTCATCA
TCCTCGGAGACAGGGGGGTTGGGAAAACATCTCTGGTGGATCCATATGTTAACAAAAAGTACAGGAATCAGTACA
AGGGGAATATTGGAGCTGGTTTCCTTACCAAGGGGGTTCAAGTTGGTGACAGGCTTGGCACCATGGAGATCTGGG
ATACTGGGGGCCAAGAGCGCTTTCAAAGTCTTG > SEQ ID NO:1546 131272 204375_300792_1b
GAGCAAAAGCCAGCCTCGTCATTGAAGCCTCAAAGTATAGGCAGCCGGCATTCAAGGTCTCGTGACGCTTGCGAC
GCTGATTTCTTCCATCACACTACCGGACACTCTTTTTTCGATATCCATCATCACCTTTCCGCCACCAGAAGCACC
CGGAGAAGGCCTCTTCGCTCGCGGCGGCTGTGCTTTTGGCTCATATCTATCACGTCATTGGAGCCCCGAGTGTAC
GACGATAACCAGTCAAGATGTCTTCGCGCAACAAGAAGGTCCTTCTCAAGGTCATCATCCTTGGAGATAGCGGTG
TGGGCAAGACGAGTTTGATGAACCAATACGTCAACAAGAAGTTCAGCACAAGCTACAAAGCGACTATCGGCGCTG
ATTTCTTAACGCGAGAGGTCCTGGTGGACGACGACAAGTCACCATGCAGCTCTGGGACACAGCCGGACAAGAGA
GATTCCAGTCTCTGGGCGTCGCATTCTACAGAGGAGCCGACTG > SEQ ID NO:1547 131272 233366_301089_1b
GTTTGCGTGTAGAGCTCTCGCCGAAGGCCTGAGGGGTGCTGGGATCTACACCATCAGCTCAAGCATGGCATCCAG
GAAGCGAACTCTCCTCAAGGCGATCATTCTCGGCGACAGCGGATACGTGAACAAGAAATTTAGCAACCAGTACAA
GGCGACCATTGGAGCGGATTTTCTCACCAAGGAAGTCCAAGTGGAGGATAGGCTACTGACGATGCAGATATGGGA
TACAGCCGGTCAGGAGCGATTCCAAAGCCTTGGTGTGGCCTTCTATCGAGGGGCTGATTGCTGTGTGTTGGTATA
CGACGTGAATGTGATGAAGTCGTTTGATAATCTGGACAACTGGCGCGACGAGTTCCTCATCCAGGCAAGTCCTTC
TGATCCAGAGAACTTCCCTTTCATTGTTCTTGGCAACAAGGTTGATGTACACGGGGGGAACAGCAGAGTGGTATC
CG > SEQ ID NO:1548 131272 197486_301738_1b
CTCCCTTCTAACAGTTGATTATAGGAGGACTTCAATTTTCTGAAAGATCGTTTCAAATTTACTGGTTTTTATTCAT
TTTTTAGCTCCGTTTAACCCTTTTGAACAAAAATAATGGCAGCTCGAAGGCGGATGCTTCTCAAGGTCATAATCC
TAGGCGATAGCGGGGTGGGAAAGACATCTCTGATGAACCAGTATGTGAATCGTAAGTTTAGTAACCAATACAAGG
CGACAATCGGAGCTGATTTCTTGACAAAAGAAATTCAGTTTGAGGATAGGTTATACACATTGCAGATATGGGATA
CAGCTGGGCAGGAAAGGTTCCAAAGCCTGGGTGTAGCTTTTTACCGTGGAGCAGATTGTTGTGTTCTAGTATATG
ATGTGAATGTTATGAAGTCATTTGAGAATCTTAACAACTGGAGGGAAGAATTTTTAATCCAGGCAAGCCCATCTG
ATCCCGAGAACTTCCCATTTGTCGTAGTGGGGAATAAGATAGATGTTGATGGTGGCAACAGTCGAGTGGTCTCTG
AGAAGAAAGTAAAGGCATGGTGTGCTTCCAAGGGAAACATACCATATTTTGAGACCTCAGCAAAAGAGGGATTCA
ATGTGGA > SEQ ID NO:1549 135281 127764_300472_1b
TCTCTCTGTATTTGTTCTTCTTAAAAATCCCTTTTACAGAAAACCCAAAAGTAGTGCAAAAATTGAGAATTAATG
GCAAATCTAGGAGGAATTCGTGAGGCAGGAGGATCTGAGAACAGCCTTGAGATCAATGATCTTGCTCGCTTTGCT
GTTGATGAACACAACAAGAAACAGAATGCACTTCTGGAGTTCGGAAAGGTTGTTAATGTGAAGGAACAAGTGGTT
GCTGGAACCATGTACTACATAACACTGGAGGCAACTGAAGGTGGTAAGAAGAAAGCATACGAAGCCAAGGTCTGG
GTGAAGCCGTGGCAGAACTTCAAGCAATTGGAAGACTTCAAGCTTATTGGGGATGCCGCTAGTGCTTAACAAGTG
CTAAATGAATGCATCTTATGCTTGTGAAAATAAAGGTAACATAGTTTCGCTTGCGAGTATTTGAATATCGTAAAG
TAAGCTTTAAACTATGTCGTAGTGTTAAGTTACAAGTAACTGTAACTTTACAATGTTCCATATTTCATATTATAT
GGTCCTCCATATGATAGTTCTATGATATATCTTGTATATGTACTGCTTTTCTATTGCTAATATATATCTGAGAAG
CATAAGCAATTGCCTTTTTGA > SEQ ID NO:1550 135281 8087_300316_1b
AGAGAAGACGATGATGCTAGGAGGCGTTCATGATCTCCGAGGAAATCAGAACAGTGGAGAGATCGAGAGTCTCGC
TCGATTTGCCATTCAAGAACATAACAAACAACAGAACAAAATTCTTGAGTTCAAGAAGATTGTCAAAGCAAGGGA
GCAGGTAGTTGCAGGAACGATGTACCACTTAACCCTAGAAGCAAAAGAAGGTGATCAGACTAAGAATTTTGAAGC
CAAAGTGTGGGTGAAGCCATGGATGAACTTCAAACAGTTGCAGGAGTTCAAGGAATCATCTTCTTGAATTTCACT
TGTTCAAGTTAATGATTACAAATGCTCTGAGAGTAATTAATTATAT > SEQ ID NO:1551 135281 138595_300774_1b
CACGCGTCCGCCCACGCGTCCGCCCACGCGTCCGGCCGCCCTGCTCGTGCTGCATTCGCTAGCCACGCCGTCCGC

Figure 2 continued

TCAGGCCGAGGCGCATCGCGCAGGGGGAGAAGGGGAGGAGAAGATGTCGAGCGACGGAGGGCCGGTGCTTGGCGG
CGTCGAGCCGGTGGGGAACGAGAACGACCTCCACCTCGTCGACCTCGCCCGCTTCGCCGTCACCGAGCACAACAA
GAAGGCCAATTCTCTGCTGGAGTTCGAGAAGCTTGTGAGTGTGAAGCAGCAAGTTGTCGCTGGCACTTTGTACTA
TTTCACAATTGAGGTGAAGGAAGGGGATGCCAAGAAGCTCTATGAAGCTAAGGTCTGGGAGAAACCATGGATGGA
CTTCAAGGAGCTCCAGGAGTTCAAGCCTGTCGATGCCAGTGCAAATGCCTAAGGCCCATCTCGTATCCTATGTGT
ATCAAGTTATCAAGAAGATGGGGAATAATATGGTGTGGATATAGCTATTGGACATGTTAATTATCCACATGATAA
TATGGCTTGGATATAAGGATCTCACACGATAATATGGCTTGGATATATAGCTATTAAAGATTTTACCTATGGCAT
ATTTCAATGTGTATTAGTACTAAGTAAGAATGATTGCAAGGTGTATTAACTACAAATATTGCAATAAAAGTCCCT
GTTACTAC

> SEQ ID NO:1552  135281  317136_301453_3b
GTGTTCGACTTCAAGTACCCCGCATTTTGTGGTAATTTCTGCTGTGCATAGATGGAAAATATCAATTTGTTCCAG
ATGCGGCAAAATTTATCACAAAATTAGGTAGAACTGATGTGAGAGATGTAGAAGTTTTGAGTGAGATTTATATCT
CTATCAATGACAATTACAAATCTTACAAAGACTTTAAGGTGCTTGATGCTTTGGATAAGGCTTTAGTGGATAGAT
ATCGATCCCCTTATAGTGCTATTTCTGCTTTGGTTTCTTTATGTTATCATATCTTTGACTTTAATAAGTTTAAGT
TGCTGTTTAATTGTGAAGGGAAATTTGTGGATAAGAAGCTGAGAAAAGACTTCGAGTGGTGAACTCTAGGTCCTG
ATGTTTAAATCTACTGTATTTACCTTCGCATTAATTAAGCATGGCCGAGGAGGCGCAGAGCCACGCGGCGTGAAG
GTGGGCGGCATCCACGACGCGCCGGCCGGGCGCGAGAACGACCTCACCACCGTCGAGCTCGCCCGGTTCGCCGTC
GCCGAGCACAACAGCAAGGCCAACGCGATGTTGGAGTTGGGGAGGGTGGTGAAGGTGAGGCAGCAGGTGGTGGGC
GGGTTCATGCACTACCTCACCGTCGAGGTGAAGGAACCCGGCGGCGCCAATAAGCTGTACGAGGCCAAGGTGTGG
GAGAGGGCGTGGGAGAACTTCAAGCAGCTCCAGGATTTCAAGCCCCTCGACGACGCCACCGCCGCGGCCGCTTAT
CCGTATGATGTTCCGGATTATGCCGAGCTCTACAAACAGCTGTTGAATTTTGATTTGCTGAAGTTGGCGGGTGAC
GTGGAATCTAACCCTGGTCCTAGGTCTAGAATGGCTACTTTCTCTTGTGTGTGTTGTGGTACCTTAACTACAAGT
ACTTACTGTGGTAAGAGATGTGAGCGAAAGCATGTATATTCTGAAACAAGAAATAAGAGATTGGAACTTTACAAG
AAGTATCTATTGGAACCGCAAAAATGCGCCCTGAATGGAATCGTTGGACACAGTTGTGGAATGCCATGCTCCATT
GCGGAAGAGGCTTGTGATCAACTGCCAATCGTGAGTAGGTTCTGTGGCCAAAAGCATGCGGATCTGTATGATTCA
CTTCTGAAACGTTCTGAACAGGAGTTACTTCTTGAATTTCTCCAGAAGAAGATGCAGGAGCTGAA

> SEQ ID NO:1553  135281  159760_200141_1b
CCCACGCGTCCGGTTGAAGGAGAAAAGAGAAACGAGTGCAGTCTGAGTCTGTCCACAGATGAGAGTATCTCGAAA
CGCCACACTGCTATTTGTTTTAATTTTGTCATTAAGTTTTCTCTTCTCTGCGTTTGGGTTAAGCGAAACCGGAGG
AGGATTTTGCGGTGAAGAGGAAGGAGAAAAGGAAATAATCTGATTGAGATGGCTACTCTTGGTGGGGTTCGTGATTC
GCATGCTTCGTCCCACAACAGCGACGAGATCCATAACCTTGCCAAATTTGCTGTCGATGAGCACAACAAGAAGGA
GAATGCGATGATTGAATTTGCCAGAGTTGTGAAGGCGCAAGAGCAAGTTGTTGCTGGTACACTGCACCATCTGAC
TCTTGAGGTCATAGATGCTGGAAAAAAGAAACTCTATGAGGCTAAGGTCTGGGTCAAACCATGGTTGAATTTCAA
GGAACTTCAAGAGTTCACTCATGTTGAAGATGTTCCTACCTTAACTTCTTCAGATCTAGGTGTTAAGCAAGAAGA
GGAAGGCTCTGGATTGAAGTCAGTGCCTGTGCATGATCCGGTGGTTCAGGAAGCTGCAGAGCATGCAATTAAGAC
CATCCAGCAGAGATCCAACTCGCTACTTCTGTATGAACTCCAAGAGATTGTTCATGCAAATGCTGAGGTCATTGG
GGAGGACAATATGAAGCTTCATATGCTCATCAAAACTAGCCGGGGAGGGAAGCGAGAAAAGTTCAAAGTTCAAGT
GCACCATA

> SEQ ID NO:1554  135357  1101328_301475_1b
CCCCTAGAGGTTGCACACTGCGCATCATCACCCTCCTCGTCTCTCCATCTCAGGTGAGACGTTACTATCTTTCTA
TGTTCTTATGTCATTAGTGGTGATTGCAAGACTTAGGTCTGCATCTCAGTCATTGAGAGGCATTGGACAAAATCA
TACAATCAAAGCTTGCTTCTTCCAGAGAAAATTTGCATATATTTCTGAAGCGAAGGCCATGGATGCCCCGGAGGA
GATTAGTAAGATAAAGATGTTTGGTGGATACATTAAACGCTACAAACATCAGAGCTCTACACTTGGCTGTGCTAT
GAATTTCACGATATATTTCCCTCCTGCTGCACAAGAGAAGAAAGTTCCTGTTTTATACTGGCTGTCGGGGCTTAC
ATGCACGGATGAAAACTTTGTGCAAAAAAGTGGAGCTCAAAGAGCAGCTGCAGCTTGTGGCATAGCTTTGGTAGC
TCCAGATACATCACCAAGAGGTCTTAACGTGGAAGGAGAATCAGAAAGTTGGGATTTTGGTGTTGGGGCTGGTTT
CTATCTTAACGCTGCACAGGAGAAATGGAAGAACTGGCGAATGTATGACTATGTGACGGTAGAGATACCGAGGCT
CCTTAGTGCTAACTTTGGTGAGCTTGATACAGCATGCGCTTCTCTCTCTGGACAC

> SEQ ID NO:1555  135357  181796_300627_1b
GATCCGAGAACAGCAGATTCAGAGATGGAGGAAAAACCCTGTGAGATCAGCAGCGTAAAGATGTTTGGAGGTTAC
AATAAGAGATATAAGCACTTCAGTCCGACTCTGGGTTGCTCCATGACCTTCCACATTTACTTCCCTCCATCCCCT
TCTCCATCCCACAAATTTCCTGTACTTTATTGGCTGTCTGGCCTAACTTGCTCCGATGAGAACTTTATTGTCAAA
TCTGGAGCTCAGCGTGCAGCTTCCAGCGAAGGTGTTGCGCTAATTGCCCCAGATACATCCCCAAGAGGCCTTGGA
GTGAAGGAGAGGCAGACAGCTGGGATTTTGGTGTAGGTGCTGGGTTTTATCTTAATGCTACTCAAGAGAAATGG
AAAAACTGGCATTCAATGGGTGGGCATGGTGCTTTGACAATCTACTTGAAAAACCTCGACAAGTACAAGTCTGTA

Figure 2 continued

TCCGCCTTTGCACCTATTGTTAATCCCATAAATTGCCCATGGGGTCAGAAGGCTTTCTCAAACTATTTGGGCGAC
GAAAAATCTGATTGGGAGGAATATGATGCCACTTGCCTAATTTCTAAGTACAACAATGTTTTGGCCACCATCCTA
ATTGATC

> SEQ ID NO:1556 136729 1110556_301790_1b
AGGGTCTATCTATTCATCTTTCTCTCTCTCTCTCTCTCTCTCTCTCTCTAGGTCTTCTTCTTGTTGATAAT
CCATGGCTATGGCTATGTCTGTGGCTATGGCTTCCCCCTCCTCTTTGGCATTGCCCTCTTCTTCCTCCTCCTCCT
CCCTCCTCGTCAAGTCCTCCTTCTCCGGAGCCCGCCTTGCCCTCGTGCCGGCTTGCTTTGTCTCCCCTCGCCTCC
CCTCTTGCGCCCTCACCGTCGTAGCCGCCGAGAAGAAGGCTGTTGCTGTCCTCAAAGGGACCTCCAATGTCGAAG
GCGTCATCAACTTGTTCCAGGAAGACGGCGGCCCCACAACCGTGAAGGTCAAAATTTCTGGTTTAGCACCTGGCA
AGCACGGATTCCACCTCCACCAGTTTGGAGACACCACCAATGGCTGCATGTCAACAGGTCCTCATTTTAACCCTC
AGGGACTTACACATGGTGCCCCTGAAGATGAAGTTCGACATGCCGGTGATCTAGGGAATGTTGTTGCGGGACCTG
ATGGTGTTGCAGAAGCCACCATAGTTGACTCACAAATTCCTTTGTCTGGACCTAATTCCGTAATTGGGAGAGCCT
TTGTCATTCATGAACTTGAGGACGATCTGGGAAAAGGAGGACACGAACTTAGCCCTACAACTGGTAATGCTGGAG
GTCGACTTGCTTGTGGTATNGTGGGTCTCTCTCCATAAATTTTCTACAAGGAGATATCAAGTTTAGTTGGGTGGG
TTGGCTTCATCAGTAAAGCAGA

> SEQ ID NO:1557 136729 127587_300470_1b
CCCCCCGATTTTCCATTATTTCCTAACTCCTGAGTATCACAGACATATTTGACTTCTATCTTCCTCTCTTTCTCT
CTCTAGCCATTCAAGGGGTTCCCTGAGACTCTTGTATCATAATTTTCTAGATCACACATACAAAAATGGTGAAAG
CCGTTGCCGTCCTTAGCAGCAGTGAAGGTGTTAGTGGCACCATCTTCTTCACTCAGGATGGAGATGCACCAACCA
CAGTTACTGGAAATGTCTCTGGCCTAAAACCCGGATTTCATGGCTTCCACGTCCATGCCCTTGGTGATACCACAA
ATGGCTGCATGTCAACAGGACCACATTACAATCCTGCTGGTAAGGAGCATGGTGCTCCTGAAGATGAGGTGCGTC
ATGCTGGTGATCTTGGTAACATCACAGTTGGGGAAGATGGTACTGCATCTTTTACCATTACTGACAAGCAGATTC
CTCTTGCTGGTCCACAATCCATCATTGGAAGAGCTGTAGTTGTTCATGCTGATCCTGATGACCTTGGAAAGGGAG
GACACGAGCTCAGTAAAACCACTGGAAATGCTGGTGGAAGGGTTGCTTGTGGTATCATCGGCCTCCAGGGTTAAT
TACTCATGTACCATGAAGATTCTCAGCTACTACTAGTGGAGGGATCTTTGAATAAGGTTTCATTGGAGCTATTGA
GCATTGTTTTCTATGTTTCATGTGATGCTTTTTGTTTTTGAGGTGAACCAATCATACATGATGTAGATCTAATTT
CCAGTGTGTGAGTTGTACTAGTTTCTGCCAACAAAACATTAACCGTAATAAAACAGTCCTTAGCATTGCTGGTTT
CTTAGATTTGAATGTTGTCAATTCAATTGGATGGTTTCGAGGCAATACAATTCATATGGATGGAAAAGACAGCCT
GCGATTTTTTTATCATATATTGCG

> SEQ ID NO:1558 136729 1119883_301901_1b
TTTCTGTGTGGCTTCAAAATCCCCATCCCTTCTCTTATCCCATCACTCTCTCTCTCTTTCTCTCTCTCTCTCT
CTCTCATAGCTAGCATGGGGGTGAAGGCGGTGGTAGTCCTATCAGGCAGTGCTGGTGTGGGAGGTGTTGTCCATT
TCTCCCAAGAGGACCCCCATGGTCCTACAACTGTTGAGGGTACTCTTAGCGGCCTTTCCCCTGGATTGCATGGAT
TTCATGTGCACGCCCTTGGTGACACCACAAATGGCTGCATGTCCACAGGTCCGCACTACAATCCGGCCAGTAAAG
AACACGGGGCTCCGGAGGACGATAATCGCCATGCGGGAGACTTAGGGAATATCATTGTTGGACCTGATGGTTACG
CAAAGATCTCAATTGTAGATAAAGAGATTCCTTTGCTTGGAGCTAGTTCAATCATTGGTCGTGCCGTTGTTGTCC
ATGCTGATCCTGACGATCTAGGCAAGGGTGGTCATGAGCTGAGCAAATCAACTGGAAACGCCGGAGGGAGACTTG
CGTGTGGTGTCATTGGTCTTCAGGCTGCTGCTTGAAGAAGCCTAGGCTTTACCCCCCTACTTGCTGGTATTTTCA
TACTATATCTTGCTCTTTATTAAAGAATTGTATCTTTCTATCTTTGCCCAAGACAACAAAACAGAGAACATGTTA
CCAGCTAGAGA

> SEQ ID NO:1559 136729 1114417_301845_1b
GAGATGGGGTTGAAGGCAGTGGCAGTGCTTTCCGGTAGCGCAGGAGTCGCTGGTGTCGTCCATTTCTCTCAGGAC
ACTCCCAATGGCCCTACAACTGTGGTTGGTTCTCTTAGCGGGCTTTCCCCTGGATTGCATGGATTTCATGTCCAT
GCCCTTGGTGACACCACAAATGGATGCATGTCCACAGGTGCTCACTACAATCCTGCCAACAAAGTGCATGGGGCT
CCAGAGGATGAAGATCGCCATGCTGGAGATTTAGGAAATGTCACTGTCGGAGATGATGGGAAGGCACAGCTCTCA
ATTACAGACTGCCAGATTCCTTTGGATGGACCTAATTCAATCATTGGCCGTGCTGTTGTTGTACATGCTGATCCT
GATGATCTAGGCAAGGGTGGTCATGAGTTGAGCAAAACTACTGGAAATGCTGGAGGAAGACTTGCGTGTGGTGTT
ATTGGTCTTCAGGCTGCAGCTTGAAGGTGTACCCCCTATATGCCTCTATAAGCTTTTTAGGTCTTGTAATGAAGA
AATAATATATTTTCCGAGGGCAGTGAAATAGAGAACCTGTCATACAATCAAGC

> SEQ ID NO:1560 136729 144840_200137_1b
GTCAACAATTATATTCTCTCTTGGATTGTTGAGACATATATCCTCATTCTTAGGCATGCTGTTTCTATCTGTACT
GTCCTAATGATAAGCTGATACTGATGCCAATTTCTGAAGATAATATACAAAGGTAAGGAATGTCTGAAAGTTAAG
TATAGCTACAACAACGACTACTTTGATAGGAGCAACATGATGAAGTGAGTAACACAAGTACTAAACAGATGACTG
AAGCCCAATAACGCCACAACCAACTCTTGCACCGGCATTCCCAGTTGACTTACTAAGTTCATGTCCACCTCTTCC

Figure 2 continued

```
CAGATCATCAGGATCAGCATGCACAACTACTGCTCTCCCCAAGATGGAGTCTACTCCACCAAGTGGAATCAGCAT
ATCTGAAATTGATATCTCGGCCACCCCATCAAGACCAGCAACAATGTTGCCTAAATCACCGGCATGACGCACATC
ATCAGTGGGAGCTCCATGATCGTTCTTAAGTGGATTAAAATGAGGTCCAGTGGAATTGCAGCCATTGGTAGTATC
GCCCAAAGCATGAATATGGAAACCGTGAAGACCTGGAGCGAGACCAGTAATTCTTCCGCTCACATGGGTAGAGCC
GTTGGGTTGTTGGATGAACTGTAAGGAGCCTTTGACGCTATTGTTACCAGAGATGACAGCCACTGC

> SEQ ID NO:1561  136729  181525_300656_1b
TCAGACAATCTTAGCTGGTGCAACAACAGCAACATCAGCTAAACCACTTCTATCTTCATCGGGGTCAAACCCAAT
TCCTCTTTCATTCTCTTCTATCAGTTTCCCCACATCAAAACGTTCATCTTCAAGGTCTCTTACTGTTGTTTCAGC
ATTGAAAAAGCTGTTGCTGTACTTAAAGGAACTTCTACTGTTGAAGGAGTTGTTACTTTAACTCAAGAAGATGA
TGGTCCAACTACCGTGAATGTTAAGATTTCTGGGCTTACACCTGGACTTCATGGATTCCATCTTCATGAGTTTGG
TGATACTACTAATGGATGTATCTCAACAGGTCCACATTTCAATCCAAATGGATTGACACATGGAGCTCCTTGTGA
TGAAGTCCGTCATGCGGGTGACCTGGGAAACATAACAGCTAATGCTGATGGCGTGGCAGAGGCGACAATAGTGGA
TAGTCAGATTCCATTAAGTGGACCAAATGCAGTAGTTGGAAGAGCTTTGGTGGTTCACGAGCTTGAGGATGACCT
TGGAAAGGGTGGGCATGAGCTCAGCCTTAGCACAGGAAAT

> SEQ ID NO:1562  136729  256590_301673_1b
GCGAATGGCTGCTTGTCCACGGGCGCTCATTTCAACCCAAGGAATCTGGAGCATGGAGATCCAACTGACGATGTG
CGACACGCTGGTGACCTAGGGAATCTTAAAGCTGGCCCGGATGGAACTGTGGACTTCACCATCAAGGATAAACAG
ATTCCTCTCGCTGGGCCGGACTCGATCGTTGGGCGCGCCGTCGTCGTTCATGCTGATCGCGATGATCTTGGCAGA
GGTGGTCACGAGCTGAGCAAGTCGACTGGAAACGCTGGCGGCCGTCTTGCTTGTGGTGTGATTGGACTCCAGGCA
TCTGCTTGAATCCTCTCCAACTCGAAGTATAAAGAGTTTTGCAGCCAGACACTATGAGGAATAAGTGATCTCTAT
ATTAATTTCTGTTTTAACTGNCTTCAAAGTTCTGN

> SEQ ID NO:1563  136729  253376_301625_1b
AGGCTGTCGCTGTTCTTCGAGGAGATTCCAAGGTCTCCGGTACTGTCACTTTCGAGCAGGACTCTGAGTCCGGCC
CCGTCACTGTCACCTACGACATCAAGGGCAACGATCCCAACGCTGAGCGAGGATTCCACGTCCACGAGTTTGGTG
ACAACACCAACGGCTGCACTTCTGCCGGCCCCCACTTCAACCCCTTCAAGAAGAACCACGGTGGTCCCACCGACT
CTGAGCGACACGTTGGTGACCTCGGAAACGTCAAGACTGACTCTGAGGGTGTTGCCAAGGGTGTTCTCAAGGACT
CTCTTCTCAAGCTGACTGGTGACAACTCCATTGTT

> SEQ ID NO:1564  136729  240860_301317_1b
ATCAACTACTTATACTCCCCACACTACCGCCAAAATGGTCAAGGCTGTCGCTGTTATCCGTGGTGACTCCAACGT
CAAGGGCACCGTCACCTTCGAGCAGGCCTCCGAGTCCGCCGAGACCCAGATCTCCTGGAACGTCACCGGCAACGA
TGCCAACGCCGAGCGCGGTATGCACATCCACACCTTCGGTGACAACACCAACGGCTGCACCAGCGCTGGTCCTCA
CTTCAACCCCCACAACAAGACTCACGGCGCCCCCTCCGACAGCGAGCGCCACGTCGGCGACCTGGGCAACTTCAA
GACCGACGCCCAGGGCAACGCCGAGGGCTCCGTCTCGGACAAGTTCATCAAGCTGATCGGCCCCGAGAGCGTCCT
CGGCCGCACTGTTGTCGTCCACGCCGGCACTGACGACCTTGGAAAGGGCGAGAACGAGGAGAGCAAGAAGACTGG
CAACGCTGGCGCTCGTCCCGCTTGCGGTGTTATCGGTATCTCCCAGTAGATGTTGGGACGATGCCGAGGAGTAGC
AAGGAGAACTTGATGATGATGATGAACAACGTGAAAAGAAAGTCACTTGATGATGTTGCGTAGGACAGCTTGTAG
TTTGTCGAATGATAAGCTTTCAAGCACG

> SEQ ID NO:1565  136729  240760_301317_2b
GATCAACTACTTATACTCCCCACACTACCGCCAAAATGGTCAAGGCTGTCGCTGTTATCCGTGGTGACTCCAACG
TCAAGGGCACCGTCACCTTCGAGCAGGCCTCCGAGTCCGCCGAGACCCAGATCTCCTGGAACGTCACCGGCAACG
ATGCCAACGCCGAGCGCGGTATGCACATCCACACCTTCGGTGACAACACCAATGTGCTGCACCAGCGCTGGTCCT
CACTTCAACCCCCACAACAAGACTCACGGCGCCCCCTCCGACAGCGAGCGCCACGTCGGCGACCTGGGCAACTTC
AAGACCGACGCCCAGGGCAACGCCGAGGGCTCCGTCTCGGACAAGTTCATCAAGCTGATCGGCCCCGAGAGCGTC
CTCGGCCGCACTGTTGTCGTCCACGCCGGCACTGACGACCTTGGAAAGGGCGAGAACGAGGAGAGCAAGAAGACT
GGCAACGCTGGCGCTCGTCCCGCTTGCGGTGTTATCGGTATCTCCCAGTAGATGTTGGGACGATGCCGAGGAGTA
GCAAGGA

> SEQ ID NO:1566  136729  238085_301291_2b
GAAGGCTTTAGTTCTATTCATTTGGCTTTGGTGGAGAGACTATGGCGCCCCTCAAGGCAGTGGCTGTTCTTAGCG
GCAGCGCCGGCGTCGCCGGGGTCGTGAGCTTCATCCAGGACGATGACGTGACGACGGTGTCGGGAAGATCACTG
GCTTGGCCCCCGGCGAGCACGGCTTCCACGTCCACGCATTGGGCGATACCACGAATGGCTGCTTGTCCACGGGCG
CTCATTTCAACCCAAAGAATCTGGAGCATGGAGATCCAACTGACGATGTGCGACACGCTGGTGACCTAGGGAATC
TTAAAGCTGGCCCGGATGGAACTGTGGACTTCACCATCAAGGATAAACAGATTCCTCTCGCTGGGCCGGACTCGA
TCGTTGGGCGCGCCGTCGTCGTTCATGCTGATCGCGATGATCTTGGCAGAGGTGGTCACGAGCTGAGCAAGTCGA
```

Figure 2 continued

CTGGAAACGCTGGCGGCCGTCTTGCTTGTGGTGTGATTGGACTCCAGGCATCTGCTTGAATCCTCTCCAACTCGA
TACTTACATACAGTATAAAGAGTTTTGCAGCCAGACACTATGAGGAATAAGTGATCTCTATATTAATTTCTGTTT
TAACTGGCTTCAAAGTTCTGGAATTTGTGTCAA

> SEQ ID NO:1567  136729 171845_300624_1b
GGAGTCTTCCTCATCAGAAATCAGAAGAGGGGAGGGTGGGCAACTCGCAGATCGCCTTCTCGTCGCGCTCGCGCC
GCAGGGGTCGCCTGAGAACACATAGACAATGGTGAAGGCTGTTGCTGTGCTTGCTAGCAGTGAGGGTGTCAAGGG
CACCATCCTTTTCTCCCAAGAGGGAGATGGTCCGACCTCTGTGACGGGAAGTGTCTCTGGGCTCAAGCCAGGGCT
CCATGGATTCCATGTGCACGCGCTCGGTGACACCACTAATGGCTGCATGTCAACTGGACCACACTTCAATCCTAC
TGGGAAGGAACATGGGGCACCACAAGATGAGAACCGCCATGCCGGTGATCTTGGAAATATAACAGCTGGAGCAGA
TGGTGTTGCTAATGTCAATGTCTCTGACAGCCAGATCCCCCTTACTGGAGCACACTCCATCATTGGCCGAGCTGT
TGTTGTCCATGCTGATCCTGATGATCTTGGCAAGGGTGGACATGAGCTTAGCAAGACCACTGGAAATGCTGGGGG
CCGAGTTGCTTGCGGAATCATCGGACTCCAGGGTTAGACGTCTCAACTTTCCAACATACAGAAGCTGTTCATGTT
CGCTCGTATGGATGTTGAAATAAAAATAAGCACCTGATGTATG

> SEQ ID NO:1568  136729 3770_300325_1b
CCCACGCGTCCGGAGAAAATTCAGCATTTTTGATAGCTCAAGCACTTGATTCTTTCCAAAGGGGTTTCCTGAGAT
CACAAAGGCCAAGTAACAATGGCGAAAGGAGTTGCAGTTTTGAACAGCAGTGAGGGTGTTACGGGGACTATCTTT
TTCACCCAGGAAGGCGATGGTGTGACCACTGTGAGTGGAACAGTTTCTGGCCTTAAGCCTGGTCTTCATGGTTTC
CATGTCCATGCTCTTGGAGACACCACTAACGGGTGCATGTCTACTGGTCCACATTTCAACCCCGATGGTAAAACA
CACGGTGCCCCTGAGGATGCTAATCGACATGCTGGTGATCTAGGAAACATCACTGTTGGAGATGATGGAACTGCC
ACCTTCACAATCACTGATTGCCAGATTCCTCTTACTGGACCAAACTCTATTGTTGGTAGGGCTGTTGTTGTCCAT
GCAGACCCTGATGACCTCGGAAAGGGAGGCCATGAACTCAGCCTGGCTACTGGAAACGCAGGCGGCCGTGTTGCT
TGCGGCATCATTGGTCTCCAGGGCTAAAGCTGCTACGTTTCCAAAGAAGAGATTGATGTAATAAGGAGGTCCAAC
CTTAGACCTGGGTTTGGTAGTTGTGTGTATCTTCTGGTGTGTGGCTAAAAACCTTTGAGCTTAGTGTGGCTCAAA
GCATCTTTAATTCAGACAGAAAACAGAGAAAATTCCGTACTTTTATTATTTCATGAATAAAAAAGAGTTGGTTTA
C

> SEQ ID NO:1569  136729 317223_301455_1b
CGGAACATCATACGGATAGCGGCGGCTTGAAGTACGATGATCCGCAAGCACACGGCACCAGCGTTTCCGGTGGTC
TTGTCAGCTCGTGCCACCCTTTCCAAGATCATCAGGATCGGATGCACAACGACGGCTTCTGCAATGATTGAATTT
GGTCCA

> SEQ ID NO:1570  136729 264949_301439_1b
AAAGTTCCAATCTCTTATTTCTTGTTTCAGAATATACATGCTTTCGCTCACATCTCTTACCACAGTAAGTACTTG
TAGTTAAGGTACCACAACACACACAAGAGAAAGTAGCCATTCTAGACCTAGGACCAGGGTTAGATTCCACGTCAC
CCGCCAACTTCAGCAAATCAAAATTCAACAGCTGTTTGTAGAGCTCGGCATAATCCGGAACATCATACGGATAAG
CGGCCGCACCCTGGAGTCCGATGATTCCGCAAGCAACTCGGCCCCCAGCATTTCCAGTGGTCTTGCTAAGCTCAT
GTCCACCCTTGCCAAGATCATCAGGATCAGCATGGACAACAACAGCTCGGCCAATGATGGAGTGTGCTCCAGTAA
GGGGGATCTGGCTGTCAGAGACATTGACATTAGCAACACCATCTGCTCCAGCTGTTATATTTCCAAGATCACCGG
CATGGCGGTTCTCATCTTGTGGTGCCCCATGTTCCTTCCCAGTAGGATTGAAGTGTGGTCCAGTTGACATGCAGC
CATTAGTGGTGTCACCGAGCGCGTGCACATGGAATCCATGGAGCCCTGGCTTGAGCCCAGAGACACTTCCCGTCA
CAGAGGTCGGACCATCTCCCTCTTGGGAGAAAAAGATGGTGCCCTTGACACCCTCACTGCTAGCAAGCACAGCAA
CAGCCTTCACCATGCTTAATTAATGCGAAGGTAAATACAGTAGATTTAAACATCAGGACCTAGAGTTCACCACTC
GAAGTCTTTTCTCAGCTTCTTATCCACAAATTTCCCTTCACAATTAAACAGCAACTTAAACTTATTAAAGTCAAA
GATATGATAACATAAAGAAACCAAAGCAGAAATAGCACTATAAGGGGATCGATATCTATCCACTAAAGCCTTATC
CAAAGCATCAAGCACCTTAAAGT

> SEQ ID NO:1571  136729 138891_300706_1b
CCCACGCGTCCGCGGACGCGTGGGTGGGAGCGAAGCGGCAGAGAATGGCAGGGAAAGCCGGCGGCCTCAAGGGCG
TCGCCCTCATCGGCGGCGCCGGCGGCAACAGCGCGGTCGCCGGCGCCCTCCACTTCTTCCAGGACCCCTCCACCG
GGTATACCGAGGTGAGGGGAGGGTCACCGGCCTCGCTCCGGGCCTCCATGGCTTCCACATCCACTCCTTTGGCG
ACACCACCAACGGCTGCAACTCTACCGGGCCCCATTTTAATCCTCACAATAAGTCCCATGGGGCACCATCTGATG
ATGAAAGACATGTGGGCGACCTGGGAAACATAGTAGCCAACAAAGATGGTGTTGCAGATATCTTCATAAAGGACC
TACAGATNTCACTAAGCGGGCCTCATTCCATATTGGGAAGGGCAGTTGTTGTTCATGCTGATTCTGATGACCTAG
GAAGGGGTGGTCATGAACTCAGTAAAACAACAGGAAATGCAGGAGCAAGAATTGGATGCGGTATCATTGGACTTC
GATCTGCAGTTTAACAATCTATAGTCATGA

> SEQ ID NO:1572  137131 170330_301609_1b

Figure 2 continued

ATTCACCTCATGTTCTGCTTGCAAAGTTTCAATACACTGGAGTGAGTCAGTGAGGTTGGTGAAGCAGAGTGAGGA
AAGGAGGATGGGAAGGGTGGCGCCTAGCGTCGAGGAGGTCGGGGGCGAGCAGCCGCCGCCCGCGCTTGGGCCCGG
CGAGACCGTGAGCGGGACGGTGGCCGAGCTGAGGGCGGCGTACGAGAGCGGCAGGACGCGGAGCCTGGAGTGGAG
GCAGTCGCAGCTCCGGGGGCTCCTCCGGCTCTTGGCGGAGGAGGAGGCCGCCGCGTTCCGGGCGCTCCGCGAGGA
CCTCGGCAAGCACCAAGCCGAGGCCTACAGAGACGAGATCGGCGTGCTTGTCAAGTCGGCGAACGCCGCGCTGCG
TGAGGTCGGGAAATGGATGGCGCCGGAGAAGGTCTGGGTGCCGCTAATCGCGTTCCCGGCAAGGGCGCAGCTGGA
GCCGCAGCCGCTCGGGGTCATCCTCGCCTTCTCTTGCTGGAATG

> SEQ ID NO:1573 139377 135694_300416_1b
CCCCCCGACTCACACACACACTCCTCATCCCAGAGCAAGAAGCTCAGCTCCTCCTCCTCTCGCATGGCAGCCATG
GCCACCACCGCGTCCAGCCTCCTCAAGACCTCCTTCGCCGGCGTGCGCCTCCCCGCCGCCGCCCGCAACCCCACC
GTCTCCGTCGCGCCGCGCACCGGAGGCGCCATCTGCAACTCCATCTCGTCGTCGTCGTCCACTCCCCCCTACGAC
CTCAACGCCATCAGGTTCAGCCCCATCAAGGAGTCCATCGTGTCCCGCGAGATGACCCGGCGGTACATGACCGAC
ATGATCACCTACGCCGACACCGACGTCGTCGTCGTCGGCGCCGGCTCCGCGGGGCTCTCCTGCGCGTACGAGCTC
TCCAAGGACCCCTCCGTCAGCGTCGCCGTCATCGAGCAGTCGGTGTCCCCGGCGGCGGCGCGTGGCTCGGCGGG
CAGCTGTTCTCCGCCATGGTGGTGCGCAAGCCGGCGCACCTGTTCCTCGACGAGCTCGGCGTCGCGTACGACGAG
CAGGAGGACTACGTCGTCATCAAGCACGCCGCGCTCTTCACCTCCACCGTCATGAGCCGCCTCCTGGCGCGCCCC
AACGTGAAGCTGTTCAACGCCGTCGCCGTCGAGGACCTCATCGTCAAGGAGGGCCGCGTCGGCGGCGTGGTCACC
AACTGGGCGCTGGTGTCGATGAACCACGACACGCAGTCGTGCATGGACCCCAACGTGATGGAGTCCAGGGTGGTG
GTGAGCTCCTGCGGCCACGACGGGCCGTTCGGCGCCACGGGCGTCAAGCGGCTGCAGGACATCGGCATGATCGAC
GCCGTGCCCGGCATGCGCGCCCTCGACATGAACACCGCCGAGGACGAGATCGTCCGCCTCACCCGCGAGGTCGTC
CCCGGCATGATCGTCACCGGCATGGAGGTCGCCGAGATCGACGGCGCCCCGAGAATGGGCCCGACGTTCGGAGCC
ATGATGATCTCCGGCCAGAAGGCGGCGCACCTGGCGCTGAAGGCGCTCGGCCGGCCGAACGCCATCGACGGCACG
ATCAAGAAGGCGGCGGCGGCGGCGGCGCACCCGGAGCTGATCCTGGCGTCGAAGGACGACGGCGAGATCGTG
GACGCCTGAGCGAATAGAACAGGGTAAAAAAAAATCCGCAAGACGTGGTGGTGACACGGAGGCGTTGGGGACGAG
AAGAAGATGTGGACTTTCCCCTGTGTTTTTTTTTCGGGATTTGCTTTGATCCCCTTGTTTGTTTTAGCTCTGGA
TGTTGATTAGCGTCTTGTTCATAGCAATTCCACTGCCACCGTGTGTGTGCTCTGCTTGCCTGATGAGGGCAAG
AAAACTTCCATGGATCCGTCTCTCTGGGAGGAATGAATAAAAAGGATGAGGAAATAAAAATGATTCAGTGCCATT

> SEQ ID NO:1574 139377 227981_301032_1b
CTAGCTGATTAATTAAGTCGACCCACTGCGTCGTGATGATCTCCGGCCAGAAGGCGGCGCACCTGGCGCTGAAGG
CGCTCGGCCGGCCGAACGCCATCGACGGCACGATCAAGAAGGCGGCGGCGGCGGCGGCGCACCCGGAGCTGATCC
TGGCGTCGAAGGACGACGGCGAGATCGTGGACGCCTGAGCGAATAGAACAGGGTAAAAAAAAATCCGCAAGACGT
GGTGGTGACACGGAGGCGTTGGGGACGAGAAGAAGATGTGGACTTTCCCCTGTGTTTCATTGTTCGGGATTTGGT
TTGATCCCCTTGTTTGTTTTAGCTCTGGATGTTGATTAGCGTCTTGTTCATAGCACTTCCACTGCCACCGTGTGT
GTGTGCTCTGCTTGCCTGATGAGGGCAAGAAAACTTCCATGGATCCGTCTCTCTGGGAGGAATGAATAACAAGGA
TG

> SEQ ID NO:1575 139377 183150_300619_1b
CCCCCCGAGTCACACACACACTCCTCATCCCAGAGCAAGAAGCTCAGCTCCTCCTCCTCTCGCATGGCAGCCAT
GGCCACCACCGCGTCCAGCCTCCTCAAGACCTCCTTCGCCGGCGTGCGCCTCCCCGCCGCCGCCCGCAACCCCAC
CGTCTCCGTCGCGCCGCGCACCGGCGGCGCCATCTGCAACTCCATCTCGTCGTCGTCGTCCACTCCCCCCTACGA
CCTCAACGCCATCAGGTTCAGCCCCATCAAGGAGTCCATCGTGTCCCGCGAGATGACCCGGCGGTACATGACCGA
CATGATCACCTACGCCGACACCGACGTCGTCGTCGGCGCCGGCTCCGCGGGGCTCTCCTGCGCGTACGAGCT
CTCCAAGGACCCCTCCGTCAGCGTCGCCGTCATCGAGCAGTCGGTGTCCCCGGCGGCGGCGCGTGGCTCGGCGG
GCAGCTGTTCTCCGCCATGGTGGTGCGCAAGCCGGCGCACCTGTTCCTCGACGAGCTCGGCGTCGCGTACGACGA
GCAGGAGGACTACGTCGTCATCAAGCACGCCGCGCTCTTCACCTCCACCGTCATGAGCCGCCTCCTGGCGCGCCC
CAACGTGAAGCTGTTCAACGCCGTCGCCGTCGAGGACCTCATCGTCAAAGAGGGCCGCGTCGGCGGCGTGGTCAC
CAACTGGGCGCTGGTGTCGATGAACCACGACACGCAGTCG

> SEQ ID NO:1576 167904 1046530_301924_1b
GAGAGAGAGAGAGGAGAGAGAGAGAGAGACTCCACCATGACCGCCATTACTGCCCTCACTCCGACCTCCCTTG
AACAGAATTGCACAGCCAGACGCATACCTTCCCCTTCTTCCTCTTCCTCCCTTGTCCCCCTTCCCCGTCGCCTCC
GCCTCTCCCGCCCGCACCCGCACGCAAGACGGCTCAGCCTTCGCGCGGAAGCCCCCGGGGGTGACCCCGCCGCTG
TCCTCGAGCCCGCCTCGAAGGAGGACCCCATCCAGCAGTTCCTCAAGCGCGACTACAAGTGGGGTTTTGTCTCCA
ACGTGGAGTCCGAGTCCATCCCCAAGGGCCTCTCGGAGGAGACCGTCCGCCTCATCTCTGCCAAGAAAGCCGAGC
CGGAATGGCTCCTTGAGTTTCGCCTCAAGGCATACCGCCGGTGGCTCAGCATGGTGGAGCCCAAGTGGTCGGACA
ACGAGCACCCGAAGATCGATTTTCAATCGTTTCACTACTACACAGAGCCGAAGCGGAAGGAAACGAAGGCAAGCT
TGGACGAGGTCGATCCGGAGCTGCTCGAGACGTTCCGGAAACTGGGCATACCCATAACTGAGCAAAAGCGGTTGG

Figure 2 continued

CCAACGTTGCTGTGGATGCAGTATTTGATAGTGTATCGATCGC

> SEQ ID NO:1577  168371  1044387_301917_1b
ACACACCTCATCTAGTGATAGTAATGGGATCATTCTGTAGAAGGCCAATGAGTCGGTTGGTGAAGAGAGCTATTG
ATGGCCATGCACATCCCACTATGTTCTTCAGCTCCCTTACAGCCCATGCTCATGCCCATCCTCATCATCACCTCC
ATATCAAGACCGATGTCTCTCAGGTGGTGGGAAGAACTCCTATTGTGTTCCTTAACAAGGTGACTGAAGGCTGCG
GTGCCTACATTGCTGCAAAATTGGAATTGATGCAGCCTTGCAATAGTGTGAAAGATAGAATTGGGTACAAAATGA
TTGCTGATGCAGAGGCAAAGGGGCTTATCTCTCCAGACAAGACAGTACTTGTGGAGCCCACATCTGGCAACATGG
GAATCGCCCTCTCTTTCATTGCTGCAGCCAAGGGCTACAACCTGATCTTGACAATGCCCTCATACACAAGCATTG
AGCGCCGAGTCACAATGCGCGCCTTTGGCGCCCAACTCACCCTCACTGACCCTTCCAAAGGGATGGGTGGAACTG
TCAAAATGGCTTATGAAATTGCGGACAAAACTCCCGGTGCTTTCATGCTTCAGCAGTTTGAGAATCCCTCCAATG
TCCAGGCACACTTTGAGACAACTGGACCTGAGATATGGGAAGATACTGTGG

> SEQ ID NO:1578  168371  14076_300245_1b
CCCACGCGTCCGGGTTATTGACTTTCTCATTCAGTGAAGCTTGAATCATGGCCTCGAGAATTGCTAAAGATGTGA
CTGAATTGATTGGGAACACTCCATTGGTGTATTTGAACAATGTTGCTGAAGGATGTGTTGGTCGTGTTGCTGCTA
AGCTTGAGATGATGGAACCGTGCTCTAGCGTCAAAGACAGGATTGGTTTTAGCATGATTTCTGATGCAGAAAAGA
AGGGTCTTATCAAACCAGGAGAGAGTGTGCTGATTGAGCCAACAAGTGGAAACACTGGAGTT

> SEQ ID NO:1579  168371  180861_300625_1b
GAATTCAACAGCAATGGCTTCTTCTTCTCTTTGTTCCAACCCATTAACTTCTATACCCAAATCTAAATTAGGGTT
CTCTTCTTCTACTTCTAAAACCCAATCTTCTTTCGTTAATTTGAGAAAATCATCAACTCAATTTGCTAGAAAACA
ACTCTCACAGTCTTCTGTTGTTGTTTGTAAGGCTGTTTCTGCTGAACCATCTACTCAAATTGAAGGTCTTAACAT
TGCTGAAGATGTTTCTCAGCTTATTGGAAAGACACCTATGGTTTACCTCAATACTATTGCCAAGGGTTCTGTTGC
AAATATTGCTGCCAAGCTTGAGATAATGGAACCCTGTTGCAGTGTTAAAGACAGGATGGGTTTAAGTATGATTAC
TGATGCCGAGGAAAAGGGGCCTATAACACCTGGAAAGAGTGTCTTGGTGGAACCAACCAGTGGAAACACAGGTAT
CGGTCTTGCCTTTATTGCTGCTGCAAGAGGATACAAACTCATCTTAACTATGCCTGCATCAATGAGTATGGAAAG
ACGAGTCCTTCTGAAGGCATTTGGGGCAGAGTTAGTTCTTACAGAATCCGCCAAGGGTATGAAAGGAGCTCTTGC
AAAAGCAGAAGAGATAGTAAATAAGACACCTAATTCTTACATGCTTCAACAGTTTGACAACCCAGCTAATCCAAA
GATTCACTTTGAAACAACTGGTCCTGAGATTTGGGGAGATACAAGAGGCAAAGTAGATATATTTGTCGCAGGAAT
TGGTACTGGTGGAACTATTTCTGGGGTTGGTCGGTACCTAAAGAAACAAAATCCCAACGTAAAGATTATTGGTGT
TGAGCCAACAGAAAGCAACGTACTTTCAGGGGAACACCTGGACCTCACAAAATTCAAGGGATTGGAACAGGCTT
TATACCTGGAAAT

> SEQ ID NO:1580  168371  175142_300530_1b
ACCGCCGGCAGTGACCAGCAGCAACCAATCAGCAAATCAGCAATGGAGAGGGCTCTGATGAGCCTCATGAGGCGG
CGCTCCCTCCTCCAGAGCGGCGGACGAGCACCGCCGGCGATGGCCGCCGCCGCCGGTGGCTCACCATTCTTCTCC
ACCCTGCAGCAAGCAGCCGCCGCAGACCCGGTCCAGTCGCCTGGCATCTTGCCAGGGCTCAAGATCAGGGACTCT
GCGTCACAGCTGATTGGGAGGACACCCATGGTTTACCTGAACAAGGTCACTGAAGGATGTGGGGCCCGGATTGCT
GCTAAGCTCGAGTTCTTGCAGCCGTCCTTCAGCGTCAAGGACAGACCAGCAATTTCAATGTTGGAAGATGCTGAA
AAGAAGGGGTTGATCACCCCAGGCAAGACCACACTGATCGAGCCGACATCAGGGAACATGGGTATTGGCCTGGCA
TTCATGGCTGCTCTTAAAGGGTATGAACTCATACTCACAATGCCTTCATACACCAGCCTTGAGAGGAGGGTGACC
ATGAGGGCCTTCGGCGCAAAACTCGTCCTTACCGACCCAACAAAAGGTATGGGAGGCACGGTGAGGAAGGCCGCC
GAGCTGTATGAGAACCATCCTAGCGCGTTCATGCTGCAGCAGTTTGAGAATCCTGCAAATGTCAAGGTACACTAT
G

> SEQ ID NO:1581  168371  189494_300606_1b
GAATTCCAGCTGACCACCATGTCACAAGAAACAAAAATGCTACCTTCTCTGTCTAGTCTTCTATCGGGAACCGAA
ATCTCGTCCAGCCCCGTATCACCAAGCTTCACTAATCCAAGAACGAGTTTTCACCTCGATGATCGCGGAACCATA
AAATTACCACCGCTAAACACCAGTATCAATCGTCCAAGATCTGTGGAAAGCGCCTTGAGACACACTGTTACATCC
TTGCATGAAAATAGCAGCGCTTATGGTGATGACATGCTCAAGCACACGCAATCAGACTCAGCCCTCTCATCTCAG
TTGAATAGTTCTCAAGAAACAGTTGATGAATCACACGAAAACCTTCTACTGACTCCCCTAAATAGCAAAAAGAGA
GATTATTCGGTTTCTTCAAAGAAAAACGACATATTAACACCACTCTCTGCAGCGAAGTCGATTATTATCCCCTCT
GCCTCTAAGGAAAAAAGACGTGCATTTGCTTTCATCACACACTCGCAGGAGACCTTCCCTAAGAAGGAGCCTAAG
ATCGACAACGCTCCACTAGCACGCCGAAAGAGAAGAAGAACCTCGTCCCAGGAACTATCTATTCTTCAGGCTGAA
TTTGAAAAATGTCCTGCTCCATCGAAGGAGAAACGAATTGAGTTAGCTGAATCTTGCCATATGACTGAAAAAGCC
GTTCAAATATGGTTCCAGA

> SEQ ID NO:1582  168371  226705_301004_1b

Figure 2 continued

AACACCTCCGAGTCCGAGCAACGCAAGATGGCGTCGTGGTCGTCGCCCGTCGCCGCCGCCGCCTTGGAGGTCCAT
TTCGGGTCCTCCTGCTTCTTCTCCGCCCGATCGCCACGACAGACCCTCCTCCTACCACCTCTCGCCCGCAACCCT
ACACTGACCATCCAGCCCCGGCCCCATCCCTTCCGGAACATCAACTCCTCCTCCTCCTCCAGCTGGATGTGCCAC
GCCGTCGCCGCCGAGGTCGAGGGCCTCAACATCGCCGACGACGTCACCCAGCTCATCGGCAAGACTCCAATGGTA
TATCTCAACAACATCGTCAAGGGATGTGTTGCCAATGTCGCTGCTAAGCTCGAGATTATGGAGCCCTGTTGCAGT
GTCAAGGACAGGATAGGATACAGTATGATTTCTGATGCGGAAGAGAAAGGCTTGATAACTCCTGGAAAGAGTGTT
TTGGTGGAACCAACAAGTGGAAATACAGGCATTGGTCTTGCCTTCATTGCTGCTTCCAGAGGATATAAATTAATA
TTGACCATGCCTGCATCAATGAGCATGGAGAGAAGAGTTCTACTCAAAGCTTTTGGCGCTGAACTTGTCCTTACT
GATGCCGCAAAAGGGATGAAGGGGGCTGT

> SEQ ID NO:1583 168371 190718_300779_1b
CCCAGTGAGCCACAGCACCGCCGGCAGTGACCAACAGCAACCAATCAGCAAATCAGCAATGGAGAGGGCTCTGAT
GAGCCTCATGAGGCGGGCTCCCTCCTCCAGAGCGGCGGACGAGCACCGCCGGCGATGGCCGCCGCCGCCGGTGG
CTCACCATTCTTCTCCACCCTGCAGCAAGCAGCCGCCGCAGACCCGGTCCAGTCGCCTGGCATCTTGCCAGGGCT
CAAGATCAGGGACTCTGCGTCACAGCTGATTGGGAGGACACCCATGGTTTACCTGAACAAGGTCACTGAAGGATG
TGGGGCCCGGATTGCTGCTAAGCTCGAGTTCTTGCAGCCGTCCTTCAGCGTCAAGGACAGACCAGCAATTTCAAT
GTTGGAAGATGCTGAAAAGAAGGGGTTGATCACCCCAGGTAAGACCACACTGATCGAGCCGACATCAGGGAACAT
GGGTATTGGCCTGGCATTCATGGCTGCTCTTAAAGGGTATGAACTCATACTCACAATGCCTTCATACACCAGCCT
TGAGAGGAGGGTGACCATGAGGGCCTTCGGCGCAAAACTCGTCCTTACCGACCCAACAAAAGGTATGGGAGGCAC
GGTGAGG

> SEQ ID NO:1584 168371 50708_300156_1b
TGATTGAGCCAACAAGTGGAAACACTGGAGTTGGGTTAGCATTCACGGCAGCTGCCGAAGGCTACAAGCTTATTA
TTACAATGCCAGCTTCTATGAGTACTGAGAGAAAAATCATTCTCTTAGCTTTTGGAGTTGAGTTGGTTTTAACTG
ACCCAGCTAAGGGCATGAAAGGAGCTATCGCAAAGGCGGAAGAGATTTTGGCGAAAACACCCAATGGTTACATGC
TTCAGCAGTTTGAGAACCCTGCCAACCCTAAGATCCACTATGAGACTACCGGACCTGAGATATGGAAAGG

> SEQ ID NO:1585 168371 271263_200032_1b
ATTGTATCTAGCCTGAAAAAGAGGGAAGATAGAGATAGCTTGAGCAAATAGCAATGGCGACTTTCATCAACAATC
CCTTGACTTCACTCTGTTCCAACACCAACAAGTCTGAAGCTAATCTCTTCAGAATTTGCCCTTTAAGGGCTCAGA
CTTTGGGGATTTCCAAGTTTATCCCCAACAGAAAGGTTACTTTCCCTTCTATTGTTTGCAAAGCAGTGTCTGTGC
AACCAAAATCAGCCACTGAAGTTGAAGGACTTAACATCGCTGAGGATGTTACTCAGCTTATTGGGAACACACCAA
TGGTTTACCTTAATACAATCGTTAAAGGTTGTGTTGCAAACATTGCTGCTAAACTTGAGATTATGGAGCCATGCT
GCAGTGTCAAGGACAGGATAGGGTTCAGTATGATATCTGATGCTGAGGAAAAGGGACTTATATCTCCGGGGAAGA
CTGTTCTAGTGGAACCTACGAGTGGAAACACAGGCATTGGGCTTGCCTTCATTGCTGCTTCCAGAGGATACAAGC
TCATCTTAACGATGCCTGCTTCAATGAGTCTTGAAAGAAGGGTTCTTTTGAAAGCTTTTGGAGCTGAACTTGTTT
TAACTGACCCAGCCAAAGGGATGAAAGGAGCTGTTTCAAAGGCTGAAGAAATATTGAATAACACACCAGATGCCT
ATATCCTTCAACAATTTGACAATCCCGCAAACCCCAAGATACACTATGAAACAACGGGCCCAGAGATCTGGGAAG
ATACAAAAGGCAAGATAGACATACTTGTTGCAGGCATTGGAACTGGCGGAACCATTTCAGGAGCAGGGCGATTCC
TGAAAGAGCAAAATCCAAACATTAAGATTATTGGTGTGGAGCCCACAGAAAGTAATGTACTATCAGGGG

> SEQ ID NO:1586 168371 265560_200112_1b
CCCACGCGTCCGGCGGGAGAAAAGAATGGAATTGCGAAGGATGTAACTGAATTGATCGGTAACACTCCTTTGGTG
TACCTGAATAATGTTGTGGATGGGTGTGTTGCTCGCGTTGCTGCCAAGCTCGAAAGCATGGAGCCATGCTCTAGT
GTTAAGGATAGGATTGGTTATAGTATGATTACAGATGCTGAGGAGAATGGCCTGATCAAACCTGGCGAGAGTGTC
CTCATTGAACCTACAAGTGGAAACACTGGAGTAGGATTGGCATTTATGGCTGCTGCTAAAGGCTACAAACTCATC
ATAACGATGCCTTCTTCAATGAGTCTTGAGAGGAGAATTATTTTGCGTGCTTTTGGTGCTGAGTTGGTGCTTACC
GATCCAGCAAAAGGGATGAAAGGTTCTATTCAGAAGGCTGAAGAGATTAAGGCCAAAACACCTAACTCCTTTATT
CTTCAGCAATTTGAAAACCCTGCAAACCCAAAGGTACACTATGAGACAACTGGTCCTGAGATCTGGAAAGGCTCA
AACGGGAAAGTAGATGCTCTCGTCTCTGGAATTGGAACAGGAGGCACAATAACAGGTTCAGGCAAGTATTTAAGA
GAGCAGAACCCCGACATAAAGCTCTATGGTGTGGAACCAGTTGAAAGTGCTATTCTTTCTGGAGGAAATCCTGGT
CCGCATAAGATTCAGGGGATTGGTGCTGGTTTCATTCCTGGTGTTTTGGAAGTTGGTCTTATTGATGAAGTAATT
CAAGTTTCAAGTGAAGAAGCCATAGAAACTGCAAAGCTTCTGGCATTAAAGGAAGGTTTGCTTGTGGGCATATCA
TCTGGTGCTTCTGCTGCTGCAGCAATCAAACTTGCTAAGCGCCCTGAAAATGCTGGGAAGCTGATTGTTGTTGTT
TTCCCAAGCTTCGGGGAGCGATATCTTTCCTCTGTGCTCTTTGAAT

> SEQ ID NO:1587 168371 242765_301332_1b
CACGCGTCGATTGGAGGCTGGAATGGCTCAAGAGGTTGCCAAGGGTCACGAATTCCAGTCCATGGACGCTGGGCT
CAAGTCGCTGGGCATGGATGGCGCCGCCAAGCCCGGGGTTCTGCGCCGCCGCGCATCGCCCGAGCTTCGATCGGA

Figure 2 continued

CTTCTCGGGAGGTAAGCTCAGCGCCGGGCTGGCCAAAGATCCGGCGCTCAAGGATGGCGAATTGTCCGGCGTCAA
TATCGCTGAGGATGTCACACAGTTGATTGGAAAAACTCCAATGGTCTATCTCAACAGCGTGGTGGAAGGATGTGT
CGCAAACATTGCTGCGAAGCTGGAGACCATGGAGCCATGCTGCAGCGTGAAAGATCGTATTGGCTTGAGCATGAT
CGCCGACGCCGAGGCCAAAGGAGCCATTTCTCCTGGAAAGAGCGTCCTCGTGGAGCCTACGAGCGGCAACACTGG
AATTGGTTTGGCATTCATCGCTGCTGCCAAGGGCTACAAGCTGATCCTCACCATGCCGGCGTCCATGAGCATGGA
ACGTCGAGTTCTACTCCGCGCCTTCGGTGCCGAGCTCGTCGTCACCGATCCTGCCAAAGGAATGAAAGGAGCCGT
TTCCAAGGCCGAAGAGATCGTCAACAAGACACCAAACGCGTACATGCTTCAGCAATTCGAGAATCCTGCTAATCC
GAAAATCCATTTCGAGACCACTGGACCCGAGATCTGGGAAGATACACGCGGAAAAATCGATATCCTTGTTTCAGG
AATTGGAACCGGTGGTACCGTGACTGGTGCCGGACGGTTCCTCAAGAGCAAGAACCCGAATATCAAGCTTGTTGG
TGTGGAGCCGACTGAGAGCAATGTCTTGTCCGGCGGGAAACCAGGGGCTCACAAGATTCAAGGAATGGGAGCTGG
ATTCATACCCGGCATCTTGGACGTCGGAATTCTTGACGAGGTGGTGGAGATATCCAGCAACGAGGCAGTAGAGAT
GGCGAAGCAGCTCGCGCTCAAGGAAGGCCTGCTTGTTGGCATCTCGTCGGGAGCTGCTGTTG

> SEQ ID NO:1588 168371 230304_301056_1b
CCACGCGTCGAAGAAAAGAATGGCGACTGGCGCTGCTGCCGCGGGTGGAATCAGCGTGGTTCTGGGGAATGCCGG
GTGCGGCAGGAGAGAGCCAGCGGTCGCGGTGGCGATGCAGCGCCGGATGGTCCCGTCAATGCTCCGGATCCAGCG
AGGGAAGATTGTGACGTCGCCCAGGGCGAGGATTGCGATCTCGGCTGTCTCTACAGAGGTCCAGCAAGAGGCTGC
CGATGCTGAGCCGGAAGAGGGGCTCAACATCGCGGAAGACGTGACTCAGCTCATCGGGAAGACGCCTATGGTCTA
CTTGAACAGTGTCGTCGATGGTTGTGTTGCAACGTCGCTGCCAAGCTGGAAATCATGGAGCCATGCTGTAGCGT
GAAAGATCGGATAGGATACAGCATGATCTCTGATGCCGAAGAGAAGGGAGCAATCACTCCCGGCAAGAGTGTACT
GGTAGAGCCTACCAGTGGCAACACGGGAATTGGACTGGCATTCATAGCTGCGGCGAAAGGTTACAAGCTCATTCT
AACCATGCCTGCGTCCATGAGTCTCGAGAGGCGTATTTTACTGAAGGCCTTTGGTGCTGAGCTTGTCCTCACCGA
TCCCGCCAAAGGCATGAAAGGTGCAGTGCAGAAGGCTGAGGAAATACTGAAGAGAACTCCAAATTCTTACATGCT
TCAACAGTTT

> SEQ ID NO:1589 171278 1171012_302052_1b
GGCGGAGGAGGAGAGGGGCTTCGAACTCTGTGGCGAGTCTTCGGAGAAGGGGGAGGGAGAATGAGTCTTCAGAGC
GTGAGCACGCGAGTGGGGAAGTACGAGCTGNGAAGAACCCTTGGAGAGGGAACATTTGCAAAGGTCAAATTCGCC
ACTAATACCGATTCTGGTCTTTCCGTCGCCATCAAAGTCCTTGATAAGGATAAAATCCTCAGACACAAGATGGTC
GAACAGATAAAGCGTGAAATTTCGACAATGAAGCTGATCAGGCATCCAAATGTTGTACAGTTATATGAGGTTACA
GCTAGCAAAACAAAAATCTACATTGTTCTGGAACTCGTCACTGGGGGCGAGTTGTTCGATAAAATTGTTCATCAT
GGAAGACTTAAGGAGGATGATGCGAGGAGGTATTTCCAACAACTTATCAATGCGGTTGATTTTTGCCATAGCAGA
GGAGTTTGTCACAGG

> SEQ ID NO:1590 171278 120277_300383_1b
GTGAATTGTTCGCGAAGGTTGCCAAAGGAAGGTTAAGAGAAGATATAGCACGTGGCTATTTTCAGCAATTGATTT
CAGCTATTGATTTTTGTCATAGCCGCGGAGTTTATCATAGGGATTTAAAGCCTGAGAATTTGTTGTTAGATGAAG
AAGGTAATCTTAAGGTTACAGATTTTGGGCTTAGCGCGTTTTCGGATCATTTAAGGCAAGATGGTTTGTTGCATA
CAACTTGTGGTACCCCTGCTTATGTTGCACCTGAAGTAATTGGTAAAAATGGCTATAATGGTGCAACAGCTGATA
TTTGGTCATGTGGTGTAATTCTTTATGTACTTATAGCTGGTTTTTTACCATTTCAAGACGAGAATATTATGGCTA
TGTATAAGAAAATTCATAGGGGTGATTTTAAATGTCCACCTTGGTTTTCATCAGATGCAAGAAAGTTGATAACAA
GAATGTTGGATCCGAATCCGAGTACTCGAATCACTGCTTCAAAAATTATGGATTCCTCTTGGTTTAAGAAATCTA
TGCCAAAGACATTGAAGACTAAGGAGGAGGAAGAATTTGGCGTANGAAAGGCGAAAATGATTGAGTCTTTAAATG
CTTTTCATATCATATCTTTATCGGAGGGGTTCGATTTATCACCTTTGTTTGA

> SEQ ID NO:1591 171278 155978_301361_1b
CCTGCATTCCATGAATCTAGTTACAATCTTTACATTAACCCAAATGCCGAACTAATCCCTTAATTTTCCCAATCC
TTTCTTCTTCAATTTCATACCACCGCTTCTCTGCATAGCTCTTCTCTTTACGTTGCTTTTCAACGCAGCTTCATC
GCTCCACGCCGGAAAATGGATGGATCAACAGTCCAAGGTGGGAGCAGCGTGGAGTCATTTCTGCGGAACTATAAG
CTTGGGAAAACTCTTGGCATTGGATCATTCGGAAAAGTTAAAATAGCTGAACATACCTTAACAGGGCATAAAGTT
GCTGTCAAGATTCTCAATCGTCGGAAATCAAGAACATGGATATGGAAGAAAAGTGAGAAGGGAAATTACAATA
TTGAGATTGTTCATGCATCCTCACATCATTCGGCTGTATGAGGTTGTAGAGACACCATCAGATATATATGTTGTG
ATGGAGTATGTGAAATCTGGTGAGCTGTTTGATTACATTGTGGAGAAGGGCAGGCTACAAGAGGATGAAGCTCGT
AAATTCTTCCAGCAGATAATCTCTGGTGTGGAGTACTGCCACAGGAACATGGTGGTTCATAGAGATCTTAAGCCT
GAGAACCTCCTTTTG

> SEQ ID NO:1592 171278 280969_200070_1b
GAAAAATACCATTGATTCTCTGGTTTTTTCCTGTAAACCCTAGCTAAAAAATACCTTAATTCTCTTTCGGGAATG
CAGAGAGATGAGAGGTTATCGGTTTTCTGATCCCCTTTTGACTGCCGGAAAAATCCAAAAACCAGTCGCCGGCGG

Figure 2 continued

CAGGAATTGCCACCGGAAACACGTAGAAGACGGGTGAATCAATCACCCATTTTCCCCCCTTTCTGTCAACCATTT
CCTTTTTTCTTTACAGAAACAGACACCCTTTTCATTCTTTAGCCTCTTTTTTACAAATTTAACCAAAATCTTTCT
CTGTTCCAAAAAATGGCACCTGAGGAGAAATGCATGGCTTTGTACGGAAAATACGAGCTCGGCCGCCTTTTAGGC
CATGGAACTTTTGCCAAAGTTTTCCATGCACGTAACGTGCAAAATGGCAAAAGTGTGGCTATGAAAGTTGTGGGC
AAAGAAAAAGTGATTAAAATTGGTATGATGGATCAAATCAAACGAGAAATCTCTGTTATGAAAATGGTAAAACAC
CCAAATATCGTTGAGCTTAACGAAGTCATGGCGAGTAAAACAAAGATTTACTTCGCCATGGAGTTCGTTAGAGGG
GGTGAATTATTTGCAAAAATAGCCAAAGGCAGGTTAAGGGAAGATGTGGCTAGAGGCTATTTTCAGCAATTAATT
TCAGCTATTGATTTCTGTCATAGCCGTGGTGTTTATCATAGAGATTTAAAGCCTGAAAATTTGTTGGTAGATGAA
GAAGGAAATCTTAAGGTAACAGATTTTGGGCTTAGTGCATTTACTGACCATTTAAGACAAGATGGGCTATTACAT
ACAACATGTGGAACTCCTGCTTATGTTGCTCCTGAAGTGATTATTGGTAAAAAAGGCTATGATGGTGCAAAAGCT
GATATTTGGTCATGTGGTGTAATTCTTTATGTTCTTTTAGCTGGGTTTTTACCATTTCAAGATGAAAATATTATG
GCTATGTATAAAAAAATTTATAGGGGTGATTTCAAATGTCCACCTTGGTTTTCATCAGAGGCTAGAAGATTAATC
ACCAAGATGTTGGATCCGAATCCAAATTCAAGAATCACTACTTCTAAGATTATGGAGTCAACTTGGTTTAAAAAA
TCACTGCCAAAGATTTTAAGAACCAAAGAGGAGGAAGAATTTTCTATAGGAGATGATATAAATTGTGTCGAAAAG
GCTAAAGATCTCGAGACATTAAATGCGTTTCATATCATTTCTTTATCAGAAGGTTTCGATTTATCGCCATTATTT
GAAGAGAAGAAG

> SEQ ID NO:1593 171278 272254_200042_1b
TTAATCCATTCTATAACAATCACGCCTCCATCCCAAACAAACGGAGACCGCCAATTCGTAATCCTTACGGATTGT
GAGGAAGTTTTATTGGGCACAATGGCGACGATTCCCCAAGAATAAATAAAAAAATTCTCAATTGTAACGCCAATC
TCTTCTCCAAGATGACCAACAAGAACGAGAAGAAAGGCTACATTTTGATGCAAAGGTATGAGATTGGGAAATTGT
TAGGCCAAGGGACATTTGCCAAGGTGTACCATGCAAAAAATCTGAAAACTGGCCAAAGTGTTGCTGTAAAGATCA
TTGACAAGGAGAAGGTGATGAAAGTTGGCTTAATTGATCAAATCAAACGTGAAATCTCTGTCATGAGGCTAATCA
AACACCCAAATGTTGTCCAGCTCTATGAGGTTATGGCTAGCAAAACTAAGATATATTTCGCCATGGAATATGTCA
GAGGTGGTGAACTTTTCAATAAGGTTGCTAAAGGCAGGCTTAAAGAAGATGCAGCTAGAAAATACTTCCAACAAT
TAATCGCTGCAGTTGATTTCTGTCATAGCCGTGGCGTCTACCACCGTGATCTCAAGCCTGAAAATCTCCTCCTCG
ACGAAGATGGAAACTTGAAAGTGTCAGATTTCGGGCTGAGTGCA

> SEQ ID NO:1594 171278 270976_200129_1b
CTCAAACATAGCCTTTCGTATTCAGCTTCTCATATACTCTTCGATCTGAATAGTTTATTATAATATTTGAGTTCT
CTTTAATCTTTTTTAATCTTTTTATTTTGGAAAAGTTTAAGATGAGTGTATCCAAGTCCCAGGTTTGGCAACCTT
GTAAAAAGAAGAGGATTTAGCTTAAGGCTTAATCCAGAAGTAAAAAAAATAAAAGAAGATTTTTTTATAGGGAAG
AAAAAAAAGAGGATGGTCTTTGTATTGATTTAGGGTAGGGATTTAATAAGATTGTAGGATCTGTAAGAAATAGAA
AGTTTGGAGATAGATGGGTTCAAGATCAAATAATGGAAGTGGGAGGACTACAGTGGGAAGGTATGAGATAGGGAG
GACAGTTGGGGAGGGTACTTTTGCAAAGGTCAAATTTGCAAGGAATGTTGAGACTGGTGATAATGTTGCCATTAA
GATTCTTGATAAAGAGAAGGTCATGAAGCACAAGATGATCGGCCAGATTAAACGGGAAATATCAACGATGAAACT
TATAAGACACCCCAATGTTATCCGAATGTATGAGGTCATGGCCAGCAAGACGAAGATATATATTGTTTTGGAATT
TGTTACTGGTGGCGAACTGTTTGACAAAATTTCTAGTAGAGGTAGGCTCAAAGAAGATGAAGCAAGAAAATACTT
TCAGCAACTTATAAATGCAGTTGACTACTGTCATAGTAGAGGTGTATTCCACAGAGATCTCAAGCCTGAAAACTT
GTTGCTGGATGCGAATGGTGTTCTTAAAGTTTCAGATTTTGGACTGAGTGCGCTACCTCAGCAAGTTCGCGAAGA
TGGACTACTACATACAACATGTGGAACACCAAATTATGTGGCCCCGAGGTGATCAACAATAAAGGTTATGATGG
AGCTAAGGCTGACCTGTGGTCATGTGGTGTAATCCTTTTTGTACTTATGGCTGGTTATTTGCCTTTTGAAGAGTC
AAATCTCATGGCACTATATAAGAAGATACCATAAAGCTGAATTTTACATGTCCACCC

> SEQ ID NO:1595 171278 256506_301673_1b
TTGTGAAGCTTTTGGCGCATTCCCAGCGGCCGGGCGAGGGCATCGTGATCTGGAAAGAATGCGATCCTAGTGCCG
GGCACAGTCGATCCATCAATCGACTTCGGCGGCGGCGGCGGGGCGGCATGGTGATGCGCAAGGTGGGCAAGTATG
AGATCGGTCGGACGATTGGCGAAGGTACGTTTGCCAAGGTCAAGTTCGCGCAAAACACCGAGACCGGGGAGAGCG
TCGCCATGAAAGTGCTCAACAAGGAGACGATCCTCAAGCACAAGATGGTCGATCAGATCAAGCGAGAGATCTCTA
TCATGAAACTTGTGCGTCACCCTTATGTTGTCCGGCTTCACGAGGTTCTTGCTAGCAGAACCAAAATCTACATCA
TTTTGGAGTTTGTTACCGGTGGAGAGCTGTTTGACAAAATTGTGGATCAAGGGAGACTTAGTGAGAATGAGTCGC
GCAAATACTTTCAGCAGCTAATTGATCGTGTGGACTATTGTCACAGCAAAGGAGTTTATCACCGAGATTTGAAGC
CTGAAAATCTTCTCCTTGATTCGCAAGGAAATTTGAAGATATCAGATTTCGGCTTGAGTGCTCTGCCGCAACAAG
AAGATGGACTTCTTCATACAACCTGTGGAACTCCAAATTATGTTGCTCCAGAGGTTCTTGATAACAAGGGTTATG

> SEQ ID NO:1596 171278 8138_300316_1b
AATTCGGCACGAGGTAAATGATGGGCGGATGAAAGAAGATGAGGCGCGGAGATATTTCCAACAGCTTATACATGC
TGGGGACTACTGTCATAGCAGAGGGGTCTACCATAGAGACCTCAAGCCTGAAAATTTACTATTGGACTCCTATGG
AAACCTCAAGATCTCAGATTTTGGATTAAGTGCTTTTGTCCCAACAAGTCAGGGATGATGGACTCTTGCATACAT

Figure 2 continued

CGTGTGGAACACCAAACTACGTTGCTCCTGAGGTTCTCAATGATAGAGGCTATGATGGAGCAACAGCTGACATGT
GGTCATGCGGTGTTGCACTCTATGTCCTGCTTGCAGGCTACTTACCTTTTGATGATTCTAAACTAATGAATCTTT
ATAAAAAAATATCATC

> SEQ ID NO:1597 171278 56661_300127_1b
ATGAAGCTTCTTAACCATTCAACATTGTCCAAATACACGAGGTGATTGGAACCAAGACAAAGATCTGTATAGTTA
TGGAATACGTTTCAGGTGGTCAGCTTTCAGACAGACTTGGAAGACAGAAAATGAAAGAATCAGATGCTAGAAAAC
TTTTCCAACAATTGATTGATGCTGTTGATTATTGTCATAACAGAGGAGTTTATCATAGAGATCTTAAGCCACAAA
ACTTGTTACTAGATTCAAAGGGTAATCTCAAAGTTTCTGACTTTGGATTAAGTGCAGTTCCTAAATCGGGGGATA
TGCTCTCTACAGCTTGTGGCTCTCCATGTTATATAGCACCAGAGTTGATTATGAACAA

> SEQ ID NO:1598 171278 241487_301348_1b
GCAAAGTGTTAGAACCAGAGTCGGTAAGTATGAGATCGGCAGGACACTCGGGGAGGGTACTTTTGCGAAAGTCAA
GTTCGCCAAGCACATCAAAACTGGACATGGTGTGGCTATCAAGATTTTGGACAGAGATAGGGTTCTCAAGCACAA
GATGGTCGAGCAGATCAAGCGAGAAATTTCGACAATGAAACTTGTGAGACATCCGAATATTGTTCAAATAAAGGA
GGTTATGGCCAGCAAGTCGAAAATCTATATTGTCTTGGAGCTTGTCACAGGCGGTGAACTCTTTGATAAGATCGT
CCATCAAGGCAGGCTCAAGGACGACGAAGCAAGGAAATATTTTCAGCAGCTGATCAACGCGGTGGACTACTGCCA
CAGTCGTGGAGTATACCACCGTGATTTGAAGCCTGAGAATCTGCTGCTAGACTCAAGCGGGAATCTTAAAATATC
GGATTTTGGTCTGAGCGCTCTTCCTCAGCAACTCCGGGCCGACGGCTTGCTGCATACTACTTGTGGAACTCCAAA
CTACGTGTCGCCCGAGGTGATCAATGACAAAGGTTACGACGGAGCGAAAGCAGACTTATGGTCCTGCGGGGTTAT
CCTTTTTGTCCTCATGGCTGGCTATTTG

> SEQ ID NO:1599 171278 232875_301218_1b
GGTGAAGTCTGTGGGGAAGAAATCTAGGGTTAGAAGGCCCTGCGCCAGGAAGCGGCCCAAGGGTAGTTAGAACCA
GCACTTCGCGGCGCACCACTGACGAGTTCTTCGCGACTTTTTTGGTAGCGTATTGGAATTTGGGGCGATTCTAGT
TCTCGCAATGGCGGCAACGCCCAGTGGCCTCCAGACCAGGGTCGGGAAGTATGAGCTGGGAAAGACGATCGGCGA
GGGCAATTTCGCCAAGGTTCGGCGAGCCAGGAATCTCGACACTGGCGAGATCGTGGCGATCAAGGTCCTCAACAA
AGAGGAGGTGATGAAGCACAAAATGGTCGAGCAGCTCAAGCGGGAGATTTCGACCATGAAGCTAGTAAAGCATCC
AAACATTGTCCAGCTCCACGAGGTTCTGGCCAGCAAAACTAAAGTTTACATCGTTTTAGAGTACGTCACTGGTGG
AGAACTTTTTGACAAGATCGTGAAACAAACCCGCTTGAAAGAAGACGAAGCAAGGAAGTATTTCCAGCAACTCAT
CAATGCAGTTGACTATTGCCACAGCAGGGGTGTGTATCACCGCGACTTGAAGCCGGAGAATTTGCTTCTCGATAA
AAATGGAAACTTGAAGATCTCTGACTTCGGTTTGAGTGCGCTTCCGCAACATCTTCGGCCGGATGGTCTACTTCA
CACTACTTGCGGCACTCCAAACTACGTAGCTCCTGAAGTCATAAACAACAAAGGATACAACGGGGCCACTGCGGA
CTTGTGGTCGTGCGGTGTGATTCTTTACGTCTTGATGGCTGGATTTTTACCTTTTGAAGAGCCCAACCTGATGAA
TTTGTACAAAAAGATCTTCCGCGCGGATTTCAAGTGTCCAAAGTGGTTTAGCAGTGGGGCGAAGAACCTGATTTG
TAAAATACTGCATCCAAATCCAAAATCTCGGATTACGATTCCACAAATTCTCGAGGACGAGTGGTTCAAGGTGGG
CTACAAGCCAGCAAAGTTCCTTGAGGAAGATGCTGCTCATCTGAAA

> SEQ ID NO:1600 171278 198823_300685_1b
TCGACCACGCGTCCGGCCGCTCGGCCGGCTCCTCGGCCGTGGCACGTTCGCCAAGGTCTACAAGGCCTATAAGTT
GGCCACCGGCGAGGCCGTCGCCATCAAGGTGTTCGACAAGGAGGCGGTGCAGCGGTCCGGCACGGTGGAGCAGGT
GAAGCGCGAGGTGGACGTCATGCGGCGTGTGCACCACCGCCACGTCATCCGCCTCCACGAGGTGATGGCTACGCG
GTCCAGGATCTACTTCGTCATGGAGTACGCGAGCGGCGGCGAGCTCTTCACCCGCCTCTCCCGGAGCCCGCGGTT
CCCGGAGCCCGTCGCGCGCCGCTACTTCCAGCAGCTGATCACCGGCGTGGAGTTCTGCCACAGCCGCGGCGTGTA
CCACCGCGACCTCAAGCCCGAGAACCTCCTCCTCGACGCCC

> SEQ ID NO:1601 171278 182002_300598_1b
GAATTCGAATCTCATCACTTATCTCTCTCTCAATCTCTCTTTTAAATTTCAAAAAGTTCCTGAAAGAACTTCAAA
ACCATATTGAGATCTTAGAACCCCAGGAGAAAAAAATACATTCAGCGAGCGAATTGATTGATTTTTCAAATCAAT
TCGCTCGTATTCTGGTTTATTTCAGATTAACGAATCTATTTCTTGTTTGTTGAAATTATATCAATCACGCATGCC
TGAATTAATCGAGATCTCATCAGAAAATTCATTATTTGGCAAATATGAGCTCGGTAAATTGCTTGGTTGTGGCGC
ATTCGCTAAAGTTTATCACGCAAGGAATATCAAAACAGGGCAAAGCGTAGCAATAAAATGTATAAGCAAACAGAA
AATCCTCAAAGGAGGATTAATGGCACATGTCAAGAGAGAAATCACTATTATGCGTCGTCTCCACCATAAGAATAT
TGTGAAGCTTTATGAAGTTTTGGCCACGAAAACAAAGATTTATTTCGTTATGGAATTTATTAAAGGTGGTGAATT
GTTTGCTAAAGTAGCTAAAGGTAAATTTAGTGAAGATTTGAGTCGTAAATATTTCCAGCAATTAATATCAGCTGT
TGGCTATTGTCATTCTCATGGTATTTTTCACAGAGATTTGAAACCTGAAAATCTA

> SEQ ID NO:1602 171278 175570_300545_1b
CCCCCCGGCTCCTCCAACCTGGCTCAGTGGCCTCCTGTTCTTGAGAGAACTGAATCTGCTGTCCAGCTGCTGCTC

Figure 2 continued

CGGCTGGTCTCTGAGTTGAAGGTACTTGAATAACTTGAAGGTTCCTAGGAACCTTCATTTGTTGGAAGATGTATA
GGGCTAAGAGGGCTGCATTATCTCCAAAGGTGAAGCGCCGTGTAGGGAAGTATGAGCTCGGGCGCACCATTGGAG
AAGGAACCTTTGCAAAGGTCCGGTTTGCGAAGAACACTGAAAATGACGAACCAGTTGCTATCAAAATCCTTGACA
AGGAGAAGGTTCAGAAGCACAGATTGGTTGAACAGGCGTGAAATTTGTACTATGAAGTTAGTAAAGCATCCTAAT
GTTGTTCGGCTGTTCGAGGTCATGGGAAGTAAAGCAAGAATTTTCATTGTTCTGGAATATGTTACTGGAGGAGAG
CTCTTTGAAATCATTGCAACTAATGGAAGGTTGAAGGAGGAGGAAGCACGAAAATACTTTCAACAACTTATCAAT
GCAGTTGACTACTGCCACAGTAGGGGTGTGTACCACAGAGACTTGAAGTTAGAAAATTTGCTGCTTGATGCTTCT
GGAAACCTGAAAGTATCTGACTTTGGTTTGAGTGCTTTAAC

> SEQ ID NO:1603 171278 1114882_301805_1b
TGCAGAGGAGGGAGGATCTTCTTCACAGCCTTTCTTAGCTCACAAGGTTTTTGATTTTTAGGTGAAGGAAAAAAA
GATATAGAAGTTTGCCTCGAAAATATACCCTCTACTTGGAAGTGAGAAACGCTTCTCCCGCTGGTTCTCTAAGAC
GGCGCAAATGCCTGAAAGATGCTCTAGCAGTAGCAGTCAAAGTGTTAAAACAAGAGTTGGAAATTTCGAGCTCGG
CCGTGTTCTTGGGCAAGGCACCTTTGCCAAGGTGAAGATTGCCAAAAATGTTGTCACCAGCCAGATTGTGGCGAT
TAAAATCCTCGATAAAGAGAGAGTGCTCAAAGACAATCTCGTTAATCAGATTAAACGGGAGATTTCGACAATGAA
GCTGGTGAAGCACCCCAACGTTGTTCAACTCTATGAGGTTACAGCAAGCAAAAGCAAAATCTATTTTGTGCTAGA
GTATGTCACTGGAGGCG

> SEQ ID NO:1604 171278 109416_300038_1b
CCCACGCGTCCGCTCTTGTCTCTCTCGGTTTCGGATCCGTCGGAAGCTCTTTAATCCCCAACAAGTGCTTGTTAA
AGCAAAATAATTGGGATGCAGAAGGATGGGGTTATATAGCAGCGATTACCTTTTGGAGGCTACTAAATTTCAGTG
TGCATTGTTGTTAGTCTTCCTCATCCTTCGTGATCTCAAATATGCAGCTCACGGCACACTTAACTTCTCGTGCCA
GATGCACAATGAAGCGACAACCCTTATACATCTCGTCATGCTGAAGCACAGTCTTGTCGGAGACGGTTGAGCTCC
GTAACAAGGCCTCCTGCCTGTTACAAACGAGCATCATCACAGCAGGAGAAAGTTACTTGTAGTTGTTACTAGGAT
TGTCGATTCAAATGGAGGAGAAGAAAGGAAATGTTTTGATGCAAAAATATGAGTTGGGGAGATTATTAGGTCAAG
GAAATTTTGCTAAGGTTTATTATGGAAGGAATCTTGAAACGGGACAGAGTGTAGCCATCAAGGTAATTGATAAAG
AGAAGGTTCTCAAGGCCGGACTGATCGAACAGACTAAGAGAGAGATATCTATTATGGCACTGGTCGAACACCCAA
ATGTTCTACAGCTATACGAGGTTATGGCAACTAAATCTAAGATTTACTTAGTGATTGAACAAGCCAAAGGCGGGG
AGCTTTTCAAAAAATTGACAAAGGGGAGACTCAAGGAAAATGTAGCTAGGAAGTACTTTCAACAATTGATTAGTG
CTGTTGAGTGTTGCCACAACCAAGATGTTTATCACCGTGATCTGAAACCAGAAAATGTGCTGCT

> SEQ ID NO:1605 174874 1046554_301924_1b
GAGCAATAGAGGGGTGGAATGATGGCTAGTGTTTCTTCTGTACCAATTCCGGCTTCTTCTCTCTCAAGCTCGTTT
AGGGTATCCCGGCCACTGTCCTTCATGGTTCCCTCTTCCGCCTCCTCGTGCCCCCTTTGCCCTCGATAACCTGC
GCATTGGCTTCTGAAGGCGCTGTCCGCATCCAGAACCTTCCTCGCCCTGATTCCTCTGGTCGCTTCGGCAAGTTT
GGAGGCAAATATGTCCCTGAAACCCTCATCGCTGCCCTCGATCAACTCGAGAAGGCTTACTCTGAAGTCACTAAT
GATTCTTCGTTCCAGCAACAACTTTCTAGTATTCTCAAGGATTATGTTGGACGAGAGTCACCTCTTTATTTCGCC
GAAAGATTAACGGAACATTACAAAAATAGCTCTGGTGAAGGTCCTCTCATATATCTGAAGCGAGAAGATCTGAAC
CACACAGGTGCTCACAAGATCAATAATGCTGTTGGGCAAGCTTTACTAGCAAAGTGGATTGGGAAGAAACGCATC
ATTGCAGAGACAGGCGCCGGGCAGCACGGTGTAGCAACTGCAACAGTTTGTGCTCGCTTTGGCTTGAATTGCGTC
ATTTATATGGGTGCCCGAGATATGGAGAGGCAATCCTTGAA

> SEQ ID NO:1606 174874 131150_300511_1b
GAATTCACTTGTAAATGGCTTTCTCATCCTCCACTGTTACTTGCAAAAACCCTAATTCCAATCTCCTTCAAAAAC
CATACTTTTCTTCGTCTTCTTCCTTTAATCCTTTACGAGTTCATTTCCAGAAATTTCCTTTACCTTCTTCTTCTT
CCATTAAAAGTTCTTCAATTTCTTGTGCAGTAACCGAAGAGAAACCCAAAATGTCGACTGTTTCGCAGAGACCTG
ATTCTTTTGGTAGGTTTGGGAAATTTGGGGGAAAATATGTTCCTGAAACACTAATGTATGCACTTACGGAGCTTG
AATCTGCGTTTCGGTCATTGGCGGCAGACCAAGATTTTCAGGAAGAATTGAGTGGAATTTTGAAGGACTATGTTG
GTAGGGAGACACCTCTTTACTTTGCAGAGAGGTTAACGGAACACTATAAGTCTGCTAATGGTGAAGGACCTCATA
TATATCTTAAAAGGGAAGATCTTAACCACACAGGTGCCCACAAAATCAACAATGCTGTTGCCCAAGCTTTACTTG
CGAAGCGATTGGGGAAAAAACGGATTATAGCTGAGACTGGAGCT

> SEQ ID NO:1607 174874 245978_301573_1b
GGCACGGCGGCGGCGTCACGGCGATTCATTGCTTCTCCTCCTTCCGATCAGCTCGGCACGGAGGTGGAGTTGCCG
GCGAGGATCAATCTGCCGCGGCGCAGCGTTCGGGCAGCGATCTCGTCCCAGGGCGCCGTGGCGCCGGCGGAGGCG
GAGGACGTGTTGCATGCCGAGTATGGAGGGTTCCAGCGGCCGGATGCGTTTGGAAGGTTTGGGAAATTCGGTGGT
AAGTATGTTCCGGAGACGCTCATGGCGGCGCTGGCGGATCTGGAGGCCGCGTATCGATTGCTTGTTGGCAAGCCC
GAATTTCAGCAAGAATTGGCTGGTATTCTCAAAGACTACGTTGGACGAGAGTCTCCACTCTACTTTGCCGAGCGC
TTGACGCAGTACTACAAGAACGCCAATGGCAGTGGACCTGATATATATCTCAAGCGAGAAGATCTAAACCACACC

Figure 2 continued

GGTGCTCACAAGATCAACAATGCCGTCGGCCAAGCCTTGCTCGCCAAGCACATTGGCAAGAAGCGCATCATCGCC
GAAACTGGAGCCGGCCAGCACGGAGTTGCCACGGCCACTGTCTGTGCTCGCTTTGGACTGGAATGCGTCGTTTAC
ATGGGTGCACAAGACATGGAAAGGCAAGCTCTCAACGTGTATCGTATGCGGCTTCTCG

> SEQ ID NO:1608  174874  156478_301366_1b
AACATTTTATTGATTCTTATCATCCAAACATGGCCTTCTCCTCCTCCACTGCTCAAACAGCTTCACCTCTATCCT
CCAAACATTGTTCCCGCCTATCTTCCTCCGCCGCCTCCTCCTCCTCTTACTTCCCTAAATTTCAAATACCCTTCA
AATTCAACGAAATTACATCTTGCCCTTCCTCAATTTCCTGTGTCCTTACCAAACAGGAATCAATGGCGGCTCGAG
AGGCTGCTGAACCGGCGGTTCCCCTGCGTCCTGATTCGTTTGGCCGGTTTGGTAAATTTGGCGGGAAATACGTAC
CTGAAACCCTAATGCACGCTCTTGACGAGCTCGAGACCGCCTTCAAATTGCTCGCTACCGATGAAGCTTTTCAGA
AAGAGCTAGATGGAATATTGAGAGATTATGTAGGCAGAGAGAGCCCTCTTTATTTTGCAGAGAGACTTACTGAGC
ACTACAAACGTCCAGATGGCCAAGGGCCATTGATCTACCTGAAGAGGGAGGATCTTAACCACACTGGTGCCCACA
AAATCAATAATGCGGTTGCCCAAGCTTTGCTTGCCAAGCGCTTGGGCAAGAAGCGCATCATTGCTGAGACAGGGG
CAGGTCAGCATGGTGTTGCTACTGCTACTGTTTGTGCTCGCTTTGGTTTGGAATGTATTATCTACATGGGTGCTC
AAG

> SEQ ID NO:1609  175126  120384_300384_1b
CCCACGCGTACGGCGTATTGAGATAGAAAACTTTTTAAAAAGGTGCAAAAAAAGAAGAAAAAAAAACTAAAAGGG
ATAGGGGCTGAGTAAAATAATCTGTGGTTCTTTGTTAGATTTCCTCTGTTTTGAATCTCAACACAGAGCCATGGC
AAAGTTTTCCAAGAATTCCATGGTTCTGTGCTTTTGGTTAGTCATAGTTTTTGTAATCTCTTGTGCAAATGGTGT
TAGGCTTAAGAAATTTGATCACCCCACTAAAGGTGATGGCACTCTTAACTTCTTGGTTATTGGTGACTGGGGAAG
AAAGGGTACCTTCAATCAATCTCACGTAGCTCACAAGATGGGAAGAATCGGAGAGGATCTAAACATTGATTTTGT
AGTATCAACTGGTGATAATTTCTATGATAACGGATTGACAGGGGTGCACGATCCAAATTTTGTAGAGTCATTTAC
TAATATATATACAGCAAAGAGTTTACAGAAACAATGGTATAGTGTATTAGGCAATCATGATTACAGAGGAAATGT
ATAAGCGAACTCAGTCCTTACCTTAGGAAAATTGATAGAAGATGGCTTTGTTTAAGGTCTTTCATAGTTAATGC
AGAAATTGCTGAAATATTCATGGTGGATACAA

> SEQ ID NO:1610  175126  55822_300130_1b
ACGGTTCCGTTAGTTTTATAGTCATCGGAGATTGGGGTCGTCGTGGCTCCTTCAATCAGTCTCTCGTTGCTTATC
AGATGGGAAAAATTGGAGAGAAGATTGACTTAGATTTCGTGGTGTCTACGGGAGATAACTTCTACGACAATGGAT
TGTTTAGTGAACATGATCCAAACTTCGAACAATCTTTCTCTAACATCTACACTACTAAGTCTTCAGAAACAGTGG
TACAGTGTTTTGGGAAACCATGACTATAGAGGTGACGCAGAAGCTCAGCTGAGTTCTGTTCTCCGGGAAATCGAC
AGCCGTTGGATTTGTCTTCGATCATTTGTCGTTGATGCAGAGTTGGTAGAGATGTTCTTTGTTGACACGACTCCT
TTCGTGAAAGAATACTACACAGAAGCAGATGGTCACTCATATGATTGGCGCGCAGTTCCATCTCGCAACTCTTAT
GTC

> SEQ ID NO:1611  175126  242487_301329_1b
GATTTGATTCAAGCTCTAGGCGTTTAAGTAGATGGATGCGTGATTGATTGAATGGAAGCGATAGACAAGCTAGAT
CTAGCTTGATCTTCACTGATAGAGGAAGAGGAGGAAGGGAAGATCAAGGATGGCTCCTGACGAGGAATCGGCGCT
CTTGGGGACAAATAGCGATCATCACAGCAAGCGCAAATTCCGGCGCAAAGTCGTCGCTACAAGCTGTGTTCTTGG
GATCTTTCTCGTTCTCACTACTGTTTGGTTCCTTGACCGTGGCGGCTTCTTAGAATTCTACGCTGGTCAGGCGAT
AGAATCGTCGAATCCTCTGGTCTCGCCGGTCGATCGTGTAGCTCCAGTGAACTTCTTAGCGATAGGGGATTGGGG
ACGACATGGATTGTATAACCAAACGTTGGTTGCTTCCCAGATGGGAAAAGTTGGCGAGGAGCTCGGCATAGATTT
CGTGGTCTCGGTGGGAGATAATTTTTATAAGAATGGATTGACTGGCGTGGACGACATTGCGTTTGATCAATCCTT
CTCGAACATCTACACTGCTCCAGGCCTTCAAAAACCATGGCATGCAGTGCTGGGAAACCATGACTATCATGGAGT
TGTTCTCGCACAGCTTGATCACCGGCTAGCTTTGCGTGATTGGAGATGGCACTGCGTCAGAGGTGGACAAATTAT
TTATGATCTGAGCTCATCTCTTTCTCGAGGAT

> SEQ ID NO:1612  175126  231712_301233_2b
ATTTGATTCAAGCTCTAGGCGTTTAAGTAGATGGATGCGTGATTGATTGAATGGAAGCGATAGACAAGCTAGATC
TAGCTTGATCTTCACTGATAGAGGAAGAGGAGGAAGGGAAGATCAAGGATGGCTCCTGACGAGGAATCGGCGCTC
TTGGGGACAAATAGCGATCATCACAGCAAGCGCAAATTCCGGCGCAAAGTTTTCGCTACAAGCTGTGTTCTTGG
ATCTTTCTCGTTCTCGCTACTGTTTGGCTCCTTGACCGTGGCGGCTTCTTAGAATTCTACGCTGGTCAGGCGATA
GAATCGTCGAATCCTCTGGTCTCGCCGGTCGATCGTGTAGCTCCAGTGAACTTCTTAGCGATAGGGGATTGGGGA
CGACATGGATTGTATAACCAAACGTTGGTTGCTTCCCAGTTGGCGAGGAGCTCGGCATAGATTTCGTGGTCTCGG
TGGGAGATAATTTTTATAAGAATGGATTGACTGGCGTGGACGACATTGCGTTTGATCAATCCTTCTCGAACATCT
ACACTGCTCCAGGCCTTCAAAAACCATGGCACGCAGTGCTGGGAAACCATGACTATCATGGAGATGTTCTCGCAC
AGCTTGATCACCGGCTAGCTTTGCGTGATTGGAGATGGCACTGCGTCAGAGGTGGACAAATTATTTATGATCTGA
GCTCATCTCTTTCTCGAGGTAATTATATA

Figure 2 continued

> SEQ ID NO:1613 175159 133736_300417_1b
GGAGGAGGGTGAGTTCTCTGAGGCCCGCGAGGATCTCGCCGCGTTGGAGAAGGACTACGAGGAGGTTGGCGCTGA
GTCCGACGAGAATGAGGATGGCGATGATGGTGACGAGTACTAGAGGAGTCGTCGTCGTCTGGGGGCTCGATGTTC
TGTGTGTCAAGGCCTGATTGATAACTGCTGCTATCCCATGATCTGCCAGTGTGGAGTTATCCTGTTGCCGTGTGC
GTGTGTCTTCGAGACATTTGCTTGTGGTGATCTGATGTTTGGGGCTTAATGGGCTTACAACCCTCGTTGTTGTAA
CCTGTGTGCCTTGTAATGTGAGACCGCTTCGTCACTTATAATATGCGCGTTTGTTCAATTT

> SEQ ID NO:1614 175159 186970_300672_1b
CCCACGCGTCCGCCCACGCGTCCGGCTTTCCTCCTACGCCCCGGTGATCTCGGCCGAGAAGGCCTACCACGAGCA
GCTCTCCGTGGCGGAGATCACCAACAGCGCCTTCGAGCCGTCCTCCATGATGGCCAAGTGCGACCCGCGCCACGG
CAAGTACATGGCGTGCTGCCTGATGTACCGCGGCGACGTGGTCCCCAAGGACGTGAACGCCGCGGTGGCCACCAT
CAAGACGAAGCGCACCATCCAGTTCGTGGACTGGTGCCCCACGGGGTTCAAGTGCGGCATCAACTACCAGCCGCC
CAGCGTCGTCCCGGGGGAGACCTGGCCAAGGTGCAGAGGGCCGTGTGCATGATCTCCAACTCCACCAGCGTCGT
CGAGGTGTTCTCCCGCATCGACATCAAGTTCGACCTCATGTACTCCAAGCGCGCCTTCGTCCACTGGTACGTCGG
CGAGGGCATGGAGGAGGGGAGTTCTCCGAGGCCCGCGAGGACCTCGCCGCGCTGGAGAAGGACTACGAGGAGGT
CGGCTCCGAGTTCGACGATGGTGACGAGGGTGATGAGGGTGACGAGTACTAGAGAGGTTCAGGGTTCTTGCCTGG
TGCCTTGGCAATGCTTGATTACTGCTGCTATCCTATGATCTGTCTATCAGTTTGTGTGTCTGGTTTTGAAAAACA
TTTGCTTTTCGATTATGCAGGGTTTGCTTGTAGCTTTCGCTGCTGTGACCTGTGTTGTTTATGTGAACCTTCTTT
GTGGCATCTTTAATATCCAAATGAGTGGTTTGTC

> SEQ ID NO:1615 175159 201662_300718_1b
AACAGTGCCTTCGAGCCATCCTCCATGATGGCCAAGTGCGACCCTCGCCACGGCAAGTACATGGCCTGCTGCCTC
ATGTACCGCGGCGATGTCGTGCCCAAGGACGTGAACGCCGCCGTCGCCACCATCAAGACCAAGCGCACCATCCAG
TTCGTGGACTGGTGCCCGACGGGGTTCAAGTGCGGCATCAACTACCAGCCGCCCAGCGTCGTCCCCAGCGGCGAC
CTCGCCAAGGTGCAGAGGGCCGTGTGCATGATCTCCAACTCCACCAGCGTCGTGGAGGTGTTCTCCCGCATCGAC
CACAAGTTCGACCTCATGTACTCCAAGCGCGCCTTCGTCCACTGGTACGTGGGTGAGGGCATGGAGGAGGGTGAG
TTCTCTGAGGCCCGTGAGGATCTCGCCGCGTTGGAGAAGGACTACGAGGAGGTTGGCGCTGAGTCCGACGAGAAT
GAGGATGGCGATGATGGTGACGAGTACTAGAGGAGTCGTCGTCGTCTGGGGGCTTGATGTTCTGTGTGTCAAGGC
CTGATTGATAACTGCTGCTATCCCATGATCTGCCAGTGTGGAGTTATCCTGTTGCCGTGTGCGTGTGTCTTCGAG
ACATTTGCTTGTGGTGATCTGATGTTTGGGGC

> SEQ ID NO:1616 175159 183133_300619_1b
CGCCGCGCTGGAGAAGGACTACGAGGAGGTCGGCTCCGAGTTCGACGATGGTGACGAGGGTGATGAGGGTGACGA
GTACTAGAGAGGTTCAGGGTTCTTGCCTGGTGCCTTGGCAATGCTTGATTACTGCTGCTATCCTATGATCTGTCC
GTGTGGGCTTCTATCTATCAGTTTGTGTGTCTGGTTTTGAAAAACATTTGCTTTTCGATTATGCAGGGTTTGCTT
GTAGCTTTCGCTGCTGTGACCTGTGTTGTTTATGTGAACCTTCTTTGTGGCATCTTTAATATCCAAGTTCGTGGT
TTGTCGT

> SEQ ID NO:1617 175159 227209_301009_1b
GTACTCCAAGCGCGCCTTCGTCCACTGGTACGTCGGCGAGGGCATGGAGGAGGGGGAGTTCGCCGAGGCCCGCGA
GGACCTCGCCGCGCTGGAGAAGGACTACGAGGAGGTCGGCTCCGAGTTCGACGATGGTGACGAGGGTGATGAGGG
TGACGAGTACTAGAGAGGTTCAGGGTTCTTGCCTGGTGCCTTGGCAATGCTTGATTACTGCTGCTATCCTATGAT
CTGTCTATCAGTTTGTGTGTCTGGTTTTGAAAAACATTTGCTTTTCGATTATGCAGGGTTTGCTTGTAGCTTTCG
CTGCTGTGACCTGTGTTGTTTATGTGAACCTTCTTTGTGGCATCTTTAATATCCAAATGAGTGGTTTGTCGT

> SEQ ID NO:1618 175378 1008044_301406_1b
TCTCTCTCTCTCTCTCTCCCTCTCGCTCATCGTCAGCTATGGCGATGGCTGCGACCTCGCACATCTCCTCGGC
TACAGCCTGCACTCTCCACTCCAAGCTATCGGCCACCCGCAATGGGGTTTACAGCTCACAAACCCTGGCCTTTGC
ACCCCTCGGCGAGGCCATAGTGACACGTCGGAGTGGTCGAGGAAAGATTGTTTGCCAGGCTGCCATCCCGTCTCG
TGTCCCAGACATGGGAAAGCGCCAATTGATGAACCTACTTCTCCTTGGTGCCCTCTCCCTCCCCACTGCTGGATT
GCTTGGTCCCTACCTGACTTTCTTTGTTCCTCCAAGCTCTGGATCTGGGGAGCTGGTATAATTGCTAAGGATGC
CCTTGGAAATGATATAGAGTTGGCAGCATGGCTCAAGACTCACCCTCCTGGTGATAGAACACTCAGCCAAGGCCT
CAAGGGTGATCCCACCTACCTGGTTGTTGAATCCGACGGAATTCTTGCAACCTATGGTATCAATGCAGTTTGCAC
ACATTTGGGTTGTGTTGTTCCATGAATCCTAATGAGAAGAAATTCATTTGCCCTTGCCATGGATCTCAGTACAA
CAGCCAGGGCAAGGTTGTGCGAGGTCCGGCTCCTTTGTCTCTTGCCTTGGCCCACGCTGATGTATCGGATGGCCA
GATCCTGTTCTCTCCCT

> SEQ ID NO:1619 175378 112183_300040_1b

Figure 2 continued

```
CGGACGCGTGGGGTGGACACCATACATCCGCTTCACAAGTTGCTTACCCCCACCCCCAGGTCTCATCAACGATCA
CTAATATCACTGCTACCTTCCTCCGAATATCTTTTTCTCAGAACATTCAGAAATGGCTTCTTCTACTCTTTCTCA
CGTAACTCAGCTATGCTCGAGCAAGAGCGGTTTGTCTTCGGTTTCACAATGTTTGCTACTGAAACCAATGAAGAT
TAACAGTCATGGATTGGGAAAGGATAAGAGGATGAAAGTGAAATGCATGGCTACAAGTATTCCAGCAGATGATAG
AGTGCCTGATATGGAAAAGAGGAATCTAATGAATTTGCTTCTTTTGGGTGCTCTTTCTCTACCCACTGCTGGGAT
GTTGGTACCTTATGCTACTTTCTTTGCACCACCTGGGTCAGGGGGTGGTGGGGGTGGAATCCCTGCCAAGGATGC
ATTAGGTAATGATGTTATTGCATCTGAATGGCTGAAAACTCATGCACCTGGCAACCGAACTCTCACGCAAGGACT
AAAGGGAGACCCTACTTACCTTGTTGTGGAGAATGATGGAACACTTGCAACCTATGGTATTAATGCTGTCTGTAC
TCACCTTGGTTGTGTTGTGCCATTTAATGCTGCTGAGAACAAGTTTATTTGCCCGTGCCATGGATCTCAATACAA
CAACCAAGGAAGAGTTGTTAGAGGACCTGCTCCTTTGTCCTTGGCTTTGGCTCATGCTGATATTGATGATGGGAA
GGTGGTGTTTGTCCCATGGGTTGAAACAGACTTCAGAACTGGTGAAGCTCCATGGTGGGCTTAGATCTCCCATTT
AAGCTTAATTACAGTATCCTCTTGTATCTTTGTTACATAAAGCTTATCCCTTTTTATGAAGAAAAAAAATATATA
TACATTTTGAGATGTAACTATTGAAGCATAACCTTGGCAGTCCCATAATGACATTTTTTGTTTGGGATA
```

> SEQ ID NO:1620 175378 129539_300480_1b

```
GAATTCAAACTCTAGTTCACCTCACACTAAACCATGGCTGCTTCTACACTTTCCCCTGCAACTCTTTCTCAGGTA
TGTTCTGGCAATGGGATGTTTTCTCCTTCACAAGGAAAACCCACCAGGACCCAATTGATGGTTAAAGAAAGGGGA
ATGAAGATTGTTTGCCAGGCTTCAAGTATTCCTGCTGAAAATGTACCTGACATGGGTAAAAGAGAGCTCATGAAT
TTGCTACTCTTGGGTGCTCTTTCTCTCCCTACTGCTGGAATGCTAGTTCCATATGGTTCCTTCCTCGCCCCCCCT
GGCTCAGGAAGTGGAGCTGGTGGACAAACAGCAAAGGATGCCTTGGGTAATGATGTCATTGCAGCTGAATGGCTC
AAGACCCATGGACCAGGAAACAGAACCCTAACTCAGGGATTGAAGGGAGACCCTACTTACCTAGTTGTGGAGAAC
GACAAAACACTTGCAACATACGGTATCAATGCAGTCTGTACCCATCTTGGTTGTGTGGTTCCATTTAATGCCAAT
GAGAAGAAGTTTATCTGCCCTTGCCATGGTTCGCAGTACAATAACCAAGGGAGAGTTGTTAGAGGACCTGCTCCT
CTGTCCTTAGCATTGGCACATGCCGATGTTGTCGATGGAAAAGTTGTATTTGTTCCATGGGTTGAAACCGATTTC
AGAACAGGCGAAGCTCCATGGTGGTCTTAAACATTTCGCATCTCTTCAATATCATTTCCATTCCTCCATGTAATC
AACTTGAACTGATTCAATTTGTTTGCTTCAGTGGATAAATACATATCATCACCTGTCATACACTCCTGCAAC
```

> SEQ ID NO:1621 175378 11926_300070_1b

```
TGGTATCAACGCAGAGTGGCCATTACGGCCGGGGAATACCTTTTTCTCAGGACCATTCAGAAATGCCTTCTTCT
ACTCTTTCTCCTGTAACTCAGCTATGCTCGAGCAAGAGTGGCTTGTCTTCGGTTTCACAATGTTTGCTAGTGAAA
CCAATGAAGATTAACAGTCATGGATTGGGAAAGGATAAGAGGATGAAAGTGAAATGCATGGCTACAAGTATTCCA
GCAGATGATAGAGTGCCTGATATGGAAAAGAGGAATCTAATGAATTTGCTTCTTTTGGGTGCGCTTTCTCTACCC
ACTGCTGGGATGTTGTACCTTATGCTACTTTCTTTGCACCACCTGGGTCAGGGGGTGGTAGTGGTGGAACCCCT
GCCAAGGATGCATTAGGTAATGATGTTATTGCATCCGAATGGCTGAAAACTCATGCACCTGGCAACCGAACTCTC
ACGCAAGGACTAAAGGGAGACCCTACTTACCTTGTTGTGGAGAATGATGGAACACTTGCAACCTATGGTATTAAT
GCTGTCTGTACTCACCTTGGTTGTGTTGTGCCATTTAATGCTGCTGAGAACAAGTTTATTTGCCCCTGCCATGGA
TCCCAATACAACAACCAAGGAAAAGTTGTTAGAGGACCTGCTCCTTTGTCCTTGGCATTGGCTCATGCTGACATT
GATGATGGGAAGGTGGTGTTTGTCCCATGGGTTGAAACAGACTTCAGAACTGGTGAAGCTCCATGGTGGGCTTAG
ATCACCTTATCTAGC
```

> SEQ ID NO:1622 175378 190816_300736_1b

```
CCCCGGGACACCCTGCGCTGCAGCCGAACGACCGAGCTACCGAGCCAATCCAGCCATGGCCTCCACCGCGCTCTC
CACCGCCTCCAACCCTACTCAGCTGTGCAGGTCTCGCGCCTCGCTGGGCAAGCCCGTCAAGGGCCTGGGCTTCGG
CCGGGAGCGCGTGCCGAGGACGGCGACGACCATCACATGCCAGGCCGCGAGCAGCATCCCGGCCGACCGCGTCCC
GGACATGGGCAAGCGCCAGCTGATGAACCTCCTCCTGCTCGGCGCCATCTCGCTCCCCACCGTCGGCATGCTCGT
CCCCTACGGCGCCTTCTTCATCCCCGCCGGGTCCGGGAACGCCGGCGGCGGGCAGGTCGCCAAGGACAAGCTCGG
CAACGACGTGCTCGCCGAGGAGTGGCTCAAGACACACGGCCCCAACGACCGCACCCTCACCCAGGGGCTCAAGGG
TGACCCGACGTACCTCGTCGTGGAGGCCGACAAGACGCTGGCCACGTACGGGATCAACGCCGTGTGCACGCACCT
TGGGTGCGTCGTGCCGTGGAACGCCGCCGAGAACAAGTTCATCTGCCCCTGCCACGGCTCGCAGTACAACAACCA
GGGCAGGGTCGTCCGTGGACCTGCTCCCCTGTCGCTGGCA
```

> SEQ ID NO:1623 175378 47389_300170_1b

```
TTGAGACCATAACCTTTTAGCGTTTTCGGCTAAAGCTTTCGCTGACTACTACAACAATGGCGTCCTCATCCCTTT
CCCCTGCTACTCAGCTTGGTTCTAGCAGAAGTGCTTTGATGGCGATGTCAAGTGGGTTGTTTGTGAAGCCAACGA
AGATGAATCATCAAATGGTTAGAAAAGAGAAGATTGGATTGAGAATTTCTTGTCAAGCGTCGAGTATTCCAGCAG
ACAGAGTTCCAGATATGGAAAAGAGGAAGACTTTGAATCTTCTTCTTCTTGGGGCTCTTTCTCTACCTACTGGCT
ACATGCTTGTCCCTTACGCTACCTTCTTTGTTCCTCCTGGAACCGGAGGTGGAGGTGGTGGTACTCCAGCCAAGG
ATGCCCTTGGAAACGATGTAGTTGCAGCGGAATGGCTTAAGACTCATGGTCCCGGTGACCGAACCTTGACCCAAG
GATTAAAGGGAGATCCGACTTACCTAGTTGTAGAGAACGACAAGACTTTAGCGACATACGGTATCAACGCAGTGT
```

Figure 2 continued

GCACTCATCTTGGATGTGTTGTGCCATGGAACAAAGCT

> SEQ ID NO:1624 175378 253565_301671_1b
ATCAAAGTTCAATGACCATGGCAGCCACAATCTCTAGCGTGGCTTCGGCAGCTAAGCTCTCGTCGGCACAGAATG
GAATTCACTCTCCATCGCCTTCGTTCTCGTCGCTGCCTCTGCTTCCAGGNAAGACGAAGAAGTGTACAACTGTGT
GCCAAGCAGCATCGGTCCCGGTCAATGTCCCAGACATGGGAAAGCGGCAGCTCCTCAACAAACTGCTACTTGGAG
CACTCTCGTTGCCGACAGCCGGGATCCTGGGGCCGTACCTCTCATTCTTCGTTCCCCCCGGCTCCGGCGGAGGTG
GCGCCGGTCTTATCGCAAAAGACGCCATTGGGAACGATATCATAGCTACAGATTGGCTCGCATCGCATCCCGTCG
GTGATAGAACACTCAGCCAAGGCCTGAAGGGAGATCCAACTTACCTCGTTGTCGAGAACGATGGAACGCTGGCAC
CTTATGCAATCAACGCCGTTTGCACGCATCTCGGGTGTGTGGTTCCATGGAACAAAGCCGAGAACAGGTTTATCT
GTCCTTGCCACGGTTCTCAATACAACAACCAGGGAAGAGTCGTTCGAGGTCCTGCACCTTTGTCTCTAGCGTTGG
CTCACTGCGACATCGACAACAACAAAGTTATCTTGAGTCCCTGGCCCGAAACAGACTTTAGAACGGGAGAGAATC
CATGGTGGGCTTAAAACCACCACCTTTGCTCGCTTTGCTCGAGACAACAATTTGTAAAAGGCATTATCATATACC
CGTCTTATTAAATAATTCAAGAAAAC

> SEQ ID NO:1625 175378 136818_300439_1b
CCCCTGGTGGACACCCTGCGCTGCAGCCGAACGACCGAGCTACCGAGCTAATCCAGCCATGGCCTCCACCGCGCT
CTCCACCGCCTCCAACCCTACTCAGCTGTGCAGGTCTCGCGCCTCGCTGGGCAAGCCCGTCAAGGGCCTGGGCTT
CGGCCGGGAGCGCGTGCCGAGGACGGCGACGACCATCACATGCCAGGCCGCGAGCAGCATCCCGGCCGACCGCGT
CCCGGACATGGGCAAGCGCCAGCTGATGAACCTCCTCCTGCTCGGCGCCATCTCGCTCCCCACCGTCGGCATGCT
CGTCCCCTACGGCGCCTTCTTCATCCCCGCCGGGTCCGGGAACGCCGGCGGCGGGCAGGTCGCCAAGGACAAGCT
CGGCAACGACGTGCTCGCCGAGGAGTGGCTCAAGACACACGGCCCCAACGACCGCACCCTCACCCAGGGGCTCAA
GGGTGACCCGACGTACCTCGTCGTGGAGGCCGACAAGACGCTGGCCACGTACGGGATCAACGCCGTGTGCACGCA
CCTTGGGTGCGTCGTGCCGTGGAACGCCGCCGAGAACAAGTTCATCTGCCCCTGCCACGGCTCGCAGTACAACAA
CCAGGGCAGGGTCGTCCGTGGACCTGCTCCCCTGTCGCTGGCATTGGTGTACGCCGACGTC

> SEQ ID NO:1626 175535 191084_300738_1b
CCCCCCCCGGATGAGAATGGCCGCGCCGCAGCAAGTGGGTGTGCGTGCCGCCCCGCTCGCGCGCGCGCTCCGAAC
TCGCGTCGCCGCCGCCGCCGCGTCTGCGAGCTCTCCCGAACGCGCGCTCCTCGGCCTCTCCGAACCAGATCTCCG
GCAGCTCGCCGTCGACCTCGGCCAGCAAAGTTACAGGGGGAAGCAGCTTCACGACCTCCTCTACAAGTCCAGGGC
CAAGCAAATCCAAGAATTTAGCCACGTACCAAAGGTGTTCCGTGAGGCCTTGGTCGGCGCTGGCTGGAAGGTTGG
CCGCTCGCCAGTGCACCCATGCTGTGACGGCCTCCGATGGCACTACCAAGATACTTCTCAAGTTGGAGGATAACAG
ATTGATCGAAACAGTAGGGATCCCTGTCGATGATGACAAAGGCCCGTCAAGACTCACTGCCTGCGTTTCATCACA
GGTTGGCTGCCCCTTGCGTTGCTCATTTTGTGCCACTGGCAAGGGAGGGTTTGCAAGAAACCTTCATGCACATGA
GATTGTGGAGCAGGTTTTGGGCATAGAGGAGACGTTCCAACACAGGGT

> SEQ ID NO:1627 175535 267881_200119_1b
ATGGAAGGTTGGAAGGTCTCTAATTCATAATGCAGTCACCGCAGCTGATGGGACCATTAAGTTGTTAATAAAACT
CGAGGACAACCGATTGGTCGAGACTGTTGGAATTCCAGTTAAAGACAAAGATGGTTCATCTCGCTTGACTTAGGT
GNNTTATCTCAGGTGGGCTGCCCATTACGCTGTTCGTTCTGTGCCACTGGCAAAGGAGGATTCTCAAGGAACCTT
AAGAGCCATGAAATTGTTGATCAGGTCTTGGCAATAGAAGAGCTATTCAATCAGAGAGTGACAAACGTTGTCTTT
ATGGGTATGGGGGAGCCAATGTTGAACATGAAAGAAGTCCTTGAAGCACATCGTTGCCTGAATAAGGATATTTTG
ATTGGGCAAAGGATGATTACGATTTCTACTGTTGGAGTTCCAAACACCATAAAGAAGCTCGCATCTTACAAACTT
CAGTCAACATTGGCTCTCAGCTTACATGCTCCAAATCAGAATCTTCGGGAAAAGATTGTACCAAGTGCAAAGTCC
TACCCTTTGAATGCAATTATGAAGGATTGCAGGGACTACTTCCTGGAAACTAGAAGACGGGTTTCCTTTGAATAT
ACACTNTTAGCCGGAGTGAATGATTCGGTCGAGCATGCGATTGAACTGGCAGAATTGCTTCATGAATGGGGTCGT
GGTCATCATGTGAACTTAATACCATATAATCCAAT

> SEQ ID NO:1628 175706 106172_300458_1b
TTTTTGAGTTTCCTCACCACAAAATGATTCCAAGAAAGCATTGGTTTTTATTTATTACATTATAGCCATATTTAT
TCCAAAATTAATGTTGGCTCAAAACTGTGGGTGTGCAGAAGGTTTATGCTGCAGCAGATGGGGTTACTGTGGCAC
TGGAAATGAATATTGTGGTCAAGGCTGCAAAGGAGGGCCTTGTTTTATTTCAGCAAATTATGGAATTTCATCAGT
TTCTGAAATTGTTTCTGAACCATTTTTCAATGGAATTGCTAATGAAGCGGCTCCAAACTGTGAAGGCAAAGGATT
TTACACAAGATCTGCTTTTCTTGAAGCTCTCAGGTCTTATCCTACATTTGGAACTGATGCTTCTTCTGATGATAA
TAAGCGTGAAATTGCTGCTTTCTTTGCTCATGTTACCCATGAGACTGGACAAATGTGCTACAGAAATGAGATAAA
TGGTGCATCTAGGGACTATTGTGACGAGACAAATGCAGAGTACCCATGTGTTCTCGGCAAGAAATATTACGGTCG
AGGACCGATACAATTGTCATGGAATTTCAACTATGGACCGGCGGGGAAAGACAATGGATTCGACGGCCTGAACGA
CCCTGATATCGTTGCTAGAGACAGTCTGATATCATTCAAAACTGCCCTGTGGTACTGGATGAACAATTGCCATGC
TCTCATAACTTCTGGACAA

Figure 2 continued

> SEQ ID NO:1629 175706 21621_300070_1b
CACCCACGCCTCCGCAAAGCGGTGCTTTCACAAAAATCTCCTTAGTCCTTCTTCTCTGCCTCTTAGGTTTCTTTT
CTGAAACTGTCAAGTCTCAAAACTGCGGTTGCGCTCCAAACCTCTGTTGCAGTCAGTTCGGTTACTGTGGTACCG
ACCATGCATACTGCGGTGTTGGATGCCGATCAGGTCCTTGTAGAGGTAGTGGAACCCCTACCGGAGGGTCGGTCG
GTAGCATTGTGACACAAGGTTTCTTTAACAATATTATCAACCAAGCTGGTAATGGTTGCGCGGGGAAAAGATTCT
ACACCCGTGACTCTTTCGTTAACGCCGCTAATACTTTCCCCAACTTTGCCAATTCTGTTACCAGACGTGAAATTG
CTACCATGTTTGCTCATTTCACTCACGAGACCGGACATTTCTGCTACATAGAAGAGATTAACGGAGAAACACGTA
ACTACTGCCATAGCAGCAACACACAATACCCATGTGCACCGGGAAAAGGCTACTTCGGTCGTGGTCCGATCCAAC
TATCATGGAACTACAACTACGGAGCGTGTGGTCAAAGTCTCGGTCTTGACCTTCTACGCCAGCCCTAACTTGTGG
GTAGCAACCCAACTGTAGCTTTCAGGACGGGTTTGTGGTTTTGGATGAAT

> SEQ ID NO:1630 175706 38484_300202_1b
CCCACGCGTCCGCCATATTCCTCAACAACATCAAAATGTTGACTCCCACCATTTCTAAATCCATCTCTTTAGTAA
CCATTCTATTAGTTCTACAAGCTTTCTCTAACACAACAAAGGCTCAAAATTGCGGTTGTTCGTCAGAGCTATGTT
GTAGTCAGTTTGGCTTTTGCGGTAACACTTCAGACTATTGTGGTGTAGGTTGCCAACAAGGACCTTGTTTTGCTC
CTCCCCCTGCAAATGGTGTCTCTGTGGCTGAGATTGTAACGCAAGAATTCTTCAATGGAATCATCAGTCAAGCCG
CGTCTAGTTGCGCCGGCAATAGATTTTACAGTCG

> SEQ ID NO:1631 175706 246948_301615_1b
ATCTTCAACTCCGAGTTCTCTTCCTCCTGCTCGCGATCTTAGCTGCCGCTGCCGAAGACTGCGGACGACAAGGCG
GCGGAAGAAGTTGTCCGCCTGGAAACTGCTGCAGCAGGTGGGGATGGTGCGGTGACACTCCCGACCACTGCGGCG
AAGGCTGCCAGAGTCAGTGCGGTGGAGTAACACCGCCGCCTGGTGACGGTGTCGGATCTATCATCACGAACTCCA
TCTTCGAGAGCCTGCTCAAGCACCGCAGAGACTCGGGATGTGCCGGTGGCTTCTACACGTACAGTGCGTTCCTCA
CGGCTGCCAGATCTTTCCCGCGGTTTGGAAACGAAGGCTCGTTGGAGCAGAGGAAGCGAGAGCTCGCTGCCTTCC
TGGCACAGACATCCAAGGAGACCACAGGTGGATGGCCGACTGCTCCTGACGGGCCTTATCGATGGGCTATTGCT
TCGTTGAGGAACAAAATAAGGACATCTACTGCAGCGCTTCGGCGACATGGCCATGTAATGGCAGCAAAAGATACT
TTGGTCGTGGTCCCATTCAGCTTACATGGAACTACAACTATGGCCTGGCAGGATCACAAGTCGGCTTCGACGGCA
TCAACGATCCGGACATCGTTTCGCGAGACGCGGTGGTGTCGTTCAAGACAGCGATCTGGTTCTGGATGACGCCAC
AGAACCCGAAGCCTTCGTGTCACGACGTAATTCTGGGGAAATGGAGGCCATCCAGTGCCGACTTAGCAGCGGGAA
GGACTGCGAGCTAT

> SEQ ID NO:1632 175706 227740_301026_1b
GGCCCGCGAGGGGGTTCTACACCTACGCGTCTTCGTCAGGGCCGCGACGAGGTTCCCCCGGTTCGCCGCCACGGG
CTGCGCCGACGCCCGCAAGCGCGAGGTCGCCGCCTTCCTCGCGCAGATCTCCCACGAGACCACCGGCGGCTGGGC
CACCGCGCCCGACGGCCCCTACGCCTGGGGCCTCTGCTACAAAGAGGAGATCAACCCGCAGAGCAGCTACTGCGA
CGCCACCGACAAGCAGTGGCCGTGCTACCCCGGCAAGTCCTACCATGGCCGAGGCCCCATCCAAATCTCATGGAA
CTTCAACTACGGGCCGGCGGGCCAGGCCCTGGGCTTCGATGGTCTGCGCAACCCGGAGATCGTGGCCAACTGCTC
GGACATAGCGTTCCAGACGGCGCTGTGGTTCTGGATGACGCCGAGGGACACCAAGCCGTCGTGCCACCAGGTGAT
GGTCGGGGAGTACCGGCCCGGCCCGGCCGACGTGGCGGCTAACCGCACGGCGGGCTTCGGGCTGGTCACCAACAT
CGTCAACGGCGGGCTCGAGTGCAACCGGGCAGGCGACGCCCGGGTGAACAACCGCATCGGCTTCTACCGGCGCTA
CTGCCAGGTGCTCGGCGTC

> SEQ ID NO:1633 175706 193681_300741_1b
CCCCCCGAACCATCACCTCTTTCACACCATATCCTATAATGGGGAACTCACCGACGCCGACAATGCTGGCGTTCC
TGGCTCTTGGGCTAGCGCTCCTCCTCTCCGGCACCGGCCAGGCGAGCGCGCAGAACTGGGGCTGCCAGTCGAACA
TGTGCTGGAGCAAATGGGGGTACTGGGGCACGGGCAAGGGCTACTGGGGAAATGGGTGCCGCTCTGGCCCGGGCT
ACGGCGGCGGCGGCGGTGGAGGAGGAGGAGGCGGAGGTGGTGGAGGCGGAAGCGGAGGCAACGGCGTGTCTGGAA
AGAGCGTGGTCACCGAGGCGTTCTTCAATGGGATCAAGAACCAGGCCCCGAACGGTTGCGCCGGCAAGAACTTTT
ACACACGACAGTCGTTGCTTAACGCTGCCCACTCCTACTCGGGCTTCGCCAGGGACCGGACCAACGATGACTCCA
AGCGTGAGATCGCTGCCTTCTTTGCCCACGTCACTCATGAGACCGGACATATGTGCTACATCAACGAGATAAACG
GG

> SEQ ID NO:1634 175706 137832_300705_1b
GCCAGAGCCAGTGCTCCGGCAGCTGCGGCGGCGGCGGCCCGACCCCGCCCTCCGGCGGTGGCGGCAGCGGCGTCG
CCTCCATCGTGTCGCGCTCGCTCTTCGACCAGATGCTTCTCCACCGCAACGACGCGGCGTGCCCGGCCAAGAACT
TGTACACCTACGACGCCTTCGTCGCCGCCGCCAACGCCTTCCCGAGCTTCGCCACAACCGGCGACGCCGCCACCC
GCAAGCGCGAGGTCGCCGCGTTCCTGGCGCAGACGTCGCACGAGACCACGGGCGGGTGGCGACGGCGCCCGATG
GCCCCTACTCGTGGGCTACTGCTTCAAGGAGGAGAACAACGGCAACGTTGGGTCCGACTACTGTGTCCAGAGCT

Figure 2 continued

CGCAGTGGCCGTGCGCCGCCGGCAAGAAGTACTACGGCCGGGGACCCATCCAGATCTCCTACAACTACAACTACG
GCCCGGCGGGGCAGGCCATCGGCTCCAACCTGCTGAGCAACCCGGACCTGGTGGCGTCGGACGCCACCGTCTCCT
TCAAGACGGCGTTCTGG

> SEQ ID NO:1635  175706 12309_300278_1b
CCCACGCGTCCGCAAAACATGGCTTTCACAAAAATCTCCTTAGTCCTTCTTCTCTGCCTCTTAGGTTTCTTTTCT
GAAACTGTCAAGTCTCAAAACTGCGGTTGCGCTCCAAACCTCTGTTGCAGTCAGTTCGGTTACTGTGGTACCGAC
GATGCATACTGCGGTGTTGGATGCCGATCAGGTCCTTGTAGAGGTAGTGGAACCCCGACCGGAGGGTCGGTCGGT
AGCATTGTGACACAAGGTTTCTTTAACAATATTATCAACCAAGCTGGTAATGGTTGCGCGGGGAAAAGATTCTAC
ACCCGTGACTCTTTCGTTAACGCCGCTAATACTTTCCCCAACTTT

> SEQ ID NO:1636  175904 50064_300166_1b
AAAACACAGAACAAGAATTAGAAAGAAGGGAGAGAAAGCAAAAATGGCGCTAAGAATGTGGGCTTCTTCTACAGC
AAACGCTCTCAAGCTTTCTTCTTCTGTTTCCAAGTCTCATCTCTCTCCTTTCTCCTTCTCTAGATGCTTCTCCAC
AGTTTTGGAGGGTTTGAAGTATGCAAATTCACATGAGTGGGTTAAACATGAAGGCTCTGTTGCCACCATTGGCAT
CACTGCCCATGCTCAGGACCATTTAGGTGAAGTGGTGTTTGTTGAACTGCCAGAGGACAATACTTCAGTGAGCAA
AGAGAAAGCTTTGGAGCAGTGGAGAGTGTGAAGGCAACAAGTGAGATCTTATCACCAATCTCAGGTGAAATCAT
TGAGGTTAACAAGAAGCTCACAGAATCACCTGGCTTGATCAACTCAAGCCCCTATGAAGATGGTTGGATGATCAA
AGTGAAACCAAGTAGCCCCGCGGAGTTGGAATCTTTGATGGGTCCAAAGGAATACACCAAGTTCTGCGAGGAGGA
AGATGCTGCTCACTAGGAGGGTTTCTCTCTGTCTTTTATGTTCGAAGTTCTATCAATTCTCATGCTTGTTTTCTA
AATTTGCATACACTCTATGACCAACTTCACAAAATAAGAGTTCAAGAAGATGAAACAGAGACCTAACAAACACAT
TAAGATTT

> SEQ ID NO:1637  175904 274733_200059_1b
GAAATGTTAAAAGTGACACCTACAAAGCACACCTCACCAACTTTTGCTGAATGAGTTTGTCGACACATCGATCCA
CCAGCCACCACCTTTCTCTTCCCTACTTTTATTATTGCTTCCACTTTCTATTCAATACACCATTTATTTTCCACT
CGAAAAGCTATTTCCCTAATACATTGCACGTTTGTCACAACTCTATATTGAACTTAAAAAAATGGCAACAAAGTT
ATGGGCTTCAAGGGCTGCTTCATATCTCGGGATCTCAACATTTCACAGGGCTTTTGCTACTGTGGCCAAGGATTT
AAAGTATGCAGAGTCTCATGAATGGGTTAAAGTTGATGGTAGTTCTGCAACAATTGGCATCACTGATCATGCTCA
GGATCATTTAGGTGATGTTGTCTATGTTGAATTGCCTGAAGTTGGGGCTTCTGTAAATCAATTTGACAGTTTTGG
TGCTGTTGAAAGTGTCAAGGCCACCAGCGATATCAATTCTCCTGTTTCAGGGAAGGTGGTGGAAGTTAATGAGAA
GCTCGACTCCTCTCCTGCTCTGATCAATGGGAGCCCATATCAAGAAGGATGGATTATAAAGGTGGAGATGAACAA
CCCCGACGAGCTCAAATCGTTGATGGACCCTGACAAGTATTCCAGTTTTTGTGATGAAGAAGACGCGAAACACTG
ATTGAAACCTCACAAAGTTGAGCAAGAACGCACTTTCCTGCAGGATTTTTCGTAGTGCATAAATAGGC

> SEQ ID NO:1638  175904 229762_301046_1b
AAGCTTTTGTGGCCGCAAGGCTGCGCTCCAGTGCTTGTGGAAGGAACATTCTCTGCCCTAATAATCTGTCTTGCT
GCTTACTACGATGGCTCTACGCACCATGGCGACGCAAGCTGCGACGCTGCTGAGAATTCGGTGCCAGCCGAACTA
CCTCGCGCAGGCGCTGGCAATTCGTGGATTTGCAACTGAAGCCGCAGCTACCGTTCCAATTCCCCAAGATTTGAA
GTTCCTCGAGTCGCATGAATGGGTGAAAGTGGAGGATGGAACTGGCACCGTAGGAATCAGTGACCATGCTCAGCA
TGAGCTTGGAGACGTTGTGTTTGCGGACTTGCCCGAGGTGGGGTCGTCGGTGAGCAAAGGCAAGAACTTTGGCGT
GGTGGAGAGCGTCAAGGCTTGCAGCGACATCTACAGCCCCGTCTCTGGCGAAGTCGTCGAAGTGAACGAAGAGGT
CAAGGCAACGCCAGCTCTGGTGAACAAGAGTGCATTCGGCGATGGATGGCTCATCAAAGTAAAGCTGTCCAGCGT
GTCGGACCTCGACGGCCTAATGGATTCAGCAGCATACGAAGAGCACGTCAAGAGTGAGGCTCACTAGCCGAGCAC
AAAGCGCAAAGCACAAATCACAGTATGTTTCGAAAAGCTCTACTAGCAAGAAGGATAATTTTCTTTCCAAAGTCC

> SEQ ID NO:1639  175904 209384_300814_1b
AGCTAACTAGGAGAAGGAAAAAAGAAGAACGCAGATACTTTGGTAACAAGCAAGAAATTGGCACAGAAATGGCTC
TGAGGCTGTGGGCTAGCTCAGCTGCCAATGCCCTCAAGATCTCATGCAGTGGAGCCACCAGGGCTGCACCTGCCT
ACTCAATCTCCAGATACTTCTCCACTGTTCTTGATGGGTTGAAGTACAGCTCCTCTCATGAGTGGGTCAAGAATG
ATGGCTCTGTGGCCACAATTGGAATTACAGACCATGCTCAGGGCCATCTGGGAGAGGTGGTGTTCGTGGAGCTGC
CGGAGGCGGGGGCGAAGGTGAGCCAGGGAGGTGCATTCGGCAACGTGGAGAGTGTGAAGGCCACCAGCGACATCA
ACTCCCCCATCTCCGGTGAGGTCGTCGAGGTTAACGACAAGCTCTCTGAGACACCCGGCCTGATTAACTCAAGCC
CGTACGAGGACGGGTGGATGATCAAGGTGAAGCCGAGCAGCCCGTCGGAGCTGGACGCCCTGCTGGACCCGGCCA
AGTACACCAAGCACTGCGAGGAGGAAGACGCTCACTAGGCTCTTCCTCTCTGTGTTTTTCTCTCCCATTTTGTC
ACTCCGACCTAAT

> SEQ ID NO:1640  175904 146987_200005_1b
GCCATTACGGCCGGGGACATTACTAGAGAGAAAAATGGCTTTGAGAATGTGGGCTTCTTCAACAGCCAATGCATT

Figure 2 continued

GAGAATTTCCACTGCCTCAAGAGCTAATCTTTCCCCTGCTTATTCACTCTCTAGATGCTTTTCCACTGTTCTTGA
TGGGTTGAAGTATGCATCTTCACATGAATGGGTGAAGCATGAGGGTTCAGTGGCAACAGTTGGAATCACTGACCA
TGCTCAGGATCATCTTGGAGAAGTAGTATTCGTAGATCTACCAGAAACTGGTGCTGCTGTTTCACAAGGAAGCAG
TTTTGGTGCTGTTGAAAGTGTGAAAGCTACCAGTGACATTAACTGTCCAATCTCGGGCGAGATCGTTGAGGTCAA
TACAAAGCTCACTGAAACACCTGGTTTGGTTAATTCGAGTCCATATGAAGACGGGTGGATGATTAAGGTGAAGCC
GAGCAGTCCATCCGAGCTAGAATCTTTGATGGGGTCCAAAGAGTACACAAAATTCTGTGAAGAAGAGGATAGTCA
TTAAAACTTGAAGGTTTTTCTTTATTCAACGTGGACTAACTTTGCCTGGTTAAGGCTGATACTGTGATGAAACTT
CCTGTCACTTGTTAAAATTCTACAAAAATCAAAATAACATCCACTTTCCTGGTGTTTTCTATGCCTTATGCAGAG
TTGTGATGTAGTTTTTG

> SEQ ID NO:1641 175904 136845_300439_1b
CCCGATCCCCTCATCTCACTGCAGCTTTCCGCTATACTACCACCACCACTGAGCTGCCACTACTCATCCAGCTAA
CTAGGAGAAGGAAAAAAGAAGAACGCAGATACTTTGGTAACAAGCAAGAAATTGGCACAGAAATGGCTCTGAGGC
TGTGGGCTAGCTCAGCTGCCAATGCCCTCAAGATCTCATGCAGTGGAGCCACCAGGGCTGCACCTGCCTACTCAA
TCTCCAGATACTTCTCCACTGCTGTTCTTGATGGGTTGAAGTACAGCTCCTCTCATGAGTGGGTCAAGAATGATGGCT
CTGTGGCCACAATTGGAATTACAGACCATGCTCAGGGCCATCTGGGAGAGGTGGTGTTCGTGGAGCTGCCGGAGG
CGGGGGCGAAGGTGAGCCAGGGAGGTGCATTCGGCAACGTGGAGAGTGTGAAGGCCACCAGCGACATCAACTCCC
CCATCTCCGGTGAGGTCGTCGAGGTTAACGACAAGCTCTCTGAGACACCCGGCCTGATTAACTCAAGCCCGTACG
AGGACGGGTGGATGATCAAGGTGAAGCCGAGCAGCCCGTCGGAGCTGGACGCCCTGCTGGACCCGGCCAAGTACA
CCAAGCACTGCGAGGAGGAAGACGCTCACTAGGCTCTTCCTCTCTGTTTTTTTCTCTCCCATTTTGTCACTCCGA
CCTAATTTCTCCCTGTTGCAACAACTGCTCTGTATCCGTATACGATTAATAACTGAATCTTCAGGCTTTGCCATG
TGTTC

> SEQ ID NO:1642 175904 129901_300483_1b
GAATTCATGAGAGTGTGGGCTTCTTCAATTGCGGGGCACTTAAATTCTCTTCATCTTCTACCTTGAAGCAGACT
TCACTCTATCCATCTGCTTTTGCCGCCTCCAAATGCTTCTCCACCGTTTTGGATGGATTGAAATATGCACCATCA
CATGAATGGGTGAAACATGAAGGAGATGTACCTACCATTGGTATTACAGACCATGCTCAGGATCATTTGGGAGAG
GTGGTGTTTGTGGAGCTACCATAAGCTGGTGGTGCAGTGACAAAAGCAAGTGGATTTGGAGCTGTAGAGAGTGTC
AAGGCAACAAGTGACATCAACTCGCCTATTTCTGGAGAGATTGTTGAGGTCAACACCAAGCTCACCGACACCCCT
GGCTTGATTAACTCAAGTCCTTATGAGGATGGATGGATGATCAAAGTGAAACCATCAAGTCCAGCTGAACTTGAA
TCTTTAATGGATTCAAAGGGTTACACCAAGTTCTGTGAGGAAGAAGATGCCAGCCATTAATTTAGTTTGATGGAT
ATGTTTCTTTCTTTGCCACTTTGTTTCGAAATTTCGATTTGGGTTAGCTAACTGAAATTTCTCCATCTGCAGTTG
TTATCAATAATGATGTCAATATTACTGAA

> SEQ ID NO:1643 175904 11914_300070_1b
ATGGTATCAACGCACAGTGGCCGGGTACGGCCGGGGGAAAAATGGCTTTGAGAATGTGGGCTTCTTCAACAGCCA
ATGCATTGAGAGTTTCCACTGCCTCAAGAGCTAATCTTTCCCCTGCTTATTCACTCTCTAGATGCTTTTCCACTG
TTCTTGATGGGTTGAAGTATGCATCTTCACATGAATGGGTGAAGCATGAGGGCTCAGTGGCAACAGTTGGAATCA
CTGACCATGCTCAGGGTCATCTTGGAGAAGTGGTGTTTGTGGATCTACCAGAAACTGGTGCTGCTGTTTCACAAG
GAAGCAGTTTTGGTGCTGTTGAAAGTGTGAAAGCTACCAGTGACATTAACTGTCCAATCTCGGGCGAGATCGTTG
AGGTCAATACAAAGCTCACTGAAACACCTGGTTTGGTTAATTCGAGTCCATATGAAGACGGGTGGATGATTAAGG
TGAAGCCGAGCAGTCCATCCGAGCTAGAATCTTTGATGGGGTCCAAAGAGTACACAAAATTCTGTGAAGAAGAGG
ATAGTCATTAAAACTTGAAGGTTTTTCTTTATTCAACGTGGACTAACTTTGCCTGGTTAAGGCTGATACTGTGAT
GAAACTTCCTGTCACTTGTTAAAATTCTACAAAAATCAAAACAACATCCACTTTTCTGGTGTTAAAAAAAA

> SEQ ID NO:1644 175904 1119431_301897_1b
GTCAGGTTCTAGGAAGAGAGAGAGAGAGAGCCTAGCCAGCCAGCCAGCCAGAAAACGGTAGTTATGGCCCTTC
GTTCATTTGCTGCGCAGGCTGTCTCTCGCCTCCGTTGCAGTTGCCGTAGTAGCGGCAACTTCGCACCTGCCGTCG
CTTCTTCCTTCCTTCGCCATTTCAGCTCTGCCTATCCATCGGACTTGAAGTACGCCAAATCGCACGAATGGGTGC
GAGCCGAGGATTCCAAGGCGACCATGGGCATTACCGACTTTGCCTTGGAGCAACTGGGAGATGTGGTTTATGTGG
AATTGCCTAGCGTTGGACAGGAGGTAGCTCAAGGCGAGTCTGTTTGCACGGTGGAGAGTGTCAAAGCAGCCAGTC
AGGTCTATGCCCCCATCAGCGGGAAAGTAGTTGAGGTCAACACCGAGATCACAACGAAACCTGAAACGATGAAGG
ATGATCCCTATGGAACAAGCTGGTTGGTGAAATTTGATATCAGCAAACCTGATGAGCTCAAGGCACTCTTGGACG
CAGATGCTTACAAGACCCAAGTTGAGAGTGAAGAACATCACTGATTTAGTAATCCTGAACCTTATTCTTGTTGT
AAGCAGTTGAATGCCAGTTATCTTTATTGAAATCAAATATGATCCAAATCAGATCAATATGTGGAGGGACTATGG
GCTAGTGAGTTGTTGTCTTGTCTCGTTCTTGA

> SEQ ID NO:1645 180809 104214_300060_1b
CTTCACTCTGTCTTCACACTCTCTGCTTTTGCCGTAGGACAGAATCGTCGAGTTTAGTGACGAAGACTGTAATCA

Figure 2 continued

ATGGCATCAGCTACAGCTTCTCACACTTTGTGCGGCATCCCCGCCACCTCATCCTCTACTACCAACAAGTCTATT
GCCCCTTCATCTGCTCGCTTCCTCTCTAAAACTCCTCTCCGCCGCCTCGGCTTCGCTGGCGCCGCCGCTGATTCT
CTCTTCACCAACCACGTGGCAACCAAGCTCCGATCCCTCAAGAGCTCCTCCAAGCCTGTTAGGGGCGTTGCTTCT
ATGGCCAAGAAAAGCGTCGGAGACCTCACCGCTGCCGAGTTGAAGGGCAAGAAAGTCTTCGTCAGGGCCGATTTG
AATGTCCCACTTGATGATAGCCAGAACATTACTGATGACACTAGAATTAGAGCTGCCGTCCCTACTATCAAGCAC
TTGATGGCCAATGGTGCTAAAGTTATTCTCTCCAGTCACTTGGGACGGCCAAAAGGAGTCACTCCTAAATACAGC
TTGGCACCCCTAGTCCCTAGGCTATCCGAACTGCTTGGAATCCAGGTTGTGAAGGCTGAGGACTGCATTGGTCCG
GAAGTCGAGAAGTTGGTTGCTTCACTTCCCGAGGGTGGTGTTCTTCTTCTCGAGAACGTGAGATTCTACAAGGAG
GAAGAGAAGAACGAACCTGAGTTTGCAAAGAAACTTGCATCATTGGCAGATCTTTACGTAAACGATGC

> SEQ ID NO:1646  180809  225349_300986_1b
GTTCTATCGATCGATCGATCCATCAGCCATGGCCGCCGCAACAGCCGCCGCATCGTCGCAGCTCCTCTCGCCGGC
GGCGTCGCTGGGCTCGGCGGCGTCGCCGTCGTCGTCGTCGTCGCCTTCCGGCAATCGCGCCGGGTTCAGGTCATT
GGGGAGGCAATGCTTCGCGGGACTCGTCGCGGGGCCGGGAGGTGCGGCGGCTGGGGGATTTCGAGCGGCAGCA
GCCGGATTTCGCGGCCGGCAGTGGCGGCGGCGGTGAGGTCGTCGGGGGGCAATGGGCGCGGCAGCCGCGCGTGGT
GTGCATGGCCAAGAAGAGTGTGGGGGATCTCAAGGAGGCGGACTTGAAAGGCAAGCGTGTCTTTGTCAGGGCTGA
TCTCAACGTTCCACTGGATGCCGATCTAAACATCACCGACGATACGAGGATTCGTGCTGCCGTGCCGACGATCCA
GTATCTCATTGGCAATGGGGCTAAGGTCATCCTCAGCAGCCATCTGGGGCGTCCCAAAGGAGTGACCGAGAAGTA
TCGACTTACACCTCTTGTTGGAAGGCTCTCAGAGCTCTTGGGAACCAAGGTTGAGAAGGCTGACGATTCCATTGG
TCCCGAAGTCGAGAAGAAAGTTGCTGCTTTGCCCGATGGTGGACTGCTACTTCTCGAGAATCTGAGGTTTTATCC
TGACGAGG

> SEQ ID NO:1647  183214  1110434_301789_1b
GCGGGAGCAAGCAAAATTTAAGCCCTGATCGGATTGTGGAGGTTTATGCTATTTGAGAAGCCAAAAAGCTACTAC
GCCCGTTTTTCCAGAAGATAATGTCCGTGACTTTGCATACGAATCTGGGAGACATCAAGTGTGAAATCTTCTGTG
ACGAAGTCCCCAAGACGGCTGAGAACTTTCTGGCCTTATGTGCCAATAATTATTACGATGGAAACATCTTCCACC
GGAACATCAAAGGATTCATGATTCAAGGTGGCGATCCAACAGGGACGGGAAGAGGAGGCACTAGCATATGGGGAC
GCAAATTCAGTGATGAAATCCGGGAATCTCTCAAGCATAATGCGACGGGTATTCTTTCCATGGCAAATAGTGGTC
CAAATACCCAATGGAAGTCAGTTCTTCATTTCATATGCCAAGCAGCCTCATCTAAATGGCATTTACACTGTGTCT
GGACGGGTTA

> SEQ ID NO:1648  183214  128338_300475_1b
CCCAACCCCCCCCGAGTCAGCTCTAATAGGGCCAAAGACTCTAGCAGCAAAACATGTCAGTGACGCTTCATACAA
ACCTAGGCGACATCAAGTGCGAAATCTTCTGTGACGAAGTCCCTAGAACTGCTGAGAACTTCTTGGCATTATGCG
CAAGTGGTTATTATGATGGGACAATATTTCACAGAAACATAAAGGGTTTCATGATCCAAGGGGGTGACCCAACAG
GTACAGGAAAAGGCGGGACAAGTATTAGGGGAAAAAAATTCAATGACGAGATAAGGGAGTCTCTCAAGCACAATG
CAAGAGGAATATTGTCAATGGCCAACAGTGGCCCTAATACCAACGGGAGCCAGTTTTTCATGACATATGCCAAGC
AACCACATCTTAATGGATTGTACACCATTTTCGGAAAAGTGATACATGGATTTGAGGTTCTTGATATCATGGAAA
AGACTCCAACAGGACCAGGTGATAGGCCCCTTGCCGAAATCAGACTCAACCGGGTGACAATACATGCTAATCCAC
TTGCTGGTTGACGTTATTTCGAACTCATGCTACGGCAGTATGTTTAATCTCATTATTG

> SEQ ID NO:1649  183214  259667_301707_1b
AGTTCATTTTTGTTGCAGCTGAAGGCTTGTGTGTTGTTGCAGTCGGTGACATTGCACACCAATTTGGGAGACATC
AAGTGCGAGATCTTCTGCGACGAGGTACCAAAGGCAGCAGAGAACTTTCTGGCACTGTGCGCTAGTGGCTACTAC
GATGGTACCGTCTTCCACCGCAACA

> SEQ ID NO:1650  183214  245451_301568_1b
TAGGGCTAGTGTCGCCATGGGGAGAATGAAGCCGGCAGCACTGCTGCAGCAAAGCAAGCGCAAGAAGGGACCGTC
GCGGCTCAGCCTTCCCACCATCGTCTCCTGCAACCTCATCGTCGTCCTCCTCTTCTTCTCCATCCTAGCGCTCCA
CAGGCACAATCGCAATAGTAGTAGCGGCAATTGGAATGCCCAGGTCGCTGGACGAAAGGAGAAAATGGGACTTCT
TCCCAAGTATGCGTGGATGAACACAACCAAAGGGGTAATTGTTTTGGAGCTCTTTGGCGATGAAGTTCCGAAGGC
CGTGGAGAACTTCGCGGTGCATGGGCAGAAAGGATACTACGACGGCGTCAAGTTCCACAGAGTGATCAAGGACTT
TATGATCCAAGCTGGTGATCCCACCGGCGACGGACGAGGAGGCGACTCCATCTGGGGTGGATCCTTCAAAGACGA
GTTCAGACCAAACTTGAAGCACGAAGCATTTACGTTATCCATGGCGAATTCTGGCCCGGATTCCAATCGGTCCCA
GTTCTTCATCACAACTGTGGAGACACCACACCTGGATGGCAAGCACACGGTGTTTGGACGCGTTGTGCGTGGTCA
AGAAGTTGTAAAGGAAATAGAAAGCCAGGAAACTAATGCGGAGAATCAGCCTTTGGTCCCTGTTGTCA

> SEQ ID NO:1651  183214  245418_301568_1b
GGGCGCGAGCAACAGCCGTCACCTGCTTCAGGTGGGGGAAGCAAAAGAAAGAAGAGCCTGGAGGAGCTGCGTTTG

Figure 2 continued

GAACGACTGCAGAGGGAGGAGAGCGAACGGGCCAAGGCCCGCAAGTTACTGCCGTCAGGTGGCACTCGGAAGCAC
TACAACTCGAGCTTTGGCAACAGGAGTTAGTGATTTTAGGGTTGTGTTTTGTAATGGAAGAAGGCGCACCGTTAG
TCACTCTGGAGACGTCCATGGGCTCCTTCACTCTAGAGCTCTACCATAAGCATGCTCCCAAAACGTGCCGTAATT
TTGGCGAGCTGGCCAGGCAGGGCTACTACAACGACGTCAAGTTTCACCGCGTCATCAAGGGTTTTATGATTCAGG
GTGGTGATCCCACTGGCACAGGCAGGGGCGGAGAGTCCATCTACGGGCACAAGTTCGAGGACGAGCTAACGCGGG
AGCTCAAGCACACGGGAGCGGGTGTCTTATCCATGGCCAACTCGGGGCCTAACACCAACGGCAGCCAGTTCTTCG
TAACGTTAGCCCCCACACCGTGGCTCGACGGCAAGCACACCATATTCGGGAGAGTCTGCAAAGGGATGGAAGTTA
TCAAGCGGCTGGGAAACGTACAGACGGACAAGAGCGACAGGCCGGTGCACGACGTCACGATTCTCAAGGCCACCG
TGGAAGACTGAGTCAAGAGCTCCTCAGA

> SEQ ID NO:1652 183214 201713_300719_1b
ATCGGCCGTCTTTGGAGGTTTCACTCCTGCGCTTTCCGCTGCTCACAGCCGCGCGCGCTTCGTCTCCTCCGCCAC
CGCTGACCCCAAGGAAGTGGACCTCCAGTCCAAAATCACAAACAAGGTGTACTTTGACATAAGCATCGGAAACCC
TGTTGGGAAGAACGTTGGGAGGGTCGTTATTGGCCTATACGGGGATGATGTTCCCCAGACCGCAGAGAACTTCCG
TGCTCTTTGCACTGGAGAAAAAGGGTTTGGTTACAAGGGGTCCAGTTTCCACCGTGTCATTAAGGACTTCATGAT
TCAGGGAGGAGACTTTGACAAGGGCAACGGTACTGGAGGGAAAAGCATATATGGCCGGACCTTCAAAGACGAGAA
CTTCAAATTGGTTCATACTGGACCTGGAGTGGTCAGCATGGCCAATGCTGGCCAAACACCAATGGCAGCCAGTT
CTTCATCTGCACTGTCAAGACACCTTGGTTGGATGGGAGGCACGTCGTGTTTGGGCAGGTTATTGAAGGCATGGA
CATCGTTAAGATGATCGAATCGCAGGAGACTGACAGAGGGACCGCCCGA

> SEQ ID NO:1653 183214 120564_300411_1b
CGGCTCCATTCATGCCGCAGTGCAGGTGGCCGAGGTGCAATCCAAAGTGACACACAAAGTTTATTTTGATATTAG
CATTGGGAATCCTGTTGGAAAGCTTGCTGGACGAATTGTAATTGGATTATATGGTGATGATGTGCCACAAACAGC
AGAAAATTTCCGTGCACTCTGCACAGGTGAGAAGGGCTTTGGCTACAAGGATTCTGCATTTCATCGTGTTATTAA
AGATTTCATGATTCAAGGAGGTGATTTCGATAAAGGAAATGGAACCGGTGGTAAAAGCATATATGGTCGTACCTT
TAAGGATGAAAACTTCAAGTTGACTCATACTGGACCTGGAGTTGTTAGCATGGCCAATGCAGGCCCTAATACCAA
TGGAAGCCAATTCTTCATTTGCACTGTCAAGACCCCATGGCTTGATGAGAGGCATGTTGTGTTCGGACAAGTTTT
AGAAGGCATGGACATTGTGAAATTGATTGAGTCGCAGGAGACCGATAGGGGTGACCGTCCAAGGAAGAGGGTTGT
CATCAGTGACTGCGGTGAGCTACCTGTGGCATGAGGCGGGAATACAAATATAAAGCACTTTATTATGTTAAGACT
CGTTGCCAGATATAAGAGGATTCTCAGTACTGAGTTTTCATCCAAAACCCAGCTTTTTCCTGTTCCTTTTTT

> SEQ ID NO:1654 183295 1044203_301916_1b
GTGAGTTGATGATGGGCTCTCTGAGCTCCCTCTCTCTCTTCCTCCTCCACTTGGCCTTAGCTTGCCTTGCCTTCT
CCGTAGCTGAGATCATCTTCGAGGAACGTTTTGAAGATGGATGGGATAGTCATTGGGTCAAATCTGGATGGAAGA
AGAGTGAAGGACTTGCTGGAAGCTGGCGACATACAGCTGGCAAATGGTTTTCTGACCCAGATGATAAAGGTATAC
AGACTTACCCTGATGCCCGATTTTTCGCTATCTCTGCACAACTCCCTGAGTTCAGCAATAAGAACCGAACCCTTG
TGCTTCAATACTCGGTAAAGATCGAGCAGAAGATTGAATGTGGCGGAGCTTATGTAAAACTCATGAGTGGTTATG
TGAACCAGAAAAGGTTTAGCAAGGACACCCCTTACAGTATCATGTTCGGACCGGATCTATGTGGTACTGATACAA
AAAAGCTTCACACAATTATCTCCTACAAGGGTCAGAATTATCCCATCAAGAAAGAGCTACAGTGTGAGACTGATC
AGCTCACGCATTTTTACACGCTAATCATA

> SEQ ID NO:1655 183295 129196_300403_1b
CCCCCGGGGAAAGTCGGTGGGTCAAGTCAGAATGGAAGAAGGATGAGAACATGGCTGGTGAATGGAACCACACAT
CTGGGAAGTGGAATGGAGATCCTGAGGACAAAGGTATCCAAACCTCTGAGGACTACAGGTTCTACGCTATTTCAG
CGGAGTACCCAGAATTCAGCAACAAGGATAAAACCCTGGTGCTGCAGTTCTCTGTAAAGCATGAGCAAAAGCTTG
ACTGTGGTGGTGGATATGTCAAGTTGCTTGGTGGTGATGTTGACCAGAAGAAATTTGGTGGGGACACACCGTACA
GCATTATGTTTGGACCAGACATCTGTGGGTACAGCACCAAGAAGGTCCATACTATCTTTACTAAGAATGACAAGA
ACCATTTGATCAAGAAGGATGTCCCCTGTGAGACTGATCAGCTGTCCCATGTGTACACTTTGATCATCCGTCCTG
ATGCTACATACACCATACTCATTGACAATGTTGAGAAGCAATCTGGCAGCATCTACGAGCACTGGGATATTCTGC
CTCCGAAGCAAATCAAGGACCCAGAAGCTAAGAAGCCAGAGGACTGGGATGACAAGGAG

> SEQ ID NO:1656 183295 193693_300741_1b
CCCCCGGATACGGGAGATTGGATCGGAAGCTTCTAGAAGTTTCCGTGGGCGATGGCGATCCGCGCGAGGTCCTCC
TCCTACGCCGCCGCGGCGGTCGCGCTGGCGCTCGCGCTGGCGTCCGTCGCCGCTGTCGCCGGCGAGGTCTTCTTC
CAGGAGAAGTTCGAAGATGGATGGGAAAGTCGGTGGGTCAAGTCAGAATGGAAGAAGGATGAGAACATGGCTGGT
GAATGGAACCACACATCTGGGAAGTGGAATGGATATCCTGAGGACAAAGGTATCCAAACCTCTGAGGACTACAGG
TTCTACGCTATTTCAGCGGAGTACCCAGAATTCAGCAACAAGGATAAAACCCTGGTGCTGCAGTTCTCTGTAAAG
CATGAGCAAAAGCTTGACTGTGGTGGTGGATATGTCAAGTTGCTTGGTGGTGATGTTGACCAGAAGAAATTTGGT
GGGGACACACCGTACAGCATTATGTTTGGACCAGACATCTGTGGGTACAGCACCAAGAAGGTCCATACTATCTTT

Figure 2 continued

ACTAAGAATGACAAGAACCATTTGATCAAGAAGGATGTCCCCTGCGAGACTGATCAGCTGTCCCATGTGTACACT
TTGATCATCCATCCTGATGCTACATACACCATACTTATTGACAATGTTGAGAAGCAATCTGGCAGCATCTACGAG
CACTGGGATATTCTGCCTCCGAAGCAAATCAAGGACCCAGAAGCTAAGAAGCCAGAGGACTGGGATGACAAGGAG
TACATTCCTGACCCTGAGGACAAGAAGCCTGAGGGATACGATGATATTCCCAAGGAAATCCCTGACCCTGATGCT
AAGAAGCCTGAGGACTGGGATGATGAGGAACATGGTGAGTGGACTGCACCAACCATTCCTAACCCTGAGTACAAG
GGACCATGGAAGCAAAAGAAAATCAAGAACCCTAACTACCAAGGCAAATGGAAGGCACCGATGATCGACAACCCA
GACTTCAAGGATGATCCATACATCTATGCTTTTGACAGCCTGAAGTACATTGG

> SEQ ID NO:1657 183295 1044351_301917_1b
GTTGCCTTCTCTTGGTACTCTTCCCCTTGGCCTCTTTCGCCCACGTTTTCTTCGAAGAACGCTTCAATGATGGAT
GGGAGAACGGATGGGTGAAATCGGATTGGAAAAAGGATGAAGGTGCTGCAGGAGACTGGGTACACACGGCAGGGA
AATGGAGTGGTGACTCCGAAGACAAAGGGATTCAAACCAATCCAGACTTACGATTTTTTGGCATATCAACTGAGT
TTCCTGAATTTAACAACAAGGGCAAGGATTTGGTTGTCCAGTTTTCTGTAAAGCATGAACAGGATCTTGATTGTG
GTGGAGGTTATATCAAGCTTTTAAGTGGTGATGTGGATCAGAAAAAGTTTAATGGTGATACCCCGTACAGCATCA
TGTTTGGGCCTGACTTCTGTGGCTATAGCACAAAGAAAGTCCATGTTATTTTGAACTACAATGACAAGAATCACC
CCATTGAGAAGGAAATTCTTGTGAAAAGGATCAACTGACACATGTCTACACTCTTGTGATAAGACCTAACAACA
CCTACAGTGTTCTAATTGATAATGAAGAGAAACAAAAC

> SEQ ID NO:1658 183295 49891_300187_1b
CCGATCTGAGTTTTTTTTTAGCAATGGCGAGAATGATTCCTAGCCTCGTCTCTCTAATTCTTATCGGTCTTGTTGC
GATCGCCTCCGCCGCAGTTATTTTCGAGGAGCGCTTTGATGATGGCTGGGAGAACAGATGGGTTAAATCTGAGTG
GAAGAAGGATGATAACACTGCTGGGGAGTGGAAGCACACTGCGGGAAATTGGTCTGGTGACGCTAACGATAAAGG
TATCCAGACCAGTGAAGACTACAGATTCTACGCCATTTCAGCTGAGTTCCCTGAATTCAGTAACAAGGACAAGAC
CTTAGTCTTCCAATTCTCAGTCAAGCACGAGCAAAAGCTTGACT

> SEQ ID NO:1659 183295 49616_300182_1b
CGGGACATGGGCTGGTGATCCTGATGACAAAGGTATCCAGACAACAAACGATGCCAAACATTTTGCTGTCTCTGC
AAAGGTACCGGAATTTAGCAATAAAAACAGAACACTGGTTGTCCAGTATTCTATAAAGTTTGAGCAAGATATTGA
ATGTGGAGGGGGTTACATAAAGCTTCTCTCTGGATATGTCAATCAGAAGAAATTTGGTGGAGACACTCCATACAG
TTTTATGTTTGGGCCAGATATCTGTGGTACACAGACGAAGAAACTTCATGTTATGCTTT

> SEQ ID NO:1660 183295 257150_301679_1b
GTCTCCTCGACGGTTATCGATCGATCTCTCGCGGTTGATCGATCTCTCACATCGATCGCCTCGATCTGATGCGTT
GCTGGCTGCATTCCAGGTTAATCCGGCGGATCGATGAGGATTTCCGCGATCGCCGCGGCAGTTCTCGCGGCGATT
CTCGCGCTGGCTCTTTCTGGAGCTGCGGAGATCTTCTTCGAGGAGCGATTCGACGATGGTTGGGAACATAGCTGG
GTCCAGTCCGATTGGAAGCGATCCGACGGTCTAGCGGGGAGCTGGCGACACACAGCAGGGAAATGGCATGGTGAT
CCAGATGATAAAGGCATCCAGACTTATCCCGATGCTCGATACTTCGCCATCTCCGCGCAGTTCCCCGAGCTCAAC
ACCAAAGGAAAGACGCTCGTAATTCAGTACTCTGTGAAGCACGAACAAAAGATCGAGTGTGGTGGCGGCTATATC
AAGCTACTCAGTGGTTACGTGAATCAGAAACGGTTCAGTGGGGATACGCCTTACAGTATCATGTTTGGTCCGGAC
ATTTGTGGCACTCAGACCAAGAAGGTCCACGCGATTTTGCAGTATAAGAGCCAGAACTATCCAATACGGAAGGAA
GTTACTTGCGAGACGGACCAGCTCACTCACGTTTACACGTTGGTAATTCGTCCCGACGCAACTTAC

> SEQ ID NO:1661 183295 146983_200005_1b
TAAAACTAGTCTTCTCAGCTGAATCATTTCTACTAGTTTTGTTACTTTTCTCACTTCTCAGCTCTTCATTCTCTG
AGATCTTTTTTGCAGAACAGTTCGATGATGATTGGCGGAGCAGATGGGTGAAGTCTGACTGGAAAAGGAGTGAAG
GGAAAGCAGGTTCATTTAAGCATACAGCTGGAAAATGGGCTGGTGATCCTGATGATAAAGGTATTCAGACATCAA
GCGATGCCAAACATTTCGCCATTTCTGCTAAGGTACCAGAATTTAGCAACAAGAACAGAACTTTGGTTGTACAAT
ATTCTATAAAGTTTGAGCAAGACATTGAGTGTGGTGGAGGTTACATAAAGCTTCTCTCTGGATATGTCAACCAGA
AGAAATTTGGGGAGACACCCCTTACAGTATGATGTTTGGACCGGATATCTGTGGTACACAGACAAAGAAACTTC
ATGTTATGCTTTCCTATCAAGGCCAGAATTATCCCATCAAAAAGGATCTACAATGTGAAACAGACAAATTAACCC
ATTTCTACACATTCATTCTTAGACCTGATGCATCATACAGCATCTGGATTGATGGTCGAGAAAGGGATTCTGGAA
GCATGTATA

> SEQ ID NO:1662 183350 133747_300417_1b
CAGGCACTTCACCAACCCTCTGGCTCCCTTCCGCCGCCCTCCGCCGCCGCATGCAAGCCAACCTCGCCGCTGCCA
TGGCCGCCCAGACCCTCTTGTTCTCCGCCACCGCCCCTCCCGCCTCCCTTTTCCAGTCCCCTTCCTCTGCCCGCC
CTTTCCACTCGCTCCGCCTCGCCGCCGGCCCCGGGGGCGCCGCCTGCCAGGGCGCTCGTCGTCGCCGACGCCA
CCAAGAAGGCCGTCGCCGTGCTCAAGGGCACCTCCCAGGTTGAGGGAGTCGTCACCCTCACCCAGGATGACCAAG
GTCCTACAACAGTGAATGTCCGTGTGACGGGACTTACTCCTGGACTTCACGGCTTCCACCTCCACGAGTTTGGCG

Figure 2 continued

ATACTACGAATGGGTGCATATCAACAGGACCACATTTTAACCCAAACAATTTGACGCACGGTGCACCAGAAGATG
AAGTCCGTCATGCGGGTGACCTGGGAAACATTGTTGCCAATGCTGAAGGTGTAGCTGAGGCAACCATTGTTGATA
AGCAGATTCCTCTGAGTGGCCCAAATTCTGTTGTTGGGAGAGCATTCGTTGTTCATGAGCTTGAAGATGATTTGG
GG

> SEQ ID NO:1663 183350 197243_300700_1b
CAATGGTTGCCTCAGCTACACCTTCAGCATTGGCAACAATGTTTCCCAGGTCACCCGCATGACGGACTTCATCTT
CTGGTGCACCGTGCGTCAAATTGTTTGGGTTAAAATGTGGTCCTGGCGATACTACGAATGGGTGCATATCAACAG
GACCACATTTTAACCCAAACAATTTGACGCACGGTGCACCAGAAGATGAAGTCCGTCATGCGGGTGACCTGGGAA
ACATTGTTGCCAATGCTGAAGGTGTAGCTGAGGCAACCATTGTTGATAAGCAGATTCCTCTGAGTGGCCCAAATT
CTGTTGTTGGGAGAGCATTCGTTGTTCATGAGCTTGAAGATGATTTGGGGAAGGGTGGCCATGAGCTTAGTCTCA
GTACTGGAAATGCTGGTGGGCGACTTGCATGCGGTGTTGTTGGGCTGACCCCGTTGTAGGTCGCTGCAAGTTGCA
GCTGAAGTGTCAGTATCGCATCCATGTCACCCTTTTTGTCATCTTCGAGCCTGAGGCAGTCGTTCTTGTATCACA
TGGATTTCGCAACATGGATGCTTAATAGTATCTGTTGATCGTTCGTCTCACAGTAATAAAATTTAGTTGAGCAAA
TAAGTGTCGTCACATCCCTGTTCTCCACCCTGTCAAACTATAAATTGTGAAACATGAGCTGTTCTGGGTATACA
ACGCATA

> SEQ ID NO:1664 183350 284676_200100_1b
CTCATCTCAATCTTAGCCACCTGTGTGGAATCCATGGCCGCCCACACAATCTTCACTACCACCACCAGCACTACC
AATTCTTTGTTATTCCCAGTCGCTGCCCCTAACACCAACCCCTCCCCTTCACTTCACTCTTCTTTCCACGGTGTT
TCCCTCAATCTCAAGTCAAAGACTCCTCAATCTTTAACACTTTCTGCTGCCACTGCTCCTAAACGTCTCACTGTT
TTTGCTGCTACTAAGAAAGCTGTTGCTGTCCTTAAGGGCAATTCCAATGTTGAGGGCGTTGTCACTCTCTCCCAA
GATGATGATGGTCCAACCACTGTGAAAGTTCGCATAACTGGACTTACACCTGGACTTCATGGATTCCATTTGCAC
GAGTTCGGTGACACTACAAACGGGTGTATGTCTACAGGACCCCATTTCAATCCTGATGGCAAGACACATGGAGCT
CCTGAAGATGAAATCCGTCATGCGGGTGACCTGGGAAACATAGTGGCCAATGCCGATGGTGTGGCTGAAGCAACA
ATTATAGATAATCAGATACCATTGTATGGTCCAAACTCAGTTGTTGGAAGAGCGCTTGTGGTTCACGAGCTTGAG
GATGACCTTGGGAAGGGTAGGCATGAACTCAGCCTTACCACTGGGAATGCTGGTGGACGATTGGCATGTGGCATA
CTTGGTTTGACTCCAATATGAAGTAATCAAGATTGATCCAGGAATAGAATATCAATAGCAAGCTGACTGCGGCTT
CATTGATTCAAGTTGAACTATTATGCTGAAGTTTCGAAACTTCAGCTAGTACGACTATAGGACAAAAACTTCAGC
TTATTTAGTTCTGAAGTTTTACAAATGAACTAAATAACTTCAACTTCTTCTGCTAATG

> SEQ ID NO:1665 183350 47074_300177_1b
AGCCATGGCTGCCACCAACACAATCCTCGCATTCTCATCTCCTTCTCGTCTTCTCATTCCTCCTTCCTCCAATCC
TTCAACTCTCCGTTCCTCTTTCCGCGGCGTCTCTCTCAACAACAACAATCTCCACCGTCTCCAATCTGTTTCCTT
CGCCGTTAAAGCTCCGTCGAAAGCGTTGACAGTTGTTTCCGCGGCGAAGAAGGCTGTTGCAGTGCTTAAAGGTAC
TTCTGATGTCGAAGGAGTTGTTACTTTGACCCAAGATGACTCAGGTCCTACAACTGTGAATGTTCGTATCACTGG
TCTCACTCCAGGGCCTCATGGATTTCATCTCCATGAGTTTGGTGATACAACTAATGGATGTATCTCAACAGGACC
ACATTTCAACCCTAACAACATGACACACGGAGC

> SEQ ID NO:1666 188836 218344_300917_1b
ACACCATCTGGAATCTTGTTTAACACTAGTATTGTAGAATCAGCAATGGCAGCATACACCAGCAAGATCTTTGCC
CTGTTTGCCTTAATTGCTCTTTCTGCAAGTGCCACTACTGCAATCACCACTATGCAGTATTTCCCACCAACATTA
GCCATGGGCACCATGGATCCGTGTAGGCAGTACATGATGCAAACGTTGGGCATGGGTAGCTCCACAGCCATGTTC
ATGTCGCAGCCAATGGCGCTCCTGCAGCAGCAATGTTGCATGCAGCTACAAGGCATGATGCCTCAGTGCCACTGT
GGCACCAGTTGCCAGATGATGCAGAGCATGCAACAAGTTATTTGTGCTGGACTCGGGCAGCAGCAGATGATGAAG
ATGGCGATGCAGATGCCATACATGTGCAACATGGCCCCTGTCAACTTCCAACTCTCTTCCTGTGGTTGTTGTTGA
TCAAACGTTGGTTACATGTACTCTAGTAATAAGGTGTTGCATACTATCGTGTGCAAACACTAGAAATAAGAACCA
TTGAATAAAATATCAATCATTTTCAGACTTG

> SEQ ID NO:1667 188877 135016_300421_1b
ATAACATTATATTGCAGCAATGGGATCCTCCTCCCTTCTACTCGCCTGTGTTGTGGTGGCGGCTATGGTGTCCGC
CGTCTCCTGCGGGCCACCCAAGGTGCCACCGGGCCCCAACATCACGACAAGCTACGGCGACAAGTGGCTGGAAGC
CAAGGCCACCTGGTATGGTGCGCCCAAGGGTGCTGGCCCCAAGGACAACGGCGGCGCCTGCGGGTACAAGGATGT
CGACAAGGCTCCCTTCCTCGGCATGAACTCCTGCGGCAACGACCCCATCTTCAAGGACGGCAAGGCTGCGGCTC
ATGCTTCGAGATCAAGTGCTCCAAGCCGGAGGCCTGCTCCGACAAGCCCGCCCTTATCCACGTCACCGACATGAA
CGACGAGCCCATCGCTGCCTACCACTTTGACCTCTCCGGCCTTGCCTTCGGCGCCATGGCTAAGGATGGCAAGGA
CGAAGAGCTCCGTAAGGCCGGCATCATCGACACGCAGTTCGCCGCCGTCAAGTGCAAGTATCCTGCCGACACCAA
GATCACCTTCCACATCGAGAAGGCCTCCAACCCCAACTACCTTGCGCTGCTAGTCAAGTACGTCGCTGGTGATGG
TGA

Figure 2 continued

> SEQ ID NO:1668 188877 227120_301008_1b
AAAAAAAAAAGGAAAAAAAAACAAAACACACCAAGCCAAATAAAAGCGACAATGGGATCGCTCACCACCAACATC
GTCCTCGCCGTCGCCGTGGTGGCAGCGCTGGTCGGCGGCGGGTCGTGCGGCCCGCCCAAGGTGCCACCCGGCCCG
AACATCACGACCAACTACAACGCCCCGTGGCTCCCCGCCAGGGCCACCTGGTACGGCCAGTCCTACGGCTCCGGC
CCCGCTGACAATGGTGGCGCGTGCGGGATCAAGAACGTCAACCTGCCTCCCTACAACGGCATGATCTCCTGCGGC
AACGTCCCAATCTTCAAGGACGGCAGGGGATGCGGCTCATGCTACGAGGTGAAGTGTGAGCAGCCGGCGGCGTGC
TCGAAGCAGCCGGTGACGGTGTTCATCACGGACATGAACTACGAGCCCATCTCGGCGTACCACTTCGACTTCTCC
GGCAAGGCGTTCGGCGCCATGGCTTGCCCGGGGAAGGAGACCGAGCTCCGCAAGGCCGGCATCATCGACATGCAG
TTCAGGAGGGTGCGCTGCAAGTACCCCGGCGGCCAGAAGGTCACCTTCCACGTCGAGAAGGGCTCCAACCCCAAC
TACCTCGCC

> SEQ ID NO:1669 188877 209350_300814_1b
CAGAATCCTACCTGACTAGTACTACCACTACTAGCTAGTAGCGAGCTACTCTCTCTGGTCATCAAGCTTTGAGTG
GTTGGAGTGGTGGCAGCTATGGCTTTTTCCATCTCCAAGAAGGCTGCAGTTGCTGCACTCTTCTCCTTCCTTGTT
GTCACCTGCGTCGCCGGCGCCAGGCCGGGGAACTTCAGCGCCTCCGACTTCACCGCCGATCCCAACTGGGAAGTC
GCCAGGGCCACCTGGTACGGCGCTCCCACCGGCGCCGGCCCTGACGACGATGGCGGTGCTTGCGGGTTCAAGAAC
ACCAACCAGTACCCGTTCTCGTCGATGACCTCCTGCGGCAACGAGCCTATCTTCAAGGACGGGAAGGGCTGTGGC
TCATGCTACCAGATAAGATGCGTCAACCACCCTGCCTGCTCCGGCAACCCGGAGACGGTGATCATCACCGACATG
AACTACTACCCCGTTTCCAAGTACCACTTCGACCTGAGCGGCACGGCGTTCGGCGCCATGGCCAAGCCGGGCAG
AACGACCAGCTCCGCCACGCCGGCATCATCGACATCCAGTTCAAGAGGGTGCCGTGCAACTTCCCTGGGCTGAAG
GTGACGTTCCACGTGGAGG

> SEQ ID NO:1670 188877 196563_300704_1b
TCCACCAGCAATAACATTATATTGCAGCAATGGCATCCTCCTCCCTTCTACTCGCCTGTGTTGTGGTGGCGGCTA
TGGTGTCCGCCGTCTCCTGCGGGCCACCCAAGGTGCCACCGGGCCCCAACATCACGACAAGCTACGGCGACAAGT
GGCTGGAAGCCAAGGCCACCTGGTATGGTGCGCCCAAGGGTGCTGGCCCCAAGGACAACGGCGGCGCCTGCGGGT
ACAAGGATGTCGACAAGGCTCCCTTCCTCGGCATGAACTCCTGCGGCAACGACCCCATCTTCAAGGACGGCAAGG
GCTGCGGCTCATGCTTCGAGATCAAGTGCTCCAAGCCGGAGGCCTGCTCCGACAAGCCCGCCCTTATCCACGTCA
CCGACATGAACGACGAGCCCATCGCTGCCTACCACTTTGACCTCTCCGGCCTTGCCTTCGGCGCCATGGCTAAGG
ATGGCAAGGACGAAGAGCTCCGTAAGGCCGGCATCATCGACACGCAGTTCCGCCGCGTCAAGTGCAAGTATCCTG
CCGACACCAAGATCACCTTCCACATCGAGAAGGCCTCCAACCCCAACTACCTTGCGCTGCTAGTCAAGTACGTCG
CTGGTGATGGTGACGTCGTGGAGGTGGAAATCAAGGAG

> SEQ ID NO:1671 188877 189151_300613_1b
ATTCACAAATAACTAACACCCATCAGCAACAATGGCATCCTCTTGTCTCCTTCTGGCCTGTGTCGTGGCAGCGGC
CATGGTGTCTGCAGTGTCATGTGGGCCGCCCAAGGTGCCGCCTGGCCCCAACATCACTGCGGCCTACGGCAAACA
GTGGCTGGAAGCTAGGGGTACCTGGTACGGCAAGCCAAAGGGTGCCGGCCCCGACGACAACGGCGGCGCTTGTGG
GTACAAGGACATTGACAAGGCTCCCTTCCTCGGCATGAACTCATGTGGCAATGACCCTATCTTCAAGGATGGCAA
GGGCTGCGGCTCCTGCTTTGAGGTCAAGTGTTCCAAGCCAGAGGCCTGCTCCGACAAGCCCGTCATCATCCACAT
CACCGACATGAACACTGAGCCTATCGCCGCCTACCACTTCGACCTCTCCGGCCATGCTTTTGGTGCCATGGCTAA
GGAAGGCAAGGATGAGGAACTCCGCAAGGCGGGAATTATCGATATGCAGTTTCGTCGCGTCCGCTGCAAGTACCC
TGGTGAGACTAAGGTCACCTTCCACGTTGAGAAGGGCTCCAACCCCAACTACTTTGCAGTGCTTGTCAAGTACGT
CGGTGGTGACGGTGATGTCGTGAAGGTGGAACTTAAGGAGAAAGGCTCTGAGGAGTGGAAGCCACTCAACGAGTC
ATGGGGTGCTATCTGGAGGATAGACACT

> SEQ ID NO:1672 188877 175541_300545_1b
CCCCCCCCGGGGGCAGTAGCAAGCAAGCAGGGCTAATATACATAAATTGATCCAGGGATCGATCGAAATTAATGG
CGGGCAGGAGCAGGAGGAGGTCGTTTTGGTCCGTGGGCGTTGCGGCTGCTCTGCTTTGTCTGCTGGCCGCCCATG
GCTGCAGCGCCAAGCATCACAAGCCCAAGCCTACTCCCGGTGGCATCAGTGGCAATGCTTCTTCTTCCTCCTCCA
ATTCCAGCACCCCCAGTATTCCTCCTCCTGTTGCCCCTACTCCTACTGCTCCTACTCCTCCTATTCCCAGCCCCG
GAACTGGAAGCAGCAACGGCAGCAGTGGCGGTGGCGGCGGGTGGCTGAACGCCCGTGCGACCTGGTACGGCG
CTCCCAACGGCGCTGGGCCGGACGACAACGGCGGCGCGTGTGGGTTCAAGAATGTGAACCTGCGCCCTTCTCGG
CCATGACTTCCTGCGGAAATGAGCCTCTCTTCAAGGACGGCAAGGGATGCGGCTCCTGCTACCAGATCCGATGCG
TGGGGCACCCAGCCTGCTCGGGGCTCCCGGAGACGGTGATCATCACGGACATGAACTACTACCCAGTGTCGCTGT
ACCACTTCGACCTCAGCGGCACGGCGTTCGGCGCCATGGCCAAGGACAACCGCAACGAC

> SEQ ID NO:1673 188877 187766_300680_1b
CAGCTATGGCTTTTTCCATCTCCAAGAAGGCTGCAGTTGCTGCACTCTTCTCCTTCCTTGTTGTCACCTGCGTCG

Figure 2 continued

CCGGCGCCAGGCCGGGGAACTTCAGCGCCTCCGACTTCACCGGCGATCCCAACTGGGAAGTCGCCAGGGCCACCT
GGTACGGCGCTCCCACCGGCGCCGGCCCTGACGACGATGGCGGTGCTTGCGGGTTCAAGAACACCAACCAGTACC
CGTTCTCGTCGATGACCTCCTGCGGCAACGAGCCTATCTTCAAGGACGGGAAGGGCTGTGGCTCATGCTACCAGA
TAAGATGCGTCAACCACCCTGCCTGCTCCGGCAACCCGGAGACGGTGATCATCACCGACATGAACTACTACCCG
TTTCCAAGTACCACTTCGACCTGAGCGGCACGGCGTTCGGCGCCATGGCCAAGCCGGGGCAGAACGACCAGCTCC
GCCACGCCGGCATCATCGACATCCAGTTCAAGAGGGTGCCGTGCAACTTCCCTGGGCTGAAGGTGACGTTCCACG
TGGAGGAGGGGTCGAACCCGGTGTACTTCGCGGTGCTGGTTGAGTACGAGGACGGCGACGGCGACGTGGTGCAGG
TGGATCTCATGGAGGCCAACTCCCAGTCGTGGACGCCGATGCGCGAGTCGTGGGGCTCCATCTGGAGGCTCGACT
CCAACCACCGCCTCACGGCGCCCTTCTCGCTCCGCATCACCAACGAGTCCGGCAAGCAGCTCGTCGCCAGCCAGG
TCATCCCGGCCAACTGGGCCCCCATGGCCGTCTACCGTTCTTTCGTCCAGTACAGCAGCTAAGCCAATGATCAAG
AACAAGCATAATTCATGCCTACTATAGCAGCAGAAGCAGCATTAGCTACTATACATACCTCTACGTACGACA
TTTGAGATCGATCGTTTGGCCATTTTTATCTGCTCGGGTATTGATTAGCTCTCCCTCGGTATTGTATGGATTTGC
ATGGATG

> SEQ ID NO:1674 188877 183332_300621_1b
CCCACGCGTCCGATCTCACTTCACTCTCTTTCTCTTCTCTTCACTTCACCACCGCCACCTCTCTCATCGGATCCC
TGCAGAGGAGGAGAGGGCAGTGGCGGCGAAAGGCGACATGGGCTCGCTGTCCTCTCTCGCCGCCGCGGCGGTGTT
TCTCTCCCTCCTCGCCGTCGGCCACTGCGCCGCCGCCGACTTCAACGCCACCGACGCCGACGCCGACTTCGCCGG
CAACGGCGTGGACTTCAACTCCAGCGACGCCGCCGTCTACTGGGGCCCCTGGACCAAGGCCAGGGCCACCTGGTA
CGGCCAGCCCAACGGCGCCGGCCCCGACGACAACGGCGGCGCGTGCGGGTTCAAGCACACCAACCAGTACCCGTT
CATGTCGATGACCTCCTGCGGCAACCAGCCATTGTTCAAGGACGGCAAGGGATGCGGCTCTTGCTACAAGATCAG
ATGCACCAAGGACCAGTCGTGCTCCGGCAGGTCGGAGACGGTGATCATCACCGACATGAACTACTACCCGGTGGC
TCCGTTCCACTTCGACCTCAGCGGCACGGCGTTCGGCAGGCTCGCCAAGCCTGGCCTCAACGACAAGCTGCGCCA
CTCCGGCATCATCGACATCGAGTTCACCAGGGTGCCATGCGAGTTCCCGGGGCTCAAGATCGGGTTCCACGTG

> SEQ ID NO:1675 188877 136901_300440_1b
CCAAAAAAAAGGAAAAAAAAAAACCAAAACACACCAAGCCAAATAAAAGCGACAATGGGATCGCTCACCACCAA
CATCGTCCTCGCCGTCGCCGTGGTGGCCGCGCTGGTCGGCGGCGGGTCGTGCGGCCCGCCCAAGGTGCCACCCGG
CCCGAACATCACGACCAACTACAACGCCCCGTGGCTCCCCGCCAGGGCCACCTGGTACGGCCAGTCCTACGGCTC
CGGCCCCGCTGACAATGGTGGCGCGTGCGGGATCAAGAACGTCAACCTGCCTCCCTACAACGGCATGATCTCCTG
CGGCAACGTCCCAATCTTCAAGGACGCAGGGGATGCGGCTCATGCTACGAGGTGAAGTGTGAGCAGCCGGCGGC
GTGCTCGAAGCAGCCGGTGACGGTGTTCATCACGGACATGAACTACGAGCCCATCTCGGCGTACCACTTCGACTT
CTCCGGCAAGGCGTTCGGCGCCATGGCTTGCCCGGGGAAGGAGACCGAGCTCCGCAAGGCCGGCATCATCGACAT
GCAGTTCAGGAGGGTGCGCTGCAAGTACCCCGGCGGCCAGAAGGTCACCTTCCACGTCGAGAAGGGCTCCAACCC
CAACTACCTCGCCGTGCTCGTCAAGTTCGTCGCC

> SEQ ID NO:1676 188959 1110603_301541_1b
AAAAGAACGTCGTCCTATAGATCTCTCCCAGGGGATACCGGCAAAGAGGACGAACCTACCCCTGCGCAGTCATGA
TTCATTTTGTGGTACTCATTAGCCGGCAGGGGAAAGTGCGATTAACCAAGTGGTACTCTCCTTATGCTCAAAAGG
AAAGGACAAAGATCATTCGAGAACTTAGTGGAGTGATATTATCAAGAGGTCCGAAACTTTGCAATTTTGTGGAAT
GGCGAGGCTTCAAAGTAGTCTATAAGCGGTATGCTAGCTTATATTTCTGCATGTGCATTGATGGGGACGACAATG
AATTAGAATGCCTTGAGATAATTCACCACTACGTCGAGATTCTCGATCGCTACTTTGGAAATGTTTGTGAGCTAG
ACCTTATTTTCAATTTTCACAAGGCTTACTACATACTAGATGAGGTTTTACTTGCTGGGGAGCTTCAAGAAACTA
GCAAGAAGTCCGTCGCCCGTGTCATCGCTGCACAGGACACGCTAGTTGAAAATGCCAAGGAGGAGGCGAGCTCTC
TCTCTAACATCATTGCACAAGCCACAAAGTGAGAAA

> SEQ ID NO:1677 188959 145211_301058_1b
AGAAGTATAACCTTGTTCTCTCACATTCACCTTAGCAGAAGCAGAAGAAGGAAGAGGAGGAGGTGTTTGTTCTTT
GGATCACCAATCATGATTCACTTTGTGCTGCTCATTAGCCGGCAGGGAAAAGTGAGGCTAACCAAGTGGTATTCA
CCATATACACAAAAAGAGAGAACCAAGGTAATCCGTGAACTAAGTGGTATGATTCTCTCCCGAGGACCGAAGCTT
TGCAATTTTGTTGAGTGGAGAGGATATAAAGTTGTTTATAAAAGATATGCAAGCCTGTACTTCTGTATGTGCATA
GACCAAGACGACAATGAGTTGGAGGTCCTGGAAATCATACACCATTATGTTGAGATTCTGGACCGTTACTTCGGA
AGTGTCTGTGAGCTGGATTTAATCTTCAATTTTCACAAGGCATACTATATATTGGATGAACTTGTGATTGCTGGT
GAACTCCAAGAGTCGAGCAAGAAAACTGTTGCACGTCTAATTGCTGCACAGGATTCTTTGGTTGAGGCTGCCAAA
GAAGAGGCAAGTTCTATTAGCAACATCATTGCACAGGCCACAAAATGAAAGATGGAGTGCATTACTGTTTTTATG
GTTCTCATTCATTGCTGTAATCAGATCTTG

> SEQ ID NO:1678 188959 127534_300470_1b
CCCCACACCCCTATTGGTTGTTGTACTAGGGGGATCCTGGTTACATTGAAGATCCATCTTTCAACCGGAAGAACG

Figure 2 continued

```
TCAATTCCAAAAACCCAAGCAAACCAAAACCAGGCAAAGTTCTCTTTTCAATTGAATAAAGTCAAAGTAATCTAT
TGCTGATTCCTTAATCAAAATCGAGAAGAAATATGGGGATCAGATTCGTATTAATGGTAAATAAGCAAGGGCAAA
CTCGGCTGGCTCAGTACTACGAGTACCTCACTTTAGAAGAAAGGCGTGCTCTTGAGGGTGAAATTGTGCGTAAAT
GCCTTGCTCGCAATGAACAGCAGTGTTCATTTGTGGAGCATCGTAATTACAAAATCGTGTACAGGCGGTATGCAT
CACTCTTTTTCCTGGTTGGAGTTGATAATGAAGAAAATGAACTTGCTATTTTGGAATTCATTCACCTGTTAGTTG
AAACCATGGATCGTCATTTTGGCAATGTGTGCGAGCTGGATATAATGTTTCATCTTGAAAAGCACACTTCATGC
TGGAGGAGATGGTAATGAATGGGTGTGTTGTTGAGACAAGCAAGGCAAACATTCTGGCTCCAATTCAGCTAATGG
AAAAGGCATCATAAGTAGTACACTCTGATCCATGGAATTCGTAATAAACCGATTTGCTTGTGTAGTGTTTACGTT
TTGGGATTTGTGCT

> SEQ ID NO:1679 188959 1114040_301842_1b
GTTGGAAGGGATTCGGGAGAGAAGAAGAGAGAGAGAGAGAGAGAGAGAGAGGGGGGATGACGATCCGATTCAT
ACTACTGGTGAATAAGCAGGGGCAGACAAGGCTCGCACAGTACTACGAGTACCTCACCATCGACGAGCGTCGCGC
CCTTGAAGCTGAGATCGTCCGTAAATGGCTCGCTCGCACCGATTCGCAGTGGTCTTTTGGAGAGCATCGCAACTA
CAAAGTTATTTACAGGCGTTACGCATCTCTCTTTTTCTTGGTTGGAGTGGATATGGATGAGAATGAGCTGGCCAT
ATTGGAGTTTATACATTTCATGGTGGAGACAATGGACCGCTATTTTGGAAATGTGTGCGAGCTTGATATAATGAT
CCACTTGGAGAAGGCGCATATTATGTTGGAAGAAATGGTTATGAATGGGTG

> SEQ ID NO:1680 189013 170328_300532_1b
CCCCCGAGCAAGCAAAGGAAAGAACTTCCCTTGCACCACCACCTGATCAGAGAAGTAGCTAGCTGCAGGAGAGAA
ACCGACCAACAATGGCGGAGTACTACTCCAGCACCGTGGACGAGTGCTACGAGACCACCGGCAGGCAGCACGGCC
ACGGGCACGGCCACGGTCACGGGCACGGGCACGGGCATGGTGGCATGAGGGTGGAGTCCCACACCGACGACTACT
ACAGCGAGGGCGGCGAGATCGACCGTGGGAGGAGGAACAACTCCATGCACTCGCAGGAGTACCTGATGAGGCAGC
AGAGCGGCCATGGCGGCTACGGCTACGGCGGCGGCCAGCAGCAGGAGTACTACAAGCGGGAGGAGCGCGAGCACA
AGCAGCGCGAGCGCGTCGGCGAGATCGGCGCCCTCGCCAGCGGCGCCTTCGCTCTCTATGAGGGGCACCAGGCGA
AGAAGGACCCGGCGAACGCGCAGAGGCACAGGATCGAGCAGGGCGTGGCGGCGGTGGCGGCGGTGGGCGCCGGCG
GCTACGCCTACCACGAGCACCGCGAGCAGAAGCAGGCCAGCTACGGCGCCAAGGAGCAGCAGTACGGCTACGCCA
GGATGCCGCAGCAGCAGGGCTACTACTGCAACTGATTAATTATTAATCACCCCCCAAATTATTAATAATCCATGC
GTACGTACGTACCACTAAATAAATACTGGCTACTACGTACGTATATATACGGTACAATAAGATGAGCAAGGATGT
ACGTACGTACACGTATATACGTTGCTCACCCACAATTT

> SEQ ID NO:1681 189013 201373_300715_1b
CGACTAACTCTGTCTGAAGGAAGCTAAGATTATTAATCAGTGAGTAGCTAGCCATGGCTGAGGAGAAGAAGCACC
ACCACCTGTTCCACCACAAGAAGGACGGGGAGGAGGAGAGCTCCGGCGTGGTGGACTACGACAAGGAGAAGAAGC
ACCACAAGCACCTCGAGCAGCTCGGCGGCCTCGGCGCCATCGCCGCCGGCGCCTACGCTCTCGTAAGTCATTAAT
TAGTACATTTGACCACCACTATTACAAGAAAATCGATTTTCGCAGACGTATATGTCATCCCCCACTTTAACTAAC
CTATATGTTTTAGCCGCTTGGAAAAATCGATTATGTAGTGGTGAACTATGATCTAATGATAACTACCTAGCCATA
GCTGATTAATTAAGAGATAATTAACGGAGAATTTATTTGTGGTACGTCGTTGCAGCACGAGAAGCACCAGGCGAA
GAAGGACACGGAGAACGCGCACGGGCACAAGGTGAAGGAGGAGGTGGCGGCGGTGGCCGCGCTGGGCGCCGCGGG
GTTCGCCTTCCACGAGCACCACGAGAAGAAGGACGCCAAGAAGCACGCCGCCGACCAATACTAGATCGATCCCGA
TCGAATGAACGCAAGAACGAACGGTTTATATGCTTAATTACTTTCTCCCCATAATTACATGTATGCATGTGGTTG
ATGGCTTAATTTGCTTCTTCTTGTTCGTCGTCATACGTCGTCGCTTTTACTTCGTGTTCATGTACATTAATTCTG
TATCCGCACTGAGTATTAAATAAGTGCGTTT

> SEQ ID NO:1682 189013 201887_300720_1b
CCCACGCGTCCGCCCACGCGTCCGGCCACATCTTATTGTCACTTCCATCTCATTCTCCTAATTGTCATCACTAGC
TTCTAGCTAGCTTAATTAATTAATTAGCCATGGCGGAGGAGAAGCACCACCACCACCTGTTCCACCACAAGAAGG
ACGACGAGCCGGCCACCGGAGTAGACTCCTACGGCGAGGGCGTCTACACGTCGGAGACGGTGACCACCGAGGTGG
TCGCCGGCGGCCAGGACGAGTACGAGAGGTACAAGAAGGAGGAGAAGCAGCACAAGCACAAGCAGCACCTCGGCG
AGGCCGGCGCCCTCGCCGCCGGCGCCTTCGCCCTGTATGAGAAGCACGAGGCGAAGAAGGACCCGGAGAACGCGC
ACAGGCACAAGATCACGGAGGAGATCGCGGCCACGGCGGCGGTCGGCGCCGGCGGCTACGCCTTCCACGAGCACC
ACGAGAAGAAGAAGGACCACAAGAGCGCCGAGGAGTCCACCGGCGAGAAGAAGCACCACCTCTTCGGCTGATCGA
CCTCATCACAACGTCGCCGGCGGCGGCGACGACCTCGCCGTACGTCGCCGGCCGCCGTGTCGTCGATTTGTGTGT
GTAATAATTTGTCTTCTTCTGCATGCGTGGTGTTGCTGTTTTTCACAAGAGTCTCCGGCCTCGACCAGTGAGAGG
CTGACAGGTGGGGCCGTGAGTTCAGCTTGTGTTGCTTGATTTTCTCTGCAGCCTTGCCCTCTGTGTGTCCAAATA
AGTGGTGTGCATGGCTCTCTCCGTGTCATGTATCAATGTATTTTTATCTGTACTTTGTACAAGTGAAGCAATATT
TATCGAACCTTGACTTTCTCCATTCTATGGGAAAAACC

> SEQ ID NO:1683 189013 201279_300714_1b
```

Figure 2 continued

GAGAAACCGACCAACAATGGCGGAGTACTACTCCAGCACCGAGGACGAGTGCTACGAGACCACCGGCAGGGAGCA
CGGCCACGGGCACGGTCACGGTCACGGGCACGGGCACGGGCATGGTGGCATGACGGTGGAGTCCCACACCGACGA
CTACTACAGCGAGGGCGGCGAGATCGACCGTGGGAGGAGGAACAACTCCATGCACTCGCAGGAGTACCTGATGAG
GCAGCAGAGCGGCCATGGCGGCTACGGCTACGGCGGCGGCCAGCAGCAGGAGTACTACAAGCGGGAGGAGCGCGA
GCACAAGCAGCGCGAGCGCGTCGGCGAGATCGGCGCCCTCGCCAGCGGCGCCTTCGCTCTCTATGAGGGCACCA
GGCGAAGAAGGACCCGGCGAACGCGCAGAGGCACAGGATCGAGCAGGGCGTGGCGGCGGTGGCGGCGGTGGGCGC
CGGCGGCTACGCCTACCACGAGCACCGCGAGCAGAAGCAGGCCAGCTACGGCGCCAAGGAGCAGCAGTACGGCTA
CGCCAGGATGCCGCAGCAGCATGGCTACTACTGCAACTGATTAATTATTAATCACCCCCAAATTATTAATAATCC
ATGCGTACGTACGTACCACTAAATAAATACTGGCTACTACGTACGTATATATACGGTACAATAAGATGAGCAAGG
ATGTACGTACGTACACGTATATACGTTGCTCACCCACAATTTCGCCGCC

> SEQ ID NO:1684 189013 188970_300611_1b
GATAAACATTAAACAAGCTGTGTGAACTTCTTTTTTCGTGACAAGTTTAATTCTTTCTCGATCGATCGTCGTGAT
GGCTGACGAGTACGGCCGCGGCGGCTACGGCAGGTCCGGCGCCGGCGCCGGCGACGACTACGAGAGCGGCGGCTA
CAACAGGTCCAGCTCCGGCGGCGCCGACGAGTACGGCCGCCGGCCGGGAGGCGGTGCCGGTGGCTACAACAAGCC
CGGTGGCACCGACGACTACGACAGCGGCTACAACAAGTCCGCCGGCGGCGACGACGACGACTACGGCCGCACCGG
CGGCGGCGGGTACAACAAGTCCGGCACCGACGACGACTACGACAGCGGCTACAACAACAGGTCAGGGGCTAACGA
GAAGTACGGCCGCCAACAAGTCCGGCGACGACGAGTACAGCGGCGGCGGCGGCGCCGAAGCCGACGAGGAGTACGT
CGACGGGTTGTCGTCCCGGGACGACCCGGAGAAGTACAGGAAGGAGGAGAAGGAGCACAAGAACAAGGAGCGCCT
CGGCGAGGTGGGCGCCCTCGCCGCCGGCGCCTTCGCCATGTACGAGAGGCACCAGGCGAAGAAGGACCCGGAGAA
CGCGCAGCGGCACAGGATCGAGGAGGGCGTGGCGGCGGCGGCGCTGGGGAGCGGCGGGTTCGCGTTCCACGA
GCACCACGACAAGAAGGAGGCCAAGCAGGCGGCGAAGGACGCCGAGGAGGAGGCGGAGGAGGAGTCCGGCTCCGG
CGCCCGCGGCGGCGAGGGGAAGAAGAAGCACCACCTCTTCGGCTGATGATCCATCGATCGATCGCCATGCATG
CGGCGGCGGCGGCGCCATGGCCGGCGTCCGCGCGCACGCGTAAGGTGTGGCCATGGGCGTGTGCAGCTGAATAAG
AGCCGGGGTTTTTGTACGTATGGGCTCAGTATGTGTACACCTCGTATATGGTATGGATGTACGTATAAGCGTATA
GTGTGTACTATACCAATAAAGCTATCTGTTGCTCTG

> SEQ ID NO:1685 189013 188227_300697_1b
CATCTTATTGTCACTTCCATCTCATTCTCCTAATTGTCATCACTAGCTTCTAGCTAGCTTAATTAATTAATTAGC
CATGGCGGAGGAGAAGCACCACCACCACCTGTTCCACCACAAGAAGGACGACGAGCCGGCCACCGGAGTAGACTC
CTACGGCGAGGGCGTCTACACGTCGGAGACGGTGACCACCGAGGTGGTCGCCGGCGGCCAGGACGAGTACGAGAG
GTACAAGAAGGAGGAGAAGCAGCACAAGCACAAGCAGCACCTCGGCGAGGCCGGCGCCCTCGCCGCCGGCGCCTT
CGCCCTGTATGAGAAGCACGAGGCGAAGAAGGACCCGGAGAACGCGCACAGGCACAAGATCACGGAGGAGATCGC
GGCCACGGCGGCGGTCGGCGCCGGCGGCTACGCCTTCCACGAGCACCACGAGAAGAAGAAGGACCACAAGAGCGC
CGAGGAGTCCACCGGCGAGAAGAAGCACCACCTCTTCGGCTGATCGACCTCATCACAACGTCGCCGGCGGCGGCG
ACGACCTCGCCGTACGTCGCCGGCCGCCGTGTCGTCGATTTGTGTGTGTAATAATTTGTCTTCTTCTGCATGCGT
GGTGTTGCTGTTTTTCACAAGAGTCTCCGGCCTCGACCAGTGAGAGGCTGACAGGTGGGGCCGTGAGTTCAGCTT
GTGTTGCTTGATTTTCTCTGCAGCCTTGCCCTCTGTGTGTCCAAATAAGTGGTGTGCATGGCTCTCTCCGTGTCA
TGTATCAATGTATTTTTATCTGTACTTTGTA

> SEQ ID NO:1686 189037 264916_301440_2b
AGAACTGATGTGAGAGATGTAGAAGTTTTGAGTGAGATTTATATCTCTATCAATGACAATTACAAATCTTACAAA
GACTTTAAGGTGCTTGATGCTTTGGATAAGGCTTTAGTGGATAGATATCGATCCCCTTATAGTGCTATTTCTGCT
TTGGTTTCTTTATGTTATCATATCTTTGACTTTAATAAGTTTAAGTTGCTGTTTAATTGTGAAGGGAAATTTGTG
GATAAGAAGCTGAGAAAAGACTTCGAGTGGTGAACTCTAGGTCCTGATGTTTAAATCTACTGTATTTACCTTCGC
ATTAATTAAGCATGAAGATCATTTTCGTCTTTGCTCTCCTTGCTATTGCTGCATGCAGCGCCTCTGCGCAGTTTG
ATGTTTTAGGTCAAAGTTATAGGCAATATCAGCTGCAGTCGCCTGTCCTGCTACAGCAACAGGTGCTTAGCCCAT
ATAATGAGTTCGTAAGGCAGCAGTATGGCATAGCGGCAAGCCCCTTCTTGCAATCAGCTGCGTTTCAATTGAGAA
ACAACCAAGTCTGGCAACAACTCGGGCTGGTGGTGCAACAATCTCACTATCAGGACATTAACATTGTTCAGGCCA
TAGCACAACAGCTACAACTCCAGCAGTTTGGTGATCTCTACTTTGATCGGAATCTGGCTCAAGCTCAAGCTCTGT
TGGCTTTTAACGTGCCATCTAGATATGGTATCTACCCTAGGTACTATGGTGCACCCAGTACCATTACCACCCTTG
GCGGTGTCTTGGCGGCCGCTTATCCGTATGATGTTCCGGATTATGCCGAGCTCTACAAACAGCTGTTGAATTTTG
ATTTGCTGAAGTTGGCGGGTGACGTGGAATCTAACCCTGGTCCTAGGTCTAGAATGGCTACTTTCTCTTGTGTGT
GTTGTGGTACCTTAACTACAAGTACTTACTGTGGTAAGAGATGTGAGCGAAAGCATGTATATTCTGAAACAAGAA
ATAAGAGATTGGAACTTTACAAGAAGTATCTATTGGAACCGCAAAAATG

> SEQ ID NO:1687 189037 196556_300704_1b
GAACTAGTGTCCTGCAACAATGAAGATCATTTTCGTCTTTGCTCTCCTTGCTATTGCTGCATGCAGCGCCACAGC
GCAGTTTGATGTTTTAGGTCAAAATATTAGGCAATATCAGGTGCAGTCGCCTCTCCTGCTACAGCAACAGGTGCT

Figure 2 continued

TAGCCTATATAATGAGTTCGTAAGGCAGCAGTATAGCATTGCGGCAAGCCCCTTCTTGCAATCAGCTGTGTTTCA
ACTGAGAAACAACCAAGTCTTGCAACAGCTCAGGCTGGTGGCGCAACAATCTCACTACCAGGACATTAACGTTGT
CCAGGCCATAGCGCAGCAGCTACACCTCCAGCAGTTTGGCGATCTCTACATTGACCGGAATCTGGCTCAAGCGCA
AGCACTGTTGGCTTTTAACTTGCCATCTACATATGGTATCTACCCTAGGTACTATAGTGCACCGGGTAGTATTAC
CACCCTTGGCGGTGTCTTGTACTGAATTTTCACAATATTGTAGTTCGGAAGTGAAAATATAAGCTCAGGTATCAT
CGGATGTGACATGTGAAACTTAAGGTGATATAAATAGAAATAAAATTATCTTTCATATTTAAAAAAA

> SEQ ID NO:1688 212426 212416_300849_1b
ACCGAGACTCGGGCCACGATCTGCCAATTGGCGGAGCTAGACGGAGTATGGCATAGCGCCAATTGCTCAGAGCAG
CTGAGCTTGCGCAATTGGCCCTCATCACAAGGATTCAGCCCTCCCTCTGGAGGTTCAGCTTCATTGATATTGCGA
GGTGGTGTCTACTGTACATACTATACAATATTCAGCACAGGAGCTTTCGGTACCAAAACCCTTCAACACCGAAAA
AAAAA

> SEQ ID NO:1689 212454 205633_300800_1b
ACGCCCACGCGTACGATTTGGCAATTCCTCAAGCTCACCCATTTGTTGACTACTGGCAGTGTAGCACACAGTCTG
CTACAACAAACCACATCACCAT

> SEQ ID NO:1690 212454 209024_300811_1b
AACATTTGGCAATTCCTCAAGCTCACCCATTTGTTGACTCTGGCAGTGTAGCACACAGTCTGCTCAACAAACCAC
ATCACCATGTCCGCCGAAGAGAAGACCACGGTGGCGACCGACGTCGCAAATCCCCCCAGTCGCGAGCATGAAGTT
GTCCACGGCGACGAGAGCAATGTCGACGTGCCTCTAGATTTGCCCGCAGGATGGAAGTACAGGCAGATTAGCCTT
TTCGGCTACAAGATGCCTTGGTACGCGTCGCCCCGTGTCCAGCTCCTCATGGTTGCTTTTGTCTGCTTCATGTGT
CCTGGCATGTTCAACGCGCTTGGTGGTTTGGGAGGTGGTGGTCGTGCCAGCGCGACCTTGGCTGACAACATGAAC
ACCGCCCTCTACAGCGCATTTGCTGTCTTCGGATTCTTTGGTGGCACCATCGTTAACAAACTCGGTGTTAAATGG
ACACTCGCTTTCGGCGGCATCGGCTATGGTATTTACGCCATCAGCCTGCTGGTTTCCCTCCATAAGACCGAACAG
GGTTTCAGCATTTTCGCTGGTACCTTCCTTGGTATCTGTGCCGGTCTTCTATGGACTGCTCAGGGCACCATCATG
ATCTCCTACCCAACCGAGAAAGAGAAGGGCCGATACTTTGCCTGGTTCTGGGCTATCTTCAACATGGGCGCTGTC
GTGGGCAGTCTTATTCCTCT

> SEQ ID NO:1691 212959 208338_300834_1b
AAAAGGTAGGGCACACGACAAACTTGGCCCCGTCAGCAACCAGCGCACGGCATGCCTCAGGGAAGGCCAAGTCCC
AGCAGATGATGAGTCCGACACGACCCCAGGGAGTATCAAACGCCCTGTGCGGCGTCAATCCATCGGCTGTCAGAT
GATCTCTCTCGGGGTGCCACAAGTTCTTCTTCTGGTAGCGTCCCAGAACGGCGCCGTCCGGACCGATAAAGTACG
CCGCATTCGCAATTCCTTCAGTCATGGAGGCATTGCCTTCCTCCGCAGGGATGGGCTCTAGGATCGTGCCCGGAG
CAATGGCGATGCCGAGCTCCTTGGCAATGGCCTGATATTTTGCAAGATACGGCGTCTGCTCCTTGGCCGTTGCGA
GGAGGATCTTGGAGTCGGGCTTCCATGAGCCGAGATGGTACTCAGGAAGGACGACCAGGTTCGCGCCCTGGGAGG
CGGCCTTGCGGATGTATGACTCTGCGCGAGCAAAGTTGCCAGCTACATCGAGCGGCTAGAGTTGGTGAACAATTA
GGAGACAAGATCAGCCTTCATAATTGCTTCAGCTGCAGCAGGGGTTGTTGGTGGCACACGGGCGACGAATGCCAA
GCAATACGTCAGATACGCAAACTCACCTTGGAATACAGCTGAACCAGCGCAATCTTCAAATTCGACGCCATTGTC
ACAGAAAATCAAATGCTAACACAAGTCAAAGTGTAC

> SEQ ID NO:1692 213011 1100450_301460_1b
GCTACCCATCTATCAACAATAAACCTATCAACCAAGACACATGACACCACCCCCAAAACAAACCCCACACACAAA
CCGCCACAATGCCTTTCACCGGATCCGACATCATCAAGATCATCTGCGCCGTCGTGCTCCCGCCCCTCGGTGTCT
TCCTCGAGCGCGGCTGCGGTGCTGACCTCCTCATCAACATCCTCCTGACCGTCCTCGGTTACATCCCCGGCATCA
TCCACGCCCTGTACATCATCCTCAAGTATTAGATGCGTCGCCATCAGGCACCAGCATGAGCGCGCACCACCCACC
CGCCACCTGCTACGCCGAGCAAACTCTACGTGAACCCACCAAACATACGATACCCCAAAGCGAGAGGAAAGGAA
GCATGCAGCGGCGGCATAATTTACACATTGTGTTGAATTACGGAACGGATCGCCGAGCTTTGACAGCGAGGCGAG
GCAACCCTTTTTTACGAGCTTGCTTTTATGAGATTGAGTAGTAATGTCTGTACTACAATTCTGAAAAATCATCCA
CCTA

> SEQ ID NO:1693 213011 205666_300800_1b
GTGCCTTGTTGCAGCATCCCGTAACCCCTGCAGGATACCGCCCTAAGCCGCCCAATTTCTCGTCACTGGCTCTAG
CTTTTTGCTGTTTATCCCGAAATGGGCATCGAATGGCTTCTGTTCCCTCCCCCCCTATGATGTGTGGCTTGACCA
GTCGATGACGCAAACATGGAAGCCGGCTTCCTTTCTCCTTCTTGGTCGGAATGCCTGGGAAGGGCCAAGATGACG
AGCCACGGCAATAAATAGTACAAGCTTCGCAGAAACCTTCTTGTCCGCTCTTCTCCCTTTTGTGTCTCACACAGC
TTTTCTTCATCTTTACTCCGCGATCTTCTTGATCTTCACCAAAACAACATCATTGCGCCCTTGAAGCCCTCTTAG
CAAATATTCGATATACCCAAAAGGCATTGAGCCCTTGAGCCTTACGAGAAACACATATATCCAACATGCCTTTCA
CCGCTAGCGATATCTGCAAGATTATTCTTGCCATCATTCTGCCACCCGTCGGTGTCTTCCTCGAGCGAGGCTGCG

Figure 2 continued

GTGCAGACCTCTTGATCAACATCCTCCTCACAATCCTGGGTTACTTCCCTGGTATCATCCACGCTCTGTACATCA
TATTGAAATACTAAGCCCGCCTTCCGCTCCCGTATCCCGCCGGATTCAAAGCGTCATGTCGTCGCACCGCATCAT
GTTGTGCAGACACCAATTACTCCCACGTTTGACCGGCAATTGTCGTTTTAGAATGGATGCGTCAGTGGAGGAGTG
AAGGTTACGGTCGCCGGCTCACCACGTGGCCGGTCATAGACGCCATAATGACAGTGGGCTTTCCTTTATGGCTTT
TCTTTTGTTTTTTCTTTTCCTCTCTTGTTGGCTGGAGGCAGATGCACCCTATTTGAAAGGGGGCGT

> SEQ ID NO:1694  213011 224168_300979_1b
ATATGTTGCTGGTTATGGTACAATTAATACTTGAAGATGATGTAGAGGGCATGGATGATACCGGGAATGTATCCA
AGACAACAGAGGAGGACGTTGATGAGCAGGTCAGCGGTGCATCCTCGCTCCATGAAAACTCCAACGGGGGGGAGG
AAGATAGCAACGATGATCTTGAGAATGTCGGAAGAGGTGAAAGCCATTGTGTTTGTGTTTGCGGACGCGTGGGT

> SEQ ID NO:1695  213059 206719_300825_1b
AACGGGCCTCCATCGACTCCAGACCATCCACGACCTACACGGAAGTGGCAAGAGATCGAAATCGTCTGCAGCTTA
CCCCTGCAACGGCCTTAACAAGCTCCCGACTCGGCGGGAAGCTATAGCGATCCAAGCCGCTCTTGTCTCGTATAT
AACCAAGAGCTAGACTTCGCATTAGATAGTTCTTCGTCCTTGTGTCTGAGGACAACTCCCTTCTTCATTACATAC
AATTGATTCAACCTGACCACAATGGCTGACGTTCAGTCCATTCGGGCATTCGGCAAAGCCCGCTCCACCATCGAG
GGCAAGCCCCTGTCTGACGAAGAAATCAAGCAATACAATGATTATTTCAAAGCCAGCTGCTACCTTTCTCTGGGT
ATGATCTACCTGCGAGAGAACCCTCTCCTTCGCGAGCCCCTCAAGAAGGAGCACTTGAAATCTCGTCTTCTTGGA
CACTTTGGTTCAGCTCCCGGACAAATCTTCACATATATGCACTTCAACCGTCTCATCAAAAAGTACGATCTGGAT
GCCTATTTCGTGTCCGGCCCCGGTCACGGTGCCCCCGCCGTTCTTTCGCAGTCTTATCTCGAAGGTGTCTATTCG
GAAGTCTACCCAGACAAGTCACAAGATATCCAAGGCCTCCAGAAATTCTTCAAGTATTTCTCTTTCCCAGGCGGT
GTTGGGTCCCATGCAACTCCCGAGACTCCAGGCTCTATCCACGAAGGAGGAGAACTCGGATACTCTCTTTCACAT
GCCTTTGGCTCTGTGTATGACTACCCCAATCTCATCGCTGTCACCATGGTAGGTGATGGTGAGGCAGAAACTGGT
CCTTTGGCTACTGCTTGGCAT

> SEQ ID NO:1696  213364 1100285_301458_1b
GAAACCTATGGTAAGGGCGTAGGCATTGACAGACGTCTGGTTAGAGGTAGCTGTTCGACTTGCAGTCATGGTGAA
CGTTCCAAAAACAAAGAAAAGCTTTTGCCAGGGCAAGGACTGCAAGAAGCATACCTTGCACAAAGTTACTCAGTA
CAAGAAGGGCAAGGACAGTCTCTACGTGCAAGGTAAGAGGCGTTATGACCGGAAGCAATCTGGATATGGAGGTCA
AACCAAGCCAGTCTTTCACAAGAAGGCTAAAACTACCAAAAAGATTGTACTGAAGCTTCAATGCCAGGGTTGCAA
ACGTGTAACTCAGCATCCTATCAAGAGGTGCAAGCATTTTGAAATTGGTGGTGACAAGAAGGGAAAGGGAACATC
TCTGTTCTGAGCTGTTGCATTGCTTTTGTCTTCTTTTTTAGTCTTGATCTTTATCTCGATGTAGTCCAATTAAAG
CTTAATTTAAATACCCCAACGGATCCTATCTGGTTCTGTAGTTGCTTCAGATATCAGATTAATGACAATGTAGTT
TATTTGAGAATTAATATCAACTCTTACCATTATTATGAATCGGATTCCCCACTGG

> SEQ ID NO:1697  213364 1117668_301848_1b
ACCTCACCGCCCTTCGACGACCGAAATACCGTCAAAATGGTCAACATCCCGAAGACGCGCAGGACCTACTGCAAG
GGCAAGGAATGCAAGAAGCACACCCAGCACAAGGTCACCCAGTACAAGGCTGGCAAGGCCTCCCTCTTCGCCCAG
GGTAAGCGTCGTTACGACCGTAAGCAGTCCGGTTACGGTGGTCAGACCAAGCCCGTCTTCCACAAGAAGGCCAAG
ACCACCAAGAAGGTCGTCCTCAGATTAGAATGCACTTCGTGCAAGACCAAGGCGCAGCTCGCTCTCAAGCGCTGC
AAGCACTTCGAGCTTGGTGGTGACAAGAAGACCAAGGGTGCCGCTCTTGTCTTCTAGATGGGTGCATAACGGTTA
TGGCGCTAGGGATGATGATGGAGCGGTCTGTGCATGTAGCCTCCTCGAGTACATGATCCTTGAGGGCTCGGAATC
AAAGCTTCGTTTCTCCG

> SEQ ID NO:1698  213364 291638_200080_1b
AAGCAAAGGCGGTTTCTACTGCAGCTCCTTCCTTGCCTGAAGTCAGCCTCCGACCATGGTGAACGTTCCAAAAAC
TAAGAAGACGTACTGCAAGTCAAAGGAGTGCAAAAAGCACACTCTGCATAAAGTTACACAGTACAAGAAAGGAAA
AGATAGCCTAGCAGCTCAAGGCAAGCGTCGGTATGATCGCAAGCAGTCTGGTTATGGTGGGCAGACGAAACCCGT
TTTCCACAAGAAGGCCAAAACTACCAAGAAGATTGTGCTAAGGTTGCAATGCCAGGGTTGCAAACATGTGTCCCA
GCACCCAATCAAGAGATGCAAGCACTTTGAAATTGGTGGAGATAAGAAAGGAAAGGGAACTTCTCTCTTTTAAGT
GGCGCATTCACGGAGATGAAATTGTTTATTTTTGTGTCGTGGTGGACTTTTTTATCAAGTGTAGCTCAACAATGT
TTCTTTTGCATATTGAACAATGTATGTCTATGGTATAATACTTATATTTCGAGT

> SEQ ID NO:1699  213364 26650_300391_1b
AACAGCAAAACCATATCTTGATGATTCAAAATATAGAGTTAACAAGCAAAGATGAGACAATCTTGTACGAGAGAG
CTAAAACAAATGGATTCCAAATCCAGCAAGTACAAAAATCGCAGAAAATAAGATGAAACCAACTTAAAACAGAGA
TGTTCCCTTTCCCTTCTTGTCACCACCGATCTCGAAATGCTTGCACCTCTTGATAGGACGCTGCGAAAAGTGCTT
GCAGCTTTGACACTGAAGCCTCAAAACAATCTTCTTCGTGGTCTTAGCCTTTTTGTGGAAGACAGGCTTAGTCTG
ACCACCATAACCAGATTGTTTACGGTCATAACGACGCTTTCCTTGAGCAGCAAGACTGTCTTTACCCTTCTTGTA

Figure 2 continued

TTGGGTAACCTTGTGCAAAGTATGCTTTTTGCATTCCTTGTTCTTACAGTAAGTGTTCTTTGTCTTTGGAATGTT
CACCATTTTCGCGTCTCTGATCTCCGGTGAAGCTTTTGTGCCGTCGTCCGGACGCGTGGG

> SEQ ID NO:1700 213364 255716_301643_1b
AGGGGAGGGCGCGCTCTGAAGCAGCCATGGTGAATGTTCCGAAGACCAAGAAGAGCTTTGCCAAGGCAAGGATGT
AGGAAGCATACGCTTCACAAGGTCACTCAGTACAAAAAGGGGAAGGATAGCTTGTATGTGCAAGGAAAGAGGCGT
TATGACCGAAAACAGTCGGGATATGGAGGTCAAACTAAGCCTGTCTTCCATAAGAAGGCAAAGACCACTAAGAAG
ATTGTCCTTAAGCTGCAATGTCAGTCTTGCAAGCGCGTGATTCAACATCCCATCAAGAGATGCAAGCACTTTGAA
ATTGGAGGTGACAAGAAGGGAAAGGGGACTTCCCTGTTCTAAATCTCATCATTTTTCTATCAGTTTTGGCTTGGG
ATCCCTGATCTTATTGTGTTGGAGCTCTTCCTTATTCCATATAAGAGCTAATTCTTAGTCTTTCTGAGTTCCTAC
TGTATGAACTTATTATAATCCAATGCACAATTATGGCTACTCTTACTATTATATGAACTTATTGTCATCCGATGC
ACG

> SEQ ID NO:1701 213364 202344_300783_1b
CCCCCGAGGGTTTTCGGCACCGAGCTCGCGCCGCCGCCATCGCACCCACCGAAGGAGGGAGAGGAACCCAAAGCT
CGGCGCCATGGTGAACGTGCCAAAAACTAAGAAGACTTACTGTAAGAACAAGGAATGCAGGAAGCACACCCTACA
CAAGGTTACCCAGTACAAGAAAGGAAAGGATAGCCTTTCTGCTCAGGGGAAGCGTCGTTATGACTGCAAGCAGTC
AGGATATGGTGGGCAGACAAAGCCTGTTTTTCACAAGAAGGCCAAGACAACAAAGAAGATCGTTCTGAAGCTGCA
GTGCCAGAGCTGCAAGCACTACTCTCAGCACCCGATCAAGAGGTGCAAGCACTTTGAAATCGGTGGAGACAAGAA
GGGCAAGGGAACTTCACTCTTCTAAGATGCTGATATTGCCCTGTTCCCCAATTCTCTGCCAGGAGTTAGCATTAA
GAATGTTCTTGTCTTGCCTTTCTAGTACAAGTTATATATCCTCTTGTTTTCAGTCAGGTCTTTTTGATACATAAC
TACACTACTA

> SEQ ID NO:1702 213364 158770_200049_1b
TAATCCTCGACTCGCGACAATGGTGAACGTACCTAAGACAAAGAAGACCTACTGCAAATCCAAGGAGTGCAAAAA
GCACACCTTGCATAAGGTCACACAATACAAGAAAGGAAAAGATAGTCTTGCTGCCCAGGGGAAGCGTCGTTATGA
TCGTAAGCAGTCAGGTTATGGTGGACAGACAAAGCCCGTCTTCCACAAAAAGGCAAAAACTACAAAGAAGATTGT
CTTAAGGTTGCAATGCCAGGGGTGCAAGCATGTCTCTCAGCACCCAATCAAGAGGTGCAAGCATTTTGAGATTGG
TGGGGACAAGAAAGGAAAGGGAACCTCTCTTTTCTAGATTGCCTGTGATGCAAAATTTGATAGTTTTCTGTTATA
CGTTTTTAGATATCTTTTTTTGTTG

> SEQ ID NO:1703 213364 127233_300469_1b
CATTTCTGTCTCACTCTTCGCCGGCGACAATGGTGAACGTTCCTAAGACAAAGAAGACCTACTGTAAGTCAAAGG
AGTGTAAGAAACACACTTTGCATAAGGTCACACAATACAAGAAGGGCAAAGATAGCTTAGCTGCTCAAGGAAAGC
GTCGTTATGATCGCAAGCAGTCTGGATACGGGGGTCAAACAAAGCCCGTCTTCCACAAAAAGGCAAAAACGACAA
AAAAGATTGTGTTGAGATTGCAATGCCAGGGGTGCAAACATGTTTCGCAGCACCCAATCAAGAGGTGCAAGCATT
TTGAGATTGGCGGGGACAAGAAAGGAAAGGGAACCTCTCTTTTCTAGATTGCCTGTGAAGCGGAATGTAACAGAT
CTTTCACCCCCTTCTGTTCTGTTACACTGTTCAGATACTTTGGTAATATTTGATGTAGTGCAGGAGTTTCTGTTA
TTGAATCATGTGATCAATTTTGTGATGTCTTAGAGAATCTGATAAGGAGAGAAAATGAATATTTTAAGTTTTTGG
TTTAGTATCTTGTTGCCTAAATCTATTGCAAGAAAGTTATGCTGCTCTACCTCACTTGGCTGCATCAATTTGTAT
GTTGGGATTATATTATAGGTTGTTTTCTCCAAACTAGTGTATATTGAAACACT

> SEQ ID NO:1704 213364 1100466_301460_1b
TTTGTCATACTTTCTGATTGGGAGGGGAGGGTGAGCTCTCTTCTGAAGCAGCCATGGTGAATGTTCCGAAGACCA
AGAAGAGCTTTTGCCAAGGCAAGGATTGTAGGAAGCATACGCTTCACAAGGTCACTCAGTACAAAAAGGGGAAGG
ATAGCTTGTATGTGCAAGGAAAGAGGCGTTACGACCGAAAACAGTCGGGATATGGAGGTCAAACTAAGCCTGTCT
TCCATAAGAAGGCAAAGACCACTAAGAAGATTGTCCTTAAGCTGCAATGTCAGTCTTGCAAGCGCGTGATTCAAC
ATCCCATCAAGAGATGCAAGCACTTTGAAATTGGAGGTGACAAGAAGGGAAAGGGAACTTCCCTGTTCTAAATCT
CATCATTTTTCTATCAGTTTTGGCTTGGGATCCCTGATCTTATTGTGTTGGAGCTCTTCCGTATTCCATATAAGA
ACTAATTCTTAGTCTTTCTGAGCTCTTACTATATGAACTTATTATAGTCCAATGCACAATTATGGCTACTCTTAC
TATATGAACTTATTATCATCCGATGCACAATTATGACTACTCTTACTATATGAACTTATAATCCGATGCACAATT
ATGGCCAATTTTTAAAAGCCGAAAA

> SEQ ID NO:1705 213827 199626_300751_1b
AAACGAAGTACTGTAATCGTACGTACTCAATTGACGGGCTTTCGACCCCTGTTTTGCATCTGCGGTCGAATAAAC
ACCGACTGCATCTCCATCAGATTGCGCTTGGCGGCCGGGTCTACTGTTGCAGTTGATGCCGCCCAACTCTGGCAA
AACCTGGCGCTGCGGCTGCGGCTGGAGACCGGGGGAGCGATTCTGGCTGCCCAAACGAGAACCGGGGGGGATGTC
AATGCACAGTTGCATCGAAATTTGGCGATTAATTTTTTTACGAGGGAGGATTAGGATTAGGACTTTGCACGGTAG
G

Figure 2 continued

> SEQ ID NO:1706 213908 212927_300845_1b
GTTCAGGAGTCCACCTACGTACTTGACGTATGCATTTCACAAAAACGGAGTACAGCTGGACTCATGAGGAGCAAG
GGATAAACGTCTGTCTAGCAATTGGCGTGATATGGCCGCTTAGGATAAATCATATGATC

> SEQ ID NO:1707 213923 207604_300827_3b
GTCCTCAGACGCTTGCATTAAGTAGACATCATTGTGTCTACTCCCAGTCATCGTCGACAACTTCTTTGATACAAG
ATTGCAAGACTCTATCCAAGTATGGCTACCCCAGGTACCGACCCCATCGAGGGACAATACAACAAAGAATCCGCG
GCCGACGTGCCCACCAACGGGCACTATGTTTCCAATGGCATGGGCTCTGGACAGCAATTCCAGCCCCAGCAGTAT
CAGCAGTATCCGGGCTATGGACAATTTGTTCCGTTTAGCAACACCCAAGATCCTCGGGCTGGGCCTCACCAGGCC
ATGATCTCCCAGGTCTACCAACCTACCCTTGGTAAGATTGGTAACCCAGGTCCTCTTGGTCTGATCGGTTTCGCT
TTGACGACCTTCGTGCTCGGACTTTACCAGTGCGGTGCTGGTCTCCCTAATTCCAACCCATTGGGCAACGTCGGC
CCTGATCAAGCTGTCTTCGGTGTGGCTGTCTTCTTCGGAGGCATGGCTCAGTTTGTTGCTGGTGTCATGGAATTT
GTCCTTGGCAATACCTTCGGTTGTACTCTCCACTGTTCATACGGGGCTTTCTGGCTTGCCTTTGCCATGTTCTCA
GTCCCTACACTGGGCATCCAGGCCGCTTATAACGGAGATCAACGTGCCTTTAGCTTTGCTGTTGGCATTTTCCTC
ATCATATG

> SEQ ID NO:1708 213991 210938_300963_1b
ATCTTCAAGTTCATTGCTGATCGTGCCGGCGACTTGCTTGGCTTCGCTCACGATGGTGTTGCCTTTTTGACCACA
CCTGCCGTGGCCGCGCTTCCCTGGTTCTTCTTTGGCGTCATCCCAGCCATCATCTTCTTCATCTCCCTGGTGCAG
GTCCTGTACTACATTGGCTTCATCCAGTGGTTCATCAAGAAGGTGGCCATCTTCGTCTTCTGGGCTCTCAATGCC
TCCGGTGCCGAGGCCGTCGTCGCTGCCGCCACCCCCTTCATCGGCCAGGGCGAGTCTGCCATGTTGGTCCGTCCC
TTCGTCCCCCACATGACCAATGCCGAGCTTCACCAGGTCTTGACCTGTGGTTTCGCCACCATTTCCGGCTCCGTC
CTTGTTGGTTACATTGGTCTTGGTCTCAATGCTGAGGCGCTCGTCTCCTCCTGGATCATGTCTATCCCCGGCTCC
CTCGCCATCTCCAAGCTTCGCTATCCCGAGACTGAGGAGACTCTTACCGGCGGCCGTGTCGTCATCCCCGACGAC
GACGAGCACAAGGCTGAAAACGCCCTGCACGCCTTTGCCAACGGTGCTTGGCTCGGAAT

> SEQ ID NO:1709 214019 218779_300921_1b
TCGACCCACGCGTCCGAAACAATCTCAGATCTTCATCTCAACTTTCAATCTTCCACACAAGCAAATAACCAACCA
ACCAACCAATCACAATGGATTCCATCAAGCAGGGCGCCAACTACGTCGGTGAGAAGGTTCAGCAGGCCACCTCTG
GTGCCTCCAAGGAGACCAACAAGCAGGTCGCCAAGGACTCCGATGCCTCTGTCGGCACTCGTGCCTCCGCTGCCA
AGGACGCTCTCGGTGACAAGATGGACGAGTCCAAGCACGACGCCAAGGGCGAGGCCCACAAGCAGGCCATCTAAA
TGGACTGAGTGAGAGGGAACGATGACAACACTTTTGCTTCTACCCCGTCTTGAGAGACAAATAGTCGATACCCCT
ATGAGAACTCAATAATACAACTTTTTCAGCCGAAAAAAAAAAGAAAA

> SEQ ID NO:1710 214086 1119606_301899_1b
AGGTTTCGAACTCTTTCCTTCTCCTCCTCCTCCTCCCGTTCCCTGCGCCGAGGAGGAAGAAGAAAGAGCCAGGCC
AACTCAGAGAGGAGGAAAGAGGAAAGAGGAAAGAAGAAGAAGGACCATCCCCCGCGCGCTATCCACACTTGTGCA
GAACTATTTGACGCTAACATGATCAAGCTATTTAGTGTCAAGCAAAAACAAAAAGAAGCTGCTGAAAGTGCAAAT
GGGAGGCCTCAAGTCAGGAAACAAAGTGCTGGGGAATTGCGTGTACAGAAAGATATCAGCGAGTTGAATTTGCCC
AAAACAACTTCCATATCCTTCCCCAACGGGAAAAATGATATGCTGAATTTTGAAATAAGCATTTACCCAGATGAA
GGCTACTATCGTGGTGGAACTTTTTTCTTCACTTTCAATATTTCCCCATTGTATCCTCATGAAGCCCCAAAAGTG
AAATGCAAGACCAAGGTATATCATCCAAATATAGATTTGGAAGGCAATGTCTGTCTAAACATTCTCCGGGAAGAT
TGGAAACCAGTCTTGAGCATCAACTCAATAATATACGGGCTTCAATATCTTCTTCTGGATCCAAACCCAGATGAT
CCTCT

> SEQ ID NO:1711 214086 284451_200098_1b
CGATAAGAGAGAAGAAAAGAACCCATTTGCTGGCTCTTACGCTAACCTGAGATCACACAAATCCTCTTTTTTCTT
CAGCTTTTTTGTGCCTTCTCACTTAAGCAGGGACCATGATTAAGTTGTTTAAAGTAAAAGAAAAGCAGAGAGAGC
AAGCTGAGAATGCAAATGGAAAGCCACCAGTCAAGAAACAAAGTGCAGGAGAGTTGCGTCTTCACAAAGATATAA
GTGAGCTAAATCTACCCAAAACATGTAGCATATCATTTCCCAATGGAAAAGATGACCTCATGAACTTTGAAGTCA
CTATTCGGCCTGATGAAGGATATTATATGGGTGGCACATTTACGTTCTCTTTCAGTATTTCCCCAATGTATCCTC
ATGAAGCCCCAAAGGTGAAGTGCAAGACAAAGGTTTACCACCCTAATATTGACTTAGAAGGAAATGTGTGTCTCA
ACATTCTTCGAGAAGACTGGAAACCTGTGCTCAACATTAACACCATTATCTATGGTCTATATCATCTGTTCACGG
AGCCGAATCACGAGGATCCCCTCAATCATGACGCAGCTGCTGTATTAAGAGACAACCCAAAGTTGTTCGAGTCCA
ACGTTAGAAGGGCAATGCATGGAGGCTATGTTGGGCAAACGTTCTTTCCTCGCTGTATGTAACATCTTTACTTCT
GAATCAACTGATTTAAGAAGCTGATGGTGGAAGTTTGA

> SEQ ID NO:1712 214111 1099380_301549_1b

Figure 2 continued

TTGCGGGTGTCAACAAGCTTCTGCGCACCTTGTCTCCTTCGATCACCCTCAAGGTAGGAGATAAAACATGGCGAT
GGCAATGGGTATGAAGCCCGGAAAGCCTGGCCTCGAGGAGCCTCAAGAAGCCCTCCATCGCATCCGTATCACCCT
TTCTTCCAAGAGTGTCAAAAACCTCGAAAAAGTGTGTGCGGATTTGGTTCGAGGTGCCAAAGAAAAAAAGTTGAA
GGTCAAGGGGCCTGTTAGAATGCCCACAAAGGTGTTGCGCCACACCACCAGGAAGTCCCCTTGTGGAGAAGGTAC
CAACACGTGGGATTGTTTTGAGCTGAGGATACACAAGAGAATCATTGATTTGCACAGCTCTTCAGAAGTTGTGAA
GCAGATCACCTCGATTACAATCGAGCCTGGAGTCGAGGTGGAAGTGACAATTGCAGATGTCTGAGTGTAGTCAAT
TATTTCTTTTTGACCGGGAAAAGGTTATTGACTTGGTTGAAGAGGGATGACTGGTCTTTCAATTTTAGGTTATGT
TTCTCCTTATGAATATTTGTTAGGATTTTTGACATTTAATCCTGTGTTAACGGAGAATTGAGCTGGATAGTATTT
TGGAATCATTTCTTAGCAACCCATATTACCTTTA

> SEQ ID NO:1713 214111 6025_300098_-1b
CCCACGCGTGCGCACAAATTCACAACCGCAAAAAATCCTCTCCCGGCTTAAAAACGAGTGATAAAGAGGTGTAAC
AAAACATGGCGTATGAACCGATGAAGCCCACGAAAGCTGGTTTGGAGGCTCCTCTGGAGCAGATTCATAAGATCA
GGATCACTCTCTCTTCAAAAAATGTGAAGAACTTGGAAAAAGTGTGCACTGATTTGGTCCGTGGAGCTAAGGATA
AGAGACTTAGAGTTAAGGGACCAGTGAGAATGCCCACTAAGGTTCTTAAGATCACTACCAGAAAGGCACCTTGTG
GTGAAGGTACCAATACTTGGGACAGGTTTGAGCTCAGGGTTCACAAGCGTGTCATCGATCTCTTCAGCTCCCCTG
ACGTTGTTAAGCAAATCACGTCTATCACCATTGAGCCCGGTGTTGAGGTCGAGGTCACTATTGCTGACTCTTAGA
CACTTGTTCCAAAACCGCTTCAAAAGAATGTATTTTATCGTTTCTGGTCCTACATTTTTGTTTGCAACCTTGTTT
CTTGGGTTTTGATAGTTCTGAGGTGGTTTTTGTCTATCGAATTTTTTTCATCTATAAGAGACCTTAATGAACCAA
AAAAAAAAAACCCAAAAAGGGCGGCCGCACCCTAGGCCAGT

> SEQ ID NO:1714 214111 264982_301439_1b
GGCGCATTTTTGCGGTTCCAATAGATACTTCTTGTAAAGTTCCAATCTCTTATTTCTTGTTTCAGAATATACATG
CTTTCGCTCACATCTCTTACCACAGTAAGTACTTGTAGTTAAGGTACCACAACACACACAAGAGAAAGTAGCCAT
TCTAGACCTAGGACCAGGGTTAGATTCCACGTCACCCGCCAACTTCAGCAAATCAAAATTCAACAGCTGTTTGTA
GAGCTCGGCATAATCCGGAACATCATACGGATAAGCGGCCGCCACATCAGCGATCGTCACCTCGACCTCGACACC
AGGCTCGATGGTGATGGAGGTGATCTGCTTCACAACATCTGGGGAGCTGATGAGATCGATCACCCGCTTGTGGAT
GCGGAACTCGAAACGATCCCATGTGTTTGTTCCTTCACCGCACGGCGACTTGCGGGTGGTGATGTGGAGCACCTT
GGTGGGGATCCTGACGGGGCCCTTGACGCGCAGCTGCTTGTCCTTGGCGCCCTTCACCAGATCAGCGCAAACCTT
CTCGAGGTTCTTGACGTTCTTGGAGGAGAGGGTGATGCGGATGCGATTGAGCTGCAGCTCCCGCCTCCTCCAT
GCCGAGCTTCCCGCCCTTCATCGCGCCGCCGGCGCCGTACACCGCCAGCCGCCGCCATGCTTAATTAATGCGAAGG
TAAATACAGTAGATTTAAACATCAGGACCTAGAGTTCACCACTCGAAGTCTTTTCTCAGCTTCTTATCCACAAAT
TTCCCTTCACAATTAAACAGCAACTTAAACTTATTAAAGTCAAAGATATGATAACATAAAGAAACCAAAGCAGAA
ATAGCACTATAAGGGGATCGATATCTATCCACTAAAGCCTTATCCAAAGCATCAAGCACCTTAAAGTCTTTGTAA
GATTTGTAATTGTCATTGATAGAGATATAAATCTCACTCAAAACTTCTACATCTCTCACATCAGTTCTACCTAAT
TTTGTGA

> SEQ ID NO:1715 214111 201663_300718_1b
CGGACGCGTGGGCGAGCACCACCAACCCCACCCCCCGAGCGAGCGGAGCGGAGAACGCGAGGCGAGGCGAAGCAA
ACATGGCGGCGGCTGCGGTGTACGGCGCCGGCGGCGCGATGAAGGGCGGGAAGCTCGGCATGGAGGAGGCGCGGG
AGCTGCAGCTCAACCGCATCCGCATCACCCTCTCCTCCAAGAACGTCAAGAACCTCGAGAAGGTTTGCGCTGATC
TGGTGAAGGGCGCCAAGGACAAGCAGCTGCGCGTCAAGGGCCCCGTCAGGATCCCCACCAAGGTGCTCCACATCA
CCACCCGCAAGTCGCCGTGCGGTGAAGGAACAAACACATGGGATCGTTTCGAGTTCCGCATCCACAAGCGGGTGA
TCGATCTCATCAGCTCCCCAGATGTTGTGAAGCAGATCACCTCCATCACCATCGAGCCTGGTGTCGAGGTCGAGG
TGACGATCGCTGATGTGTAATGCTGCCAAACTAGCACTACCTTAGACCTACCTGTCTTGTTTCTCTGCTGCTTAG
AATCTCGGTTCCGATTGCCATGCGTGTAACGGACATCCAACTGGTTTAGTGTATCTGGGTCTTTTATATGTGCGC
GGATGCTATGGATCTTTCTCATGTAAGAGGTGTGTAACTCGCCAGTTTTGCTTCAACCACATGAAATTTGGTATT
GGAA

> SEQ ID NO:1716 214111 139043_300406_1b
CGAAAAACCCTAACGCCACCCGCGCCGCCATCCCCGAGCACCACCAACCCCACCCCCCGAGCGAGCGGAGCGGAG
AACGCGAGGCGAGGCGAAGCAAACATGGCGGCGGCTGCGGTGTACGGCGCCGGCGGCGCGATGAAGGGCGGGAAG
CTCGGCATGGAGGAGGCGCGGGAGCTGCAGCTCAATCGCATCCGCATCACCCTCTCCTCCAAGAACGTCAAGAAC
CTCGAGAAGGTTTGCGCTGATCTGGTGAAGGGCGCCAAGGACAAGCAGCTGCGCGTCAAGGGCCCCGTCAGGATC
CCCACCAAGGTGCTCCACATCACCACCCGCAAGTCGCCGTGCGGTGAAGGAACAAACACATGGGATCGTTTCGAG
TTCCGCATCCACAAGCGGGTGATCGATCTCATCAGCTCCCCAGATGTTGTGAAGCAGATCACCTCCATCACCATC
GAGCCTGGTGTCGAGGTCGAGGTGACGATCGCTGATGTGTAATGCTGCCAAACTAGCACTACCTTAGACCTACCT
GTCTTGTTTCTCTGCTGCTTAGAATCTCGGTTCCGATTGCCATGCGTGTAACGGACATCCAACTGGTTTAGTGTA
TCTGGGTCTTTTATATGTGCGCGGATGCTATGGATCTTTCTCATGTAAGAGGTGTGTAACTCGCCAGTTTTGCTT

Figure 2 continued

CAACCACATGAAATTTGGTATTGGATTCAATTTTTGTC

> SEQ ID NO:1717 214111 111129_300052_1b
AAGAAAACCGAAGCTGCGGCTACGTCTTTTACATCTTCGTCGCATCTCCCTCAGCAAATCAAATCAAATCAAAAT
ATGGCGTATGCAGCAATGAAGGCAACAAAACCAGGGCTAGAGGAGCCCCAGGAGCAGATTCACAAGATTAGAATC
ACTCTTTCTTCCAAAAACGTTAAGAATCTTGAGAAAGTGTGTGCTGATCTGGTTCGTGGTGCCAAGGACAAGAGG
CTCAGGGTAAAAGGACCTGTGCGAATGCCCACTAAGGTTCTCAACATTACCACTAGAAAGTCTCCCTGTGGAGAA
GGCACAAATACATGGGACAGGTTTGAGCTGCGGGTGCACAAACGTGTGATTGACCTTTTCAGTTCCGCAGATGTT
GTCAAGCAGATCACCTCAATCACCATTGAACCGGGTGTTGAGGTTGAGGTCACCATTGCTGATTCTTAGATTCTT
CTCTGTTTTCATTAGGTTGTTGAATTTTTTTCAAGTACTAGTGGTTTGCAGTTGCTTTCTTGGCCGTCTAAATTA
TGGGCTTAAGGTTTTCTTTATTCCAATTAAAGTTTTGCAGCTAAACCAGATACTAATACTATTTGATATTGGGAA
GAGGATTTGTCCGTTAAAA

> SEQ ID NO:1718 214333 208006_300831_1b
AAGAAAATAGAGAAGGGGGAGAAAAGAAGAGAGCCTCTTAGAGGATGATGCTGAATGACGCTGTGGATGGTGAAA
TGTGAGATGAGCAAGGTTTGTGTTACATGTATATTAAGAGGATTTTTTCTTTTTGTGGACGGTTTTTTATATGTG
ATATTATGGAGAAACTAGCAAGGATGGAGAAAAGGGGGAGAAAAGGAACGATAAGTTTATCTCTGTTTGGGCATG
TATGGGTGTTAATATGATTGACTTGTCATATGTGAATGATGAGTAGATGATGTGATCAACACTTGGATGAGAGAC
TCACAACCAGATTTACGAGTCATTCATCTATACAGACATAAACGCTGAGAACGTCATCGGAGGTATTGCTTCACT
TCACATCTTGATGCTATATGTAGCTGGCCGCATTTCGTTTGCTGGAAAGAGGTGCACGGATTAAGATGCAAGTAG
CACATGTACGGTTGAGAAACTCAGGAACACAAAAGATGTACATTAAACTCCCATTCTAGAGAACCTATTTACAG

> SEQ ID NO:1719 214336 208119_300832_1b
GGACCTGGCCGACAACATCTCCGCTGTCAACGCCCAGATTGCCTTCATCGCCATCTTCATCGCCTTCTTCGCCTC
CACCTGGGGTCCCGGTGCCTGGATTGTCATTGGTGAAATCTTCCCTCTGCCTATCCGATCTCGTGGTGTTGCTCT
GTCCACCGCTTCCAACTGGCTGTGGAACACCATCATCACCGTCATCACCCCCTACATGGTTGGTACCGATAAGGG
CAACCTGAAGTCTTCCGTCTTCTTCATCTGGGGAGGTCTCTGCACTTGCGCTTTCGTCTACTCCTACTTCCTCAT
CCCCGAGACCAAGGGCCTGTCTCTCGAGCAGGTCGACCAAGATGATGGAGGAGACCANCCCCGTACCTCTGGCA
AGTGGAAGCCTACTACCACCTTCGCTGCTCAGATGGGCACTGGTGAGTACATTGAGAAGGCTGTCGTTGAGGTCT
AAGCGTTTCCTGCGTCGATTTGGATAAAGGAGGTGTTCTTTTTCTTTTTCTTCCCTTTTTACTATTTCCTTTA
TAACGTGGTGGGGTGGAT

> SEQ ID NO:1720 214350 218245_300916_1b
CCCACGCGTCCGGCCCAGAATCACATAAAAAGCACGGACACAAAAAGCACAAAAACAAGAATAAGGACAAGAGAA
AAAAAGAGGCAGCTCATAGTTAGGGCAAGGAAAAGGGCGGGATGGAGGGTACCGTGACAGGCGCTGGATGCCGG
TCCAGAATAGCCTCATCGGCAAGCACCGTGTGATTGGATCCGTGGTCCCGTCCAACCAGCTGGGACACGCGTTCA
TTCGCCCAAGGGACGGACAGGAAGCCCGCAGGCCCTTGCGAACACGGGACAGCGATGGGGCCCGTGGTGATGATG
ATGAGATGATGATATCGCCCGGGAGAAGACGAAGGGAGGAAGCAGATGGACGGCGTAC

> SEQ ID NO:1721 214411 216318_300868_1b
GTGGATAGCGGATGGATACTTGCAGTAATATGGGTAAGTGAGTGAGTGAGTGAGTGATATGGATACAGCGGGAT
GATGATGATGGTGGTGGTGGTGGTGTTGTCACTGATGTTGTCGAGTGAGTTGTTTGTTTGTTTACCTTTGGAAT
TGATTGAAATGAAATGAAATGAAACAGCCCAATGCACAGCCTAAGTCCAAAGAAAACAAACCAG

> SEQ ID NO:1722 214417 199983_300754_1b
TGTCTTGTCATTATTACTCGACCGCGTCGAGCCAAGAAACCATTGAAGCACATAACAAACCGTTCGAAAACCGCA
ACAATGTCTATCGTCCAGCCACAAGAATACCAGACCGTTGACGACGTGCCGTATCAGCGAGGCCGTCCTCTCCCA
ACAGTCACCCCCGTCTTCCAGAACAAGCTGCCCAACTCGCCTGGCAAGACGTCCATCGGCCTCCTCGTCGACTTC
CCGCCCAACTCGTCGACGCCCCCCACACGCACGGCGGCGCGGCCATCTCCGTCTTCGTCATCAAGGGCACCGTG
CTCAACAAGATGAACGATGGCCCGACTCGTGTGATCCCGGCGGGCGGCACGTGGTTCGAGGCCCCGGCTGCCAC
CACCGGACCAGCGACAACTTCAGCACCACGGAGCCGGCGCAGATTCTGGCGACGATGGTGGTTGACACAAAGACT
GTTGAAGAGGGAGGGATGGCGGCTCTTGTTGTGCTCGACCCGGAGTATGCTGATATCAGACTTGGTTAAATTGAT
ATGGATGCTGCAGTGAAGAGAACCGGAAGCTCGGAAAGGGTGTGGGTGTTGTCAATATCAGAAGTGGCCAGCGGA
GGCTCGGATTGCTGTTAGTAAACGGGCATCTCAGCAGGAAGGCAAAATGAATATGTAAAGCAATCAATGGCAAC
GAATCGTTT

> SEQ ID NO:1723 214437 1100335_301459_1b
AGGAGAGAGGGAGGGAGAGGGAGAGGGAGAGGGAGAGAGAGAAGTCGAAAACCGGCTAATCTTCTCCTCTAATCA
TGTCGCTGATCGCCAACGAGGATTTCCAGCACATTCTTCGTGTTCTCAACACGAACGTAGATGGGAGGCAGAAGA

Figure 2 continued

TCATGTTCGCCCTCACGGCGATCAAGGGTATCGGCCGACGTTTCGCCAATCTCGTCTGCAAGAAGGCAGACGTCG
ACGTCAACAAAAGAGCTGGAGAACTCTCTGCTGCAGAGTTGGAAAGCCTTATGGTGATTGTTGCAAATCCTAGAC
AGTTCAAGATCCCCGACTGGTTCCTGAACAGAAAGAAGGACTACAAAGATGGACGCTTCTCTCAAGTTGTGTCCA
ATGCTTTGGATATGAAGCTCAGGGATGACCTTGAGAGGCTCAAAAAGATCAGGAATCACCGAGGTCTTCGCCACT
ACTGGGGCCTTCGTGTTCGAGGGCAGCACACAAAGACCACTGGCCGCCGAGGAAGGACTGTTGGTGTCTCTAAAA
AGCGTGAGGGGGGTAATTCTAGTTCCTTGTCGTGGCTGGCATTTAGAAATGTCTCAATT

> SEQ ID NO:1724 214437 1126279_302022_1b
AGGTATATAAACTATTTATTAACAGACAAGGCCTACAGACTTATTTCTTCTTGGACACACCCACGGTGCGGCCAC
GGCGGCCAGTGGTCTTGGTGTGCTGGCCTCGGACACGAAGGCCCCAGAAGTGACGCAGCCCTCTATGGGCCCGAA
TCTTCTTCAGTCGCTCCAGGTCTTCACGGAGCTTGTTGTCCAGACCATTGGCTAGGACCTGGCTGTATTTTCCAT
CCTTTACATCCTTCTGTCTGTTCAAAAACCAGTCTGGGATCTTGTACTGGCGTGGATTCTGCATAATGGTGATCA
CACGTTCCACCTCATCCTCAGTGAGTTCTCCCGCCCTCTTGGTGAGGTCAATGTCTGCTTTCCTCAACACCACA

> SEQ ID NO:1725 214437 127831_300473_1b
GCATCTCTTTCAAACTAAAGCAGCCGCAGCCGCAGCCGCACTGTGCCGAAAGCAGTGAAACCCTAACCATGTCGC
TGGTTGCAAACGAAGAGTTTCAGCACATTCTTCGTGTGCAAAACACGAACGTTGATGGAAAGCAGAAGATCATGT
TCGCTATGACCTCTATCAAAGGTATCGGTCGCCGTTTTGCTAACATTGCTTGCAAGAAAGCCGATATCGACATGA
ACAAGAGGGCCGGAGAACTCTCTGCTGCAGAGCTTGATAGCTTGATGGTGGTTGTGGCTAATCCTCGCCAATTCA
AAATCCCAGATTGGTTTTTGAACAGGCAGAAGGATTACAAGGATGGCAAGTTTTCTCAAGTTACATCTAATGCAC
TTGATATGAAACTCAGGGATGATCTGGAACGGCTGAAGAAGATCAGGAATCACCGTGGTTTGCGTCACTACTGGG
GCCTTCGTGTACGTGGTCAGCACACAAAGACCACTGGCCGCAGGGGGAAGACTGTTGGTGTCTCCAAGAAGAGAT
AAATCATTTACTTGCCAGTTCCTTTATGTTTTATGCTTCTCTTTGGTATGTGGAGTCCGAACACCCGCAGGAAGT
TTATTAGGTATTTTGTAATGTTTGCACTGGAATTTTCTAGTCTTGCCATTTGGAGGGTTATAGTTCCTATAAATC
CTCTGGCGGCATTGCAAGCATTTGTTTATTGTGGGATCAAAGTTTTGCCGGTTTTACGCTTGAATTATTACATTG
ATTGAGTACTTTTTATTGAGATGC

> SEQ ID NO:1726 214437 171725_300536_1b
CGAACCCTCGCAGCCGCATCGCGCCGGCGCCTCCTCCTCCCCCTCCCCCTCCCCCTCCGGCGAGAGAGCCCGCGC
CGTTGCCGCCGCCGCCGCCGCCATGTCGCTGATCGCGGGGGAGGATTTCCAGCACATCCTGCGTCTGCTGAA
CACGAACGTGGATGGGAAGCAGAAGATCATGTTCGCGCTCACCTCCATCAAGGGTGTCGGCCGCCGCTTCTCCAA
CATCGCATGCAAAAAGGCCGACATCGACATGAACAAGCGGGCTGGTGAACTCACTCCTGAGGAGCTTGAGCGCCT
CATGACTGTGGTGGCAAACCCTCGCCAGTTCAAGGTCCCTGACTGGTTTCTGAACAGGAAGAAGGACTACAAGGA
TGGGAGGTTCTCCCAGGTTGTTTCTAACGCCCTGGACATGAAGCTCAGGGATGACCTTGAGAGGCTGAAGAAGAT
CAGGAACCACCGTGGTCTTCGTCACTACTGGGGTCTCCGTGTCCGTGGTCAGCACACCAAGACTACTGGCAGGAG
GGGAAAGACTGTCGGTGTCTCCAAGAAGAGATAAATTCCATGCCCATCAGCACAGCAAATGCGTTTTGCTTATCT
TATGAGCGTTTCAATGATGTCAGTCTTGATAGGGCATTTTGTTGGATGATGCTTTTGTCTA

> SEQ ID NO:1727 214437 175882_300522_1b
CCCCCCCCCACCGTGGTCTCCGTCACTACTGGGGTCTCCGTGTCCGCGGTCAGCACACCAAGACTACTGGCAGGA
GGGGAAAGACTGTCGGTGTCTCCAAGAAGAGATAAATTCCATGCCCATCGGCTCAGCAAATTCATTTTGCTTGTC
TTATGAGCGTTTCAATGATGTCAGTCTTGATAGGCAGTTTTGTTGGATGATGCTTTTGTCTAAGAAGATAGATCG
TGCCGTTGCAGGAATCTCAAAACTTTTATATATTGTAACTTGGTTGTTTGGTACCGCAAATTCTGAAGCCTAATTT
TTTTACTGGATGTGTTTCTGGT

> SEQ ID NO:1728 214437 9161_300301_1b
CCCACGCGTCCGCTTTTGTGTTCTTCACTCTCCAGCGATCGTTTATTGCTTGAAGACGGCTTCTTCTTCTCACAA
ATCTCATCTCTGCTAATCAAAATGTCTCTGGTTGCAAATGAGGAGTTTCAACACATTCTTCGTGTGTTGAATACT
AATGTTGATGGTAAGCAGAAGATTATGTTTGCCCTTACCTCTATCAAAGGTATTGGTAGGCGATTGGCTAACATT
GTCTGCAAGAAGGCTGATGTCGACATGAACAAAAGGGCTGGTGAGTTATCTGCTGCTGAGATTGATAACCTCATG
ACAATCGTTGCAAACCCACGTCAGTTCAAGATCCCAGACTGGTTCTTGAACAGGCAGAAGGATTACAAAGATGGC
AAGTATTCTCAAGTTGTCTCCAATGCTCTTGACATGAAGCTGAGAGATGATCTTGAACGTCTCAAGAAGATC

> SEQ ID NO:1729 214437 49984_300189_1b
AAACCTCATCTCTGCTAATCAAAATGTCTCTGGTTGCAAATGAGGAGTTTCAACACATTCTTCGTGTGTTGAATA
CTAATGTTGATGGTAAGCAGAAGATTATGTTTGCCCTTACCTCTATCAAAGGTATTGGTAGGCGATTGGCTAACA
TTGTCTGCAAGAAGGCTGATGTCGACATGAACAAAAGGGCTGGTGAGTTATCTGCTGCTGAGATTGATAACCTCA
TGACAATCGTTGCAAACCCACGTCAGTTCAAGAT

Figure 2 continued

> SEQ ID NO:1730 214437 4778_300317_1b
GATCTTTCTCGGCATCCAAAAATGTCTCTAGTTGCGAACGAGGAGTTTCAGCATATTCTGCGTGTGCTCAATACT
AATGTCGATGGGAAGCAAAAAATTATGTTTGCTTTGACCTCAATCAAGGGTATTGGAAGGCGATTGGCTAACATT
GTGTGCAAGAAGGCTGATGTTGACATGAACAAGAGGGCTGGAGAACTAAGTGCTGCTGAGATTGATAACCTCATG
ACAATCGTTGCTAACCCTCGCCAGTTCAAGATCCCAGACTGGTTTCTTAACAGACAAAAGGATTACAAGGATGGG
AAATACTCCCAAGTTGTTTCCAATGCTCTTGACATGAAGTTGAGAGATGATCTTGAGCGTCTCAAGAAGATCAGA
AACCATCGTGGTCTGAGGCACTACTGGGGTCTCCGTGTACGTGGACAGCACACCAAAACCACCGGACGCCGTGGA
AAGACTGTTGGTGTTTCCAAGAAGCGTTAAAAAGAGTTTGAGCTTGGTTCAATGGCTTTGTTTTGTTTTTTTTGT
ATTGTTGTTTTTTGCGGCCGCAATTCTCGAGC

> SEQ ID NO:1731 214437 253203_301624_1b
ACCGGTCGACCCATAACTACACGCCAAAATGTCCCTCGTCGTCACTGAACAAGGCAACTTCCAGCACATTCTTCG
ACTCCTCAACACTAACGTTGACGGCCGAATCAAGGTCATGTACGCCATGTGCAAGATCAAGGGTGTTGGTCGACG
ATACGCCAACCTGGTCTGCAAGAAGGCCGATGTCGATCTCTCCAAGCGAGCCGGTGAGCTCACCGTCGAGGAGCT
CGAGCGAATCGTTACTATCATCCAGAACCCTGGTCAGTACAAGATTCCCGGCTGGTTCCTTAACAGACAGCGAGA
CTTTACCGACGGTAAGGACTCCCAGCTGCTCGTTAACCAGCTTGATGTCAAGCTGCGAGACGATATTGAGCGACT
CAAGAAGATCCGAGCCCACCGAGGTCTCCGACACTACTGGGGCTACAAGGTCCGAGGTCAGCACACCAAGACTAC
CACTCGAAAGGGTAAGATCATGGCTCACCGAGGTTAAAACGTGCATGTACATGTAAAATTATTAAAATGCTATTG
AGGACC

> SEQ ID NO:1732 214437 245406_301568_1b
ACGCGTCGGTTTGTAGGCGGCTCGGCGGCGAAGATGTCTCTGGTGAGCAATGAGGAGTTTCAGCACATTCTTCGT
GTGCTCAACACCAACGTGGATGGGCGGCAGAAGATCATGTTTGCGCTCACCTCCATCAAGGGTATCGGCCGCCGC
TTCGCCAACATTGTCTGCAAGAAGGCCGATGTGGACATGAACAAGAGGGCTGGTGAGCTGACCGCTACCGAGCTC
GAGAACCTGATGCTGATCGTTGCCAACCCGCGGCAGTTCAAGATCCCCGAGTGGTTCCTCAACAGGAAGAAGGAC
TACAAGGACGGGAGGTACTCCCAGGTTGTGGCCAACGCTCTCGACATGAAGCTCAGGGACGACCTGGAGAGGCTC
AAGAAGATCAGAAACCACCGTGGTCTTCGTCACTACTGGGGTCTCCGCGTCCGCGGGCAGCACACCAAGACCACT
GGACGCCGTGGAAGAACTGTGGGAGTGTCCAAGAAGCGATAGATAGCCGCAGCTTTTGTTTGGTCTCTTAATTTC
CAATATGTTTTAAGTGCAAATTTTAAAATTCATTAAGAAAATTAATTT

> SEQ ID NO:1733 214437 190584_300693_1b
CCCAAAACCCTAACCCTCGCAGCCGCATCGCGCCACCGCCTCCTCCTCCCCCTCCCCCTCCGGCGAGAGAGCCCG
CGCCGTTGCCGCCGCCGCCGCCGCCCATGTCGTCGATCGCGGGGGAGGACTTCCAGCACATCCTGCGTCTGCT
GAACACGAACGTGGATGGGAAGCAGAAGATCATGTTCGCGCTCACCTCCATCAAGGGTGTCGGCCGCCGCTTCTC
CAACATCGCCTGCAAGAAGGCCGACATCGACATGAACAAGAGGGCCGGTGAGCTTACGCCGGAGGAGCTGGAGCG
GCTGATGACCGTGGTGGCGAACCCGCGGCAGTTCAAGGTGCCCGACTGGTTCCTCAACAGGAAGAAGGACTACAA
GGACGGGAGGTTCTCCCAGGTTGTCTCCAACGCGCTCGACATGAAGCTCAGGGATGATCTTGAGAGGCTCAAGAA
GATCAGGAACCACCGTGGTCTGAGGCACTACTGGGGCCTCCGTGTGCGTGGGCAGCACACCAAGACAACCGGAAG
GAGGGGTAAGACTGTCGGTGTGTCCAAGAAGCGATAAGCCTAAGAACCACCCGAGACTTGATGAAGCGTTTCGTT
GGGTGATGTTTTGCCCTAGGATAATATTTTGCAGCTATGGAACCTTGTCGTAATGTATCTTGAAGAGTGTCTTTG
GGAACTA

> SEQ ID NO:1734 214437 156462_301366_1b
CTCACATCTCTTGAATACAGAAGAAGCCGCCGCCGCACAGAGCAAGATTTGAAACCTAGCAATGTCGCTCGTTGC
AAATGAAGAATTTCAGCACATTCTTCGTGTGCAAAACACCAACGTCGATGGGAAGCAAAAGATCATGTTCGCTTT
GACCTCAATCAAAGGTATCGGTCGTCGTTTTGCCAACATTGCCTGCAAGAAAGCTGATATCGACATGAACAAGAG
GGCGGGAGAACTTACTGCTGCAGAGCTTGACAGTGTGATGGTGGTTGTTGCAAATCCCCGTCAATTCAAAATACC
TGATTGGTTTTTGAATAGGCAGAAGGATTACAAGGATGGGAAGTTTTCACAAGTTACCTCTAATGCTCTTGACAT
GAAGCTTAGGGATGATCTCGAGCGCCTGAAGAAGATCAGGAATCATCGTGGTTTACGTCACTACTGGGGTCTCCG
AGTGCGTGGTCAGCACACAAAGACCACAGGGCGCAGGGGGAAGACTGTTGGTGTCTCCAAAAAGAGATAAATCAT
CTACTTGTTCAGTTTGTTATGTGCTTTCTCTTTATGTGCTCCGGGCGATACATGTTTAAGATATTTTAGGGGATT
TTGTGTTGGTATGCTTAAATTTTCCTTTCCGTTGGTGGATTACAGTATAATTTTTTTCCATAGTGACAAGGATTT
CTCTGCTTTATGATCTAGGTTTTGCAAGATGATCTTGAATTAAATTGAATGAGTATTTCCTTAAATATACTC

> SEQ ID NO:1735 214437 126863_300467_1b
GCCATTACGGCCGGGGAGGGTTTTGGTAGTTCTGCATCTCTTCAGGAGTGAACGAAACAGCCGCACCGCGGAGCA
GAATTCGAAACTGTAGCAATGTCGCTGGTTGCAAATGAAGAATTTCAGCACATACTTCGTGTGCAAAACACGAAT
GTTGATGGGAAACAGAAGATAATGTTCGCAATGACATCTATCAAAGGTATCGGCCGTCGTTTCGCTAACATTGCC
TGTAAGAAAGCCGATATCGATATGAGCAAGAGGGCGGGTGAGCTTTCTGCTGCTGAACTCGATAGCTTGATGGTG

Figure 2 continued

GTTGTGGCAAATCCTCGCCAATTCAAAATCCCCGACTGGTTTTTGAATAGGCAAAAGGATTACAAGGATGGTAAG
TTTTCGCAAGTTACATCTAATGCTCTGGACATGAAGCTTAGGGATGATCTGGAACGCCTAAAGAAGATCAGGAAT
CATCGTGGTTTGCGTCATTACTGGGGTCTTCGAGTCCGTGGTCAGCACACAAAGACCACTGGTCGTCGGGGGAAG
ACTGTTGGTGTCTCCAAGAAGCGATAATCTCCTTTCCCCTGAGCCAGTTTTGCATGGTTATGCTATTTTGTTTTT
ATATGCAGCAACAAAGTTTGAATGGAGTTA

> SEQ ID NO:1736 214437 1109442_301531_1b
GTTCTTTCTTCTTGGAGGGTGTGTCGTAGTTTAGCTATTGGGGAGGGGTAGGGATAGGATAGAGGCAGAAAGAGA
ACAGGAAGAAGAAAGAAGCCGGCGAAGGGTAAGAAGGGGTTTTCCTCAGCTCTCAACCATGTCTCTGATCGCCAA
TGAGGATTTCCAGCATATCCTGCGTGTCCTGAACACGAACGTGGATGGGCGGCAGAAGATCATGTTCGCCCTCAC
GGCCATTAAGGGTATCGGGCGTCGCTTCGCCAACCTCGTTTGCAAGAAGGCCGACGTCGATGTCAACAAGAGAGC
TGGGGAGCTTTCGGCGGCTGAACTTGAAAGCTTGATGGTGATTGTTGCCAACCCAAGGCAATTCAAAATCCCTGA
TTGGTTCTTGAATAGAAAGAAGGACTACAAAGATGGTCGTTTCTCCCAAGTTGTATCCAATGCCTTGGACATGAA
GCTCAGGGATGATCTGGAGCGGCTTAAGAAGATCAGGAACCACCGAGGTCTTCGTCACTACTGGGGCCTTCGTGT
GAGAGGACAGCACACAAAGACCACTGGCCGCAGAGGAAGGACAGTTGGTGTCTCCAAGAAGCGATAGTCACCTAT
ATTCTTCTTGCTGGCGGATTTTTTTTATACATGTTTTGTCAATCTTGATATCAGAAATCGATGCAGACGGACAGN
CCCCCCTTCTTTGACCGTATCGCATTGGCAGGATCCTTTAGTTTCTAATGAACACAACGGAAGT

> SEQ ID NO:1737 214447 200469_300759_1b
GCTTTTCTCCTGGGATTTTCGAGTGCAAACATCTGCCCTTGTTTGCGTCTTTCCGCCTGCGCAAACCAGAACACC
GCACTTCCTCCCGAGACAGAAACGAGTGTTGGTTGCCCCAGACTGTCTTTGATTCTGAGACATTTGGCCTCCCTT
GCAGGTAACTGACGGTGAGAATAAAAGCCGACGGGCCGCCGCCTGCAGCAAACGAAACCAGCGACATACAAAAG
AAACACAAACAAGCAAATCAATTCCCGAGCAAGAAAAAAGAAGAAGCCCATCATGAAGATGCTTTCGTTTGCCG
CCCTCTCGGTGCTCGTGTTGGGCGCTTCGGCCCTGGCTGCGCCGCCGGCCCACCCCCGGCCGACAATGGGTGCT
GCTGCTGCGACATCAACAAGAAGAGAATCGACTGCGACAGGTCGATCCCGGCGTCGGAGTGCATCTGCCCCCAGG
TCATCTGCCCCGCCGGCGCGCCCACGTTCACGCACGGCACGCCGCCGAAAGCCACCCCACCGCCCACGCCGCTGC
CGACTTACAAGCAGTGCTGCTGCTGCAATCCCAACATTAACAAGATTGTGTGCTCGCTGAGGCTCGTGGAGGACT
GTATCTGCTTGGCCGTGATGTGTCCGACGGATGCAAAGACCATCTTTGTCAGGCCAACTGGCGTTCCGACTGTCG
CTTAAGAGTATTCGTTGGCGAGCCGACTTGCCTGAATCCTGGACCGGGGACATGACATGGGGGGAGGGAAAATAC
AGGGCAAGGCATTGCTGATGGTGAATGCACAACACGCGTGGCAGACTGGCCGAAAATTGATGATTTACTGATGGG
CGACTTTGGACTTGAAATGGGGCATGCCGGATGGGTTACTTGACAGTATTTACACCATTTCTATTCAACAATAAA
TGGAATTCTCTAGATAAAAAAAA

> SEQ ID NO:1738 214452 187931_300682_1b
CCCACGCGTCCGCCCACGCGTCCGCCCACGCGTCCGTTCTCCTCCAGGTTGCAGCAAAAGCACAGGAAGCAGCGA
GATGGAAGGCAAGAGCCGGCGACCGGAGATAACCGTCGTGCCGGCGGCAGGCGGCGGCGCCGCCGCCGCCGTTGA
TGCGGTGAAGGCGGCGAACAAGGAGCCCATCAGCCCGGGCTCGCCGTCCCTGGCGAGCGGCGCCGGCAAGGAGAG
CCTGAGCCGCCATGAGGCCGCCGTCGTGTCCCTGCCCGCGTGGAAGCTCGACGCGCTCTGCCAGGAGTCCGGCTC
GTCGCCGGCGGTGATGAGGGCGCGCTTCCCCTACTTCTGAATTTCTGAATTTCTGATGAAGCCATGAGCTTTTTG
CCATCTTCGTACGTGTGTGTGTGTGTGTGTGTGATTGTAACTGTGTTGTTCATGGCTGAGTAAAGAATTATAC
TTCCTACAAGCGGCTGTGATGTATATGTGAGCTGCTTTAGCTGACGCGTTCATCTTTGGACGCTGTAAAAACTAA
AAACTGCCAGTTTTTCATGTAGCATCATTGGAAAAACATAGCCATCTGTTTGCGTTG

> SEQ ID NO:1739 214456 217790_300911_1b
TTGTAAAGACTCCCCCTCAAGGCCCCAGAAAAGACGAATTCAAATCTACGCCGACTGTCTCTCTGCAATCGAAAG
CTATTCGTGCAACCATTACACGTCAACAAGCCATCGATCTCTTAACAAACCTTTATAGAACTTGCGACAACTTTC
TACCGCCATCATGGGTGTCTGTGCCGCAGTACTAATTGTCATCGTCACCATCTTCTTCCCTCCGCTCGGCGCGTG
GGCTGTGGCAGGATGTGGAATGGACCTACTCATCAACGTATGCTTGACGATACTTGGGTATTTCCGGGTCACAT
ACATGCGTTCTATCTCGAATACGTGTATTACGACCGTCGGCAACAAGCCCGCGAGGGCCATTATCCGCCGCGTCG
TGCTCCCGGCATCTACTCTGACAAGGTGCAAACGGGTGGACAAGGCCGTCGACAAGGCTATGGAACGATGGCACC
GCCGCCTGCTGGGCAGCCTGCTGGTGCTGGTGCGCCTGTCGCTGGCCCTCCCTATGATAGCCAAGGTTATAACAA
CAACCAAGGCTATGTAAATCAGGGCTATGTCAACCAAGGTTATAGCAACCAAGGTCAAAACCAGGGATA

> SEQ ID NO:1740 214485 210386_300888_1b
GGGCGGACGCGTGGGCGGCCAAATCCCACACTTCAGACTCAGACTCAGACTCACGCTCAGAAACAGTCGTCACAA
TGGATCCCTTGGAGAGCATGTCAACTGGAGGGCCCCTGCCCAAGGACTTCAATGCCGACGATGCGGGCAACATGG
AGGATATGGAGAAGCAATTTGCCGTCAAAGTTGTGCAACACATGGCAACCTACTGGGCCATTCTCGAAAAGGTCA
AGGGCTCCGGCCTGCGACTGACGAAGATCGACGACGAGATCTACGACCACCTCAAGGAGGCCTTTCCCGAGTTTG
ACCCCGCCGCCACGATCGACGAGGACCAGATGAAGAGCAAGACCGGCAAGGAGAGGTGGCGCGCCTTCATGATGA

Figure 2 continued

AGTACGAGAAGAAGGTGGACGACTACAACTTTGGCACCATGGTGCGGAACAACGCCAAGGCCGAGTACGAGCAGG
ACACAACCATTTTCGTCCCCAGGATGCAGTTTTATGCCATTGAGATCGCCCGAAACCGAAGCGGCCTCAACGACT
GGATATACGAAAAGGCTCAGGAAGAGAAGAATAGCTCCAAATAAATACCCCAATACACAAGCCAATTCAAGAGTT
GTTTTTGTTATCACCGCGTGCCTTTGTCAACTAAAAATATTGAGGATTCACTCAACGGGCGTGGATATGGTTTTG
TCAT

> SEQ ID NO:1741 214485 224025_300978_1b
CAAGCCCAAGTGGAGAGAATTCATGAACACGTACGAGAACATCATTGCCGACTACAACTTTGGCACCATTCTGCG
AGTTGATGCTTCCAAGGGCTACACTGAGACCAACACCATGTTTGTGCCTCGAATGCAGTTCCTGGCCATTGAAAT
TGCTCGAAACAAGTACGGTCTCAACGACTGGGTCTACCAGTCTGACGCCTAAGCGCGCGGACGGAGACGCCAAAC
ACCACCAACAACTAATGTTGGGCAACGATAGAGCCCGATAGCTAATGTCATTATTTATGATCG

> SEQ ID NO:1742 214504 216933_300903_1b
AAACGAAACCGCAATCCATCTCCCGGCGGAAATTGCCCTCCAACCGCAACCATGTCGACCCTCCCCAGGACTCTG
GCAACCTGCGCAAGATTGGCATCAAGGAATACTTCCGCCAGATGCTGGTTCGTCTCTCGCCCTTCTAACCTCCC
ACGACCTCTGGCTAACGCACAGCTCTTCGCGGTCCTCCTCGAATAGTACATCGGTGACACCAAGTACGGTACTCT
CATCGGCCAGGATCGCTTCGGCAACAAATACTACGAGAACCTCGAGGAACTGCCCCTCCGAACCCGCTGGGTCGA
CTACGCCAAGCACGACTACGATGCCTCCCACATCGAGCCCGGCTGGCACGCCTGGATCAGCTACTCCGTCGACAA
GCCCCCGACCCAGGACAGCCTCATCGCCACGGGCACCAGACACTTTGAGCCCGCCCTTCCCAAGCCCAACTTTAC
CGGAACGCGAGGCGCTTACAAGCCGTATAACACAGTGAAATCGAAGCTTAATGCTTGGGAGCCGGTGGCCAAGGA
TCGGGTATGAGTGGTTTTTACGTTTTCTTTTTTAAACCGTGGGAAAATATGGTGTACATATTGAAATCGCGCAAC
AAACGCAAACAAATCAAACAATAGACACAGACATGTG

> SEQ ID NO:1743 214515 224066_300978_1b
AGCAAAAATGCCCCCTAAAGTGCAGCAGACCAAGGCCGCTAAGGCCGCCGCCGCCATGGCCGGAGGAAAGACCCG
AAAGAAGAAGTGGTCCGCCCAGAAGATGAAGGATAAGGCTCAGCACCACGTTATCCTTGACCAGCCCCTGTACGA
CCGAATCTTCAAGGAGGCTGCTACCTTCAAGCTCGTCTCTGTCTCCGTGCTTGTTGACCGACTCAAGATTGGAGG
TTCTCTCGCCCGAGTTGCTCTCCGAGATCTCGAGGCCAAGGGTATCATCAAGCCCGTTGTCAAGCACTCCAAGCA
GTACACTTTCACCCGAACTGCTGCCGAGTAAATTAGTTATTTTATAGCTGAAAAAAATATGTATTG

> SEQ ID NO:1744 214533 207606_300827_3b
GTTGTTTTTTTGTTTTTCATCTTTCTTCTTTGTCACAATCACTTTGCCGTCTTCCACGGACATTTCCGCAGATCT
GCATCACAGAGATCTGCATCAGAGAGGATTTCAAGCTTTTCCTCTTTGTTTGCCTTCCTCTCCTCTTCTCTTCTT
GGATCACAAAACAATCGGCAAAATTGACATCTCGATATTTTCTGCCTCCAATCACAGCCGTCATACCACCTGTGG
CGTCTTTGCCATCAATTCTCTGCTGCGGTGCTACCCGCCCTGCAGCAATTTTTCCCGCTGGCCGTCTGCAGGCTT
GCCTCGGCTGTGGGTTTTTCGTCGACCACTGAGGCTTAGTGCCCATCAGCCACTAAAGCGGCTTGACGTCGATTC
TCAACTTTGAACCCTTTTGAGCTGCCTCTGGCCTCTGCCTCATCTCTCCCACACCCTCACGCGCGCAGTCTTGAA
TCAACACCCCTTCACGCACTCGCCATTGCCGCGCTCCTCGTCACGCTCTGCTCGATTAGCCGTCTCTCGCCCATT
GATTGAACCTGCTCTCGGCCTCTGCAGCCACCCTCACGCAACCTACGCCTGACATCCTCTGCGTCGCTCGGCTGT
CTCCCGGTTTTATCCATCAGCTGAACCTTCACCTTCGCCTTCGCTCTCAAGAGGGAATCCGAGGGCCCGGCCGTT
CTCTGCCATCTATTGTTATTGCCATTAACGCTGCTGCTGCTGCCACTGTCTCCTCTACTCCTGTTTCGCCCTCAT
ATGTCTCAGCCGCCTCGCCGGATGCCTCTACTATCACACCCTAAACACCGTATTAGCATACTTGATCTTACCAAA
CTGCCGTTGCAGTAACGCCGGCTTCATCTTCTTGACAATGCCGTCGAAAACTAACAATGGTGTGGGAGTTCAGGT
CGAGGACACAAAGATATGCGTTGTCATGGTTGGTCTCCCGGCCCGCGGGAAGAGCTACATTGCCCAGTTAGCCCA
GAGATACCTGCAATGGCTGTCGATTCCGGCAGCGACTTTCAATGTCGGCAACTATCGGCGCAATGACGCTCCACA
GCCGACTGCCGACTTCTTTGATTTTAACAATCCCGAAGGAGAGCGGAAGCGCCGTGCGGCTGCCGAGGCCGCCGT
TGCTGACATGCTTGCCTGGTTCCGCACCGGCGGCGTCGTCGGCATCCTTGACGCGACCAATTCTACAAAGGAGCG
CCGTAAATGGGTCATGGACACGTGCACCGCTCACGGCATTGAAGTGCTCTTTGTCGAGAGCAAATGCGATGATGA
AGAGGTCATCATGGCCAATATCCGTGACGTCAAGCTAACGAGCCCCGACTATCGAGGCCAAGATCCCGAGGCCGC
GGCGCAAGACTTTCGCAATCGCATCAGCCACTACGAGAAAGTTTACAAGACCATCAACGCCGACGAGGATGAGGA
CAACTACACCTACCTAAAGCTGATGAACGTCGGCAAGCAAGTCATCA

> SEQ ID NO:1745 214603 232946_301085_1b
GTTTTTCTAGGGCAAGCCCTCGCGATGATTCGGCGGAATGCCCGCCTCCGGAGGGAGTATTTGTATCGGAAGAGC
TTGGAAGGGAAGGAGCGCGAGGTCTACGAGAAGAAACGCAAGATCAAGCAAGCGCTTCAGGAAGGCAAGCCATTG
CCGACTGAGCTGCGGAACGAGGAGGCGGTTCTCAGGAGGGAAATCGATCTAGAGGACGAAAACACTGCAGAGCCT
ACTACTCATGTCGATGACGAGTATGCCTACGCTGGAGAGGTTGATCCAAAAATCCTTCTGACCACGTCCCGTGAT
CCCAGCAGTCGACTGACGCAGTTTGTCAAGGAACTAAAGGTTGTCTTTCCAAATGCACAAAGAATGAACCGTGGA
GGCCAGGTGATTTCGGAGATTGTAGAATCCTGCCGAGCTCACGACTTCACCGACATAATCATGGTTCATGAGCAC

Figure 2 continued

AGAGGAGAACCCGACGGTCTGATCGTATGCCATCTGCCGTATGGTCCTACAGCGTATTTTGGTCTCATGAACGTG
GTGACAAGGCACGATATAAAAGACAAGAAAGGCCTGGGAACAATGTCTGAAGCTTTCCCACATCTAATACTAAAC
AACTTCAACACCAAGCTTGGACAGAGAACTTCCAACATACTTAAATACCTCT

> SEQ ID NO:1746 214613 259107_301666_1b
TGATGTTTAAATCTACTGTATTTACCTTCGCATTAATTAAGCATGGCGGACCAGCTCACCGACGACCAGATCGCC
GAGTTCAAGGAGGCCTTCAGCCTCTTCGACAAGGACGGCGATGGTTGCATCACAACCAAGGAGCTGGGAACCGTG
ATGCGTTCGCTGGGGCAGAACCCAACGGAGGCCGAGCTCCAGGACATGATCAACGAGGTCGACGCGGACGGCAAC
GGCACCATCGACTTCCCCGGAGTTCCTCAACCTGATGGCACGCAAGATGAAGGACACCGACTCGGAGGAGGAGCTC
AAGGAGGCGTTCAGGGTGTTCGACAAAGACCAGAACGGCTTCATCTCCGCCGCCGAGCTCCGCCACGTCATGACC
AACCTCGGCGAGAAGCTGACCGACGAGGAGGTCGACGAGATGATCCGCGAAGCCGACGTCGACGGTGACGGCCAG
ATCAACTACGAGGAGTTCGTCAAGGTCATGATGGCCAAGGCGGCCGCTTATCCGTATGATGTTCCGGATTATGCC
GAGCTCTACAAACAGCTGTTGAATTTTGATTTGCTGAAGTTGGCGGGTGACGTGGAATCTAACCCTGGTCCTAGG
TCTAGAATGGCTACTTTCTCTTGTGTGTGTTGTGGTACCTTAACTAC

> SEQ ID NO:1747 214613 248465_301583_1b
ATCGATCCATCGATCCACCGGGCATTTCGTCAAAGAGGAGATGGCTGATCAGCTGACCGAGGACCAGATCGCCGA
GTTCAAGGAGGCGTTTAGCCTGTTCGACAAGGATGGAGACGGCTGTATCACAACTAAGGAGTTGGGAACGGTGAT
GCGATCGCTTGGACAAAACCCGACCGAGGCGGAGCTCCAGGACATGATCAACGAGGTGGACGCCGACGGCAATGG
GACCATCGACTTCCCCGAGTTCCTCAACTTGATGGCGCGCAAGATGAAGGACACTGACTCGGAGGAGGAGCTCAA
GGAGGCGTTCCGCGTCTTCGACAAGGACCAGAACGGCTTCATCTCGGCTGCCGAGCTCCGCCATGTAATGACCAA
CCTCGGCGAGAAGCTCACGGACGACGAGGTGGACGAGATGATCCGCGAGGCTGATGTGGACGGGGACGGGCAGAT
CAACTATGAGGAGTTCGTCAAGATGATGCTAGCTAAGTAGTAGAACATCTGTTTCCTTTTTCTCTACTTTGTTCC
TCGCCTTTCCTCTCTCTGTCTTTTCTCTTTCCTTTTTGTTTGGTAAAGTCCTGCTTCCATGTTAGGATGATGAT
TCCACCACGTCTAAAACCTTTTAAATTATTTGTTCCTGTCCTTGCAAAAAAAAA

> SEQ ID NO:1748 214613 245055_301564_1b
AGGAACACAGCAGCAAGCTTGGTGCTTCGTCGTCCGGTACCCCTGTTCTTCGCAGGGCCTGAAAAGGAAGGAAGA
GTTTTAAGCAAGAGACATCGATGGCCGCCTCTGCTGCCGAGCAGCTCACACAGGAGCAATTGGCAGAGTTTAAGG
AGGCCTTCAGCCTGTTTGACAAAGATGGCGATGGCTGCATTACCACCAAGGAACTGGGGACGGTGATGAGATCCC
TGGGACAGAACCCCACCGAGGCGGAGCTGCAGGACATGATCAACGAGGTGGACGCGGACGGGAACGGGACCATCG
ACTTTGCCGAGTTCCTGAGCCTTATGGCCAGGAAGATGAAGGACACCGACTCGGAGGAGGAGCTCAAGGAGGCGT
TCCGGGTGTTCGACAAGGACCAGAACGGCTTCATCTCGGCGGTGGAGCTGCGGCATGTAATGACCAACCTCGGGG
AGAAGCTCACCGACGAGGAGGTGGACGAGATGATCCGGGAGGCGGACGTCGACGGCGACGGGCAGATCAAC

> SEQ ID NO:1749 214613 176172_300519_1b
CGCCACTCGTTCCCCTTCCTTCCTCTCCTCCTCTCGCGGAACCTTCTCGAAGCTTCCACACCCCCAACCTCGCCT
CCACCACCAACCCCCCATGGCGGACCAGCTCACCGACGAGCAGATCGCCGAGTTCAAGGAGGCGTTCAGCCTCTT
CGACAAGGACGGCGACGGTTGCATCACTACTAAGGAGCTTGGAACCGTGATGCGGTCCCTTGGTCAGAACCCAAC
TGAGGCGGAGCTGCAGGACATGATCAACGAGGTTGATGCTGATGGCAATGGGACCATTGACTTCCCAGAGTTCCT
GAACCTGATGGCGAAGAAGATGAAGGATACCGACTCTGAGGAGGAGCTCAAGGAGGCCTTCCGTGTGTTTGACAA
GGACCAGAACGGTTTCATCTCGGCTGCTGAGCTCCGCCACGTCATGACCAACCTTGGTGAGAAGCTGACCGACGA
GGAAGTCGACGAGATGATCCGTGAGGCTGACGTCGATGGCGATGGCCAGATCAACTACGAGGAGTTCGTTAAGGT
CATGATGGCCAAGTGAGGAGGGTTCCCATTAAATAAGTTCTGTCTGAAGTGAACTAAAACTGTCAGGGCCTACAA
CAAAGCTGTACTTTGTGATG

> SEQ ID NO:1750 214613 174890_300527_1b
CTCTCCGCGACGGTCTGGGCTTCCCCACCCCTCGCCTCCTCGCGCGCTCGGTGAGAGAAGCGAAGAAGAAGAAGA
AGAGGAGGAGGAAGAAGCCAGGCTAAGCCCCGCGGCATGGCGGACCAGCTCACCGACGACCAGATCGCCGAGTTC
AAGGAGGCCTTCAGCCTCTTCGACAAGGACGGCGATGGTTGCATCACAACCAAGGAGTTGGGAACTGTCATGCGT
TCACTAGGGCAGAACCCAACGGAAGCTGAGCTCCAGGACATGATCAACGAGGTTGATGCTGATGGCAATGGAACC
ATTGATTTTCCTGAGTTTCTCAATCTGATGGCTCGCAAGATGAAGGACACTGATTCAGAGGAAGAACTCAAGGAG
GCCTTCCGGGTTTTGACAAGGACCAAAATGGCTTCATCTCCGCTGCTGAGCTCCGCCATGTGATGACAAATCTTG
GCGAGAAGCTAACTGACGAGGAGGTGGATGAGATGATCCGTGAGGCTGATGTTGATGGTGATGGTCAGATAAACT
ATGAGGAGTTTGTGAAGGTCATGATGGCCAAGTGAGCCATGGAACCATACTCTAAAGCAGAGGAGATTGTGTGTT
GCATAGTCCTAGCTAAGATGCAACACTTGTTTTATCAATTTCCAGTGAAGCATCCTACTAGCTGTAGTCGCTAAA
AAGGATTTTCCTGCTATGTTCCTCTG

> SEQ ID NO:1751 214613 142414_300435_1b

Figure 2 continued

AGCCATTCTCTCCGCGACGGTCTCGTCTTCCCCACCCCTCGCCTCCTCGCGCGCTCGGTGAGAGAAGCGAAGAAG
AAGAAGAAGAGGAGGAGGAAGAAGCCAGGCTAAGCCCAGCGGCATGGCGGACCAGCTCACCGACGACCAGATCGC
CGAGTTCAAGGAGGCCTTCAGCCTCTTCGACAAGGACGGCGATGGTTGCATCACAACCAAGGAGCTGGGAACCGT
GATGCGTTCGCTGGGGCAGAACCCAACGGAGGCCGAGCTCCAGGACATGATCAACGAGGTCGACGCGGACGGCAA
CGGCACCATCGACTTCCCGGAGTTCCTCAACCTGATGGCACGCAAGATGAAGGACACCGACTCGGAGGAGGAGCT
CAAGGAGGCGTTCAGGGTGTTCGACAAAGACCAGAACGGCTTCATCTCCGCCGCCGAGCTCCGCCACGTCATGAC
CAACCTCGGCGAGAAGCTGACCGACGAGGAGGTCGACGAGATGATCCGCGAAGCCGACGTCGACGGTGACGGCCA
GATCAACTACGAGGAGTTCGTCAAGGTCATGATGGCCAAGTGAGGCACCACTTCCCCTGCCGATGATGGCATAGT
ACCCTGGGAGGAGGAAACCGTGCATTGCCGTATTAGTAAGGGGATGCAAACACTGGTTTCAGTCGTCTTCCCTGA
TGAAGAAAACCGAACCGTACTAGTTGTAGTTGCTGAACATTTTTCTATCTCTCCAGTCTCTCCGGTGTGCCATGG
AACTTCTTGCTTGATTTTTCTGTGTGAATCTGTT

> SEQ ID NO:1752 214613 1101059_301473_1b
ACCCCTCTCTCTCTGTCTGTGCCTCTCTCTCTCTCTCTCTTTATATATATATATTCTCTTTCCTCCGGTCAAA
CGTTGGGAGTAGCATGGCCGAACAGCTGACTGAGGATCAGATCGCAGAGTTCAAGGAAGCCTTCAGTCTCTTCGA
CAGAGATGGCGATGGTTCCATCACCACCAAAGAGCTAGGTACAGTTATGCGTTCTTTAGGGCAGAATCCAACGGA
AGCTGAGCTTCGAGACATGATCAATGAGGTTGACGCTGACGGAAATGGAACAATTGATTTTCCAGAGTTCCTTAA
TTTGATGGCTCGCAAAATGAAGGATACTGATTCTGAGGAGGAGCTGAAGGAAGCATTTAAAGTCTTTGATAAGGA
TCAGAATGGCTACATTTCTGCTGCAGAGTTGCGTCACGTAATGACAAATCTTGGAGAGAAGCTGACTGATGAGGA
GGTTGATGAAATGATTCGTGAAGCTGACATAGACGGGGACGGCCAGGTTAATTATGAGGAATTTGTGAGAATGAT
GCTTTCAAAGTAATTCCAAACTTGTTCTTGTTGCCGTTCGTATTCAAATAGCAGATCTACTGCTAACAAAGATTT
GCTTTGGCACATAATTGAGCCGCTTTTTCATGTGGAAGGAGGCAAAAAAAAGGCCACAAAGTTCACCAGAACAAT
TAGCTGCTGTGTATTTTGAGGTAGTAGGTTATATAACGTTTGTAGTGG

> SEQ ID NO:1753 214613 1112638_301803_1b
TTCTCTCTCTCTCTCTCTCTCTCTCACTCTGTCCAGCTCCTCCTCCTCCTCAGCAATGGCAGACCAGCTGACA
GAGGAGCAAATCGCAGAGTTCAAGGAAGCCTTCAGCCTCTTTGATAAGGATGGAGATGGTTGCATCACAACGAAA
GAGCTGGGTACCGTCATGCGTTCCTTAGGGCAAAATCCAACTGAAGCAGAGCTTCGAGACATGATCAATGAGGTT
GATGCTGATGGAAACGGAACAATTGATTTTCCGGAATTCCTGAATTTGATGGCCCGTAAAATGAAGGACACGGAC
TCTGAAGAGGAGCTGAAGGAGGCATTCAAGGTCTTTGATAAGGATCAAAATGGCTATATTTCTGCCGCCGAGTTG
CGTCACGTGATGACTAATTTGGGAGAGAAGTTGACGGATGAGGAGGTCGATGAGATGATTCGTGAAGCGGACATT
GATGGGGACGGCCAGGTTAACTATGAGGAGTTTGTCAGAATGATGCTTGCAAAATAAAATCCCCCATTCCTTGCA
CTCAATCTAACACAAATAGGTTGCTAATTTGCTTTTTGGGATAGGTTGTATTAAGCTTGCACTCCCTAAGGAATG
AATTGTTTTTTTTTCTTTCCCTTTTTTGTTCATATAGCCATGGCTGAAATGCTTGGGCACAATTATCAGTTATGC
TTCATTGAGACACCATACGGGCTTTATGAGCTTGTGTAACTTTGATGAAG

> SEQ ID NO:1754 214613 1108616_301519_1b
GTTTTGGAGAGACGGGGAGCTGAGATGGCCGACCAGCTGACGGAGGATCAGATCGCAGAGTTCAAAGAAGCCTTC
AGTCTTTTTGATAAGGATGGAGATGGTTGCATCACAACGAAGGAACTGGGGACTGTGATGAGGTCTCTGGGCCAG
AATCCAACGGAAGGAGAGCTACAGGACATGATCAATGAAGTGGATGCAGACGGAAGTGGAACCATTGACTTCCCC
GAGTTCCTCAACCTCATGGCCCGCAAGATGAAGGACACCGACTCTGAGGAGGAGTTGAAAGAGGCCTTCCGTGTG
TTTGACAAGGACCAGAATGGATATATCTCTGCCGAAGAGCTTCGTCATGTCATGACTAACTTGGGAGAGAAGCTG
ACCGACGAAGAAGTTGATGAGATGATACGGGAGGCGGACGTGGACGGCGATGGCCAAATCAATTACGAGGAATTT
GTGAAGATAATGCTGTCCAAGTGAGGAGACCGAACGGGAATACTTGGGTTGTGTGTGAGGGGACTTTCTCTTACT
CGTAGCAATTCTTTTTGTGTGAAATTGAGCAACTA

> SEQ ID NO:1755 214613 130580_300488_1b
GAATTCACAACAGAGACTCGGCCATCATAATTCCGCGTTCTCTAAAATTTACCTTTTAGAGATCCCATCTTCCTC
TTGTTCTTCGTTGATATTATATCACACAGGGAAGAAACAAAATCATGGCTGATCAATTAACTGACGACCAGATCT
CTGAGTTCAAGGAAGCTTTCAGCTTATTCGACAAGGATGGAGATGGTTGCATCACAACCAAGGAACTGGGAACTG
TCATGCGTTCACTAGGTCAGAACCCAACAGAAGCAGAGCTCCAGGACATGATAAACGAGGTTGACGCTGATGGAA
ATGGAACAATTGATTTTCCAGAGTTCCTCAACCTTATGGCACGTAAAATGAAGGATACTGACTCAGAGGAGGAAC
TAAAAGAGGCTTTTAGGGTATTCGACAAGGACCAGAATGGTTTCATTTCTGCAGCTGAGTTGCGCCATGTCATGA
CCAACCTAGGGGAGAAGCTTACAGACGAGGAAGTTGATGAGATGATTCGTGAAGCTGATGTAGATGGTGATGGTC
AAATCAACTATGAGGAATTTGTCAAAGTCATGATGGCCAAGTAAGGAGACTCATCCCCTTACCACTAAAAAGGGA
AAAGAGAAACA

> SEQ ID NO:1756 214613 1107219_301505_1b
AATAGATCCTCCTCAGGCGATACTGCTTCTGCTCATCTTCTCTCCTTCAATATCTCGTCCTTGGCAGTAGCGCGA

Figure 2 continued

ATCGAACAGCGGTGGAATGGCGGAGCAGCTGAGCCCTGAGCAAATCGCTGAGTTCAAAGAGGCCTTTAGCCTCTT
CGACAGAGATGGAGATGGCTGTATTACAACTCGGGAGCTGGGGGTAGTGATGCGGTCGTTGGGTCAGAACCCAAC
GGAATCAGAGCTTGTAGACATGATTAACGAAGTTGATGCTGATGGCAATGGGACCATCGATTTTGC3GAGTTTCT
CAACTTGATGGCCCGCAAGATGAAGGATACTGACTCTGAGGAGGAATTGAGGGAGGCTTTCAAAGTTTTCGATAA
GGACCAGAATGGCTTTATCTCCGCTTCCGAGCTGCGCCATGTGATGATAAACCTTGGCGAAAAGCTGACTGACGA
AGAAGTGAAAGAGATGATTCGGGAGGCTGATACGGACGGGGATGGCCAAGTCAACTACGAGGAGTTTGTGAAGAT
GATGCTCTCTAAGTGAGTCGGGAAAGTCAAAGTCAAAAGCGAAAAGTGAAAAGTAAAAAGTAAAAAAATT

> SEQ ID NO:1757  214613  1100495_301460_1b
GTTCCACGTGCTTTTCTGCTCTCTTTTGGTTTCACGACTGCCCAACTCAACCTGCCCAGCGCTCTCTCTCTCT
CTCTCTCTCTTCCTGGTTTGGGTTTCTATGGCCGCAGTGATGGTCGAGCAGCCCCTGACAGAGGAGCAAATAGCC
GAATTTAAGGAGGCCTTTAGTCTTTTTGATAGAGATGGAGATGGGTGCATCACAACAAAGGAGTTGGGCACGGTG
ATGAGGTCGTTAGGGCAGAACCCCACTGAGGCCGAGATCCAAGACATGATCAATGAAGTGGATGCAGACGGCAAT
GGGATCATCGACTTCATGGAGTTTGTGGGCCTCATGTCTAGGAAGATGAAGGATACTGACTCAGAAGAGGAGCTC
AAAGAGGCCTTCAAGGTCTTTGACAAGGATCAAAATGGCTTCATCTCAGCCCTTGAGCTCCGCCACGTCATGACC
AACCTCGGTGAGAAGCTCAGTAACGAAGAGGTTGACGAGATGATCCGAGAAGCCGATGTGGACGGGGATGGCCAG
ATTAACTATGAAGAATTTGTCTTAATTATGATGAGTAGTAAGTAAGTAGGACCCCCATATAGAAGCCTCTTAAAC
CCTTCTCTAAGTCTTGTGTGTACTCATGAAAGGAAACATCCCCAGACTGAGCCCTTTGGTGTACTAAAGCATCAC
CAAAGC

> SEQ ID NO:1758  214626  1007975_301405_1b
GCACTCGATTTGTCAGCCTTGGTTGTCCTGCCCCCCTCAACCAGCGGGAAGCTTGGTTGCCAGATAAGGCGCTTG
GTTTGTCCCCCAGCACGGCCGCTGGGGATGGCCTCCAGGCGACTCCTTCCGGCCCTCCTCCGACGCGGCGCTGC
TTCATCGTCCCCGTCCCCGATCCGTTCTCCTGCGGTGGCCTCCTCCCGCCACTCCGGTAGTTGCCGCCCGCACAA
TGTAGCCCTAGCCCGGTCTCTCCCCTTCTCCACGAAGGCGGCTACCTCTCCTCCCGCCTCCCTGTCCCCACCTCC
TACTCCTACTAGCATGGGGGATTACTTCTCTGGAAAGGGTAGCGTTGGTACCATTGCCCAGGTCATCGGTGCCGT
CGTCGACGTCAAGTTCCAGACTGGCCTCCCCCCCATCCTCACGTCCCTCGAAGTGCAGGGCCATAGTATCCGCGT
CGTCCTTGAAGTGGCTCAGCACCTCGGAGATAACACTGTCCGGACCATTGCTATGGACTCCACTGACGGACTCGT
CCGTGGCCAGGAAGTGCTCAACACTGGCGCGCCTATCACCATTCCTGTGGGCAGAGCGACTTTAGGCCGCATTAT
GAATGTTGTTGGTGAACCAATTGACGAGCGTGGCGACATTGTTACGGATCACTACTTGCCCATACATA

> SEQ ID NO:1759  214626  3094_300332_1b
CCCACGCGTCCGGAGGGTCTTGTCCGTGGAAGGAAGGTTCTCAACACTGGTGCTCCAATCACTGTACCTGTTGGA
AGAGCTACCCTTGGCCGTATCATGAATGTGCTTGGAGAACCCATTGACGAGAGAGGCGAAATCAAGACCGAGCAT
TACTTACCTATTCACAGAGATGCTCCGGCTTTGGTTGATCTAGCCACTGGGCAAGAGATCCTGGCCACTGGTATT
AAGGTTGTTGATCTTCTTGCTCCTTACCAAAGAGGAGGAAAGATTGGTCTCTTTGGCGGTGCTGGTGTTGGGAAA
ACTGTGCTTATTATGGAGCTGATCAAC

> SEQ ID NO:1760  214626  280460_200067_1b
CAAACCCTCCCCCATGGCTTCTCGGAGGCTTCTCGCCTCTTTCCTCCTTCAATCGGCTCAACGTGGCGGCGGTCC
AATTTCCCGATCATTAGGAAACTCCATCCCAAAATCCGCTTCACGCGCCTATTCACGCGCATCCCCTAAGGGATT
CCTCTTAAACCGCGCCGTACAGTATGCTACATCCGCAGCAGCACCGGCATCTCAGCCATCAACACCACCCAAGTC
CGGCAGTGGACCGTCCGGAAAAATTACCGATGAGTTCACCGGCGCTGGCTCGATCGGGAAGGTGTGCCAGGTCAT
CGGTGCCGTCGTGGATGTGAGGTTCGATGAAGGTTTGCCACCAATTTTGACCGCTCTCGAAGTGTTGGATAATCA
GATCCGGCTTGTGCTTGAAGTGGCTCAGCATTTGGGTGAGAATATGGTTCGGACTATTGCTATGGATGGTACCGA
AGGACTTGTTCGTGGTCAACGCGTCCTCAATACTGGTTCTCCTATCACCGTTCCTGTGGGTAGAGCCACACTTGG
CCGTATCATCAATGTCATTGGAGAGGCAATTGATGAGAGAGGCCCAATTACTACCGATCACTTTTTGCCAATTCA
TCGTGAAGCTCCTGCCTTTGTCGAGCAAGCCACTGAACAACAAATTCTTGTCACTGGTATTAAGGTTGTTGATCT
TCTTGCTCCATACCAAAGAGGAGGAAAAATTGGGCTTTTTGGTGGTGCTGGTGTGGGAAAACTGTGCTTATTAT
GGAACTGATTAACAATGTTGCAAAAGCTCATGGTGGTTTCTCTGTCTTTGCTGGTGTTGGTGAACGCACTCGCGA
GGGTAATGATTTGTACCGAGAAATGATTGAAAGTGGTGTCATCAAGCTAGGCGAGAAGCAAAGTGAAAGCAAGTG
TGCTCTTGTATATGTCAAATGAATGAGCCCCCTGGTGCTCGTGCACGTGTTGGACTTACAGGTTTGACCGTGGC
TGAGCACTTCCGAGATGCCGAGGGGCAGGATGTGCTTCTCTTTATTGACAATATTTTCAGGTTTACTCAGGCTAA
CTCAGAAGTGTCTGCTTTGCTTGGTCGTATCCCATCTGCTGTCGGTTATCAACCAACTTTGGCTACGGATCTTGG
AGGTCTTCAAGAACGTATCACCACCACCA

> SEQ ID NO:1761  214626  258539_301697_1b
ACTGCTGAGGTTCTTGAGACCGGTATTGGGGTCGTCGACCTCCTCGCCCCTTACGCTCGAGGTGGTAAGATTGGT
CTCTTCGGTGGTGCCGGTGTCGGTAAGACCGTTTTCATCCAGGAGCTGATTAACAACATTGCTAAGGCCCATGGT

Figure 2 continued

GGTTTCTCCGTTTTCTGCGGTGTCGGTGAGCGAACCCGAGAGGGTAACGATCTTTACCGAGAGATGAAGGAGACT
GGTGTCATCAACCTCGAGGGTGAGTCCAAGGTCACCCTCGTCTTCGGTCAGATGAACGAGCCTCCCGGAGCCCGA
GCCCGAGTCGCCCTTACTGGTCTGACCATTGCCGAGTACTTCCGAGACGAGGAGGGTCAGGATGTGTTGCTCTTC
GTTGACAACATTTTCCGATTCACCCAGGCCGGTTCCGAGGTGTCCGCTCTGCTTGGTCGAATTCCCTCCGCTGTC
GGTTACCAGCCCACTCTGGCCACCGATATGGGTGCCCTCCAGGAGCGAATTACCACCACCCAGAAGGGTTCCGTC
ACTTCCGTCCAGGCCGTCTACGTGCCCGCCGATGATCTGACTGATCCT

> SEQ ID NO:1762 214626 257258_301680_1b
GTGCTATGGCGTCGAGGCGGGCGCTGGGACAGCTCCTCCGCGCGGCATCGCGGACATCTTCGTCTTCTACCAGGC
AAGCGTCGTCGCTCTTCCCGGGCGGAATTCTCCCGGCATCGCGGCGGGCATCTAGGGATCCCCTGGGCGACGGCC
ATGCCCTTGCCGGGATCAGGAGCTTCGCCACTGCCGCTGCCGCGAAGCCGCAGACGGATACCTTGGGCTACATTT
CCCAGGTGATTGGAGCCGTGGTGGATGTCAAGTTCGACAAGGATCTGCCCAACATTCTAAACGCTCTCGAGGTCC
AAGACCATTCCTTCCGGGTCGTGCTCGAGGTGGCGCAGCATCTGGGCGACATGACCGTCAGGACCATCGCCATGG
ACACCACCGATGGCCTTGTGAGGGGGCAGAAGGTCTTGAACACTGGGGCTCCAATCACTATTCCTGTTGGGAGGT
GCACCTTGGGCCGGATCATGAACGTCATTGGAGAGCCCATCGATGAGCTTGGGGATTTTGTCACCGATCATTTCC
TGCCGATCCATAGGGAAGCTCCGGTTTTCACAGAGCAGTCCACTGAACAGGAGGTTCTGGTGACGGGTATCAAGG
TGGTGGATCTTCTT

> SEQ ID NO:1763 214626 224181_300979_1b
CAACAACCGAGTCTTCAACGCCCCCTTCCGAGGTATGGGCTCTTCCGCCGGCGTCGGCTCTGGTAAGATCAGAAC
CGTTATTGGTGCCGTTGTCGATGTCCAGTTCGAGCAGGATAATCTCCCCGGTATTCTTAACGCTCTGACCATTGA
TCGTGGTGAAGGGTAACAAGCTCGTCCTCGAGGTTTGCCAGCATCTCGGTGAGAACACCGTCCGAACCATTGCCA
TGGACGGTACTGAGGGTCTTGTCCGAGGCACCTCTGTCGCTGACACTGGTGCTCCCATC

> SEQ ID NO:1764 214626 204482_300817_1b
ATTTGCATATCCATCGCTGATTGCTCTCTGTCATCTGCCAAGATGTTCAAGAGCGGCGTTTCGTCCCTCGCAAGG
GCTGCCCGCCCATCAATTGCCGCTCGACGAGCTATCCGACCAGCCTTCCCCCGATCCCCCATCGTCAGGCTTGCA
AGCACTCAGAGCGTTGGAGATGGCAAGATCCACCAGGTCATTGGTGCCGTCGTCGACGTCAAGTTCGACACTGCC
AAGCTGCCTCCTATCCTGAACGCCCTGGAGACCACCAACAACAACCAGAAGCTGGTCCTTGAGGTCGCTCAACAC
TTGGGCGAGAATGTCGTTCGCTGCATTGCCATGGACGGTACTGAGGGTCTTGTTCGTGGTGCCAAGGCTTCCGAC
ACTGGTGCTCCCATCACCATTCCCGTCGGCCCCGCCACTCTCGGTCGTATCCTGAACGTCACTGGTGACCCCATT
GATGAGCGTGGACCTGTCAAGACCGACAAGTTCCTGCCTATCCACGCTGATCCCCCCTCTTTCACTGACCAGTCC
ACCCTCTGCCGAGATTCTGGTTACTGGTATCAAGGTCGTCGATCTGCTCGCTCCCTACGCTCGTGGTGGAAAGATT
GGTCTCTTCGGTGGTGCTGGTGTCGGCAAGACCGTCTTCATTCAGGAGCTGATCAACAACATCGCCAA

> SEQ ID NO:1765 214626 111734_300059_1b
AACTGTATCACACTACCCATGGCTGCTCGAAGGTTCCTTTCCTGCATGTTCCGCTCATCCATACGTCACTCTTCT
TCAAAACCCTCACTCACAACCCATATCCATCGCCCCTCTCCGGCCGGCCACCTTCTCCACCGCGCCGTCAATTAC
GCCACATCTGCCGCCGCAAAGGCGACGCCGGCGCCTCAGAAAAAAACTTCTCCTCCGAAAATTAAGGAAACTGGC
GGTAAGATCACCGATGAGTACACCGGCGCCGGTGCCATTGGTAGCGTATGTCAGGTGATCGGAGCTGTTGTGGAT
GTCCGGTTCGATGAAGGTCTGCCGCCGATTTTGACGGCGTTAGAAGTGATGGATAATGATATAAGGTTGGTGCTA
GAGGTAGCTCAACATTTGGGAGAAAATATGGTTAGGACTATTGCTATGGATGGGACTGAGGGGCTTGTGCGTGGT
CAAAGAGTCCTCAATACTGGTTCCCCTATTACTGTGCCTGTTGGCAGGGCTACACTTGGTCGTATCATAAATGTC
ATTGGAGAGGCCATTGATGAAAGGGGTGATATAAAAACGGAACATTATCTCCCGATTCACCGTGAAGCTCCATCT
TTTGTTGAACAAGCAACTGAGCAAC

> SEQ ID NO:1766 214626 107406_300264_1b
CGGACGCGTGGGCTACACCTCACCTTTCTCTCTCTATAGACCAAACCTAACCTCACCATGTCTTCTCGGAGGCTT
CTAGCCTCTCTCCTCCGATCAACCGCCCAACGCGGTGGCGCTATTTCCAGATCGCCATTAGCAAATTCCATTCCC
AGAACTACTTCACGCGCCTCACCGAAAGGATTCCTCTTAAACCGTGCCGTTAAGTACGCTACCTCAGCTGCTGCT
GAAAAGCCGAAGGCGACTCCTCCTAAACCTTCCGGTAATGAACCTACTGGAAAAATCACCGATGAATTCACCGGC
GCGGGTTCGATCGGGAAAGTGTGTCAGGTTATTGGTGCCGTCGTAGATGTGAGATTCGACGAAGGTTTGCCTCCG
ATCCTTACAGCGCTTGAGGTTTTGGATAACCAGATCCGGCTTGTGCTTGAGGTTGCTCAGCATTTGGGTGAGAAT
ATGGTTAGGACTATTGCTATGGATGGTACTGAAGGTCTTGTTCGTGGTCAACGCGTCCTCAATACTGGTTCTCCT
ATCACTGTCCCTGTTGGTAGGGCCACCCTCGGTCGTATTATTAATGTCATTGGAGAGCCTATTGATGAGAGGGC
GACATTAACACCGATCACTTTTTGCCAATTCACCGTGAAGCTCCTGCCTTTGTTAACAGGCAACTGAACAACAA
ATTCTCGTTACTGGTATCAAGGTTGTTGATCTTCTTGCCCCTTACCAAAGGGGAGGAAAGATTGGGCTTTTTGGT
GGTGCTGGTGTTGGAAAGACTGTGCTTATTATGGAACTGATTAACAACGTTGCAAAGCGCACGGTGGTTTCTCT
GTCTTTGCTGGTGTTGGTGAACGCACTCGTGAGGGTAATGATTTGTACAGGGAAATGATTGAAAGTGGTGTCATT

Figure 2 continued

AAGCTTGGTGACAAGCAAAGTGAAAGCAAGTGCGCTCTTGTGTACGGTCAAATGAATGAGCCCCCTGGTGCTCGT
GCCCGTGTTGGTCTTACAGGCTTGACTGTGGCTGAGCACTTCAGAGATGCTGAGGGGCAGGATGTGCTTCTCTTC
ATTGACAACATTTTCAGATTTACCCAGGCTAACTCAGAGGTGTCTGCTTTGCTTGGTCGTATCCCATCTGCTGTC
GGTTATCAACCAACTTTGGCTACAGATCTTGGA

> SEQ ID NO:1767 214633 1100838_301464_1b
TGTTATTAGGCCTAAACCTACCCTCTGTTCTTTTCAGGTAACTTAGCGGTTTCTTTTCCCTGTGTTTGGTGTTCG
TAGTCAAATCTGGCTATGGCTGGTAATGGCGTAGTGGCCATCTATGGCAATAGTAGCTCCATCGCAGACCCCAAG
AAGTCCTCCTATGGTGTCAAGGTCGGCCTTGCCCAAATGCTCCGCGGTGGTGTCATCATGGACGTCATTAACGTT
GAACAGGCCCGTATCGCCGAAGAAGCTGGTGCCGTCGCTGTCATGGCCCTTGAGCGCGTCCCTGCTGATATCCGT
GCTGAAGGCGGCGTCGCCCGTATGAGTGACCCTGGCTTGATCAAGGAGATCAAGGCTGCCGTCACTATCCCTGTC
ATGGCCAAGGCCCGCATCGGCCACTTTGTTGAGGCCCAGATCCTCGAGGCCATCGGTGTTGACTACATTGATGAG
AGCGAGGTCCTCACGCCGGCCGACGATGCTCATCACGTCAACAAGCACAACTTCCGTGTCCCGTTTGTCTGTGGC
TGCCGGGACCTCGGCGAAGCACTCCGCCGCATTGCGGAGGGCGCTGCCATGATCCGCACCAAGGGGAAGCCGGC
ACTGGCGACATCGTTG

> SEQ ID NO:1768 214633 131281_300512_1b
TGTTTAGTTTGCATAGCCCAATCATAAGGAGCAGCAATTTTCTTTGCATATGACAACACCTCATCATCATCCATA
TTACGCAAAAGCCTAATATCACCCATGACAGACCTCACATGCTTAACAGCTTCAACAACATTACCAGTTCCAGCT
TCACCTTTTGTTCGAATCATGGCCGCACCTTCCCGAATCCTCCTTAGGACTTCCCCAAGATTACGACAACCACAA
ACAAATGGAATCCTGAAATTATGCTTGTTAATATGATGTTCTTCATCAGCAAGGGTCAAAACCTCACTCTCATCG
ATATAATCAACACCAATCGCTTCAAGAATCTGAGCTTCAACGAAATGACCAATTCGAGCTTTAGCCATGACAGGA
ATAGTAACAGTATATGGAAATGGAGCAATAACAGAGGCAAAAACCTCACCATTCTCTGTTAAAGTAGGATTAGCA
CAGATGCTTAGAGGAGGAGTAATCATGGATGTTGTTAATGCAGAACAAGCCAGAATCGCTGAAGAAGCAGGTGCT
TGTGCTGTCATGGCATTAGAACGTGTACCAGCAGATATTCGTGCTCAAGGTGGTGTTGCTCGTATGAGTGATCCA
CAGATGATTAAAGAAATCAAACAGGCTGTTACTATTCCTGTCATGGCTAAAGCTCGGATTGGTCATTTTGTTGAA
GCTCAGATTCTCGAAGCAATTGGTGTTGATTATATCGATGAGAGTGAGGTTTTGACCCTTGCTGATGAAGAACAT
CATATTAACAAGCATAATTTCAGGATTCCATTTGTTTGTGGTTGTCGTAATCTTGGTGAAGCCCTAAGGAGGATT
CGGGAAGGTGCGGCTATGATTCGAACAAAGGGTGAAGCTGGAACTGGTAATGTTGTTGAAGCTGTTAGGCATGTG
AGGTCTGTCATGGGTGATATGAGGCTTGTGCGTAATATGGATGATGATGAGGTGTGTTCATAT

> SEQ ID NO:1769 214633 247585_301621_1b
TTCCATTGCTTTAATCAGGATCGCGGAGGCGGAGGAAGAAAGAGTAGCGGCGATGGATGCCAACGGCGTGGTGGC
CGTGTACGGCAACGGCGCCATAGCGGAGCCCAAGAAGGCGTCATACGCGGTCAAGGTCGGTCTCGCCCAGATGCT
CCGCGGCGGCGTCATCATGGACGTGGTCAACGCCGAGCAGGCCCGCATCGCCGAGGAGGCCGGCGCGGTGGCGGT
CATGGCCCTGGAGCGCGTCCCGGCGGACATCCGCGCCCAGGGTGGCGTCGCACGGATGAGCGACCCGGGCATGAT
CAAGGACATCAAGAAGGCGGTCACCATTCCGGTCATGGCAAAAGCCCGCATTGGGCATTTTGTCGAGGGGCAGGT
GCTCGAGTCCATCGGCGTCGACTTCGTGGACGAGTCCGAGGTGCTCACCCCCGCCGACGACGCCAACCACATCAA
CAAGCACAACTTCCACGTCCCGTTCGTGTGCGGCTGCCGCAACCTGGGCGAGGCGCTGCGGCGGATCACCGAGGG
CGCGGTCATGATCCGGACCCAAGGGCGCACGCGGCACCGGGAACGTGATCGAGGCGGTGCGCCACGTCCGGTCGC
TCATGGGGGACATCCGGCGGCTGCGCAGCCTGGACGAGGACGAGGTG

> SEQ ID NO:1770 214633 219564_300946_1b
CTCAAATAAACCACTCAATCGATTCCTTGATACCCCTTGGGACAAATCTACTTGTTCTCTCCAAACTTACCCCTC
CAAATACCATCATCACCATCACCAT

> SEQ ID NO:1771 214634 179812_300564_1b
AGCAACCATTTCGTCATCGGACCATAGCACTCCCCAAATACCTCACTCTTCTCGCTGATCTGGTCCTGCTCTTAT
CCCTCATTCCCATCATCAACTTTTCCACATCTCGAACAAATATGTCGGGAGACGGCTATCGTTCAGTCGCCTATT
TCGTCAACTGGGCCATCTATGCTAGAAAGCATCGCCCCAAGATCTCCCCGTTGATAAACTCACTCATATCCTCT
ATGCCTTTGCCAATGTCCGCCAAGATAGCGGGGAAGTACACATGACGGATGGCTGGCGGACACAGACATCCATT
GGGAGGGCGACTCATGGAACGACACGGGAAACAACATGTATGGATGCCTCAAGCAGCTGAATCTTCTCAAGAAGC
GCAACCGCAATCTCAAGGTTTTGCTGTCCATTGGAGGTTGGACGTACAGCGGCAACTTCAAGGGCCCCGCCAGCA
CTCAGCAGGCCGTGAGACATTCGCCAAATCTAGTCTCGAGCTGCTCAAAAACTTGGGTTTCGACGGACTTGATA
TCGATTGGGAGTATCCCCAGAATGCAGACGAGGCTAGGAATTTCGTCGAGCTTCTCGCCACCGTCCGCAGAGAGC
TGGATGCCTATTCTGCTACCCTTCCAAACTACAGCCACTTTGAACTGACTGTTGCTTGTCCCGCCGGAGCTACGC
ACT

> SEQ ID NO:1772 214634 199488_300749_1b

Figure 2 continued

TTGAACAATCTACCAACATCACAAGCAATTCACCATGTTGAGCTTCCTCGGAAAATCGGTAGCCTTGCTGGCTGC
GCTGCAGGCTACTCTCAGCTCTGCAAGCCCCTAGCCACAGAAGAGCGCTCTGTTGAGAAGAGAGCCAACGGATA
CGCAAACTCCGTCTATTTCACCAACTGGGGCATTTACGACCGCAACTTCCAGCCTGCCGATTTGGTGGCATCAGA
TGTCACTCATGTCATCTACTCATTCATGAACCTCCAGGCAGACGGCACAGTTGTCTCTGGCGATACCTACGCTGA
TTTCGAGAAGCACTATGCCGATGATTCTTGGAATGATGTCGGCACCAATGCCTACGGCTGTGTCAAGCAGCTGTT
CAAGGTCAAAAAGGCCAACCGAGGCCTCAAGGTTCTGCTCTCCATCGGTGGCTGGACCTGGTCCACCAACTTCCC
CTCTGCAGCAAGCACGGATGCCAACCGAAAGAACTTTGCGAAGACTGCCATTACCTTCATGAAGGATTGGGGTTT
CGATGGCATTGACGTCGATTGGGAGTACCCTGCAGACGCCACCCAGGCCTCCAACATGGTTCTTCTGCTCAAGGA
AGTCCGATCTCAGCTGGATGCTTATGCTGCCCAGTATGCCCCTGGCTACCACTTCCTCCTCACCATTGCCGCACC
AGCTGGCAAGGATAACTACTCCAAGCTGCGCCTGGCCGATCTTGGCCAAGTTCTCGACTACATCAACCTCATGGC
CTACGACTATGCTGGATCCTTCAGCCCCCTCACCGGTCACGACGCCAACCTGTTTGCCAACCCGTCCAACCCCAA
CGCCACACCCTTCAACACCGATTCTGCCGTTCAGGATTATATCAACGGAGGTGTTCCCGCCAACAAGATTGTTCT
CGGAATGCCCATCTACGGACGATCATTCCAGAACACCGCTGGTATTGGCCAGACTTACAACGGAGTTGGAGGTGG
CGGTGGTGGCTCAACTGGAAGC

> SEQ ID NO:1773 214666 211667_300901_2b
CCCACGCGTCCGCCAATCTCGACCATTACCATCATACAGCCAACCTCTACATAAGCACAAATACCATTCAAAATG
TCTTACGGCGGTGACAACAACGACAACTACGGCTCTCGCCGTAATGACGACAACTTTGGCTCCGGAGGAGATTCT
TTCGGCTCTGGTGGAAACCAGCAATATGGCTCCGGAGGAGACTCATTTGGCTCTGGGGGAGATTCATACGGCTCT
GGTGGAAATCAATTCGGCTCCGGCAACCGCCGTAACGATGACAGCTCATTTGGTACCAGTGGCCAGGGCGAGTTC
GGCTCTGGAGGTAACTATGGCAGCTCTGGCGGTGACTCCTATGGGTCTGGAGGAAACACCTATGGCTCCGGCGGC
AATGACAACTTTGGCTCTGGGGGCAATGATACGTACGGCTCGTCCCGTAACCAAGAGTCTTCTTTTGGATCCA

> SEQ ID NO:1774 214672 1114826_301805_1b
GCGGGATTAGGAGTTGGAGAAGAGGTGATACGAGATGTCGTACGATGACGTGGAGATAGAGGACATGGAGTGGAA
CGCGGAGCTCGAAGCGTACACCTATCCATGCCCTTGCGGAGACCTCTTCCAAATCTCTCTGCCTGACCTTCGCTT
GGGAGAGGAGATAGCCAGATGCCCTAGCTGCTCCCTCTACATCACCGTTGTCTACAACCTCGAAGACTTCCAAGA
CCCTCGGCCCCCGCCTCGCCCCCAACAGCCGATCGCCGTCGCCTGATCTTTCCAGTTGCTTCGTTCAGTAAACTC
GACATCTACATTCTATCCTAAATTGATAGTCACCAAATGTCTGGTGCACTTGAGACTGTTTATCTGACAAGATTT
CATGTATCTTGGAGTTTTGCTTAAATCAGCATGTAGAATGATAACTGTTGGCTTCTTGATGTTTCAAAGGTTAGA
TATTGTCATATCTCGTGTGAGTTTTTTAAATTTTTGGTCATGCTAGATACCATGATAATATATTATGCAAGGACT
ATATG

> SEQ ID NO:1775 214680 224177_300979_1b
GCAACACACACAATGTCCTTCAACTTCAACGATTCTCTCAACAGTCTGTCCACCACCTTCTCCCCATGGGCCAAG
CGAACCCAGCGAATGGTCCAGGAGAAGCTCGGCAACGTGGAGGACGTGACCGAGCTCCCCAGGAGTACCTGGAG
CTGGAGGCTCGAGTTGACGCTCTCAAGATTGTCCACCAGAAGCTGCTCGCCGTCACCTCTAACTACGAAAACGAG
GGCTACGACTACCCCTCCCAACCTGCGGGAGTCCCTGTCTGACCTGTCTAAGACCATCACCGAGAAGGTGCAGGGT
CTGTCCCAGGTGTCTTCTGCTGCCGAGGCCCAGTCTGTGCTCACCANCCCCGGCTCCAAGAAGGACCCCAAGACC
ATGAACCATGCTCTTGGCCGAGCTGCTCTTGGTGGTGTTGCTGCCCTCAAGGAGGCCGGTGCCGACTCTGACGAN
CCCCTGTCCGAGTCTCTCCAGAAGTACGCCATTGCCGAGGAGAAGATTGGTGAGGGCCGACTGTCCCAGGAATAC
CTGATCGCCAACAAGTTCAACGCC

> SEQ ID NO:1776 214695 199934_300754_1b
ACGCGTCGCACAAATCAGCTCGAATCCATCACCATGGCAGACATCACAGAAGAACCCCAGGCCCTCCCTGTCGAT
GAGACGCCCATCTCTTCCGTCAAGACCAACTCCGCTCGCAAGAACTCTCTTTCCAACTACCTCAAGCACCGACCC
GAACGCTCCGAGCTGGTAGAGAAGAACATTCTCCCAGACTCTACAGCCGCACCCGGCCTCCTCGCTCAGCAAAAA
GAGCTTCAGAAACACATGCTCGGAGACAAGCTCAACGACAAGATTTCACATCGTCCCTCCCCCGACGCCCTCCTC
AAGGAAGGTGTCTTACACGAAGACCCCCGCTCCCCAGAGGAAAAGTACGCCGAGGCCATCGAGGAGGAGTACGCT
AAGCGGGAGGGCGGCGCTTAAGCAGCATTAGAGCTACATGGCGAACACGGATGCTGGGAAATGCGAACTTGTTTT
TTCTTTTTTTTTTT

> SEQ ID NO:1777 215181 112371_300001_1b
AAGTAACTTAAATACCCATTCTCACCACTAAACATGGTTGTGCAGAAGATGGAGGATAAAAATGCTAGAAGAAAC
AAATATAAAGTAACACAACTCAAAAACTAGCAAAATTACAGCCTGAACAAGGCTCAAGCCAACATAGAAAGTTCC
TTGTTGCATTGAACTTAAATTTTGTTGAAGGCAACAATATCACAGCTCTGCACATATTCATTGATAGGCTCTACT
GTTAATTTTTCCTCAACGAGAGTGTCCACAGAGACAAGGTCATCCACGATGGTAAGCATGATCTGCAATTTCTTA
ATCCCGTAGCCAACTGGGACCAATTTGGATGCTCCCCAAGTAAGCCCTTCTTGCTGAACACTGCGAACAGCCTCC
TCCAGCAGCTTCATATCAGTTTCATCATCCCAAGGCTTAACGTCCAAAAGAATGGATGACTTTCCACTCTCTTTC

Figure 2 continued

TTCTTGGTAGATGCTTTAGTAGCCTCCCTTGCTTCTGCTGCCTTCTTTTCCTCCTCTGTCTCTTCTCCGAAGAGA
TCAATATCATCATCGTCATCATCATCTGCAGCCTTAGCAGCTTCTTTAGCTGGAGCAGCTTCAGCAGGAGCAGCT
TGGCTTCCAATTCTCACACCGACAGCTTTCCCAGGAAAACTTGAGGCAAGTTTTGCAGAAACAGCTTGGTACCAC
TGGCTAGCATTGGGGTAAAGATCTGAACTGGGTTGCTCCAAAACTGCCCCATAAACCTTAATATCGTCCTTCGTC
AATTGATCTCCGGAAATAAAAGTTCTTCCGGAAAGATGGTCGTTAACGGAGTTGAGACCAGATTCAGTGTGGAGA
TCTGAGAAGGTTACAGCCATTGTTGAAGAGTAAAAAGGAGTTGAGATTTGAGAGTGTGAAGAGAGAGTATGAGCG
ACGCG

> SEQ ID NO:1778 215181 158533_200019_1b
TTTCTCTCTTCAGTCTTCTGTCATCGCCAGATCGTGAAAGACTTGTATTATTATCAAGCAATGGCTGTTGCATTC
AACAACCTTAACTCTGATTCTGGTCTCAAGAAGCTTGATGAGTACCTCCTGACTCGTAGTTACATCTCCGGGTAC
CAAGCCTCGAAGGATGATATCACTGTGTATTCATATCTAGCAAAATCCCCATCAGCTGAATATGTGAATGCATCT
AGGTGGTATAAGCACATCGATGCACTTTTAAGAATCTCTGGTGTATCTGGCGAAGGTGCCGGTGTCACTGTAGAG
GGATCTGTACCAATCACCGAGGAGGCAGTGGCAACTCCTCCTGCTGCTGACACTAAAGCCTCAGCTGCTGAAGAA
GAAGAAGAAGATGATGATGACGTAGACCTATTGGTGAGGAAACTGAAGAGGAGAAGAAGGCTGCTGAAGAACGT
GCAGCAGCAGTTAAGGCTTCAGGGAAGAAGAAAGAGTCTGGCAAGTCCTCAGTTCTCTTGGATGTCAAGCCATGG
GATGATGAGACTGATATGAAGAAGCTTGAAGAAGCTGTTCGAAGTGTTCAGATGGAAGGATTGACTTATGGAGCA
TCTAAACTTGTTCCTGTTGGATACGGTATTAAGAAGCTGCAAATCATGCTTACCATTGTGGATGACTTGGTCTCT
GTGGATGATCTTGTTGAGAATTATTTTACGGTTGAACCTATCAATGAGTATGTTCAGAGCTGTGATATTGTTGCT
TTCAACAAAATATAAATTCTGTTACTCTGAAGTTTTGATTGAAATGGGTGGCTAAACTGAAGAACAACAACCAGG
GTTCGATGTTGCTTCTCTTTATGTTGTTACTATGTTTTCTTGTCAAAAGAGGTGTACCTGAACCTGAACCTGACA
AGGGCATATGTTTTGCTCGTTTGGATTAATATTTAAAATTCTGGAATACTTC

> SEQ ID NO:1779 215181 187107_300674_1b
CAAGCCTCCAACGATGACTTGGCTGTGTACTCTGGATTTTCAACTGCGCCCTCTTCAAGCTATACCAATGTTGCT
AGGTGGTTTACTCACATTGATGCACTCCTACGTCTGAGTGGAGTTACTGCTGATGGTCAAGGCGTAAAGGTCGAG
TCGACAGCTGTTCCTTCAGCTTCAACCCCTGATGTTGCTGATGCAAAGGCTCCTGCAGCTGATGATGACGATGAT
GACGATGTTGACCTTTTTGGTGAGGAGACTGAAGAGGAGAAGAAGGCTGCTGAGGAGCGTGCTGCTGCTGTCAAG
GCTTCTGGCAAGAAGAAGGAATCTGGGAAGTCCTCAGTGTTGCTTGATGTCAAACCATGGGACGATGAGACTGAC
ATGACCAAATTGGAAGAAGCTGTGAGGAATGTTAAGATGGAAGGCCTCCTTTGGGGCGCATCCAAGCTTGTCCCG
GTTGGTTACGGTATCAAGAAATTGCAAATCATGATGACCATTGTCGATGATCTTGTGTCAGTTGATAGTCTGATT
GAGGACTACTTCTACACCGAACCAGCGAATGAGTACATCCAGAGCTGCGACATTGTTGCGTTCAACAAGATC

> SEQ ID NO:1780 215181 240648_301316_1b
GGCTTTTGCGAGGCGGCAGAGCTATGGCGATCAGCTTCGACGATCTTGATTCCGCCGGCGGGCTCAAGAGCCTCG
ATGAGTACCTCGTCAAGCGCAGCTACATCTCTGGCTCCCAGGCATCCAGGNACGATTTGCTTGTCTACATGGCCT
TGGCTGGAGCTCCGTCTCAGGATCTCATCAACTTGTCGCGCTGGTACTCGCACATTTCTGGATTGATCCACTCCA
GCTTCCCTGGATCTCCAGTTGGTGTGTCGCTGAAGGATGGCACTACTCCACTTCCGGCTGCCCCGGCTGCTCCAG
CTACACCACCACCTCCGCAGACCCCGGCTGCCGCAAAGGATGACGATCTCGATCTGTTTGGAGAGGAGACAGAGG
AAGAGCAAGCCGCCGCTGCAGAGAGGGAGGCTCAAAAGAAAGCGTCGGCCAAGAAGAAAGAATCTGGGAAGTCGT
CTGTGCTAATGGACGTGAAGCCGTGGGACGATGAGACCGACATGGTGAAGCTCGAGGCGGCAGTGAGGGCCGTGC
AAATGCCGGGGCTCTTCTGGGGTGCTTCCAAGCTGACCCCTGTGGGATACGGGATCAAGAAGTNGACGATCATGA
TGACGGTGGAGGACGAGCTTGTGTCTGTCGATTCTTTGATTGAGGATCATCTCACGGAAGGTCCGGCAGCGGAGT
TCATCCAGAG

> SEQ ID NO:1781 215181 279649_200063_1b
GTTCTCTCTTCAGTCTTCTGTCATCGCCAGATCGTGAAAGACTTGTATTATTATCAAGCAATGGCTGTTGCATTC
CAGAACCTCAACTCTGATTCTGGTCTCAAAAAGCTTGATGAGTACCTCTTGACCTGCAGTTACATCTCCGGGTAC

> SEQ ID NO:1782 215181 39237_300206_1b
GCAGAGGAGAGGGATGCTGCTAAGAAGGACACCAAGAAGCCTAAAGAGAGTGGAAAGTCTTCTGTGCTCATGGAT
GTTAAGCCATGGGATGATGAAACCGACATGAAGAAACTGGAAGAGGCTGTTCGTGGTGTTGAGATGCCTGGTCTT
TTCTGGGGAGCCTCAAAACTTGTACCAGTTGGTTATGGGATCAAGAAACTCACAATTATGTTCACGATTGTTGAT
GACCTCGTGTCCCCGGACAACCTCATTGAAGACTTCCTCACCTCAGAGCCTAACAACGAGTACATCCAGAGTTGT
GACATTGTCGCTTTCAACAAGATTTAGAGACTTCAAATTTCTCCTTACCGAAACATATCTGAATTTCAAGTTTT

> SEQ ID NO:1783 215181 4469_300327_1b
CTACAAAAACTTGGGAAACTGAATATAGAAGAAGAAGAAGAACCAGACCACATGAACACAGACATTCCTTGAAGC
TTTCTCCATCCTCATATCTTGTTGAAGGCAACAATGTCACAGCTCTGGACATATTCATTGATCGGTTCAACAGTG

Figure 2 continued

AGTTGCTCTTCGATCATGGTGTCAATAGAGACAAGGTCGTCAACAATGGTGCACAAAATCTGCAACTTCTTGATA
CCATAACCAACTGGGACAAGCTTTGATGCTCCCCAAAACAAACCTTTCATCTGAATGGACTTCACAGCTTCCTCA
AGCTTCTTCATGTCAGTCTCATCATCCCACGGTTTGATATCAATCAAAACTGAGGACTTTCCAGATTCCTTCTTC
TTTGTAAATGCCTTGAC

> SEQ ID NO:1784 215181 39071_300199_1b
GCAGCTGATTCTAAGGATGCTGCGGCTGATGAAGAAGATGATGATGATGTTGACCTTTTCGGAGAGGAGACCGAA
GAGGAAAAGAAAGCTGCTGAAGAGAGAGCAGCTTCTGTCAAGGCATCTACAAAGAAGAAGGAATCTGGAAAGTCC
TCAGTTTTGATTGATATCAAACCGTGGGATGATGAGACTGACATGAAGAAGCTTGAGGAAGCTGTGAAGTCCATT
CAGATGGAAGGTTTGTTTTGGGGAGCATCAAAGCTTGTCCCAGTTGGTTATGGTATCAAGAAGTTGCAGATTTTG
TGCACCATTGTTGACGACCTTGTCTCTATTGACACCATGATCGAAGAGCAACTCACTGTTGAACCGATCAATGAA
TATGTCCAGAGCTGTGACATTGTTGCCTTCAACAAGATATGAGGATGGAGAAAGCTTCAAGGAATGTCTGTGTTC
ATGTGGTCTGGTTCTTCTTCTTCTATATTCAGTTTCCCAAGTTTTTGTAGACTGTTGTTTTGACTCTGTTAT
GGCCTGCCATCTCTGATCCATTTTGATATTTAATGAAAAGTGACAATTCAGT

> SEQ ID NO:1785 215181 258634_301698_1b
GGCTTCTCTGATCTTTCTTCCGCTGCTGGTCTCACCCAGCTGAACGAGTTCCTCGTCGACAAGAGCTACATTGAG
GGCAACGCTGCCTCTCAGGCTGACGTGGCTGTCTACAAGGCCGTTGCTTCTGCCCCTGACGCCGAGAAGTACCCC
AACGCCGCCCGATGGTTCAAGCACATTGCTGCCCAGGAGGACCACTCTGCTCTCCCCGGTACCGCCAAGGAGGCC
TCTGCTTACGGCCCCGAGGGTGCCGCCGCCGCCGCTGAGGAGGAGGACGACGATGATGTCGACCTTTTCGGCTCC
GACGATGATGAGGTCGATGAGGAGGCTGAGAAGCTCAAGCAGCAGCGACTCGCCGAGTACGCCGCCAAGAAGGCC
GCTAAGCCCAAGACCGCCGCCAAGTCCATTGTCACCCTTGACGTCAAGCCTTGGGATGACGAGACTGATCTCGAT
GCTCTCCTTGAGAACGTCAAGAAGGTCGAGATGGAGGGTCTGGTCTGGGGTGCCCACCAGTGGATCCCCGTTGGT
TTCGGTATCAAGAAGCTCCAGATCAACCTCGTTGTTGAGGATGACCTTGTTTCTCTCGACGAGCTCCAGCAGCTC
ATTGAGGAGGACGAGGACAACGTCCAGTCCACTGATATCGCTGCCATGCAGAAGCTTTAAGTGTTTCTAGCTTAT
ATATATGGTAAAACG

> SEQ ID NO:1786 215181 1170767_302037_1b
CCGCGAAGAAGCCCTAACTCTTAGAAAATCAGGACGCTTTCGGAGAAGGGCAAGGGAGCGTCCTCATCTGTGATC
TCTTTGACCCGGCAATGGCCTGTTTCGGTGATCTCAGCTCCCCCTCTGGCCTCAACCAGCTCGATCAGTTCCTTC
TCACTCGTAGCTACATCACTGGATACCAAGCCTCAAAGGATGACATTGTAACATATCTTGCTATCAAAGGAACTC
CGAGTGCTGACTTGATCAACGCATCTCGTTGGTACAAGCACATCACTGCCCTTCTGGAAAAAAGTTTCCCAGGGA
CTCCTACAGGTGTGACAGTTGAGTCATCTGTGGAGGTACCATCATCTGTAAGTAGAGAGTTGCCTGTTCCTCCCA
AGACACCTGCTCCACCTACTGAAAAACCAGCTGAGGCGGAAGATGATGATGATCTTGACCTCTTCGGGGATGAGA
CCGAAGAAGAAAAGCAGGCTGCAGCAGAGCGTGAGGAGAAAGTAAAGGCATCATCAAAGAAAAAAGAAAGTGGGA
AATCTTCCGTCTTGATGGATGTGAAGCCATGGGATGATGAAACAGATATGGTTGAGCTTGAAAAAGCTGTTAGAA
GTGTCTCAATGCCAGGGCTTCACTGGGGTGCATCAAAATTGGCACCGGTTGGTTATGGCATCAAGAAGCTTCAGA
TTATGATGACCATTGAAGATGACCTAGTTTCTGTTGATAATCTAATTGAGG

> SEQ ID NO:1787 215255 1126095_302022_1b
AGGTGGACAGGAAGTAGAATTTATTGGTGAGTATTAAGAGGGGGGCAGCACATTGGAAGCCCTCATGAGTGCAGG
GCCCGCCACTTGTCCAGAGGGCCACGACTGGGGATGTACTTGACCCCACAGCCATCTGGGATGAGCCGCTTTTCA
GCCACCATGTCTTCAAATTCATCAGCATTGAACTTGGTGAAGCCCCACTTCTTTGAGATGTGGATCTTCTGGCGG
CCAGGAAACTTGAACTTGGCCCTGCGCAGGGCCTCAATCACATGCTCCTTGTTCTGCAGCTTGGTGCGGATGGAC
ATGATAACTTGGCCAATGTGAACCCTGGCCACAGTGCCCTGGGCTTTCCAAAGGCACCTCGCATGCCTGTTTGG
AGCCTGTCAGCCCCAGCACAGGACAACATCTTGTTGATGCGGATGACGTGGAAGGGGTGGAGCCGCACCCGGATA
TGGAAGCCATCTTTGCCACAACTTTTTACCATGTACTTATTGGCACAAATTCGGGCA

> SEQ ID NO:1788 215255 253323_301625_1b
AATCAAAAATGGCTCGACGACCCGCTAAGTGTTACCGATACCAGAAGAACAAGCCCTTCCCCAAGTCTCGATACA
ACCGAGCCGTGCCCGACCCCAAGATCCGAATCTACGATCTTGGTCGAAAGCGAGCCCACGTCGACGACTTCCCTC
TGTGTATCCATCTCGTTTCCAACGAGCGAGAGCAGCTGTCTTCCGAGGCTCTTGAGGCTGCCCGAATCTGTGCCA
ACAAGTACATCACCAAGGTGTCCGGACGAGAGGCCTTCCACATGCGAATCCGAGCCCACCCCTTCCACGTTCTGC
GAATCAACAAGGTGCTTTCTTGCGCTGGTGCCGATCGACTTGCTCAGGGTATGCGAGGAGCCTGGGGTAAGCCCG
CCGGTCTTGCTGCCCGAGTTGACATTGGCCAGGTTCTGATTTCCATCCGAACCAAGGACAACAACAAGGCCACCG
TTATCGAGGGTCTGCGACGATGCCGATACAAGTTCCCCGGTCAGCAGAAGATCATCATCTCCAAGAAGTGGGGTT
TCACCAACCTCGACCGAGAGGAGTACATGACCCGACGACAGAACGGAGAGATCAAGGAGGACGGTGCCTACGTCA
AGTTCCTCACCAAGAAGGGTCCTCTGGCCGAGTCTCTTGCCGAGTTCCCCGACTACAACGGTG

Figure 2 continued

> SEQ ID NO:1789 215255 231761_301233_2b
GGCCGGCGAGATGCTACCGCCAGATCAAGAACAAGCCGTACCCGAAATCTCGCTTCTGCCGCGGTGTTCCAGACC
CTAAGATCAGGATCTACGATGTGGGCATGAAGAAGAAGGGCGTGGACGAGTTCCCCTACTGCGTCCATCTGGTGA
GCTGGGAGAAGGAGAATGTCTCGAGCGAAGCCCTTGAGGCGGCTCGAATCGCCTGCAACAAGTACATGGCAAAGT
ACGCCGGCAAGGACGCGTTCCATCTCCGAGTTCGTGTGCACCCCTTCCATGTCCTGCGGATCAACAAGATGCTTT
CGTGCGCTGGCGCTGATCGGCTCCAAACTGGAATGAGGGGAGCTTTCGGCAAGCCGCAGGGAACTTGCGCCCGTG
TTGACATCGGCCAGGTGCTGCTCTCGGTCCGGTGCAAGGACAACAACGGAGTTCACGCGCAGGAAGCGTTGAGGA
GGGCGAAGTTCAAGTTCCCCGGCAGGCAGAAGATCATCGTCAGCCGGAAGTGGGGATTTACGAAGTTCTCTCGCA
CCGACTTCCTCAAGTTCAAGGCGGAGAGCAGGATCGTCAACGATGGCGTGAACGCGAAGCTCCTGACTTGCCACG
GACCACTCTCGTCTCGATCCGCGGAAACCGCTATACTTCCGGATGATGAAGTAGTAGCGTAAGATAAGAAAAAGA
AAACCAATTGTACTACGTTTATTAATCGAAACGATGTTTTGTT

> SEQ ID NO:1790 215255 139076_300406_1b
CCCCCGAGCCGCACATCCCCGCCTCTTCCCGCCGCCGTCCGCCGCGCGCACGCCGCCGCCGCCATGGGGAGGAGA
CCTGCAAGGTGCTATCGCCAGATCAAGAACAAGCCGTACCCCAAGTCAAGGTACTGCCGTGGTGTCCCTGACCCC
AAGATCAGGATCTACGATGTCGGGATGAAGAAGAAGGGTGTGGATGAGTTCTCCCACTGTGTGCATCTCGTCTCT
TGGGAGAAGGAGAATGTCACCAGTGAGGCTCTTGAGGCTGCGCGTATCGCGTGCAACAAGTACATGACCAAGTCT
GCAGGAAAGGATGCCTTCCACCTCAGGGTTCGGGTTCACCCGTTCCATGTGCTCCGTATCAACAAGATGCTTTCG
TGTGCCGGGCAGATAGGCTCCAGACTGGAATGAGGGGTGCTTTTGGGAAGCCACAGGGAACCTGTGCTAGGGTG
GATATTGGCCAGGTCCTCCTTTCTGTGCGGTGCAAGCCCAACAATGCTGTCCATGCCAGCGAAGCCCTCCGTCGT
GCCAAGTTCAAGTTCCCTGGTCGCCAAAAGATCATTGAGAGTAGAAAGTGGGGTTTCACCAAGTTCAGCCGCGAT

> SEQ ID NO:1791 215255 138379_300723_1b
TGATGTTTAAATCTACTGTATTTACCTTCGCATTAATTAAGCATGGGGAGAAGGCCTGCTAGGTGCTACCGCCAG
ATCAAGAACAAGCCGTACCCCAAGTCAAGGTACTGCCGTGGTGTCCCTGACCCCAAGATCAGGATCTATGATGTT
GGCATGAAGAAGAAGGGCGTGGATGAGTTCCCCTACTGTGTGCACTTGGTGAGTTGGGAGAAGGAGAATGTCTCC
AGTGAAGCTCTTGAGGCTGCCCGCATTGCTTGCAACAAGTACATGACCAAGAATGCAGGAAAGGATGCCTTCCAC
CTAAGGGTCAGGGTCCACCCGTTCCATGTCCTTCGTATCAACAAGATGCTCTCGTGTGCTGGGGCTGATAGGCTC
CAAACTGGAATGAGGGGTGCTTTTGGGAAGCCTCAGGGTACCTGTGCTCGCGTGGACATTGGTCAGGTTCTTCTT
TCTGTTCGTTGCAAGGAGAGCAATGCTAAACATGCTGAAGAGGCACTCCGCCGTGCCAAGTTCAAGTTCCCTGGC
CGGCAAAAGATCATCCACAGCAGGAAGTGGGGCTTCACCAAGTTCACCCGTGAGGAGTACGTCAAGTTGAAGGCT
GAGGGCAGAATTATGTCTGATGGTGTCAATGCTCAGCTGCTTGGTTCTCATGGTCGTCTTGCGAAGCGTGCCCCT
GGGAAGGCGTTTCTGGCTGAGACCATTCAACGTTCCGCCGCGGCCGCTTATCCGTATGATGTTCCGGATTATGCC
GAGCTCTACAAACAGCT

> SEQ ID NO:1792 215255 130637_300489_1b
GAATTCACAGGCAGATTAAGAACAAGCCATACCCAGAATCCAGGTACTGTCGTGGTGTACCTGACCCAAAGATTA
GAATTTATGATGTTGGGATGAAAAGAAAAGGAGTTGATGAATTCCCCTTCTGTGTCCACTTGGTGAGTTGGGAGA
AGGAAAATGTCTCAAGTGAGGCTTTGGAAGCTGCACGTATTGCCTGCAACAAGTACATGACCAAGTTTGCTGGGA
AGGATGCCTTCCATTTGAGAGTCAGGGTACATCCTTTCCACGTCTTGCGTATCAACAAGATGCTTTCATGTGCTG
GAGCTGATAGACTCCAGACTGGTATGAGAGGAGCATTTGGTAAGCCCCTAGGTACTTGTGCCAGAGTTAGCATTG
GTCAGGTCCTCTTGTCAGTTCGTTGCAAGGATACCAACGGCAACAACGCCCAGGAAGCCCTTCGTCGTGCCAAGT
TCAAGTTCCCTGGACGTCAAAAGATCATTGTCAGCAGGAAGTGGGGATTCACAAAGTTCAGCCGTACTGACTACG
TCAAATGGAAGTCAGAGAACAGAATCGTT

> SEQ ID NO:1793 215255 1123730_301915_1b
GGGAGGAGGAAGGGGGGGGAGAGGGGTAGGGTTGAGCACTAGGACACCTCCGCCATGGGCCGAAGACCAGCAAG
ATGCTACCGCCAAATCAAGAACAAACCATATCCTAAGTCTAGGTTTTGCCGGGGTGTTCCTGACCCGAAGATTCG
TATCTTTGATGTTGGGATGAAGAAGAAAGGAGTCGACGAGCTTCCTTTCTGTGTGCATCTTGTAAGTTGGGAGAA
AGAGAATGTTTCTAGCGAGGCCCTTGAGGCAGCCCGGATTGCTTGCAACAAATACATGACTAAGTCTGCCGGGAA
GGATACCTTCCACCTCCGCGTCCGAGTCCACCCGTTCCACGTGCTCCGCATCAACAAGATGCTTTCATGTGCCGG
TGCTGATAGGTTGCAGACAGGAATGAGGGGGGCATTTGGAAAGCCGCTGGGTACCTGTGCCCGTGTGGCCATTGG
CCAGGTTCTTCTCTCTGTGCGATGCAAGGATAATCACTCCGCTCAGGCACAGGAAGCCCTCAGGCGAGCCAAGTT
CAAATTCCCTGGAAGGCAAAAGATCATTGTTAGCAGGAAATGGGGCTTTACAAAGTTCTCAAGAACTGACTATCT
GAAATGGAGGTCTGAAGGTAGAATTATGCATGATGGTGTCAATGCTAAGTTGCTGGGATGTCATGGACCTCTCTC
CAATCGCTCATCTG

> SEQ ID NO:1794 215255 1119785_301900_1b
AGCAGGAGAAGGAATAGACTAGTCTTCTGCGATTTTAGCCATGGGCCGCCGACCAGCAAGATGTTACCGTCAAAT

Figure 2 continued

CAAGAACAAGCCCTATCCAAAGTCTAGGTTTTGCCGAGGTGTTCCGGATCCAAAGATCCGTATCTTCGATGTGGG
GATGAAGAGGAAAGGTGTGGATGAGCTGCCTTTCTGTGTGCATTTGGTGAGTTGGGAGAAGGAGAATGTGTCAAG
TGAGGCACTGGAGGCAGCTCGGATTGCCTGTAACAAGTACATGACCAAGTATGCCGGGAAAGATACCTTCCACCT
CCGTGTCAGAGTCCACCCCTTCCATGTCCTCCGTATCAACAAGATGCTCTCGTGTGCTGGAGCTGATAGGCTTCA
GACTGGGATGAGAGGAGCCTTTGGAAAACCTCTGGGTACCTGTGCCCGGGTGGCGATTGGGCAGGTCCTTCTTTC
TGTGCGGTGCAAGGACAATCACTCAGCCCAGGCTCAGGAAGCCTTGCGTAGAGCCAAATTCAAATTCCCAGGAAG
GCAAAAGATCATTGTCAGCAGGAAATGGGGATTCACTAAGTATTCCAGAACCGATTACCTGAAATGGAAAACTGA
AGGTAGAATGGTGCATGATGGCGTGAATGCCAAGCTTCTGGGATGCCATGGTCCTCTGTCAAAGCGGAACCCTGG
GCAAGCTTTCCTTTCTGCTGCAGTTGCTGCTTCTTAAGGCTGAGCT

> SEQ ID NO:1795 215255 107704_300258_1b
GAAGCCGCAGACTAATCGCAGAGAGAATTAGCCATGGGGAGAAGGCCTGCAAGATGTTATCGCCAGATTAAGAAC
AAACCTTATCCAAAATCACGGTTTTGCCGTGGTGTGCCAGATCCAAAGATCAGGATCTATGATGTGGGTATGAAG
AAAAAGGGAGTTGATGAATTTCCTTTCTGTGTGCACTTGGTCAGTTGGGAGAAGGAGAATGTTTCAAGTGAGGCA
CTTGAAGCTGCTCGTATTGCGTGCAACAAGTACATGACCAAGTCCGCTGGAAAGGATGCTTTCCACCTCAGGGTT
AGGGTCCATCCCTTCCATGTTTTGCGAATTAACAAGATGTTGTCATGTGCTGGGCTGATAGGCTCCAAACTGGT
ATGAGGGGAGCTTTTGGTAAACCACAGGGAGTCTGTGCTCGTGTTGCTATTGGTCAGGTTCTTCTCTCTGTTCGC
TGCAAGGATGGTAATGCTAACCATGCCCAAGAGGCACTGCGCCGTGCTAAGTTTAAGTTCCCCGGCCGACAAAAG
ATCATCGTCAGCAGGAAGTGGGGGTTCACTAAGTTCAGCCGTACTGATTATCTGAAATACAAGTCAGATAATCGT
ATTATTCCAGATGGTGTCAATGCCAAGCTTCTCGGTTGTCATGGCCGACTTGCTGCACGTCAACCTGGAAGAGCT
TTTTTGGAAGCAGTGGGGAATTGAAGTTGCGAACTTACCAAACTGAACCTTTAGTTGTCTACTTCTGTTGAATGA
AATTTTGTGTCCTGATCATCGATCTACTTTTGAACTATTACTTGAGTTACTGCTTTGAACATTTTAGTTTACTGG
TAAAGCCCGGCTTGTTTT

> SEQ ID NO:1796 215267 1100464_301460_1b
GAGGACGCAAGCGGAACCAAGGCCTTACTCGAATTGTAGCAGAGATGGCCGTCGGGAAGAACAAGCGCATCTCCA
AAGGCAAGAAGGGAGGGAAGAAGAAAGTGGTAGATCCCTTCTCGAAGAAAGATTGGTACGATATCAAGGCTCCTT
CAGTCTTTACCATTCGCACTGTCGGAAAGACTCTTGTCACCAGGACACAGGGTACAAAGATTGCTGCGGATGGCT
TGAAAGGACGTGTTTTTGAGGTATCTCTTGCAGACCTCCAAAAAGATGAAGATCAAGCTGCAAGGAAGATGAAAC
TAAGAGCCGAAGATGTGCAAGGAAGAAACGTTCTCACTAATTTTTGGGGCATGGATTTCACCACGGATAAACTGC
GGTCTCTTGTGAGGAAGTGGCAATCCCTGATCGAGGCTCATGTTGATGTGAAGACTACTGACAACTACACACTCC
GGATGTTTTGTATCGCTTTCACCAAGAAGCGCCCAAACCAAATCAAGAAGACTTGCTATGCTCAGTCAAGTCAGA
TCCGGCAGATCCGGAAGAAGATGACTGAGATAATGGTACGAGAAGCACAGTCCTGTGATCTGAAAGAGCTTTGTG
GCGAAGCTCATTCCAGAAGTGATTGGCAAGGAGATTGAGAAAGCTACTGCTGGAATCTATCCCTTGCAGAACACT
TTCATTAGGAAAGTTA

> SEQ ID NO:1797 215267 256071_301646_1b
AGGGCGTCGTCGTCGGAGCTCAGTTGCGATGGCCGTCGGGAAGAATAAGCGCATTTCCAAGGGAAAGAAGGGTGG
CAAGAAGAAAGTGGTTGATCCTTTTTCAAAGAAAGATTGGTATGATATCAAGGCTCCATCAGTCTTCACTATTAG
GACGGTCGGTAAGACCCTTGTTACTCGGACACAGGGTACAAAGATTGCAGCTGATGGCCTGAAGGGGCGTGTTTT
TGAGGTCTCTCTTGCGGACCTCCAAAAGGATGAAGATCAGGCTGCTAGGAAGATCAAGCTTAGGGCCGAAGATGT
GCAAGGAAGGAATGTTCTCACCAATTTCTGGGGGATGAACTTCACTACCGATAAACTCCGCTCTCTTGTAAGGAA
ATGGCAGACTCTTATTGAGGCCCATGTTGATGTGAAGACGACAGATAACTACACTTTGAGAATGTTCTGCATCGC
CTTCACCAAGAAGCGCCCGAATCAGATCAAGAAAACTTGCTACGCACAGTCAAGCCAGATCCGACAGATCCGGAA
GAAAATGACAGAGATCATGGTGAAAGAAGCCGCGTCATGTGACTTGAAAGAGCTTGTTGCAAAGTTCATCCCGGA
AGTAATTGGGAAGGAAATAGAGAAAGCAACTGCTGGAATCTACCCCCTGCAGAACACTTTTATCAGGAAGGTCAA
GATCCTCAAGGCACCCAAGTTTGATCTAGGAAAGCTCATGGAGGTGCATGGAGACTACAGTGAAGATGTGGGAAC
TACAGTAGAGAGGCCGGTCGGCGACGAAGCAGAGACAACTGATGCCGGAACT

> SEQ ID NO:1798 215267 251337_301656_1b
AAAATAAGCAGACTACCACTACTAATCTACAGCTTCTTGACATTCCGCAAACATGGCGGTTGGCAAGAACAAGAG
ATTGTCCAAGGGCAAGAAGGGCCTGAAGAAGAGGACCGATCCCTTCGCTAAGAAGGACTGGTACTCCGTCAAGGC
ACCCTCCACTTTCGCCGTCAGAGATGTCGGCAAGACCCTCGTCAACCGTACCACCGGTCTGAAGAACGCCAACGA
CTCTCTCAAGGGCCGTGTCTTCGAGGCTTCCCTCGCCGATCTCCAGAAGGATGAGGACCACAGCTTCCGCAAGAT
CAAGCTGCGCGTCGATGAGGTCCAGGGCAAGAACTGCTTGACCAACTTCTACGGTCTCGACTTCACCCACGACAA
GCTCGCCTCCCTCGTCCGCAAGTGGCAATCTCTCATCGAGGCCAACGTTGTCGTCAAGACCACCGACGACTACCT
CCTCCGCCTCTTCGCCATTGCCTTCACCAAGAGGCGCCCCAACCAGATCAAGAAGACCACCTACGCCAGGTCTTC
CCAGATCCGCGCCATCCGCAAGAAGATGACCGACATCATGGCTCGTGAGGCCTCCAGCTGCACTCTCAGCCAGCT
CACCACCAAGCTCA

Figure 2 continued

> SEQ ID NO:1799 215267 230795_301071_1b
AAGCCCTAGCCGCTTCTAGGTTTTTAGGGTTCTTCTCAGCCGGCTGTGCGCCATGGCGGTCGGGAAGAACAAGCG
GATGTCCAAGGGGAAGAAGGGAGGCAAGAAGAAGATCGTCGATCCCTTCTCGAAGAAGGACTGGTACGATGTGAA
GGCGCCGTCCACCTTCAACGTTCGCCAGGTCGGGAAGACACTGGTGACGAGAACACAGGGGACTAAGATTGCCTC
TGATGGTCTTAAAGGCCGTGTTTTCGAAGTGTCATTGGCTGATCTGCAAAACAACGACGAGGACCATGCCTTCCG
CAAGATCAAGCTCAGGGCCGAGGATGTCCAGGGACGCAACGTCCTTACCAACTTCTGGGGAATGGACTTCACGAC
GGACAAGCTCCGGTCCCTCGTCCGCAAGTGGCAGTCGCTCATCGAAGCTCACGTCGATGTGAAGACGACTGACAA
CTACACCTTGAGGCTCTTCTGCATTGGGTTCACCAAGCGCAGGCCCAACCAGGTGAAGCGGACGTGCTATGCGCA
GTCGAGCCAGATCCGCCAGATCCGGAAGAAGATGAGGGAGATCATGGTCCGCGAAGCTCAGTCGTGCGACCTCAA
GGACCTGGTGGCGAAATTCATCCCGGAGGTGATCGGGAAGGAGATCGAGAAGGTGACTGCTGGAATCTATCCCCT
GCAGAACACATACAT

> SEQ ID NO:1800 215267 226692_300999_1b
TTCAACACCGTTCGACATTAAGACGTGATTAAACACCATGGCTCAGGGAAAGAACAAGCGACTCTCTAAGGGAAA
GAAGGGTATCAAGAAGCGAGTTGTCGACCCCTTCACCAAGAAGGACTGGTACAACATCAAGGCTCCCTCCACCTT
TGAGAACCGAGACGTCGGCAAGACCCTCGTGAACCGATCCACCGGTCTGCGACTCGCCAACGACTACCTCAAGGG
CCGAGTGCTCGAGGTGTCCCTTGCTGATCTGCAGGGCCAGGAGGACCACTCCTTCAAGAAGGTCAAGCTGCGAGT
TGACGAGGTCCAGGGCAAGAACCTGCTCACCAACTTCCACGGCTTTGACTTCACTTCCGACAAGCTGCGATCTCT
CGTCCGAAAGTGGCAGACTCTGATTGAGGCTAACGTCACCGTCAAGACCTCCGACGACTACTTCCTCCGACTCTT
CGTCATCGGTTTCACCAAGCGACAGGCCAACCAGGTCAAGAAGACCACCTACGCCCAGACCTCTCAGATCAACCA
GATCCGAAAGAAGATGACCGACATTGTTGTCCGAGAGGCTTCCAACGTGACTCTTGCTCAGCTCACCGCCAAGCT
CATCCCCGAGGTTATTGGCCGAGAGATTGAGAAGGCCACTCAGAACATCTACCCTCTGCAGAACGTCTACATCCG
AAAGGTCAA

> SEQ ID NO:1801 215267 175611_300543_1b
CCCCCCGTTTTCTCCTCGCCGCTTCCACCTCTCTCGCGCCGCCGCCGCCGCCGAGCGCCTGGAGCAGCGTCAGCC
ATGGCCGTAGGTAAGAACAAGCGCATCTCCAAGGGGAAGAAGGGATCCAAGAAGAAGACCGTCGATCCCTTTGCT
AAGAAGGACTGGTATGATATCAAGGCCCGTCGGTGTTCAATGTGCGGAACATCGGCAAGACCCTCGTGTCCAGG
ACACAGGGTACAAAGATTGCTTCTGAGGGCCTAAAGCATAGAGTGTTTGAGGTCTCCTTAGCTGATCTCCAGAAC
GATGAGGATCAGGCGTACAGGAAGATCAGACTTCGTGCTGAGGATGTGCAAGGGAAGAACGTGCTCACCAACTTT
TGGGGCATGTCGTTTACTACCGATAAGCTCAGATCACTTGTTAAGAAGTGGCAGACACTGATTGAGGCTCATGTG
GATGTCAAAACCACAGACGGCTACATGCTGCGTCTGTTCTGTATCGGCTTCACCAAGCGGCGGCCTAACCAGGTG
AAGAGGACTTGCTATGCTCAAGCGAGTCAGATCAGACAGATTCGTCGCAAGATGGTTGAAATCATGGCCAACCAG
GCTTCAAGCTGTGATTTGAAAGAGCTAGTTTCAAAGTTCATTCCTGAAGTTATTGGGAAGGAAATTGAGAAGGCG
ACATCC

> SEQ ID NO:1802 215267 113781_300005_1b
GCAGCTCGTCTTAAGTATCGCCTCATCATCCCCTTCCCCAATACCCCCAAAGCAGTTCTAATCTCTCCATCCCAA
CATGGCCGTCGGCAAGAACAAGAGGATTTCCAAGGGAAAGAAGGGAGGAAAGAAGAAGGCGGCGGATCCGTATGC
AAAGAAGGACTGGTATGACATTAAGGCACCATCAGTTTTTGATATAAAAAACGTTGGCAAAACACTTGTTACTAG
GACTCAGGGAACTAAGATTGCTTCAGAGGGACTTAAGCATAGAGTTTTTGAAGTGAGTCTGGCTGATCTTCAAAA
GGATGAGGATCAGGCTTTCAGGAAGATCAGATTGAGAGCAGAGGATGTACAAGGAAAGAATGTCCTCACAAACTT
CTGGGGAATGGATTTTACAACTGACAAGTTGAGGTCACTTGTTCGCAAATGGCAGACTTTGATTGAGGCCCATGT
GGATGTTAAAACTACCGACAGCTATACTCTGAGGATGTTCTGCATTGCTTTTACAAAGAAGCGTCCAAACCAGCA
GAAGCGTACCTGTTATGCTCAGAGCAGCCAGATCCGTCAGATCCGTAGGAAGATGGTTGAGATCATGAGAAACCA
AGCAAGTTCATGTGACCTGAAGGAGTTGGTTGCTAAATTCATCCCTGAATCAATTGGCAGAGAGATTGAGAAAGC
AACTTCAAG

> SEQ ID NO:1803 215267 14178_300269_1b
CCCACGCGTCCGGCTTCTTCTTCTTCCTCACTGTAGCTCGTCGGCGCTACACCATCTAGAAGACCCTTAACCATG
GCTGTCGGGAAGAACAAGAGGATTTCAAAGGGTAGGAAAGGAGGAAAGAAGAAGGCTGTTGATCCCTTCTCCAAG
AAGGATTGGTATGACGTGAAGGCTCCTGGTTCTTTCACGAACAGGAATGTTGGGAAGACTCTTGTTTCCAGGACT
CAGGGTACCAAGATTGCCTCTGAGGGACTGAAACACAGGGTGTTTGAGGATTCTCTTGCTGATCTACAAAATGAT
GAGGATAATGCCTACAGGAAG

> SEQ ID NO:1804 215267 175113_300530_1b
GCGCCGCCGCCACTCACTGGCCAAACCCTAACCCGGAGGAGAGGGAGGAGCAGCCATGGCCGTGGGCAAGAACA
AGAGGATCTCCAAGGGCAGGAAGGGCAGCAAGAAGAAGACCGTCGATCCCTTTTCCAAGAAGGATTGGTACGACA

Figure 2 continued

TCAAGGCGCCGACCGTGTTCTCCGTCCGCAACATCGGCAAGACCCTCGTCTCCAGGACCCAGGGGACCAAGATTG
CATCTGAGGGTCTCAAGCATCGTGTCTTTGAAGTCTCCTTGGCGGATCTTCAGAATGACGAGGATCAGGCTTACA
GGAAGGTTAGACTTCGTGCTGAGGATGTTCAGGGGAGGAATGTCCTCACGAATTTCTGGGGCATGAGTTTTACCA
CGGACAAGCTTAGGTCCTTGGTCAAGAAATGGCAAACATTGATTGAAGCCCATGTGGATGTTAAGACCACAGATA
ACTACATGCTCCGCCTGTTTTGCATTGGTTTCACCAAGCGCCGCCCAAATCAGGTGAAGCGTACCTGTTACGCTC
AGGCTAGCCAGATCCGGCAGATCCGCCGGAAGATGGTTGAGATCATGGCCAACCAGGCATCAACATGTGACTTGA
AAGAACTGGTTTCAAAATTCATCCCTGAAGTCATTGGAAAGGAGATCGAGAAGTCAACTTCAAGTATAT

> SEQ ID NO:1805 215267 144219_200133_1b

CTCCTCGTCCAAAAGCAGCTGCAACATCTCCTTCCCAACATGGCTGTCGGTAAGAACAAGAGGATTTCAAAGGGA
AAGAAAGGAGGAAAAAAGAAGGCGGCGGATCCGTACGCAAAGAAGGACTGGTATGACATAAAGGCACCATCAGTA
TTTGATATCAAAAACGTTGGCAAGACCCTGGTCACTAGGACTCAGGGTACTAAGATTGCTTCGGAAGGACTAAAG
CACAGAGTATTTGAAGTCAGTTTGGCTGATCTTCAGAAGGATGAGGATCAATCCTTCAGGAAGATCCGCTTGAGG
GCAGAAGATGTGCAAGGGAAGAATGTCCTCACAAACTTCTGGGGAATGGATTTCACAACAGACAAGTTGAGGTCT
CTGGTAAAGAAGTGGCAGACATTGATTGAGGCTCATGTGGATGTCAAAACTACAGATAGCTACACTCTCCGGATG
TTCTGCATTGCTTTTACAAAGAAACGTCCCAACCAGCAGAAGCGGACATGCTATGCTCAGAGCAGCCAGATCCGT
CAGATCCGTCGGAAAATGGTTGAGATCATGAGAAACCAAGCAAGTTCCTGTGACCTGAAGGAGTTGGTCGCAAAA
TTTATCCCCGAGTCAATTGGCAGAGAGATTGAGAAAGCGACTTCAAGCATCTTCCCACTGCAAAATGTTTATATC
CGCAAAGTGAAAATCCTTAAGGCCCCAAAATTTGATATTGGCAAGCTGATGGAGGTTCATGGTGACTATTCAGAA
GATGTTGGCGTGAAGTTGGATCGACCAGCTGATGAGAATGTTGCTGAGGCAGAACCCGAAATTCCTGGAGCTTAG
ACTTGTTTGATTTGGATTCTATCTGAATATGGTGCTTGTCTTCTAAATTTATGAATTTCTTTTAGTTGAGGTGTT
AAGGCGCGACCTATCAAAATATTGGATATCTTTCTTTGGCATTCATCAG

> SEQ ID NO:1806 215280 1007809_301403_1b

ACGCGTCGCATTTTTCGTTCTTTTTGCGTTTCTCTCTCTCTCTCGCTCTCTCTTTCTGTTTCCTGTGAAAATGCA
GATCTTTGTGAAGACCCTGACGGGGAAGACCATCACCCTGGAGGTGGAAAGCTCCGACACCATTGATAACGTCAA
GGCCAAGATCCAAGACAAGGAGGGCATCCCCCCTGACCAGCAGCGCCTCATCTTTGCCGGGAAACAGCTTGAAGA
TGGCCGTACCCTTGCAGACTACAACATCCAGAAGGAGTCCACCCTCCACCTTGTCCTCCGCCTCCGAGGTGGTAT
GCAAATCTTCGTCAAAACCCTCACCGGTAAGACCATCACCCTCGAAGTTGAGAGCTCTGACACTATCGACAATGT
CAAGGCCAAGATCCAAGACAAGGAAGGGATTCCCCCTGATCAGCAGAGGCTTATCTTCGCTGGGAAGCAGCTCGA
AGACGGGCGAACCCTCGCTGACTACAACATCCAAAAGGAGTCCACCCTCCACCTCGTGCTGAGGCTCCGGGGAGG
CATGCAGATCTTTGTCAAAACCCTGACGGGGAAGACAATAACACTGGAGGTGGAAAGCTCTGACACAATTGACAA
CGTTAAAGCTAAGATTCAAGACAAGGAAGGGATCCCCCCCGATCAGCAGCGTTTGATCTTTGCCGGCAAGCAGCT
GGAAGA

> SEQ ID NO:1807 215280 1044002_301885_1b

CACGCGTCGCCCACGCGTCGCTCTTCTCTTGTGGTATCTCTCTCTCTCTCTCTCTCTCTTTCCTGAGAAAATG
CAGATCTTGTGAAGACCCTGACAGGGAAGACCATCACCCTGGAGGTGGAAAGCTCCGACACCATCGACAACGTCA
AGGCCAAGATCCAAGACAAGGAGGGCATCCCCCCTGACCAGCAGCGCCTCATCTTCGCTGGGAAACAGCTCGAAG
ATGGCCGTACCCTCGCTGACTACAACATCCAGAAGGAGTCCACTCTCCACCTTGTCCTCCGCCTCCGAGGTGGTA
TGCAAATCTTTGTCAAAACCCTCACTGGTAAGACCATCACCCTTGAAGTCGAGAGCTCTGATACTATTGACAATG
TCAAGGCCAAGATCCAAGACAAGGAGGGGATTCCCCCTGACCAGCAGAGGCTCATCTTTGCTGGGAAGCAGCTTG
AAGATGGGCGGACCCTTGCCGACTACAACATCCAGAAGGAGTCCACCCTCCACCTTGTGCTGAGGCTCCGGGGGG
GCATGCAGATCTTCGTCAAAACTCTAACAGGGAAGACGATAACGCTGGAGGTGGAAAGCTCTGACACAATTGACA
ATGTGAAGGCAAAGATTCAAGACAAGGAAGGGATCCCCCTGACCAGCAGCGATTGATCT

> SEQ ID NO:1808 215280 109158_300043_1b

CAATAATCCGTCATGCAGATCTTCGTGAAAACCCTAACGGGAAAGACCATAACCCTCGAAGTCGAGAGCAGCGAC
ACCATCGACAATGTCAAGGCCAAAATTCAGGACAAAGAAGGGATACCTCCTGATCAGCAGAGGTTGATTTTTGCT
GGAAAACAGTTGGAAGATGGTCGAACTCTGGCTGATTACAATATCCAGAAAGAATCAACACTTCACCTGGTTTTG
AGGCTCAGGGGAGGAACTATGATTAAGGTGAAGACTCTCACTGGAAAGGAAATTGAGATTGATATTGAACCCACA
GACACCATTGATCGAATTAAGGAACGAGTTGAGGAAAAGAAGGAATACCTCCTGTGCAGCAAAGGCTTATTTAT
GCTGGAAAGCAGCTAGCTGATGACAAGACCGCTAAGGATTACAATATTGAAGGAGGTTCTGTTCTTCATCTCGTT
CTTGCATTGATGGGTGGTAGTCTTTAGAATGCTCCGAATTTGGGTAAAAATGTGCAACCTTTATCCACGAATTTA
TCATGACAGTTCTCTTTTGTTTTCTTTTTACCTTTTCTCATGTAAAACATGAAAACTTGGTTAAAGCTGACTAGC
TGAGATTGATTTCCCCTTATAAAAAAA

> SEQ ID NO:1809 215280 56456_300139_1b

TTACAATATCCAGAAGGAATCCACCCTCCACTTGGTTCTCAGGCTCCGTGGTGGTATGCAGATTTTCGTTAAAAC

Figure 2 continued

CCTAACGGTAAAGACGATTACTCTTGAGGTGGAGAGCTCTGACACCATTGACATCGTCAAGGCCAAGATCCAAGA
TAAGGAGGGTATTCCTCCGGACCAGCAGAGGTTGATCTTCGCCGGAAAGCAACTTGAGGACGGCAGAACTTTGGC
GGATTACAACATCCAGAAGGAGTCTACGCTTCATTTGGTCTTGCGTCTGCGTGGAGGTATGCAGATCTTCGTAAA
GACTTTGACCGGAAAGACCATCACTCTTGAAGTTGAGAGCTCCGACACCATTGATAACGTGAAGGCTAAGATCCA
GGACAAGGAAGGCATTCCTCCGGACCAGCAGCGTCTCATCTTCGCTGGAAAGCAGCTTGAGGATGGACGTACTTT
GGCCGACTACAACATCCAGAAGGAGTCTACTCTTCACTTGGTCCTCCGTCTCCGTGGTGGTTTCTAAACCTTGTC
TCTCTCTCTTATGGTTACTGAACCAAGTTCATGTATCGTTTCATCTAGTACTTTGGTGGTTTATGTTTTGGGGCC
ATGTACAGCCTCTGATAAATAATTGATCGACTATGTTTCCGTTA

> SEQ ID NO:1810 215280 50818_300186_1b
CGACAATGTTAAAGCCAAAATCCAGGACAAAGAGGGCATACCACCTGATCAACAGAGGCTGATTTTTGCTGGTAA
GCAATTGGAAGATGGCCGGACCTTAGCTGATTACAACATCCAGAAAGAGTCTACTCTTCATCTTGTCCTCAGGCT
CAGAGGTGGAACCATGATCAAGGTGAAGACACTCACTGGAAAAGAAATCGAGATTGATATCGAACCAACCGACAC
TATTGATCGGATCAAAGAACGTGTTGAAGAGAAAGAAGGCATCCCTCCTGTTCAACAAAGGCTCATATATGCCGG
AAAACAGCTTGCTGATGACAAAACGGCCAAAGATTATGCGATAG

> SEQ ID NO:1811 215280 4655_300310_1b
CGCGGTATGCAGATCTTCGTGAAGACTCTCACCGGAAAGACTATCACTTTGGAGGTAGAGAGCTCTGACACCATT
GACAACGTGAAGGCCAAGATCCAGGATAAGGAAGGAATCCCTCCGGACCAGCAGAGGTTGATCTTTGCCGGAAAA
CAATTGGAGGATGGTCGCACTTTGGCGGATTACAACATCCAGAAGGAGACGACCCTTCACTTGGTGTTGCGTCTG
CGAGGAGGTATGCAGAAATTCGTCAAGACTTTGACCGGAAAGACCATCACCCTTGAAGTGGAAAGCTCCGACACC
ATTGACAACGTCAAGGCCAAGATCCAGGACAAGGAGGGAATCCCCCCTGACCAGCAGCGCCTCATCTTTGCCGGT
AAACAGCTCGAAGACGGCCGCACCCTTGCCGATTACAACATACAGAAGGAGTCTACCCTCCACCTTGTCCTTCGC
CTCAGGGGCGGTATGCAAATCTTCGTCAAAACCCTCACTGGCAAGACCATTACCCTTGAAGTCGAGAGTTCTGAT
ACCATCGATAATGTGAAAGCCAAGATCCAAGATAAGGAGGGAATTCCCCCTGACCAGCAGCGCCTTATCTTTGCT
GGTAAACAGCTTGAAGATGGCCGCACCCTCGCTGATTACAACATACAGAAGGAGTCTACCCTCCACCTTGTCCTT
CGCCTCAGGGGTGGTATGCAAATCTTCGTCAAAACCCTCACCGGCAAGACCATTACTCTTGAAGTCGAGAGTTCT
GACACAATTGATAACGTGAAAGCCAAGATCCAAGATAAGGAGGGAATTCCCCCCGACCAGCAGAGGCTCATCTTT
GCTGGGAAGCAACTTGAAGATGGTCGCA

> SEQ ID NO:1812 215280 39255_300206_1b
CCCACGCGTCCGCTCAAAATCTTAAAAACTTTCTCTCAATTCTCTCTACCGTGATCAAGATGCAGATCTTTGTTA
AGACTCTCACCGGAAAGACAATCACCCTCGAGGTGGAAAGCTCCGACACCATCGACAACGTTAAGGCCAAGATCC
AGGATAAGGAGGGCATTCCTCCGGATCAGCAGAGGCTTATTTTCGCCGGCAAGCAGCTAGAGGATGGCCGTACGT
TGGCTGATTACAATATCCAGAAGGAATCCACCCTCCACTTGGTCCTCAGGCTCCGTGGTGGTATGCAGATTTTCG
TTAAAACCCTAACGGGAAAGACGATTACTCTTGAGGTGGAGAGTTCTGACACCATCGACAACGTCAAGGCCAAGA
TCCAAGACAAAGAGGGTATTCCTCCGGACCAGCAGAGGCTGATCTTCGCCGGAAAGCAGTTGGAGGATGGCAGAA
CTCTTGCTGACTACAATATCCAGAAGGAGTCCACCCTTCATCTTGTTCTCAGGCTCCGTGGTGGTATGCAGATTT
TCGTTAAGACGTTGACTGGGAAAACTATCACTTTGGAGGTGGAGAGTTCTGACACCATTGATAACGTGAAAGCCA
AGATCCAAGACAAAGAGGGTATTCCTCCGGACCAGCAGAGATTGATCTTCGCCGGAAAACAACTTGAAGATGGCA
GAACTTTGGCCGACTACAACATTCAGAAGGAGTCCACACTCCACTTGGTCTTGCGTCT

> SEQ ID NO:1813 215280 38919_301003_1b
TTTATTTTTTTAAGAAGAAGTTCGACTTGTCATTAGAAAGAAAGAGATAACAGGAACGGAAACATAGTAGAACAC
TTATTCATCAGGGATTATACAAGGCCCCAAAACACAAACCACCAAAGTTTTACATGAAACGAAACATTGAACTTC
TTAAGCATAACAGAGACGAGATTTAAAAACCACCACGAAGACGCAGGACCAAGTGAAGAGTAGACTCCTTCTGGA
TGTTGTAGTCGGCCAAAGTACGTCCATCCTCAAGCTGCTTTCCAGCGAAGATGAGACGCTGCTGGTCCGGAGGAA
TACCTTCCTTGTCCTGGATCTTGGCCTTGACGTTGTCAATGGTGTCGGAGCTTTCCACTTCAAGGGTGATGGTCT
TTCCGGTCAAAGTCTTGACGAAGATCTGCATACCTCCACGCAGACGCAACACCAAGTGAAGGGTCGACTCCTTCT
GGATGTTGTAATCCGCCAAAGTACGACCATCCTCCAATTGTTTTCCGGCAAAGATCAACCTCTGCTGGTCCGGAG
GGATTCCTTCCTTATCCTGGATCTTGGCCTTCACGTTGTCAATGGTGTCAGAGCTCTCTACCTCCAAAGTGATAG
TCTTTCCGGTGAGAGTCTTCACGAAGATCTGCATACCTCCACGCAGACGCAAGACCAAGTGAAGTGTGGACTCCT
TCTGAATGTTGTAGTCAGCCAAAGTTCTTCCATCTTCAAGTTGCTTTCCGGCG

> SEQ ID NO:1814 215280 31142_300086_1b
CCCACGCGTCCGCTCTCCCAAAGCCTAAAGCGATCTCTGCAAATCTCTCGCGACTCTCTCTTTCAAGATGCAAAT
CTTCGTGAAAACACTCACTGGCAAGACTATCACTCTCGAGGTTGAGAGCTCTGACACCATCGACAATGTTAAGGC
AAAGATTCAGGACAAGGAAGGCATTCCTCCGGATCAGCAAAGATTAATATTCGCCGGTAAACAGCTAGAAGATGG
CCGTACCTTGGCCGATTACAACATTCAGAAAGAATCAACCCTTCATTTGGTTCTCCGTTTAAGAGGTGGTATGCA

Figure 2 continued

AATCTTTGTCAAGACTCTGACTGGCAAGACCATTACTTTGGAGGTTGAGAGCTCTGACACTATTGACAACGTCAA
AGCAAAGATCCAGGACAAGGAAGGAATCCCTCCGGATCAGCAGAGACTTATCTTTGCCGGTAAGCAGCTTGAAGA
CGGAAGAACTCTTGCTGACTACAACATTCAAAAGGAGTCGACCCTTCATTTGGTGCTTCGTCTCAGAGGTGGTAT
GCAAATCTTTGTCAAGACCCTCACTGGTAAAACAATCACCCTTGAGGTTGAGAGTTCAGACACCATTGACAATGT
CAAAGCTAAGATCCAAGATAAAGAGGGAATTCCTCCGGATCAGCAGAGGCTTATCTTTGCCGGTAAGCAGCTCGA
AGATGGACGCACCCTTGCAGATTACAACATCCAAAAGGAGTCGACACTTCATCTTGTGCTTCGTCTCCGTGGTGG
TATGCAGATCTTTGTGAAGACCCTTACCGGAAAGACCATTACTCTGGAGGTTGAAAGCTCAGACACCATCGATAA
TGTCAAGGCTAAGATTCAGGACAAGGAAGGGATCCCACCAGACCAACAGAGACTCATCTTCGCTGGAAAACAGCT
TGAGGATGGTCGCACACTTGCAGATTACAACATCCAGAAGGAGTCGACTCTTCACTTGGTTCTTCGTCTTCGTGG
TGGAAGCTTCTAAGCTTTTTGTGATCTGATGATAAGTGGTTGGTTCGTGTCTCATGCACTTGGGAGGTGATCTAT
TTCACCTGGTGTAGTTTGTGTTTCCGTCAGTTGGAAAAACTTATCCCTATCGATTTCGTTTTCATTTTCTGCTTT
TCTTTTATGTACCTTCGTTTGGGCTTGTAACGGGCCTTTGTATTTCAACTCTCAATAATAATCCAAGGGCATGTT
TACCCAAAAAAAAAAAAC

> SEQ ID NO:1815 215280 258042_301688_1b
GTTGGTCGAGGCGAGGAGAGCGGCGGCGAAGAAGGACAAGTCTGGAGCCATGCAGATCTTCGTCAAGACATTGAC
TGGGAAGACAATCACCCTCGAGGTTGAGTCGTCGGACACGATCGACAATGTGAAGACCAAGATCCAGGACAAGGA
AGGGATCCCTCCCGACCAGCAGCGGCTGATCTTCGCGGGCAAGCAGCTGGAAGATGGCCGGACGCTGGCGGACTA
CAACATCCAGAAGGAGTCGACCCTCCACCTTGTTCTTCGCCTCCGGGGTGGCGGCAAGAAAAGGAAGAAGAAGAC
GTACACCAAGCCCAAGAAGATCAAGCACAAGAAGAAGAAGGTGAAGCTGGCGGTGCTCCAGTACTACAAGGTGGA
CGATTCGGGCAAGGTGAACAGGCTGCGCAAAGAGTGCCCGAATCCAGAGTGCGGTGCCGGGACGTTCATGGCGAA
CCACTTTGATCGGCACTACTGCGGCAAGTGTGGACTCACCTACGTCTACCAGAGAGCGTGAAGCTTAGAGAGGATG
ACGAGCTTTGCTCTCTTTCCTTGTGTTTCTATCCAATTTTCTTTGAACGAAAGTATAATCTTTTCTTTTGTT

> SEQ ID NO:1816 215280 255187_301642_1b
GGGCAGGTAGAGGTGGAGGCAAGCGGGGAAGATGCAGATATTTGTGAAGACCCTGACGGGGAAGACCATCACCC
TCGAGGTCGAGAGCAGTGACACCATCGATAATGTCAAAGCAAAGATCCAAGACAAGGAAGGAATTCCACCGGATC
AGCAGAGGCTTATTTTTGCTGGGAAACAACTGGAGGATGGTCGCACATTGGCTGACTACAATATCCAGAAAGAGT
CTACTTTGCACCTTGTTTTGAGGCTTCGAGGTGGTATCATAGAGCCTTCGCTGATGGCGCTCGCCAGGAAGTATA
ATCAAGAGAAGATGATATGTCGCAAGTGCTATGCTCGTCTTCATCCTCGCGCTGTGAACTGCAGAAAAAAGAAAT
GTGGGCACAGCAATCAGCTTCGACCAAAGAAGAAGATCAAGTAGGTNGTTCGGTTGCAGCCTCTCCAGATATTCA
GAATCTTGTTTTTTTGCTGATTTGAGGAAAAGTTGTTTGAGTGCCATTTACCATGTTTTGGTGCAAGTGGCACTC
TTATTATGTTAATCTCTGCGAAGTAATTACTGACGATGAGTCGTTTGCATTTGAATTTTCGGAACAAAAGGAATT
TGAA

> SEQ ID NO:1817 215280 254507_301633_1b
TTGCTTTCTCTCTCTCTGTCTCTCTCTTTCTGTCTACCCTTTCTCTCTCTGTCCTCTGTTTGAGCCAAGAAGAAG
ATGCAGATCTTCGTGAAGACCCTGACCGGCAAGACCATCACCCTCGAGGTCGAAAGCTCTGACACCATCGACAAC
GTCAAGGCCAAGATCCAGGACAAGGAGGGTATCCCCCCTGACCAGCAGCGCCTCATCTTTGCTGGTAAACAGCTT
GAAGATGGCCGCACCCTTGCTGATTACAACATACAGAAGGAGTCTACCCTCCACCTTGTCCTTCGCCTCAGGGGC
GGTATGCAAATCTTCGTCAAAACCCTCACTGGCAAGACCATTACCCTTGAAGTCGAGAGTTCTGATACCATCGAT
AATGTGAAAGCCAAGATCCAAGATAAGGAGGGAATTCCCCCTGACCAGCAGCGCCTTATCTTTGCTGGTAAACAG
CTTGAAGATGGCCGCACCCTCGCTGATTACAACATACAGAAGGAGTCTACCCTCCACCTTGTCCTTCGCCTCAGG
GGTGGTATGCAAATCTTCGTCAAAACCCTCACCGGCAAGACCATTACTCTTGAAGTCGAGAGTTCTGACACA

> SEQ ID NO:1818 215280 248863_301587_1b
TCATCAATTAGGTTTCTTCGATAGCAAGTAGCGATGCAGATCTTCGTCAAGACTCTCACCGGCAAGACTATCACC
TTGGAGGTGGAGAGCTCCGACACCATCGACAACGTCAAGACCAAGATCCAGGACAAGGAAGGGATCCCTCCGGAT
CAGCAGCGGTTGATCTTTGCCGGCAAGCAGCTTGAGGACGGGCGTACCCTCGCCGACTACAACATCCAGAAGGAG
TCTACGCTGCATCTTGTTCTTCGGCTGCGAGGAGGTATGCAAATATTCGTCAAGACCCTAACGGGTAAGACGATC
ACCCTGGAGGTGGAGAGCTCCGACACCATCGACAACGTCAAGACCAAGATCCAGGACAAGGAAGGGATCCCGCCG
GATCAGCAGCGTCTGATCTTCGCTGGCAAGCAGCTCGAGGATGGCCGTACCCTGGCCGACTACAACATCCAGAAG
GAGTCGACCCTTCATCTTGTGCTGCGTCTGCGAGGAGGCATGCAGATCTTCGTTAAGACCCTCACTGGTAAGACG
ATCACCCTGGAAGTCGAGAGCTCGGACACCATCGACAACGTGAAGACTAAGATCCAGGACAAGGAGGGAATTCCT
CCCGGACCAGCAGCGGTTGATCTTCGCGGGTAAGCAGCTCGAGGATGGGCGCACTCTTGCCGACTACAACATTCAG
AAGGAGTCTACACTCCATTTGGTGCTGCGTCTTCGCGGAGGCATGCAGATCTTCGTCAAGACCCTCACGGGTAAG
ACGATCACCCTGGAAGTCGAGAGCTCAGACACCATCGACAACGTGAAGACCAAGATCCAGGACAAGGAGGGAATT
CCTCCGGATCAGCAGCGGTTGATCTTCGCGGGTAAGCAGCTCGAAGATGGGCGCACTCTCGCCGACTACAACATT
CAGAAGGAGTCTACTCTCCATTTGGTGCTGCGTCTTCGCGGAGGCATGCAGATCTTCGTCAAGACCCTCACGGGT

Figure 2 continued

AAGACGATCACGTTGGAGGTGGAGAGCTCGGACACGATTGACAACGTGAAGACCAAGATCCAGGACAAGGAGGGA
ATTCCTCCGGACCAGCAGAGGCTGATCTTCGCCGGGAAGCAGCTCGAGGATGGCCGCACTCTTGCGGACTACAAC
ATCCAGAAGGAGTCTACTCTCCATTTGGTGCTCCGTCTTCGTGGAGGCCAGTAGATAGCATGTAGCGCGTTAGCG
CGTGAAGTAT

> SEQ ID NO:1819  215280  239507_301305_1b
AAGATGCAGATCTTCGTGAAGACCCTGACGGGCAAGACCATCACGCTCGAAGTCGAGAGCAGTGACACCATCGAC
AACGTCAAGTCCAAGATCCAGGACAAGGAGGGTATTCCCCCGGACCAACAGCGCCTGATCTTCGCCGGAAAGCAA
CTCGAGGATGGCCGCACTCTGTCCGACTACAACATCCAGAAGGAGTCAACCCTCCACTTGGTCCTCCGTCTCCGT
GGTGGTATCATTGAGCCTTCGCTGAAGGCGCTTGCCTCCAAGTACAACTGCGACAAGATGATCTGCCGCAAGTGC
TACGCACGTCTGCCACCGAGGGCTGTCAACTGCCGCAAGAAGAAGTGCGGTCACACCAACCAGCTCCGCCCCAAG
AAGAAGTTGAAGTAAACTACTCGCTCCTATCGGCGTCTGGCGAAGAGAGCAACGGGGTCGGTGGATACGAATTGC
AACGATTGCATGCGATGGATATGAGGGCTAGGTCACTACTACTTCTTCCACGGCACATGGCATCAATGGAGTGCT
TGTCTTGTCTCGCATTTGGGACTTTATGAAGGGAACCAGGCATGTAGAGTGAATCGATTCAAATTCAAAAACCAC
CA

> SEQ ID NO:1820  215280  234660_301219_1b
CGACCCACGCGTCCGCTTTTGTGGGCGATTCCTGGGTAATTTCATACAGCGGCAACTATGCAGATCTTCGTCAAG
ACACTGACTGGCAAGACGATCACTCTGGAGGTCGAGAGCTCGGACACGATCGATAATGTGAAGACCAAGATCCAG
GACAAGGAAGGGATCCCCCCGGACCAGCAGCGTCTCATCTTCGCCGGGAAGCAGCTCGAAGACGGGCGAATCTTG
GCTGACTACAACATCCAGAAGGAATCCACTCTCCATCTCGTCCTACGTCTTCGCGGAGGCATGCAGATCTTTGTC
AAGACGCTGACCGGCAAGACCATCACTCTGGAGGTCGAGAGCTCGGACACGATCGATAATGTGAAGACCAAGATC
CAGGACAAGGAAGGGATCCCCCCGGACCAGCAGCGTCTCATCTTCGCCGGGAAGCAGCTCGAAGACGGGCGAACC
TTGGCTGACTACAACATCCAGAAGGAATCGACTCTCCATCTCGTCCTACGTCTTCGCGGAGGCATGCAGATCTTT
GTCAAGACGCTGACCGGCAAGACCATCACTCTTGAGGTCGAGAGCTCGGACACGATCGATAATGTGAAGACCAAG
ATCCAGGACAAGGAAGGGATCCCCCCGGACCAGCAGCGTCTCATCTTTGCTGGGAAGCAACTCGAAGACGGGCGA
ACCTTGGCCGACTACAACATCCAGAAGGAGTCGACCCTTCACTTGGTGCTGCGTCTCCGTGGAGGCATGCAGATC
TTCGTCAAGACCCTGACCGGCAAGACCATCACCCTCGAGGTGGAGAGCTCCGACACGATTGACAACGTTAAGACG
AAAATCCAGGACAAGGAAGGGATCCCTCCTGACCAGCAGCGCCTCATCTTCGCCGGCAAGCAGCTCGAGGATGGA
CGAACTCTCGCCGACTACAACATCCAGAAGGAATCCACCCTTCACCTGGTGCTGCGTCTCCGCGGAGGCATGCAA
ATCTTCGTCAAGACCCTGACCGGCAAGACCATCACGCTCGAGGTCGAGAGCTCCGACACGATCGACAACGTAAAG
ACCAAGATCCAGGACAAGGAAGGGATCCCCCCGGACCAGCAGCGACTCATCTTTGCCGGGAAGCAGCTCGAGGAT
GGCAGGACTCTGGCCGACTACAACATCCAGAAGGAATCCACCCTTCACCTGGTGCTGCGTCTCCGCGGAGGCATG
CAAATCTTCGTCAAGACCCTGACCGGCAAGACCATCACTCTGGAGGTGGAGAGCTCGGATACCATCGACAACGT

> SEQ ID NO:1821  215280  229138_301040_1b
AGAAGAGAGGCTCAGCGTTCAAGATGCAGATCTTCGTCAAGACCCTCACGGGCAAGACCATCACTCTCGAGGTCG
AGAGCTCCGATACCATTGACAATGTCAAGTCCAAGATCCAGGACAAGGAGGGCATTCCCCCGGACCAGCAGCGTC
TGATCTTCGCCGGAAAGCAGCTCGAGGATGGCCGCACTCTTTCGGACTACAACATCCAGAAGGAGTCCACCCTCC
ACTTGGTCCTCCGCCTTCGTGGTGGTATGGCCAAGAAGCGCAAGAAGAAGGTGTACACCACCCCCAAGAAGATCA
AGCACAAGCGCAAGAAGACCAAGCTAGCTGTCCTCAAGTACTACAAGGTTGACGGCGATGGCAAGATCGAGCGTC
TTCGCCGCGAGTGCCCCCACCCCGA

> SEQ ID NO:1822  215280  226271_300995_1b
GAAAGACGCACAGTTTTCTTTGCAGACGACACCGAAATGCAGATTTTTGTCAAGACCCTTACCGGTAAGACTATC
ACCCTCGAGGTGGAGTCTTCCGACACCATCGACAACGTCAAGTCCAAGATCCAGGACAAGGAGGGAATTCCCCCG
GACCAGCAGCGACTTATCTTCGCCGGTAAGCAGCTCGAGGACGGCCGAACCCTTTCTGACTACAACATCCAGAAG
GAGTCCACTCTCCATCTCGTCCTGCGACTTCGAGGTGGTGGTAAGAAGCGAAAGAAGAAGGTCTACACCACCCCC
AAGAAGATCAAGCACAAGCGAAAGAAGAACAAGCTTGCTGTCCTCAACCTCTACAAGGTTGACGATGACGGAAAG
GTTGAGCGACTTCGACGAGAGTGTGAGTCTGAGTCCTGCGGTGCCGGTGTCTTCATGGCTGACATGAAGGACCGA
CAGTACTGCGGCCGATGCCACCTCACCCTCAAGGCCTAAATGTATTGATTTAGTTTAGTATATTTATCTCTTGAA
CAAAAAAA

> SEQ ID NO:1823  215280  224458_300972_1b
GGTGATTTCTAAACATGCAGATCTTTGTGAAGACCTTGACCGGCAAGACTATCACCCTCGAGGTGGAGAGCTCGG
ATACCATCGACAACGTTAAGACCAAGATCCAGGACAAGGAAGGGATCCCACCGGACCAGCAACGATTGATCTTCG
CCGGGAAGCAGCTTGAGGACGGACGGACCCTTGCGGACTACAACATCCAGAAGGAATCCACGCTTCACCTGGTTC
TTCGTCTCCGCGGTGGCATGCAGATATTTGTGAAGACCTTGACCGGCAAGACCATCACCCTCGAGGTGGAGAGCT
CGGATACCATCGACAATGTCAAGACCAAGATCCAGGATAAGGAGGGGATTCCTCCGGACCAGCAGCGACTTATCT

Figure 2 continued

TCGCCGGGAAGCAACTCGAGGACGGACGGACCCTTGCCGACTATAACATCCAGAAGGAGTCGACTCTCCACTTGG
TTCTTCGTCTCCGCGGTGGCATGCAGATATTTGTGAAGACACTGACCGGCAAGACCATCACCCTCGAGGTGGAGA
GCTCGGATACCATCGACAATGTCAAGACCAAGATCCAGGATAAGGAGGGGATTCCTCCGGACCAGCAGCGTTTGA
TCTTCGCTGGGAAGCAGCTCGAGGACGGACGGACCC

> SEQ ID NO:1824 215280 224020_300978_1b
GCGACAGTTAGCAGGAATCATCGACAACAATGCAAATCTTTGTCAAGACCCTTACTGGCAAGACTATCACCCTCG
AGGTGGAGTCCTCTGACACCATTGACAACGTCAAGTCCAAGATCCAGGACAAGGAGGGAATCCCCCCGGACCAGC
AGCGACTTATCTTCGCCGGTAAGCAGCTCGAGGACGGCCGAACTCTTTCCGACTACAACATCCAGAAGGAGTCCA
CTCTCCATCTCGTTCTGCGACTCCGAGGAGGTATCATCGAGCCCTCTCTCAAGGCTCTTGCCTCCAAGTACAACT
GTGAGAAGGCCATCTGCCGAAAGTGCTACGCCCGACTTCCTCCTCGAGCCACCAACTGCCGAAAGAAGAAGTGCG
GACACACCAACCAGCTCCGACCCAAGAAGAAGCTCAAGTAAACTATTCGCATGTATGGTATATGTATAAAAATTC
TGTT

> SEQ ID NO:1825 215280 220302_300954_1b
TCCGCAACATCTGAAGATTGCTTAGGACGGCAATAGGTCTATTGTCGAGGTATGTCTGAAAGATGCTGCATTTCT
ATCTGCCCTCCATGAGCTCCGGGAGCTTCATGAGGGAATCATCGTTGATGTCTCCCTCTTGAGCATTCTTCTTTG
TTTCCCGGAGCTCTATTCCCCAAATCCCGAGATATTGCTCGTTGTCGCGAAGAAATTTGCAACACGGCAATTCTC
GCCTTCTTCTCCCCAAAGTCAACTCACGCAGGCAATGTATGCTGGGCAAACAAATCTAACCCTTCCAGTTAGGCA
AGATGCAGATTTTCGTCAAGACCCTCACGGGGAAGACGATCACCCTTGAGGTGGAGTCTTCCGACACCATCGACA
ATGTCAAGTCCAAGATCCAGGACAAGGAGGGCATTCCCCCGGACCAGCAGCGATTGATCTTCGCTGGTAAGCAGC
TGGAGGATGGCCGAACCCTCTCCGACTACAACATCCAGAAGGAGTCTACCCTCCACCTGGTCCTGCGCCTGCGTG
GTGGTGCCAAGAAGAGAAAGAAGAAGGTCTACACCACCCCCAAGAAGATTAAGCACAAGCGCAAGAAGACCAAGT
TGGCTGTCCTCAAGTACTACAAGGTCAGCAACGATGGTAACATCGAGCGTCTCCGCCGCGAGTGCCCCAGCGAGA
CTTGCGGTGCTGGTGTCTTCATGGCTGCCATGCCTGACCGTCAATACTGTGGTCGTTGCCACCTGACCTACGTCT
TCGACAAGCAGTAAACGACAAAACTTTCAAAAAGGGAAAAAATTTATTGTGGATTGGACAGCTGGAGCCATGGGA
CTGCCATAACACACAAAGGCGTTGATGTAGCATTAGAGAGCACATCCGGCGGCTTCTGGTAATGAATGCTTGATT
TGAGACACGTTTGG

> SEQ ID NO:1826 215280 139045_300406_1b
AAAAAAGGGAAGAAATTTTTTTCTTTTTTTTTTGTTCGCCTCCGCTTCTTCCTCACGCAGCTCTCGCCTCGCCTC
GCCGCCCGCCACTAGAGAGGAGAGGGAGAAGGAGAAGGAGGCGAATCCCAGCAAAAGAAGATGCAGATCTTCGTG
AAGACCCTGACGGGGAAGACCATCACCCTCGAGGTGGAGAGCAGCGACACCATCGACAACGTCAAGGCCAAAATC
CAGGACAAGGAAGGGATCCCTCCAGATCAACAGCGTTTGATATTCGCCGGCAAGCAGCTGGAAGATGGGCGCACA
CTGGCCGACTACAACATTCAGAAGGAGTCAACTCTTCACTTGGTCCTCAGGCTCAGGGGTGGCACTATGATCAAG
GTTAAGACCCTCACTGGAAAAGAGATTGAAATTGACATTGAGCCCACCGACACGATCGATAGGATCAAGGAGCGT
GTTGAGGAGAAAGAAGGCATTCCTCCCGTGCAGCAAAGGCTTATCTATGCTGGTAAGCAGCTTGCCGACGACAAG
ACTGCGAAGGACTATAACATCGAAGGTGGCTCTGTCCTCCATCTTGTCCTTGCTCTGAGGGGTGGTTATTAGTAA
AGCTAATGTGCTAGTACTTAGCTCAATAC

> SEQ ID NO:1827 215280 138074_300688_1b
CGAAAAATTTCTCCCCAATCTCGCGAGGCTCTCGTCGTCGAATCGAATCCTCTCGCGTCCTCAAGATGCAGATCT
TTGTGAAGACATTGACCGGCAAGACTATCACCCTCGAGGTGGAGTCCTCTGACACCATCGATAATGTCAAGGCTA
AGATCCAAGATAAGGAGGGCATCCCCCCGGACCAGCAGCGTCTCATCTTCGCTGGCAAGCAGCTGGAGGATGGCA
GGACCCTTGCTGACTACAACATCCAGAAGGAGTCGACCCTTCACCTTGTCCTCCGCCTCCGTGGTGGCATGCAGA
TCTTTGTCAAGACTCTGACCGGCAAGACTATCACCCTTGAGGTGGAGTCTTCTGACACCATCGACAACGTCAAGG
CCAAGATCCAGGACAAAGAGGGCATCCCCCCAGACCAGCAGCGTCTCATCTTCGCCGGCAAGCAGCTGGAGGATG
GCAGGACCCTTGCTGACTACAACATCCAGAAGGAGTCCACCCTCCACCTTGTCCTCCGCCTCCGTGGTGGCATGC
AGATCTTTGTCAAGACACTGACCGGCAAGACCATCACCCTCGAGGTGGAATCTTCTGACACCATCGACAACGTCA
AGGCCAAGATCCAGGACAAGGAGGGCATTCCCCGGACCAGCAGCGTCTCATCTTTGCCGGCAAGCAGCTTGAGG
ACGGCAGGACCCTTGCTGACTACAACATCCAGAAGGAGTCAACGCTTCACCTTGTCCTCCGTCTCAGGGGAGGCA
TGCAAATCTTCGTGAAGACTCTGACCGGCAAGACCATCACCCTCGAGGTGGAGTCTTCTGATACCATCGACAATG
TCAAGGCCAAGATCCAGGACAAGGAGGGCATTCCCCGGACCAGCAGCGCCTCATCTTTGCTGGCAAGCAGCTGG
AGGATGGCAGGACCCTTGCTGACTACAACATCCAGAAGGAGTCCACCCTCCACCTTGTGCTCCGCCTTCGTGGTG
GTATGCAGATCTTTGTCAAGACCCTCACAGGCAAGACCATCACCCTGGAGGTTGAGAGCTCGGACACCATCGACA
ACGTCAAGGCCAAGATCCAGGACAAGGAGGGCATCCCCCAGACCAGCAGCGTCTCATCTTCGCCGGCAAGCAGC
TCGAGGATGGCCGCACCCTCGCCGACTACAACATCCAGAAGGAGTCTACCCTCCACCTGGTGCTTCGTCTCCGTG
GTGGTATGCAGATCTTCGTGAAGACCTTGACTGGGAAGACCATCACTTTGGAGGTTGAGAGCTCCGACACCATTG
ATAATGTGAAGGCCAAGATCCAGGACAAGGAGGGGATTCCCCCAGACCAGCAGCGTCTGATCTTCGCTGGCAAGC

Figure 2 continued

AGCTGGAGGATGGACGCACCCTCGCCGACTACAACATCCAGAAGGAGTCCACCCTCCACCTGGTGCTCCGCCTCC
GTGGTGGTCAGTAATCAGCCAGTTTGGTGGAGCTGCCGATGTGCCTGGTCGTCCCGAGCCTCTGTTCGTCAAGTA
TTTGTGGTGCTGATGTCTACTTGTGTCTGGTTTAATGGACCATCGAGTCCGTATGATATGTTAGTTTTATGAAAC
AGTTTCCTGTGGGACAGCAGTATGCTTTATGAATAAGTTGGATTTGAACCTAAATATGTGCTCAATTTGCT

> SEQ ID NO:1828 215280 135673_300416_1b
AATTTCTCCCCAATCTCGCGAGGCTCTCGTCGTCGAATCGAATCCTCTCGCGTCCTCAAGATGCAGATCTTTGTG
AAGACATTGACCGGCAAGACTATCACCCTCGAGGTGGAGTCCTCTGACACCATCGATAATGTCAAGGCTAAGATC
CAAGATAAGGAGGGCATCCCCCCGGACCAGCAGCGTCTCATCTTCGCTGGCAAGCAGCTGGAGGATGGCAGGACC
CTTGCTGACTACAACATCCAGAAGGAGTCGACCCTTCACCTTGTCCTCCGCCTCCGTGGTGGCATGCAGATCTTT
GTCAAGACTCTGACCGGCAAGACTATCACCCTTGAGGTGGAGTCTTCTGACACCATCGACAACGTCAAGGCCAAG
ATCCAGGACAAAGAGGGCATCCCCCCAGACCAGCAGCGTCTCATCTTCGCCGGCAAGCAGCTGGAGGATGGCAGG
ACCCTTGCTGACTACAACATCCAGAAGGAGTCCACCCTCCACCTTGTCCTCCGCCTCCGTGGTGGCATGCAGATC
TTTGTCAAGACACTGACCGGCAAGACCATCACCCTCGAGGTGGAATCTTCTGACACCATCGACAACGTCAAGGCC
AAGATCCAGGACAAGGAGGGCATTCCCCGGACCAGCAGCGTCTCATCTTTGCCGGCAAGCAGCTTGAGGACGGC
AGGACCCTTGCTGACTACAACATCCAGAAGGAGTCAACGCTTCACCTTGTCCTCCGTCTCAGGGGAGGCATGCAA
ATCTTCGTGAAGACTCTGACCGGCAAGACCATCACCCTCGAGGTGGAGTCTTCTGATACCATCGACAATGTCAAG
GCCAAGATCCAGGACAAGGAGGGCATTCCCCCGGACCAGCAGCGCCTCATCTTTGCTGGCAAGCAGCTGGAGGAT
GGCAGGACCCTTGCTGACTACAACATCCAGAAGGAGTCCACCCTCCACCTTGTGCTCCGCCTTCGTGGTGGTATG
CAGATCTTTGTCAAGACCCTCACAGGC

> SEQ ID NO:1829 215280 135385_300413_1b
GGGAAGCGAAGCTTTGCGTTCTCTAATCGCCTCGTCAAGATGCAGATATTCATTAAGACCCTCACTGGCAAGACC
ATCACCTTGGAGGTTGAGTCCTCCGATACGATTGACAATGTGAAGGCTAAGATTCAGGACAAGGAGGGCATCCCT
CCGGACCAGCAACGCCTTATCTTCGCTGGCAAGCAGCTTGAGGATGGGCGTACTCTCGCGGATTATAACATCCAG
AAGGAGTCCACCTTGCACCTTGTCCTCCGCCTTCGTGGAGGCATGCAAATATTCGTGAAGACCCTCACCGGCAAG
ACCATTACCCTGGAGGTCGAGTCCTCCGACACGATCGATAATGTGAAGGCCAAGATCCAGGACAAGGAGGGAATC
CCACCAGACCAGCAGCGTCTCATCTTTGCTGGGAAGCAGCTCGAGGATGGCCGCACCCTTGCAGACTACAACATC
CAAAAGGAATCCACCCTGCACCTTGTCCTGCGCCTCCGGGGCGGTATGCAGATCTTTGTGAAGACCCTTACTGGC
AAGACGATCACCTTGGAGGTTGAGTCCTCTGACACGATCGACA

> SEQ ID NO:1830 215280 135205_300412_1b
CCCAGACCAGCAAAGGCTGATTTTCGCAGGGAAGCAACTGGAAGATGGACGTACATTAGCTGATTACAACATTCA
GAAAGAGTCAACGCTCCATTTGGTCCTGAGGCTCAGGGGTGGAACCATGATCAAGGTGAAGACACTCACTGGGAA
GGAAATCGAGATCGACATCGAGCCCACTGATACCATTGATAGAATCAAGGAGCGTGTTGAGGAGAAAGAGGGTAT
TCCACCTGTTCAGCAGAGGCTCATTTATGCTGGGAAGCAACTTGCTGATGATAAAACTGCCAAGGATTACAACAT
TGAAGGTGGCTCAGTGCTCCATCTCGTGCTTGCTCTGAGGGGTGGTCAGTAGATGTAGTTTCCATGCCCGCATTA
TCTCTAAAGGGAGAAGCATATTTGCTATTCCATTTCTATCTGTAGTTGCTGCAGACTTATAGCTATATTTGGTAG
GATTATTGAAGTACTATGCGATTGGCGCATTGTGTATTGGAATCAATTGTCATCTGTACTGGAAAGGAAATATTG
GAACTAAGTTAAGCAGTAGTTTATCAATTGCC

> SEQ ID NO:1831 215280 11857_300290_1b
TGGTATCAACGCAGAGGGGCCATTACGGCGGGGCCAGCAAAGGTTGATTTTTGCTGGTAAGCAATTGGAAGATGG
CCGTACCCTAGCTGATTACAACATTCAAAAGGAGTCGACTTTGCACCTTGTGCTCCGTCTTCGTGGTGGGATGCA
GATTTTCGTGAAGACATTGACCGGGAAAACCATCACTCTTGAGGTGGAAAGCTCTGACACTATTGACAACGTTAA
GGCCAAAATCCAGGATAAGGAGGGAATCCCACCAGACCAGCAGAGATTGATTTTT

> SEQ ID NO:1832 215280 204284_300791_1b
ATACAAACACTTCTCACATCTCTTCCACCCTAAGGAATATCCGTTAACAGCGCATCTTCTTGCACTCTCTACGAA
TCTCCCAGCGGCCAACGCTTAATCCGCCACCATGCAAATCTTCGTCAAGACCCTCACCGGCAAGACCATCACCCT
CGAGGTCGAGTCTTCCGATACCATCGACAATGTGAAGTCCAAGATCCAGGATAAGGAAGGCATTCCTCCTGACCA
GCAGCGTCTGATTTTCGCTGGCAAGCAACTCGAGGATGGCCGAACTCTGTCCGACTACAACATCCAGAAGGAGTC
CACCCTCCACCTGGTCCTCCGCCTTCGTGGTGGTATGCAGATCTTCGTCAAGACCCTCACTGGAAAGACCATCAC
CCTCGAGGTGGAGTCATCTGATACCATCGACAACGTCAAGTCCAAGATCCAGGACAAGGAGGGTATCCCTCCTGA
CCAGCAGCGACTGATCTTCGCTGGTAAGCAGCTTGAGGATGGCCGAACCCTCTCCGACTACAACATCCAGAAGGA
GTCCACTCTCCACCTTGTCCTTCGTCTCCGTGGTGGTATGCAGATCTTCGTCAAGACGTTGACCGGCAAGACCAT
CACATTGGAGGTTGAATCATCAGACACCATCGACAATGTCAAATCAAAGATTCAGGACAAGGAGGGTATTCCCCC
GGATCAGCAGCGTCTTATCTTTGCTGGCAAGCAGCTTGAGGACGGTCGCACCTTGAGCGACTACAACATTCAGAA
GGAGAGCACACTTCACCTTGTCCTCCGTCTTCGTGGTGGTATGCAGATTTTCGTCAAGACTCTGACCGGCAAGAC

Figure 2 continued

AATCACCCTCGAGGTGGAATCTTCCGACACCATCGACAACGTTAAGTCCAAGATTCAGGACAAGGAGGGCATTCC
TCCTGACCAGCAGCGCTTGATCTTTGCTGGTAAGCAGCTGGAAGACGGTCGCACCTTGAGCGACTACAACATCCA
GAAGGAGAGCACACTGCACTTGGTCCTGCGTCTGCGTGGTGGCCAGTAAATGTGTCTTTTGCTTACGACCGCACT
GTTACGACTGAATTGGACGGTTGGGCGTTTTTGGGAACTTTTTTTCAAAGCAGATATGGGAAC

> SEQ ID NO:1833   215280   20058_300163_1b
ACGAAAATCTCAACTTTTCTCTTTACTTCAAACGCCTCTCAAGATGCAGATCTTCGTCAAAACCCTTACCGGAAA
GACGATAACCCTTGAGGTTGAAAGCTCCGACACAATTGACAACGTTAAGGCTAAGATTCAGGACAAAGAAGGAAT
CCCACCGGACCAGCAAAGGTTGATCTTCGCCGGAAAGCAGCTCGAAGACGGCAGAACCCTAGCTGATTACAACAT
CCAAAAGGAATCCACCCTTCACTTGGTGCTCCGTCTTCGTGGCGGTATGCAAATCTTTGTTAAAACCCTAACCGG
GAAAACAATAACCCTTGAAGTCGAAAGCTCTGACACAATTGACAATGTCAAGGCGAAGATTCAGGACAAGGAGGG
AATCCCTCCAGACCAGCAAAGGTTGATTTTTGCCGGAAAGCAACTCGAAGACGGCAGAACCCTAGCTGATTACAA
CATCCAGAAGGAATCGACCCTTCACTTGGTCCTTCGTCTTCGTGGTGGGATGCAGATCTTCGTCAAAACCTTAAC
TGGGAAAACAATCACCCTTGAAGTCGAAAGCTCCGACACCATTGACAATGTCAAGGGTAAAATCCAGGATAAGGA
GGGAATCCCACCAGACCAGCAAAGGTTGATTTTTGCTGGTAAGCAATTGGAAGATGGCCGTACCCTAGCTGATTA
CAACATTCAAAAGGAGTCGACTTTGCACCTTGTGCTCCGTCTTCGTGGTGGGATGCAGATTTTCGTGAAGACATT
GACCGGGAAAACCATCACTCTTGAGGTGGAAAGCTCTGACACTATTGACAACGTTAAGGCCAAAATCCAGGATAA
GGAGGGAATCCCACCAGACCAGCAGAGATTGATTTTTGCTGGTAAGCAGCTGGAGGATGGCCGAACCCTCGCTGA
TTACAACATTCAGAAGGAGTCTACCCTTCACTTGGTTCTCCGTCTCCGCGGTGGGATGCAGATCTTCGTCAAAAC
ACTCACTGGGAAGACAATCACCCTCGAAGTTGAAAGCTCCGATACTATCGACAATGTTAAGGCTAAGATTCAGGA
CAAGGAAGGTATTCCACCGGACCAGCAGAGATTGATTTTTGCTGGTAAGCAGTTGGAAGATGGGAGAACTTTAGC
TGATTATAATATCCAGAAGGAATCCACACTGCATTTGGTGCTCCGTCTTCGTGGTGGGATGCAGATTTTTGTGAA
GACGTTGACCGGGAAAACCATCACTTTGGAGGTAGAGAGTTCTGATACGATCGACAATGTGAAGGCTAAGATTCA
GGACAAGGAGGGTATCCCGCCAGATCAGCAGAGGCTGATTTTTGCTGGGAAGCAGTTGGAAGATGGAAGGACTCT
GGCTGATTATAATATTCAGAAGGAGTCGACTCTGCACCTTGTCCTCCGTCTCCGTGGTGGTTTCTAAAGTGTCCG
TCAATAGTGGTGGTAATGTCTGTGTCTTGGGTCTTGGGTCTGTTCGGTGTTTGTTTGATTCATGATTTAGTAGTT
TGTGTAGTTTTTGTTAGTTGTCATCATGTTATGCCTTCAAAAGAAGGAAGGAGACTTGTCCTCTTTGTCTCTGTT
TGCGAATAATAAAGTTCGAATTATGGTTT

> SEQ ID NO:1834   215280   194050_300743_1b
GCCGCCGCAGCAGCAAGGAGCTAGAGAGACAAAGGGGAGAGAGCCCCGGGGAAGAAGAAGAAGCAGCAGCTAGGG
CGCCAAGATGCAAATCTTCGTGAAGACCCTGACTGGGAAGACCATCACCCTCGAGGTGGAGAGCAGCGACACCAT
CGACAATGTCAAGGCTAAGATCCAGGACAAGGAGGGAATCCCGCCGGACCAGCAGCGGCTGATCTTCGCCGGGAA
GCAGCTGGAGGACGGACGCACCCTGGCTGACTACAACATCCAGAAGGAGTCCACCCTCGTCCTCCAGGCT
CCGTGGCGGTATCATCGAGCCGTCGCTTCAGGCGCTTGCCCGCAAGTACAACCAGGACAAGATGATCTGCCGCAA
ATGCTATGCGCGCCTGCACCCTAGGGCTGTCAACTGCCGCAAGAAGAAGTGTGGTCACAGCAACCAGCTGAGGCC
CAAGAAGAAGATCAAGAACTAGAGCGTCACTCGCCGGGTTCATGGACTGGTTAAATCAATCGTCATATTAGACTT
TTATGCTTCCGTTGTTATCTCCCTGGATGTTGTTGAACCGTGTTTTACTGTGCTGGATGCTTCAGCTTCTTGTTT
TGACGGTCGTGGTATATGGTAATTGGCAGCAAACTATATTGGTCATGTCGAAATTGTC

> SEQ ID NO:1835   215280   1832_300334_1b
TTTTCTCTCTTTATTCAAACGCCTCTCAAGATGCAGATCTTCGTCAAAACCCTAACTGGAAAGACGATAACCCTT
GAGGTTGAAAGCTCCGACACAATTGACAACGTTAAGGCGAAGATTCAGGACAAGGAAGGAATTCCACCGGATCAG
CAGAGGCTGATCTTCGCCGGAAAGCAGCTCGAAGACGGCAGAACCCTAGCCGACTACAACATCCAGAAGGAATCG
ACTCTTCACTTGGTGCTCCGTCTTCGTGGCGGTATGCAAATCTTCGTCAAAACCCTAACAGGGAAAACAATCACC
CTTGAAGTTGAAAGCTCCGACACTATTGATAACGTTAAGGCGAAAATCCAGGATAAAGAGGGAATCCCACCAGAT
CAGCAGAGGTTGATCTTTGCTGGCAAACAG

> SEQ ID NO:1836   215280   183163_300619_1b
CTTGAGGTCGAGTCCTCGGACACGATCGAGAATGTGAAGGCCAAGATCCAGGACAAGGAGGGCATCCCCCCGGAC
CAGCAGCGTCTCATCTTCGCTGGCAAGCAGCTGGAGGACGGCCGCACCCTTGCCGACTACAACATCCAGAAGGAG
TCCACCCTCCACCTTGTGCTCAGGCTCAGGGGTGGTATGCAGATCTTCGTCAAGACCCTGACCGGCAAGACCATC
ACGCTTGAGGTCGAGTCCTCGGACACGATCGACAACGTGAAGGCCAAGATCCAGGACAAGGAGGGTATCCCCCCG
GACCAGCAGCGCCTCATCTTCGCCGGCAAGCAGCTGGAGGATGGCCGCACCTTGGCTGACTACAACATCCAGAAG
GAGTCCACCCTTCACCTGGTTCTCAGGCTCAGGGGTGGATGCAGATCTTCGTGAAGACCCTGACTGGCAAGACC
ATTACCCTTGAGGTTGAGTCGTCCGACACTATTGACAACGTGAAGGCGAAGATCCAGGACAAGGAGGGCATCCCC
CCGGACCAGCAGCGTCTGATCTTTGCTGGTAAGCAGCTTGAGGATGGCCGCACCCTGGCCGACTACAACATCCAG
AAGGAGTCCACCCTCCACCTTGTGCTCAGGCTCAGGGGAGGCATGCAGATCTTCGTCAAGACCTTGACTGGCAAG
ACCATCACCCTTGAGGTCGAGTCGTCTGACACCATTGACAATGTCAAGGCCAAGATCCAGGACAAGGAGGGCATC

Figure 2 continued

```
CCCCCGGACCAGCAGCGTCTCATCTTCGCTGGCAAGCAGCTTGAGGATGGCCGCACCCTGGCCGACTACAACATC
CAGAAGGAGTCTACCCTCCACCTTGTGCTCAGGCTCAGGGGAGGCATGCAGATCTTCGTCAAGACCTTGACTGGC
AAGACCATCACCCTTGAGGTCGAGTCGTCTGACACCATTGACAATGTCAAGGCCAAGATCCAGGACAAGGAGGGC
ATCCCCCCAGACCAGCAGCGTCTCATCTTCGCCGGCAAGCAGCTGGAGGATGGCCGCACCCTTGGTGACTACAAC
ATCCAGAAGGAGTCCACCCTCCACCTTGTGCTCAGGCTCAGGGGAGGTATGCAGATCTTCGTCAAGAGCCTGACC
GGCAAGACCATCACCCTCGAGGTCGAGTCCTCGGACACGATCGACAACGTGAAGGGCAAGATCCAGGACAAGGAG
GGCATCCCCCCGGACCAGCAGCGTCTCATCTTCGCCGGCAAGCAGCTGGAGGACGGCCGCACCCTTGGCGACTAC
AACATCCAGAAGGAATCCACCCTCCACCTTGTGCTTAGGCTCAGGGGAGGTATGCAGATCTTCGTCAAGACCCTG
ACTGGCAAGACCATCACACTTGAGGTCGAGTCCTCGGACA
```

> SEQ ID NO:1837 215280 183090_300665_1b
```
GAATTCAGATTCTCTTTTTGCGATCTAAAGGATCTTCTTCAATTCTCCTTCAAGATGCAGATCTTTGTGAAAACT
CTTACTGGTAAGACCATCACCCTTGAGGTCGAGAGCTCAGACACAATTGACAACGTTAAGGCTAAGATTCAAGAC
AAGGAAGGAATTCCTCCAGACCAACAACGTTTGATCTTCGCCGGAAAGCAGTTGGAAGATGGAAGAACTTTAGCT
GACTACAACATCCAGAAGGAATCAACTCTCCATCTTGTCCTTCGTCTTAGAGGTGGTATGCAAATCTTTGTCAAA
ACCTTGACTGGTAAGACCATCACTTTGGAAGTCGAGAGCTCTGACACCATTGATAACGTTAAGGCTAAGATTCAA
GATAAGGAAGGAATTCCTCCAGACCAGCAACGTTTGATCTTCGCCGGAAAGCAGTTGGAAGATGGTCGTACTCTT
GCCGACTACAACATCCAGAAGGAGTCTACTCTCCATTTGGTTCTTCGTCTCAGAGGTGGTATGCAGATTTTCGTC
AAGACCCTTACTGGAAAGACCATCACCTTGGAGGTTGAGAGTTCCGACACCATCGATAATGTCAAGGCTAAGATT
CAAGATAAGGAGGGTATCCCCCCAGACCAGCAACGTTTGATCTTCGCCGGAAAGCAGCTGGAAGATGGTCGCACT
CTTGCCGACTACAACATTCAGAAGGAGTCTACCCTCCATTTGGTGCTTCGTCTTAGAGGTGGTATGCAAATCTTC
GTGAAGACCTTGACCGGAAAGACCATCACTCT
```

> SEQ ID NO:1838 215280 175812_300522_1b
```
CCCGGACCTTGCTCCACACCCGCAGCAGCAGCAGCAGCAAGGGGAAGAAGAAGAGCCAAGATGCAGATCTTCGTG
AAGACCCTAACGGGGAAGACCATCACGCTCGAGGTCGAGAGCAGCGACACCATCGACAATGTCAAGGCCAAGATC
CAGGACAAGGAAGGCATCCCTCCGGACCAGCAGCGCCTCATCTTCGCCGGCAAGCAGCTGGAGGATGGCCGCACC
CTGGCCGACTACAACATCCAGAAGGAGTCCACGCTCCACCTCGTCCTCCGCCTCCGCGGTGGCATCATCGAGCCC
TCCCTCCAGGCCCTCGCCCGCAAGTACAATCAGGACAAGATGATCTGCCGCAAGTGCTATGCTCGGCTGCACCCC
AGGGCTGTCAACTGCCGCAAGAAGAAGTGCGGCCACAGCAACCAGCTGAGGCCCAAGAAGAAGATCAAGAACTAG
AGTTTGAGATATCATTTCCGCGGATCATTGAAATCAACAGGAAGATCAGAGTTTAAGTTTTTTTGTAGTGTAATG
CCTCATGTTGTATGCCGAACTTTCTGTTTATCCTGTTGTATGTTAACCTTGGTTACGCTGGAGAGTACTCCAGCT
TATT
```

> SEQ ID NO:1839 215280 175171_300530_1b
```
CCCAAAATCGCAGAGAAGAAAAAATCTCCCCTCGAAGCGAAGCGTCGAATCGCCTTCTCAAGATGCAGATCTTTG
TGAAGACCCTCACCGGCAAGACCATCACCCTCGAGGTTGAGTCCTCGGACACCATTGACAATGTCAAGGCCAAGA
TCCAGGACAAGGAGGGCATCCCTCCGGACCAGCAGCGTCTCATCTTCGCTGGCAAGCAGCTTGAGGATGGCCGCA
CCCTGGCCGACTACAACATCCAGAAGGAGTCCACCCTCCACCTTGTGCTCAGGCTCAGGGGAGGCATGCAGATCT
TCGTCAAGACCTTGACTGGCAAGACCATCACCCTTGAGGTCGAGTCGTCTGACACCATTGACAATGTCAAGGCCA
AGATCCAGGACAAGGAGGGCATCCCCCCAGACCAGCAGCGTCTCATCTTCGCCGGCAAGCAGCGGGAGGATGGCC
GCACCCTTGCTGACTACAACATCCAGAAGGAGTCCACCCTCCACCTTGTGCTCAGGCTCAGGGGAGGTATGCAGA
TCTTCGTCAAGACCCTGACCGGCAAGACCATCACCCTCGAGGTCGAGTCCTCGGACACGATCGACAACGTGAAGG
CCAAGATCCAGGACAAGGAGGGCATCCCCCCGGACCAGCAGCGTCTCATCTTTGCTGGCAAGCAGCTGGAGGATG
GCCGCACCCTTGCCGACTACAACATCCAGAAGGAGTCCACCCTCCACCTTGTGCTCAGGCTCAGGGGTGGTATGC
AGATCTTCGTCAAGACCCTGACCGGCAAGACCATCACGCTTGAGGTCGAGTCCTCGGACACGATCGACAATGTGA
AGGCCAAGATCCAGGACAAGGAGGGTATCCCCCCGGACCAGCAGCGTCTCATCTTCGCCGGCAAGCAGCTGGAGG
ATGGCCGCACCTTGGCTGACTACAACATCCAGAAGGAGTCCACCCTTCACCTGGTTCTCAGGCTCAGGGGTGGGA
TGCAGATCTTCGTGAAGACCCTGACTGGCAAGACCATTACCCTTGAGGTTGAGTCGTCCGACACTATTGACAACG
TGAAGGCGAAGATCCAGGACAAGGAGGGCATCCCCCCGGACCAGCAGCGTCTGATCTTTGCTGGTAAGCAGCTTG
AGGATGGCCGCACCCTTGCGGATTACAACATCCAGAAGGAGTCCACACTCCACCTGGTGCTCCGCCTCCGTGGTG
GCCAGTAAGTCCTCAGCCATGGAGCTGCTGCTGTTCTAGGGTTCACAAGTCTGCCTATTGTCTTCCCCAATGGAG
CTATGGTTGTCTGGTCTGGTCCTTGGTCGTGTCCCGTTTCATTGTGTACTATTTACCTGTAATGTGTATCCTTAA
GTCTGGTTTGATGGTGTCTGAAACGTTTTGCTGTGGTAGAGCAGCATGGAAGAACTATAATGAATAAGTGATCCC
TAATCATTGTGTCC
```

> SEQ ID NO:1840 215280 167370_300546_1b
```
GAATTCATAATCGATCAGATTCTTCTAGGCAGTCTTATTCGGCGATCTAACCTAAATTTCTTCGACACCTCTCTG
AAGATGCAGATTTTTGTGAAAACCCTCACTGGCAAGACCATCACACTTGAGGTTGAGAGCTCAGACACAATTGAC
```

Figure 2 continued

AACGTGAAAGCTAAGATTCAAGATAAGGAAGGAATTCCCCGGATCAGCAGAGGTTGATCTTTGCTGGCAAACAG
TTGGAAGATGGAAGAACTCTAGCTGACTACAACATCCAGAAAGAATCCACTCTCCATCTCGTCCTCCGTCTCAGA
GGTGGTATGCAAATATTTGTGAAAACCCTCACTGGCAAGACCATTACTTTGGAAGTGGAGA GTTCTGATACCATC
GACAATGTCAAGGCCAAGATCCAAGATAAGGAAGGTATTCCTCCAGACCAGCAGAGGTTGATTTTTGCTGGGAAG
CAGTTGGAAGATGGGCGTACCCTTGCTGACTACAACATCCAGAAGGAATCCACCCTTCACCTGGTTCTACGACTA
AGAGGTGGTATTGCAGATCTTTGTGAAAACGCTTACTGGAAAGACCATCACCTTAGAAGTTGAGAGTTCAGATAC
CATTGACAATGTAAAAGCCAAAATTCAGGACAAGGAAGGTATTCCTCCAGACCAGCAACGTTTGA

> SEQ ID NO:1841 215280 155867_301360_1b
TTCGTCAAACCCTCACCGGCAAGACCATCACCCTGGAGGTTGAAAGCTCCGACACCATTGACAATGTCAAGGCCA
AGATCCAGGACAAGGAGGGGATTCCCCAGACCAGCAGAGGTTGATCTTTGCAGGTAAGCAGTTGGAAGATGGTC
GCACCCTTGCGGACTACAACATTCAGAAGGAGTCCACCCTGCACTTGGTGCTGAGGCTGAGGGGAGGAATGCAGA
TCTTCGTGAAGACATTGACCGGGAAGACCATCACCTTGGAGGTGGAGAGCTCTGACACCATCGACAATGTAAAAG
CTAAGATCCAGGACAAGGAGGGTATCCCACCCGACCAGCAGAGGTTGATCTTTGCTGGGAAGCAGCTCGAGGATG
GAAGGACCTTGGCTGACTACAATATCCAGAAAGAGTCAACCCTTCACCTTGTCCTCCGTCTCCGTGGTGGTTTCT
AGGTTGTCTGTTGTTGATGACGTGGTGTCCTGTTAATTGGCTGTGTTGTCTGTTTCTAGTTGTGGTCATGATGTG
CTTTGTTTGCTGAGGTCTCAATGATGTTCCATTCTGTTTCTGTTCGCTGTTTCTTTTATGTTCTCTGTTGTGAAT
AAAGATTCCGATTTCTGT

> SEQ ID NO:1842 215280 14555_300243_1b
CCCACGCGTCCGCTCAAAAATCTTAAAAACTTTCTCTCAATTCTCTCTACCGTGATCAAGATGCAGATCTTTGTTA
AGACTCTCACCGGAAAGACAATCACCCTCGAGGTGGAAAGCTCCGACACCATCGACAACGTTAAGGCCAAGATCC
AGGATAAGGAGGGCATTCCTCCGGATCAGCAGAGGCTTATTTTCGCCGGCAAGCAGCTAGAGGATGGCCGTACGT
TGGCTGATTACAATATCCAGAAGGAATCCACCCTCCACTTGGTCCTCAGGCTCC

> SEQ ID NO:1843 215280 113036_300021_1b
ATTCTCATTATCTCCTCAACTTTTCTCTCTTTATTCAAACGCCTCTCAAGATGCAGATCTTCGTCAAAACCCTAA
CTGGAAAGACGATAACCCTTGAGGTTGAAAGCTCCGACACAATTGACAACGTTAAGGCGAAGATTCAGGACAAGG
AAGGAATTCCACCGGATCAGCAGAGGCTGATCTTCGCCGGAAAGCAGCTCGAAGACGGCAGAACCCTAGCCGACT
ACAACATCCAGAAGGAATCGACTCTTCACTTGGTGCTCCGTCTTCGTGGCGGTATGCAAATCTTCGTCAAAACCC
TAACAGGGAAAACAATCACCCTTGAAGTTGAAAGCTCCGACACTATTGATAACGTTAAGGCGAAAATCCAGGATA
AGAGGGAATCCCACCAGATCAGCAGAGGTTGATCTTTGCTGGCAAACAGTTGGAAGACGGCAGAACCCTAGCCG
ACTACAACATTCAGAAGGAATCAACTCTTCACTTGGTACTCCGTCTTAGAGGAGGCATGCAAATCTTCGTCAAAA
CCCTAACCGGGAAAACAATCACCCTTGAAGTCGAAAGCTTTGACACAATTGACAATGTCAAGGCGAAGATTCAGG
ACAAGGAAGGAATCCCACCAGATCAGCAGAGGTTGATCTTTGCGGGTAAGCAATTGGAAGATGGAAGGACCTTAG
CTGATTACAATATTCAGAAGGAGTCCACCCTCCATTTGGTGCTCCGTCTTCGTGGTGGAATGCAGATTTTTGTGA
AGACTTTGACCGGGAAAACAATCACTCTTGAAGTTGAAAGCTCAGATACTATTGACAACGTTAAGGCCAAGATCC
AGGATAAGGAGGGTATCCCACCAGATCAGCAAAGGCTGATCTTTGCTGGCAAGCAGTTGGAAGATGGTCGTACTC
TTGCTGATTACAACATTCAGAAGGAGTCGACTTTGCACCTTGTCCTCCGTCTCCGTGGTGGTTTCTAAAGTGTCC
GTCAGTGGTGGTGGTGATGTCTGTGTCTGTGTCTTGGGTCTTTGGTCTGTTTGGTGTTTGTTTGATTCATGATTT
AGTACTTTGTGTAGTTTCTGTTAGTTGTTATCATGTTATCTTTCCAATAGAGGCGAGGAGTCTTGTTTTCTTCTG
TCTCTGTTTGTGAATAATAAAGTCGAATTATTG

> SEQ ID NO:1844 215280 1119818_301901_1b
GGGCAGGTAGAGGTGGAGGCAAGCGGGGGAAGATGCAGATATTTGTGAAGACCCTGACGGGGAAGACCATCACCC
TCGAGGTCGAGAGCAGTGACACCATCGATAATGTCAAAGCAAAGATCCAAGACAAGGAAGGAATTCCACCGGATC
AGCAGAGGCTTATTTTTGCTGGGAAACAACTGGAGGATGGTCGCACATTGGCTGACTACAATATCCAGAAAGAGT
CTACTTTGCACCTTGTTTTGAGGCTTCGAGGTGGTATCATAGAGCCTTCGCTGATGGCGCTCGCCAGGAAGTATA
ATCAAGAGAAGATGATATGTCGCAAGTGCTATGCTCGTCTTCATCCTCGCGCTGTGAACTGCAGAAAAAGAAAT
GTGGGCACAGCAATCAGCTTCGACCAAAGAAGAAGATCAAGTAGGTTGTTCGGTTGCAGCCTCTCCAGATATTCA
GAATCTTGTTTTTTTGCTGATTTGAGGAAAAGTTGTTTGAGTGCCATTTACCATGTTTTGGTGCAAGTGGCACTC
TTATTATGTTAATCTCTGCGAAGTAATTACTGACGATGAGTCGTTTGCATTTGAATTTTCGGAACAAAAGGAATT
TGAATTGCATTTTAGCTTTCAG

> SEQ ID NO:1845 215280 111917_300050_1b
CCCACGCGTCCGGGGTAAACTGAAGAGTGCGCCGCAAAATGCAGATCTTCGTGAAAACCCTAACCGGGAAGACAA
TCACGCTCGAGGTTGAATCGAGCGACACCATTGATAATGTCAAGGCTAAGATTCAAGACAAAGAAGGTATTCCAC
CGGACCAGCAGCGGTTGATATTCGCCGGAAAGCAGCTCGAAGATGGACGTACTCTTGCTGATTATAACATCCAGA
AGAGTCAACTTTGCATTTGGTTTTGAGGCTTCGTGGAGGGATTATTGAGCCTTCTCTGATGGCTTTGGCTAGGA

Figure 2 continued

AGTACAACCAGGATAAGATGATTTGTCGCAAGTGCTATGCTCGCCTGCATCCTCGTGCTGTTAACTGCAGGAAGA
AAAAATGTGGGCACAGCAACCAGCTGAGGCCAAAGAAGAAGATCAAGTAGACGTGATGTCTTTTCTAAGCTTAGA
TCAATTTTGCGCGTTGCAGCTATATATTGCCAGTCCGTTGTTTTTACAGTTTTCAGTCCTGCTTCAATTTGATGT
CATGGATAACAAACATGTCTTAAACATCTAATTATTGGATAAGATATCTTTGTGCACTCAATATATGTCT

> SEQ ID NO:1846 215280 1113240_301796_1b
GGCAGAGAGAGGAGAGGGAGAGAGAGATGCAGATCTTCGTGAAAACCCTAACAGGGAAGACCATCACTCTCGAAG
TCGAGAGCAGTGATACCATCGACAATGTCAAAGCCAAGATCCAGGACAAAGAAGGGATACCACCAGATCAGGAGA
GGCTGATATTTGGTGGCAAGCAGCTTGAAGATGGGCGCACACTGGCTGATTACAACATCCAAAAGGAGTCCACAC
TGGATCTGGTGCTGAAGTTGCGTGGAGGGACCATGATCAAGGTTAAGACCCTCAATGGGAAGGAAATT

> SEQ ID NO:1847 215280 111165_300052_1b
TCATCGCCTTCAAATTTCTCTCTCAAGGTTTGAGAAAATTTCCTCAATTTCTCGCTTTAGGAGTTCTTTTTTATT
GAATCACCGATTTGGGTGTGTCAAGCCCTAATTTTGAAGTTCATTTTTTCAATTGTTTGTTGTTGATTTTATGTT
ATAACAGATGCAGATCTTCGTAAAAACCCTAACCGGTAAGACCATCACTCTCGAGGTTGAGAGTTCCGACACAAT
CGACAACGTAAAAGCCAAAATCCAGGATAAGGAAGGAATTCCCCCAGATCAGCAAAGGCTTATCTTCGCCGGCAA
GCAGCTTGAGGACGGCCGTACCCTAGCCGATTACAACATCCAGAAGGAATCTACTCTTCACTTGGTCCTCCGTCT
GCGTGGTGGGATGCAGATTTTCGTCAAAACCCTCACTGGCAAAACAATCACCCTTGAGGTGGAAAGTTCTGACAC
CATCGACAATGTCAAGGCTAAAATTCAGGATAAGGAGGGAATTCCACCAGACCAGCAGAGGTTGATCTTCGCTGG
CAAGCAGCTTGAGGATGGTCGTACCCTTGCCGATTACAACATCCAGAAGGAGTCTACCCTTCACCTTGTCCTCCG
TCTCCGTGGTGGTATGCAGATCTTTGTCAAAACGCTCACCGGCAAAACCATCACCCTTGAGGTCGAGAGTTCCGA
CACCATCGACAATGTCAAGGCCAAAATTCAGGACAAGGAGGGCATTCCCCCAGACCAGCAGAGGTTGATTTTCGC
TGGCAAGCAGCTCGAGGATGGCCGTACACTAGCTGATTATAACATCCAGAAGGAATCCACCCTTCACCTTGTCCT
CCGTCTCCGTGGTGGTATGCAGATCTTCGTCAAAACACTCACCGGCAAGACCATCACCCTGGAGGTTGAAAGCTC
TGACACCATTGACAATGTTAAGGCCAAGATCCAGGACAAAGAGGGGATTCCCCCAGATCAGCAGAGGTTGATCTT
CGCAGGAAAGCAGTTGGAAGATGGTCGCACCCTTGCGGACTACAACATTCAGAAGGAGTCTACTCTGCACTTGGT
GCTAAGGCTGAGGGGAGGAATGCAGATCTTCGTGAAGACATTGACCGGGAAGACCATCACCTTGGAGGTGGAAAG
CTCTGACACCATCGACAATGTCAAAGCTAAGATCCAGGACAAGGAGGGTATCCCACCGGACCAGCAGAGGTTGAT
CTTTGCTGGTAAGCAGCTTGAGGATGGAAGGACCCTGGCCGACTACAATATCCAGAAAGAGTCAACCCTTCACCT
TGTCCTCCGTCTCCGTGGTGGTTTCTAGGTTGCCTGTTGTTGATGTTGTTGTGTCGTGTTGATTGGCTGTGTCTT
GTTGTGGTCATGATGTGTTTTGTCTACTAAGGTCCCAAAGATGTTCAATTCTGTTTCTGTTCGCCGTTTCTTTCA
TATTTTCTGTTGTGAATAAAGACACCAGATTCTGTCCTAGTGCTTAGGTTTTGTGCTCTCTGTTGGCAGTAAATG
AACTTTCCTTTGTTTTATCCATT

> SEQ ID NO:1848 215280 104285_300060_1b
ATTCTTCTCTCCCTTTGCGAAACAAGCTAACTTTCTCCCGAGTCTTTTTCTTCTTCCTCTCAAGATGCAGATCTT
TGTAAAGACACTCACTGGGAAAACCATTACTCTTGAGGTTGAGAGTTCAGACACAATTGATAACGTGAAGGCCAA
AATTCAAGACAAGGAAGGGATTCCCCCAGACCAGCAGAGGCTGATATTTGCTGGAAAGCAGCTTGAAGATGGCCG
AACTCTTGCTGATTACAATATTCAAAAGGAGTCTACCCTCCACCTTGTCCTCCGTCTACGTGGTGGTATGCAGAT
TTTTGTTAAAACTCTTACTGGCAAAACCATTACTCTTGAGGTCGAGAGTTCAGACACCATTGACAATGTTAAGGC
CAAGATTCAAGATAAGGAAGGCATTCCACCTGATCAGCAAAGGCTGATCTTTGCTGGAAAGCAACTTGAGGATGG
AAGGTCCCTCGCGGATTACAACATTCAAAAGGAGTCGACCCTACATCTTGTCCTCCGTCTACGTGGTGGCATGCA
GATTTTTGTTAAAACTTTAACGGGCAAGACGATCACTCTTGAAGTTGAGAGCTCAGATACCATTGACAATGTAAA
GGCAAAGATCCAGGACAAGGAGGGTATTCCTCCAGACCAGCA

> SEQ ID NO:1849 215290 221291_300969_1b
GGCCAAGATGTCACTGCATGGGGGTTTCGTTAATGAAGCTGTTCAGGGCATGATATGGTGCATGAGGATGCACGA
GTGGATACTAACATATGACAGTTGATGCTCTTTTTATAGAGCATCCGTTTGGATATAAAAGCATCGAGTGTCGCC
AACATTTGATCTTGTTCCATCCATCAATCGCATCAACCACTCTCAAGCAACAATAACAACCTTTACCCAACTTC
AAAGACTTTCAGTCTCTCAACTCAACACCTTCAAGATGTCTCCCTGGTGAGTCTTCTGAGGACCATTGGTCCATC
ACTTGCTCGGGAGTTCCTCTTTGCTTTACCTTCAGCGTTCCACTACCTGATCTATGATACCTTCTTTCCCACCAC
CGAGCAAAGCACTCATTAGACATGTCACTAACGATTTTCTTTCAATAGCGCATGCAACTCCTGTGGATGCAAGGA
CAACTGCTCCAGCTGCTCCTGCACCAGCTGCAGCGTAAGTCCTGCTTCTCTCCCTGCTTTGGGCATTGAGAAAC
TTTTCCACCAGAAAGCTAACAGATGGGAACATATAGCACTAAATCATCGTGCTCTTTTTCCTTCGCTGGATCTAT
ACTCTCTCGGAATGACAGCTTGAGGGCTCGGATGTGCTTAAGACGCCATGGGAAGGGCAAGGCATTTGGGCGAAT
AGACCTCCATCATGTGGGATATAGCAGAATAGGAATTTGAAGATTTTGCCCTAACACACATATAATTTGCTTGTG
AAG

> SEQ ID NO:1850 215316 199522_300750_1b

Figure 2 continued

GTGCAGCTGATAAATTCCATCGATTGGTTTCTTTGGGAGCATTAATCGACCTTTCTCATTCTTCATACCATCGGC
GTCGTTGGCATTTATACGGCATCTCGTCTTGTTTCCTTCGTACTCGAGGTACGGTACCCTGACCGCGTCGTCATA
CGAATTTGCAGCATCGGCGAATTGACAGTATAAGGCAGACATCATGGCTGGGTGGCAGTCCTGGAACCCCTTCAG
TAAGAGGGAGACGCACAGCAATGGCTCCATCGTCGCATACAAGATTTTAACCTTGCTCTCATGGCTTTTGTCCGT
CGTCGTCACTGTCTACTATGCCGTTGACGAGCCTCACGATGGCTTCCACATCCGCCGGCGCATATGGGATCAGAA
CTATCTGTATCCCAGCGCCTTTACCATGAACCACATCCTCGCTGATATCTACTGGATTGTTCTCTTCATCCTCCA
GTTTGGATACGTCACATCGCTCTTCTCCAGCAGTGCCGACGTCGTTGCCGCAGCTGCTGGTGTCGGCAGCCACTT
CATCCTCAACAACTTGCTTCACTCTGCATTCGTCATGCTCTTTGTGAACTCGCACTTCCACATCGCCGAGGTCAT
ACTGATTCTCAACTTCTTCAACCTCAGCTCACTGTATTTCCGCCACAACACGGTCCCGCGCTTCATTCACGTCCC
TGTTGCTACAGGCCCGTTGGCATGGA

> SEQ ID NO:1851 215316 213169_300847_1b
AGCTGATAAATTCCATCGATTGGTTTCTTTGGGAGCATTAATCGACCTTTCTCATTCTTCATACCATCGGCGTCG
TTGGCATTTATACGGCATCTCGTCTTGTTTCCTTCGTACTCGAGGTACGGTACCCTGACCGCGTCGTCATACGAA
TTTGCAGCATCGGCGAATTGACAGTATAAGGCAGACATCATGGCTGGGTGGCAGTCCTGTAAGAGACAACGATCC
CAACAATTCCCATTCTTCACAGCTTGCTAAAATCCGCATCACAGGGAACCCCTTCAGTAAGAGGGAGACGCACAG
CAATGGCTCCATCGTCGCATACAAGATTTTAACCTTGCTCTCATGGCTTTTGTCCGTCGTCGTCACTGTCTACTA
TGCCGTTGACGAGCCTCACGATGGCTTCCACATCCGCCGGCGCATATGGGATCAGAACTATCTGTATCCCAGCGC
CTTTACCATGAACCACATCCTCGCTGATATCTACTGGTAAATTCGCCATGACTCCATCAATTCTCGCTCAAGCTT
TCTGACACTTGAAAACCAGGATTGTTCTCTTCATCCTCCAGTTTGGATACGTCACATCGCTCTTCTCCAGCAGTG

> SEQ ID NO:1852 215338 104458_300364_1b
GGGGAAATGGTCTGTTTTACTTAATTGTATAACGAGGTATTACAATGTCCAGACCTTAACAACGGAAATTAAAAT
ACCCTAGCTTAAACTGACCACTAACACAAACAGAAAGCACAAACATAAAATCTACAATCACTAACAACAAAATAC
AATAAACCCTAACCGCCAATATTTAACCTCCAAATCCGTACAAGGTCCTTCCCTGCCTCTTGAGAGCGTAAACAA
CATCCATGGCAGTAACAGTCTTCCTCCTAGCGTGCTCAGTGTAGGTCACAGCATCGCGAATCACATTCTCCAAAA
AGATCTTAAGAACTCCACGAGTCTCCTCGTAAATCAACCCAGAAATACGCTTCACACCACCCCTACGAGCAAGCC
TGCGAATAGCTGGCTTTGTAATTCCCTGGATGTTATCTCTCAGCACTTTCCTGTGTCTCTTTGCTCCTCCTTTCC
CCAATCCCTTGCCTCCCTTGCCACGTCCAGACATTTTTCAAAAGCTTGAGAAAGAGATAATTGAAAGTGAATTCA
AGGGTTTTGAATTTAAAAGAGAGGAACGAGCTTCGATTGTTTTGATGCCCCGGCCGTAATGGC

> SEQ ID NO:1853 215338 1097781_301447_1b
TCTGTTTTTGTGTTAGGGAGGAATATCCATAGCCGTAGCCATGTCTGGTCGAGGCAAAGGAGGGAAGGGTCTGGG
CAAGGGGGGTGCGAAGCGGCATCGCAAGGTCTTTCGTGATAACATTCAGGGTATCACTAAGCCTGCCATTCGCCG
TCTTGCCAGGAGGGGTGGTGTCAAGCGTATCAGTGGTCTCATCTACGAGGAGACACGTGGCGTCCTGAAAATCTT
CTTGGAGAATGTGATCCGTGATGCTGTCACCTACACTGAGCATGCCCGCAGGAAGACTGTCACAGCCATGGATGT
CGTCTATGCCCTCAAGAGACAGGGAAAGACCCTCTACGGATTTGGGGGTTGAAACACCTTCTCTCTCTCTCTCTC
TTATACTGGTGTTCTTCAACACCACCATTCTGTAGAAATTGGAAGCTTGGTTGAACTGCTTTATGTGATGAGACA
TGCTGATGGGATTTAGGGGTTCGGATCCTTCTGTAAATATCTATGGTTTTCTATGCTGATACTCTCTATGCAATG
AAAAAGCATGAACTCGGTCTCTGTAGCTCTGTTGGTTAATTCTAGATTAAATTGCCCGTTTCTCTATTTGTATCT
CTCTCTGGA

> SEQ ID NO:1854 215338 234261_301098_1b
TATTGGTTGTCTAGGGTGCTAGAGCAGCAGCAGCTAGGAAATCTCTCGTCGTCGCGGCAATGTCTGGAAGAGGCA
AGGGAGGTAAGGGATTGGGCAAGGCGGCGCCAAGCGCCACCGCAAGCATCTCCGCGATAACATCCAGGGCATCA
CCAAGCCGGCCGATCCGGCGCCTTGCCCGGCGTGGCGGCGTCAAGCGTATCAGCGGCTTGATCTACGAGGAGACCC
GAGGCGTCCTCAAGATCTTCCTGGAGAACGTCATCAGGGATGCGGTCACCTACACCGAGCACGCCAGAAGGAAGA
CCGTCACCGCCATGGACGTCGTCTATGCGCTCAAGAGGCAAGGCAGGACGCTCTACGGATTTGGCGGCTAGAAGA
AGAAAATTAGAAGCTCTCCATCTCCTTGGAAAATTTCTAGTTTTCCTCGATTTCTAACTGGTAGACAAGGAAGAA
ATATTTTCCTTTGCATTCCATCCACCACTTTGTAATATTCGAATCTAATGTAGAATCTTAAATCGGAAAAAAA

> SEQ ID NO:1855 215338 194290_300745_1b
CCCCGCACCTCATCACCACCGCCGCCAACCACTCCTCACCAAGTCAAAGTTTCTTCCTCGCGACCGGCGGCGAGC
GGCGGCGGCGGCGATGTCTGGGAGAGGCAAGGGCGGCAAGGGGCTCGGGAAGGGCGGCGCGAAGAGGCACAGGAA
GGTGCTGCGCGACAACATCCAGGGGATCACGAAGCCGGCGATCCGGAGGCTGGCGAGGAGGGGCGGCGTGAAGCG
CATCTCCGGGCTGATCTACGAGGAGACCCGCGGCGTGCTCAAGATCTTCCTCGAGAACGTCATCCGCGACGCCGT
CACCTACACGGAGCACGCCCGCCGCAAGACCGTCACCGCCATGGACGTCGTCTACGCGCTCAAGCGCCAGGGCCG
CACCCTCTACGGATTCGGCGGCTAGGCGAGGCGATGCGAGGCCACGCGATTGGATAGGGATTCGATTAGTGCCAT
GTTCTTCAGTTCGTCGTAGTAGCCTAGCCTCTTCTCCTGTAGCTGTTGTTTCATCTCGTCTCCTGTTCCTTCATT

Figure 2 continued

AATTAGGGATGTATGAACTACTGGTTCGTTCGTTCGAATGGAATAGGAAATCTGCAGTGATTTACCCTCTAAATT
CAGT

> SEQ ID NO:1856  215338  193633_300741_1b
CCCGACTCCAATCACCACCACCTCTTCTCCAATTCCACTCGCTTTTCTCTCTCTCGTGCGTCGAGCCACCGGA
ATCGTCGTCGTCGGCGGCCATGTCGGGGCGCGGCAAGGGAGGCAAGGGGCTCGGCAAGGGCGGCGCCAAGCGTCA
CCGGAAGGTGCTCCGCGACAACATCCAGGGGATCACCAAGCCGGCGATCCGGAGGCTGGCGAGGAGGGCGGGGT
GAAGCGCATCTCGGGGCTCATCTACGAGGAGACCCGCGGGGTGCTCAAGATCTTCCTCGAGAACGTCATCCGCGA
CGCCGTCACCTACACCGAGCACGCCCGCCGCAAGACCGTCACCGCCATGGACGTCGTCTACGCGCTCAAGCGCCA
GGGCCGCACCCTCTACGGCTTCGGCGGCTGATCGATCTTGCCTCCCTCCGCCATCTCTCCCATGTCGTCTGGCCG
TGCCCACAAGTCTTGCGGTCAAGAAAAAAAGTTTGATGGAAAGCCGTGGAATCCACCTTGTTCAGTTCGCTGTTT
AGTTTTTCTAGTGTTTACCTGAATCATGAAATTGTGAAGCAAATGATGTTTGCAACTGGGATTTGAATTGAAACA
TGTTTCAGAGCCTAA

> SEQ ID NO:1857  215338  183342_300621_1b
AGCGATTTCAGATCTCCCCAAGTAGTAGACTTCTCTCTTCTTCCATCTCGGATTCGTCTCGGTCTCGTCTCGGTC
TCCGGCGATGTCTGGGCGCGGCAAGGGAGGCAAGGGGCTGGGCAAGGGCGGGGCGAAGCGCCACCGCAAGGTGCT
CCGCGACAACATCCAGGGGATCACCAAGCCGGCGATCCGGAGGCTGGCGAGGAGGGGCGGCGTGAAGCGCATCTC
CGGGCTGATCTACGAGGAGACCCGCGGCGTGCTTAAGATCTTCCTCGAGAACGTCATCCGCGACGCCGTCACCTA
CACGGAGCACGCCCGCCGCAAGACCGTCACCGCCATGGACGTCGTCTACGCGCTCAAGCGCCAGGGCCGCACCCT
CTACGGCTTCGGCGGCTGAGCCCTCCGGTCCTCCCTCGCCCTCGCGCTGGCCGCCTCTGCCGCCGCCGCCTCCTG
GACTGGCTGTTGCTGGTGTTTTAGCTCTTGTTGTGTCCTTTTGCTTTGCTGGTGTAAAGAGACCCGGATGTGCCA
CGGGTGGGTTTTTAGTAGTAGGATTAGTAGTATCCCAACTCCTGGTTGTGATTTGCTCATTTCCATAGATGTAAT
GACATTACGATTTCAATCGTAGCAAAATTATTTG

> SEQ ID NO:1858  215338  155494_301356_1b
ACCACGCGTCGTTCAAATCTAAAACCCTAAAGCTTCTTTTATCTTCAAATTTCTGTGTGAAAATGTCTGGTCGTG
GAAAGGGAGGAAAGGGATTGGGCAAGGGAGGAGCTAAGAGGCACAGGAAGGTGCTGAGGGATAACATCCAAGGAA
TTACGAAGCCCGCAATTCGTCGGTTGGCTCGTAGGGGAGGTGTGAAGCGTATATCTGGTCTGATCTACGAAGAGA
CACGTGGAGTGCTGAAGATCTTTCTAGAGAACGTGATTCGTGATGCTGTTACCTACACCGAGCACGCCAGGAGAA
AGACTGTTACTGCTATGGATGTCGTTTATGCACTCAAGAGGCAGGGCAGGACTCTCTATGGATTTGGTGGTTAGG
TTGTTTAGGTGTGATTTTAGGTAACTGTATTTGTAGTAATTGTAGATTTTCTGGAATTTCTGTTGTCTCTTTGTT
GGTTTCTCCGCAGCTTTGTTCTAGTTGTTGTTCTTAAGGTCTTGATAATGTAATTTCTCATTACAGATTCAAGGA
ACAAAGTTCATTTCTAGAAAAAAAACAACC

> SEQ ID NO:1859  215338  155187_301353_1b
CTACCCTCGACCACGCGTCGCTGATTTCAGTTCACATCAAAACTTGGAAGGTCTTTAATCTTCAAGTTCCTGTGT
GAAAATGTCTGGTCGTGGAAAGGGAGGCAAGGGATTGGGCAAGGAGGAGCGAAGAGGCACAGGAAGGTGCTAAG
GGATAACATTCAGGGATTTACGAAGCCAGCAATTCGTCGGTTGGCTCGTAGGGGAGGCGTGAAGCGTATTTCTGG
TCTGATATATGAGGAGACACGTGGTGTGCTAAAGATCTTTCTAGAGAACGTGATTCGTGATGCTGTTACCTACAC
TGAGCACGCCAGGAGAAAGACTGTTACTGCTATGGATGTTGTGTATGCACTCAAGAGGCAGGGTAGGACTCTCTA
CGGTTTTGGTGGTTAAGGAATTTGTGTTTGTGTTTTTGACTTTTGTTTGTTCTTCAAAAGTCTTGCGGTCAAGAA
ATTGAATGAAGTATTATTAAAATAGTTGATGTAATTAGGGTTCCTTATTAGTATTTGTAGTAGTTGTTGTAAGAA
AAGCATTCTCAGGTATTCTGGAATTTGCTCAACTTAATGGCAGAAGAATTCAAGTTTCAACT

> SEQ ID NO:1860  215338  147533_301253_1b
CTAGAAATCAACTTTTCTCCTTTCAATTACTCTATAAAAAATGTCAGGTCGTGGAAAGGGAGGCAAAGGTTTGGG
TAAAGGAGGAGCAAAACGACACCGTAAGGTGCTCCGTGATAACATTCAGGGAATCACGAAACCTGCCATTCGGAG
ATTAGCGAGAAGAGGTGGAGTGAAGAGAATCAGCGGGCTGATTTATGAAGAAACAAGAGGAGTGTTGAAGATATT
TTTGGAGAATGTGATTCGTGATGCTGTGACTTACACTGAGCACGCCAGAAGAAAGACTGTCACTGCAATGGATGT
TGTTTACTCTTTGAAGAGACAAGGCAGGACTCTTTATGGATTTGGTGGTTAAAGTTTGGGAAATTGTTGTTAACT
TCTGTGTTACTATTTGGTGTTATTGTTAATGTAGTTGACTAGATTTTCGTATTAATGAAATGAAATCCGTTGGTT
TTATTCTCATTCTTGTGTCCATTTGATTTTGAGTCTCCGAGTTTTGATTGAGTGGGAATTGTAGTATTTTTGTT
TGTTTGTGTTGCTTTACCTTATGAGTTTGCACAATGTTTATTCAAAATTCA

> SEQ ID NO:1861  215338  126606_300465_1b
GCCATTACGGCCGGGGAGAATCCGAATCAACCCACATTTTTGCTCATTTCAAATTCAAAAATCCCCAAAAATCTAG
TTTCACAATGTCAGGAAGAGGAAAGGGTGGAAAAGGATTGGGCAAGGAGGAGCTAAACGACACCGTAAGGTGCT
TCGTGATAACATCCAGGGAATCACGAAACCTGCAATTCGGCGTTTGGCTCGTAGAGGAGGAGTGAAACGTATTTC

Figure 2 continued

TGGTTTGATTTACGAGGAGACACGAGGTGTATTGAAGATATTTTTGGAGAATGTGATTCGTGATGCTGTGACTTA
CACCGAACATGCCAGGAGAAAGACTGTTACTGCTATGGATGTTGTTTATGCCCTCAAGAGGCAGGGAAGGACTCT
CTACGGATTTGGGGGTTAGATTTGTCTAATTAGAGTTTTTGTGGGGTAATGATTGTAGATTTGTTCTTTACTATC
TGATGTATTAGGGTTGGTTAGTTTTTGTTGAGATTTTATAATGTAATTCTCTATTACATACTCAGGAATAGTAAT
TGCCCAAAAAAAATCTAACAAGCTTCTAGTAGTATATATAACAAGCTCGCATTCTTAAAATCATAAATCTTGGAA
CAAGGTTTTTTCTTTTCTTTCTAG

> SEQ ID NO:1862 215338 57715_300036_1b
TATCGAGTTCAAATTTCAAAATCCCCATAATCGTTTCACAAAATGTCAGGAAGAGGCAAGGGAGGTAAAGGATTG
GGTAAAGGAGGAGCAAAGAGGCACAGAAAAGTATTAAGGGACAACATTCAGGGAATCACTAAGCCTGCAATTCGG
CGTTTGGCTCGTAGGGGTGGAGTAAAGCGTATTTCTGGTTTAATTTACGAGGAGACTCGTGGGGTGTTGAAGATA
TTTTTGGAGAATGTGATTCGTGATGCAGTGACATACACTGAACACGCTAGGAGAAAGACTGTTACTGCCATGGAT
GTTGTTTATGCGCTCAAAAGGCAGGGCAGGACTCTTTACGGATTTGGGGGTTAAATTTTTCAAATTAGGGTTTTT
GTGGGTAACTTTTATTATAGATTTGTACTTTTGCTGCCGTTGTGTTTTAGGGTTGCTTAGATTTTGGTAAGGTCG
ATGATGTAATTCTCGTTACATATTCAAGGAATAGTAATTGCTTGGTCCTCAAA

> SEQ ID NO:1863 215338 57631_300109_1b
CCCCCCCCCCGTCGAATACATTTCATTTCTGATTTCAATTCAAACCAAAAACCCTAGGTCAAAGTTCTGTGTGAA
AATGTCTGGCCGTGGAAAGGGTGGCAAGGGATTGGGCAAGGGAGGAGCTAAGAGGCACCGGAAGGTGCTAAGGGA
TAACATCCAGGGAATTACGAAGCCAGCAATTCGTCGGTTGGCTCGTAGGGGAGGAGTGAAGCGTATATCTGGTCT
GATCTACGAAGAGACACGTGGAGTGATGAAGATCTTTCTAGAGAATGTGATCCGTGATGCTGTTACCTACACCGA
GCACGCCAGGAGAAAGACTGTTACTGCTATGGATGTTGTTTACGCACTCAAGAGGCAGGGCAGGACTCTCTATGG
ATTTGGTGGTTAGGTTGTTTAGTTTGTGATTTAGGTTGGTGTACTTGTGGTAATTGTAGATTTTCTGGAAATTTC
TGTTGTTTCGGTGTTGGTTTCTCAGCAGCTTTGTTCTAGTTGTCGTTCTTAAGGTCTTGATATTGTAATTTCTCA
TTGCAAATTCAAGGAACAAAGTTCATTTTCTAGAAATTACAATGGTTAAATTGATTGTTTGAAACGACCA

> SEQ ID NO:1864 215338 53476_300090_1b
GCAGCATGTCAGGCCGAGGAAAGGGAGGAAAAGGATTAGGAAAGGGAGGAGCCAAGAGACATCGGAAAGTACTCA
GAGACAACATCCAAGGGATTACCAAACCTGCGATTCGTCGTCTCGCGAGAAGAGGAGGCGTGAAGCGTATCAGTG
GTTTGATCTATGAAGAGACTCGCGGCGTTCTCAAGATCTTTCTCGAGAACGTGATTCGTGACGCCGTTACTTACA
CGGAGCACGCTCGCCGGAAAACTGTTACGGCGATGGACGTCGTTTACGCTCTCAAGAGACAAGGACGAACTTTGT
ATGGATTCGGCGGCTAAATCGTTCGGATTGCAATTTCGGATTTTGTAAACTCTTCAATTTCAGCATCTAGGGATT
TCAGATTTGTAATTTCTCAGTTAAACGATGAATGAATTG

> SEQ ID NO:1865 215338 48634_300033_1b
GCCATTACGGCCGGGGATCGCCCTAATCATTATCTCTCGCACAATTTTTTCAGCTTCAGGGTCTTTAATTTGCAGA
GAAACTAAAGGTTGATTGAAAATGTCTGGACGTGGAAAGGGAGGAAAGGGATTAGGAAAGGGAGGAGCAAAACGA
CACCGTAAAGTCCTCCGCGATAACATCCAAGGTATCACAAAGCCAGCAATCCGGCGTTTGGCACGTAGAGGAGGA
GTGAAGCGTATCAGTGGTCTGATCTACGAGGAGACACGTGGCGTGCTGAAGATCTTTCTAGAGAATGTGATTCGT
GATGCTGTAACTTACACTGAGCACGCTAGGAGGAAGACTGTGACTGCTATGGATGTTGTGTACGCGCTCAAGAGG
CAAGGCCGTACTCTCTATGGTTTTGGTGGTTAGAATATTGGAATTAATTAATGTTGGTTTTACGTTTAATGTAAT
TATGTTCTTATAAGAGTAGTTTTGGCAAGAAACGTTGTTGCTTAAATTAATGAAATTGCACACTACATTTTTCTC
ACTATTGATTTGTCAATTTGACC

> SEQ ID NO:1866 215338 36933_300084_1b
TTTGGTAAAAAACCAGGAGACAAGATATGGAGTAAATTGTTCATCCTCATTAGATTTTCTTAGCTTTAAGTTTGC
AAAGATTTTCAACTACACCGCATTGGCTAACAACGACATCACAATAGAAAACAAAAGCAGTAGCTAACACTCCTA
GATTTACTTTAGACTAATTCAAACCATTTAACACAGATCTCAGAAACAAGAAGAAATCCCCAAACTTGCATAAAC
CCTAATCCCCCAAATCGGATTAACCTCCGAAACCGTAGAGAGTACGACCTTGCCTCTTCAAAGCGTAGACAACAT
CCATGGCGGTCACCGTCTTCCTTCTAGCGTGCTCAGTGTAAGTAACGGCGTCACGGATGACATTCTCGAGGAAGA
TCTTGAGGACACCTCTGGTCTCTTCGTAGATGAGACCACTGATACGCTTGACACCACCTCTACGAGCAAGACGAC
GAATGGCAGGCTTGGTGATTCCTTGAATGTTATCCCTCAGAACCTTCCTGTGCCTCTTCGCTCCTCCCTTTCCCA
ATCCTTTTCCTCCCTTTCCTCTTCCCGACATCACTTCACAGTTTTACTTGATACCCAAAGATCTGTGACTGTGAA
GAACAGAAGAAAAATTATTCAGTGAATGGTAACGAACAGAAACGCTAGATTTCCAAATCAATCAATTGAATTGAC
GATCGAACAATAAACCAGATGGAGAAGAAGAAGATACTTTTAAGATGATTTGGCGGACGCGTGGG

> SEQ ID NO:1867 215338 126458_300463_1b
GCCATTACGGCCGGGGATCTCAAATCAAATTCTATTTTCTTTTCAGTTCAATTACTTTACCAACAAAATGTCAGG
CCGTGGAAAGGGAGGCAAGGGTTTGGGAAAGGGCGGAGCAAAACGACACCGAAAGGTTCTCCGTGATAATATTCA

Figure 2 continued

GGGAATCACTAAGCCAGCTATTCGTCGATTGGCTCGTAGGGGTGGAGTGAAGAGAATCAGCGGGCTGATTTATGA
AGAAACAAGAGGAGTTCTGAAGATTTTTTTGGAGAATGTGATTCGTGATGCTGTGACTTACACTGAGCACGCCAG
AAGAAAGACTGTTACTGCAATGGATGTTGTTTATTCATTGAAGAGACAAGGCAGGACCCTCTACGGATTTGGTGG
TTGATTTATGTATTTTAGGTTTTTTAAGGGGAAATGGAGCTCAGTTGGTGTTTAAAAGTTGTATTGTTAATGAAG
GTTATTAGGTCATTGTAACGAGTTATTTGTGTTAATGTAATGGATCTCATTAGTATTTCAG

> SEQ ID NO:1868 215338 126411_300463_1b
GCCATTACGGCCGGGGATCTCAAATCAAAATTCATATTCTTCTCAGTTTAATTACGCTACCTACAAAATGTCAGG
CCGTGGAAAGGGAGGCAAGGGTTTGGGAAAAGGAGGAGCTAAACGACACCGTAAGGTGCTCCGTGATAACATTCA
GGGAATCACAAAGCCAGCTATTAGGAGATTAGCGAGAAGAGGTGGAGTGAAGAGAATCAGCGGGCTGATTTATGA
AGAGACAAGAGGAGTGTTGAAGATATTTTTGGAGAATGTGATTCGTGATGCTGTGACTTACACAGAGCATGCTAG
GAGAAAGACTGTGACTGCAATGGATGTTGTTTATTCTCTCAAGAGACAAGGCAGGACCCTTTATGGATTTGGTGG
TTAATTTATGTATTTTTATTTGTTTTAGGGGAGATGGAGTTTAGTTGGTGTTTAATTAGTGTTTGTTGATGAATG
TTATGAGGTTGCTGTAATTGAGTTCTTTGTGTTAATGAAATGGATCTCATTACTATTTCTGATAAAA

> SEQ ID NO:1869 215338 122243_300017_1b
CCCCCCCCCCTGAAACCAAAAAAATCCCCAAATCTCAAATCCTCCTCCGTCTCCAAGCTCTCGTCGTCGTCGTCA
GACATGTCGGGCCGTGGCAAGGGAGGCAAGGGGCTGGGCAAGGGAGGCGCGAAGAGGCACAGGAAGGTGCTGCGC
GACAACATCCAGGGGATCACGAAGCCCGCGATCCGGAGGCTGGCGAGGAGGGGCGGCGTGAAGCGCATCTCCGGG
CTGATCTACGAGGAGACCCGCGGCGTGCTCAAGATCTTCCTCGAGAACGTCATCCGCGACGCCGTCACCTACACC
GAGCACGCCGCCGCAAGACCGTCACCGCCATGGACGTCGTCTACGCGCTCAAGCGCCAGGGCCGCACCCTCTAC
GGCTTCGGCGGCTGATTCCTTCCTTCCTTCCTTCCTGGTGGCGTGCGGGTGGTGGTGGTGTAGGAGCTAGGG
TTTCGATGGGATTCGGGGGAATTTCTGCTTTGTGTTGGCTTCTGTGTAGCGACTCTTCTGTTTAAATGAATTCG
ATGAATCTGAACTGAAGATTTGGTTCAAAAAAAACAAAAAAAAAC

> SEQ ID NO:1870 215338 120756_300516_1b
CCCACGCGTCCGCGATTTCAGGGCTCCCCAAGTAGTAGACTTCTCTCTTCTTCCATCTCGGATTCGTCTCGGTCT
CCGGCGATGTCTGGGCGCGGCAAGGGAGGCAAGGGGCTGGGCAAGGGCGGGGCGAAGCGCCACCGCAAGGTGCTC
CGCGACAACATCCAGGGGATCACCAAGCCGGCGATCCGGAGGCTGGCGAGGAGGGGCGGCGTGAAGCGCATCTCC
GGGCTGATCTACGAGGAGACCCGCGGCGTGCTCAAGATCTTCCTCGAGAACGTCATCCGCGACGCCGTCACCTAC
ACCGAGCACGCCGCCGCAAGACCGTCACCGCCATGGACGTCGTCTACGCGCTCAAGCGCCAGGGCCGCACCCTC
TACGGATTCGGCGGCTAGGCGAGGCGATGCGAGGCCACGCGATTGGATAGGGATTCGATTAGTGCCATGTTCTTC
AGTTCGTCGTAGTAGCTTAGCCTCTTCTCCTGTAGCTGTTGTTTCATCTCGTCTCCTGTTCCTTCATTAATTAGG
GATGTATGAACTACTGGTTCGTTCGTTCGAATGGAATAGGAAATCTGCAGTGATTTACCCTC

> SEQ ID NO:1871 215338 108313_300381_1b
CGGACGCGTGGGCAAAGCTCAGTTTCTCTCTTTTAAATTCAATTTCTATTTTCTCTCTCTCAAACTATTGAAAAA
TGTCTGGACGTGGCAAGGGAGGTAAGGGATTGGGCAAAGGAGGAGCAAAGAGGCACAGGAAAGTGCTGAGAGATA
ACATACAGGGAATTACAAAGCCAGCTATTCGTAGGCTTGCTCGTAGGGGTGGTGTGAAGCGTATTTCTGGTTTGA
TTTATGAGGAGACACGTGGAGTGCTTAAGATCTTTTTGGAGAATGTCATTCGTGATGCTGTGACCTACACTGAGC
ACGCAAGAAGGAAGACTGTAACTGCTATGGATGTTGTGTACGCTCTCAAGAGGCAGGGAAGGACCTTGTACGGAT
TTGGAGGTTAAATATTGGGGGTTAGGGTTCATAGTATTTTGTTGTTAGTGATTGTGGATTTCATGTTTGTGCTTT
CTGGTTGAGCTAGTGGTCAGTTTAAGGTAGGTTAGTTTAATTTCTGTTGTTAAGGTCTGGATATTGTAATTCCGC
GTTATACAATCAAGTAAAACAGACCATTTTACCCTATTG

> SEQ ID NO:1872 215338 1112643_301803_1b
ACATAGACAAGTTAGATTTGAATTTAAGATTGACAGAAAGATGTCGGGCAGAGGCAAAGGAGGGAAGGGTTTGGG
AAAGGGAGGGGCCAAGCGACATCGCAAGGTCTTTCGAGATAACATCCAGGGCATCACTAAGCCTGCCATTCGAAG
GCTTGCTCGTCGAGGGGTGTCAAGCGTATCTCTGGTTTGATCTATGAAGAAACGAGAGGTGTTCTCAAGATCTT
CCTCGAGAATGTCATCAGAGATGCAGTTACCTACACAGAGCATGCGAGAAGGAAGACTGTCACGGCCATGGATGT
TGTCTATGCCCTCAAGAGACAGGGAAAGACCCTCTACGGTTTTGGGGGTTGAACTTTCCTTTCTTACTTTTTGGT
CTTCTTTACGGTGTTTGTTAACACCACTGCCTTTATGATCTGAGTTACTTTTGGCGAACTTAATGTCATATACAT
GTCTGTTTTATGTTTCTTGAACTTGTAGATGTTTTGAAAATTAGTAAAGATTGGTGTTGATTTATGGTGGA

> SEQ ID NO:1873 215379 103782_300027_1b
GGGGGCTAAGCTCTCAGCAACCATGGGTATCTCACGAGATTCTATGCACAAGAGGCGTGCCACTGGTGGCAAGAA
GAAAGCTTGGAGGAAGAAGAGAAAGTATGAACTTGGCCGCCAGCCTGCTAATACTAAGATCTCGGCTAACAAGAC
AGTCCGACGAATTCGTGTGCGTGGTGGCAATGTGAAGTGGAGGGCACTGAGATTGGATACAGGAAATTATTCATG
GGGTAGTGAGGCAGTCACACGCAAGACTCGTATCCTTGATGTGGTTTACAATGCATCAAACAATGAACTTGTTCG

Figure 2 continued

CACACAAACTCTGGTCAAGAGTGCTATTGTTCAAGTTGATGCTGCGCCATTTAAACAATGGTACCTCCAGCATTA
TGGTGTTGACATTGGTAGGAAGAAGAAGGGCCCTGCTAAGAAGGAAACTACTGAAGAAGGAGAAGGTGCTGCTGC
CGCTGCAGAGGAAACTAAGAAGAGCAACCATGTTCTCCGGAAGATTGAGACACGTCAGAAGGATCGTAAACTTGA
TCCTCATATTGAAGAGCAATTTGGTGGTGGTAGGCTGTTGGCCTGTATCTCTTCTCGCCCTGGTCAATGTGGCAG
AGCAGATGGGTACATTTTGGAGGGAAAAGAGCTTGAGTTCTACATGAAGAAACTACAGAAGAAGAAAGGCAAGGC
TGGAGCTGGTGGTAC

> SEQ ID NO:1874 215379 284685_200100_1b
GGGCGGACGCGTGGGCGGACGCGTGGGCTTAGCTGCTTTTAGCTCTCAGCAACCATGGGTATCTCACGAGATTCT
ATGCACAAAAGACGTGCCACTGGTGGCAAGAAGAAAGCTTGGAGGAAGAAGCGAAAGTACGAGCTTGGCCGTCAA
CCTGGGAATACTAAGATCTCAAGTAACAAGACAGTCAGACGAATTCGTGTTCGTGGTGGCAATGTGAAATGGAGA
GCACTGAGATTGGATACAGGAAACTATTCATGGGGTAGTGAAGCAACCACCCGTAAGACTCGTATCCTTGATGTG
GTATACAATGCCTCAAACAATGAACTTGTTCGCACACAAACTCTGGTGAAGAGCGCAATCGTTCAGGTTGATGCA
GCACCTTTTAAACAGTGGTACCTCCAGCACTACGGTGTTGACATTGGTAGGAAGAAGAAGGGGGCTGCTAAGAAA
GAAACTGCCGAGGAGGGAGAAGGTGCTGCTGCTGCAGAGGAAACTAAGAAGAGCAACCATGTAGCCCGAAAACTT
GAGAAACGCCAGAAGGATCGCAAACTTGATGCTCACCTTGAAGAACAATTTGGTGCGGGTAGGCTGTTGGCCTGC
ATCTCATCTCGGCCCGGTCAGCGTGGCAGAGCTGATGGGTATATCTTGGAGGG

> SEQ ID NO:1875 215379 258478_301696_1b
AGCACTCCACGACAACCATGGGTATTTCTCGAGACTCCCGACACAAGCGATCCCACACCGGCGCCAAGCGTGTCT
CCATCCACAAGAAGCGAAAGTTCGAGTGCGGTCGACAGGGTGCCGTCACCCGAATCGGCCCCAAGCGAATCCACA
CCGTCCGAACCCGTGGTGGTAACAAGAAGTTCCGAGCCATCCGAATCGAGACCGGCAACTTCTCCTGGGGCTCTG
AGGGAACCACCCGAAAGACCCGAGTCCTCGGTGTCTCTTTCCACCCCTCCAACAACGAGCTTATCCGAACCAACA
CTCTGACCAAGTCTGCCATTGTCCAGATTGATGCCACTCCTTTCCGACAGTGGTACGAGTCCTACTACGGCAAGT
CTCTCGGCAAGAAGAAGGCTGGCCAGGAGGAGCCCGTCATTGCTGAGGCTGACCAGGCTGCCGTTGCTGCCCGAC
AGGCTGATGCCAAGCTCGACCCTGCCGTCGAGGCTCAGTTCGGTGCTGGCCGACTCTACGCCTGCGTTTCTTCTC
GACCCGGTCAGTCCGGCCGAGTTGACGGTTACGTTCTCGAGGGAGAGGAGCTTGCTTTCTACCTCAAGAAGATTG
TCTCCAAGAAGTAGACACAAAACTAAAATGTATTATTGCACGTGAAAAAA

> SEQ ID NO:1876 215379 254604_301634_1b
ACGCGTCGGAGGGGGTGAGGCTCGAAGCTACTGCGGCTGCCGGAGGAGGAGGAGGACCTGCCACGCCATGGGTAT
CTCACGAGATTCAGTGCACAAGAGGAGGGCCACTGGAGGGAAGAAGAAGGCATGGAGGAAGAAGAGAAAGTACGA
GATGGGCCGTCAGCCAGCGATGACAAAGCTGTCAAGCAACAAGACAGTGCGGAGGATCCGAGTGCGTGGTGGTAA
CTTCAAGTTCAGGGCTTTGCGTCTTGACACTGGAAACTACTCCTGGGGGTCAGAGGCCACCACCCGCAAGTCGAG
GATCCTGGATGTGGTCTACAATGCCTCCAACAATGAGCTTGTCAGAACCCAGACTCTGGTCAAAAGTGCCATTGT
CCAAGTTGATGCGACCCCTTTCAGACAGTGGTACAGTCAACATTATGGCCTGGATATTGGCCGCAAAAAGAAATC
CAGCAGCGCTGCCAAGAAGGAGACTGAGGAGGGTGATGCTGGAGATGAGGAAAAGAAGAAAAGCAAGCATGTTCT
GCGAAAGCTAACAAAGAGGCAGGAAGGTCAGAAGCTTGACTCTCATCTAGAGGATCAGTTTGCAAGTGGTCGTCT
CTTGGCATGCATTTCGTCCCGCCCGGGACAGTGTGGCCGAGCTGATGGGTACA

> SEQ ID NO:1877 215379 237706_301280_1b
GGGCGGACGCGTGGGCGGAGCGAGGAGGAGGCGCCGCATCGTCGCGGATCGATCAGTCATGGGTATCTCCCGCGA
TTCGCTCCACAAGAGGAGGGCTACCGGTGGTAAGAAGAAGCAATGGAGGAAGAAGAGAAAATACGAGCTGGGGAG
GCAGCCGGCGATGACCAAACTGGCGGCCAAGACGGTGCGGCGCATTC

> SEQ ID NO:1878 215379 225245_300985_1b
ACAGATTGCACCAGGAGACCCGACATCAGCGTCTTCTGAACAACCGCAATCATGGGTATCTCACGAGACTCTCGC
CACAAGCGTTCCGCGTCCGGTGCGAAGCGCGCATACTACCGCAAGAAGAGGGCTTTCGAGAAGGGCCGCCAGCCT
GCCAACACCCGTATTGGCACAAAGCGTGTTCATCTTGTCCGCACCCGTGGCGGCAACCGCAAGTTCCGTGCCCTT
CGTCTCGAAGCCGGTAACTTCTCCTGGGGCTCCGAGGGCATCGCCAAGAAGACCCGTGTCATCGGTGTCGTCTAC
CACCCCTCCAACAACGAGCTCGTCCGTACCAACACCCTGACCCGCTCCGCTATCGTCCAGATCGATGCCGCTCCC
TTCCGACAATGGTACGAGGCCCACTACGGCTCTTCGCTCGGCCGCAGGAGGCAGGTCAAGGCCGGTGAGAAGGAG
GAGGACAAGAAGAAGTCCAACTCGGTCACCAAGAAGCAGGCCGACCGCTTGAAGAACGGAGGAAAGATTGAGAAC
GCTGTTGAGAAGCAGTTCGAGGCCGGTCGTCTGTACGCCGCTGTCTCTTCCCGTCCCGGCCAGAGCGGTCGCTGC
GACGGCTACGTCCT

> SEQ ID NO:1879 215379 208341_300959_1b
GCAGGTGAGGAGGAGAGGAGACCCGCCGCCGCCGCCGCCATGGGTATCTCGCGTGATTCCATGCACAAGCGCCGC
GCCACGGGCGGCAAGCAGAAGGCATGGCGCAAAAAGCGAAAGTATGAGCTCGGAAGGCAGCCTGCCAACACCAAG

Figure 2 continued

CTGTCAAGCAACAAGACAGTGAGGAGGGTGCGTGTCCGTGGAGGTAATGTGAAATGGAGGGCCCTCCGTTTGGAT
ACTGGCAACTACTCATGGGGAAGTGAGGCCGTGACCCGCAAGACCCGTATCCTTGATGTGGTCTACAATGCATCC
AACAATGAGCTTGTCAGGACTCAGACCCTTGTAAAGAGTGCTATTGTGCAAGTTGATGCTGCCCCCTTCAAGCAG
TGGTACCTCACTCACTATGGAGTGGATATTGGTAGAAAGAAGAAGGCTCCTGCAGCCAAGAAGGATGCTGAGGGG
CAGGATGCTGAAGCTACCACAGAGGAAGCGAAGAAAAGCAACCATGTTGTCAGGAAGCTTGAGAAGCGCCAACAG
GGACGCACACTTGACGCCCACATCGAAGAACAGTTTGGCAGTGGGAGGTTGCTGGCCTGCATTTCTTCCCGCCCT
GGGCAGTGTG

> SEQ ID NO:1880 215379 191353_300740_1b
CCGCTCCCCCCCGCTAGTTCCCAACCAGCAGCTGCGGCGGCGCGAGCACACGAAGAGGAGGCGGAGCAGCCGGAG
CCACCTCCGCCGCCGCCGCCACCATGGGTATCTCGCGTGACTCCATGCACAAGCGCCGGGCCACCGGTGGGAAGC
AGAAAGCGTGGAGGAAGAAGCGAAAGTATGAGCTTGGTCGCCAGCCGGCAAACACCAAGTTGTCGAGCAACAAGA
CAGTGAGGAGGGTCCGTGTTCGTGGAGGAAATCTGAAGTGGAGGGCTCTTCGCCTGGATACTGGTAACTATTCTT
GGGGAAGTGAGGCTGTCACTCGCAAGACCCGTATCCTTGATGTGGTCTACAATGCGTCAAACAATGAGCTTGTGA
GGACCCAGACCCTTGTGAAGAGTGCCATTGTGCAAGTTGATGCTGCCCCATTCAAGCAGTGGTATCTCACTCACT
ATGGTGTCGATATCGGTAGGAAGAAGAAAGCTCCTGCTGCTAAGAAGGATGCTGCTGAGGGACAAGAGGGTGAGG
CTGCCACGGAGGAAGCAAAAAAGAGCAACCATGTTGTGAGGAAGCTTGAAAAGCGTCAGCAAACTCGCACTCTGG
ACTCGCACATTGAAGAGCAATTTGGCAGCGGAAGGCTCTTGGCCTGCATCTCCTCCCGGCCTGGGCAATGTGGCA
GAGCTGATGGGTACA

> SEQ ID NO:1881 215379 160105_200029_1b
TTTTTTGTTGAGCCCTCCGTATTGAGCTAGCCGTCGGAACCCTATGATCCTTCGTCGCCGGCAACAATGGGTATC
TCTCGGGATTCGATGCACAAGAGACGTGCCACTGGAGGCAAGAAGAAGGCGTGGAGGAAGAAGAGAAAGTATGAG
CTTGGAAGACAGCCTGCAAATACAAAGCTGGTGCCTAATGCTAAGACTGTTAGGAGGATAAGGGTCCGAGGAGGC
AATGTGAAGTGGCGCGCTTTGAGGTTGGACACTGGGAACTTCTCTTGGGGCAGTGAGGCTGTTACTAGGAAGACT
CGTTTATTGGATGTGGTGTACAATGCCTCAAACAATGAGCTGGTTAGGACACAAACTCTAGTGAAGAGTGCAATT
GTTCAAGTTGATGCAGCTCCATTTAAGCAGTGGTATCTCCAGCACTATGGAGTTGATATTGGTCGCAAGAAGAAG
AGTGCTGTCAAGAAGGAAGGAGAGGAGGCTGAGACTGCTCCTGCTGCGGAGGAAAAGAAAAGCAACCATGTGCAG
AGAAAGCTGCAAAAGCGTCAACAAGATCGTAAGATTGACCCACATGTTGAAGAGCAATTTGCTAGTGGCCGTCTA
TTGGCTGCAATCTCGTCACGACCTGGCCAATGTGGTCGTGCTGATGGTTACATCTTGGAGGGTAAGGAACT

> SEQ ID NO:1882 215379 157982_301397_1b
GTCAGCTGCAAACATGGGTATCTCAAGAGATTCTATGCACAAGAGACGTGCCACTGGTGGAAAGAAGAAAGCTTG
GAGGAAGAAGCGAAAGTACGAACTTGGACGCCAACCAGCTAATACTAAGATCTCAAGCAACAAGACAGTTAGACG
AATTCGTGTTCGTGGTGGTAATGTGAAGTGGAGGGCACTGAGATTGGATACTGGAAACTATTCATGGGGTAGTGA
GGCAACCACACGCAAGACTCGTATCCTTGATGTGGTTTACAATGCCTCGAATAATGAACTTGTCCGCACACAAAC
ACTGGTCAAGAGTGCAATTGTTCAAGTTGATGCTGCACCGTTTAAACAGTGGTACCTCCAGCATTATGGTGTTGA
CATTGGTAGGAAAAAGAAGGGAGCTGCTAAGAAGGAAACTACTGAGGAGGGAGAAGCTGCTGCTCCAGCTGAGGA
AGCTAAGAAGAGCAACCATGTAGCCCGGAAACTTGAGAAACGTCAGAAGGATCGTAAACTTGATCCTCACCTCGA
AGAGCAATTTGGTTCTGGTAGGCTATATGCCTGCATCTCATCTCGCCCTGGTCAATGTGGCAGAGCTGATGGGTA
CATTTTGGAAGGGAAAGAGTTGGAATTCTATATGAAGAAACTTCAAAAGAAGAAAGGCAAGGCTGGATCTGGTGC
T

> SEQ ID NO:1883 215379 139025_300406_1b
CGCTCTCCTCCCCCCGCTAGTTCCCAACGAGCAGCTGCGGCGGCGCGAGCACACGAAGAGGAGGCGGAGCAGCC
GGAGCCACCTCCGCCGCCGCCGCCACCATGGGTATCTCGCGTGACTCCATGCACAAGCGCCGGGCCACCGGTGGG
AAGCAGAAAGCGTGGAGGAAGAAGCGAAAGTATGAGCTTGGTCGCCAGCCGGCAAACACCAAGTTGTCGAGCAAC
AAGACAGTGAGGAGGGTCCGTGTTCGTGGAGGAAATCTGAAGTGGAGGGCTCTTCGCCTGGATACTGGTAACTAT
TCTTGGGGAAGTGAGGCTGTCACTCGCAAGACCCGTATCCTTGATGTGGTCTACAATGCGTCAAACAATGAGCTT
GTGAGGACCCAGACCCTTGTGAAGAGTGCCATTGTGCAAGTTGATGCTGCCCCATTCAAGCAGTGGTATCTCACT
CACTATGGTGTCGATATCGGTAGGAAGAAGAAAGCTCCTGCTGCTAAGAAGGATGCTGCTGAGGGACAAGAGGGT
GAGGCTGCCACGGAGGAAGCAAAAAAGAGCAACCATGTTGTGAGGAAGCTTGAAAAGCGTCAGCAAACTCGCACT
CTG

> SEQ ID NO:1884 215379 130770_300490_1b
GAATTCATCAGGCAACGCAGTCGAGAGGTTTCTGGTTCCATCTGCAAACATGGGTATCTCTCGTGATTCTATGCA
CAAAAGACGTGCAACTGGAGGAAAGAAGAAGGCTTGGAGGAAGAAGCGAAAGTACGAGCTCGGAAGACAGCCCGC
AAACACCAAACTTTCGAGCAACAAAACTGTTCGAAGAGTTAGGGTTCGTGGAGGAAACGTGAAATGGAGAGCTCT
TAGACTCGATACAGGAAATTTCTCATGGGGAAGTGAGACTGTGACCAGGAAATCCCGTCTTCTTGATGTCGTTTA

Figure 2 continued

CAACGCATCTAACAACGAGTTGGTTAGGACTCAGACTTTGGTCAAGGGTGCTATTGTTCAAGTTGATGCTGCTCC
ATTTAAGCAATGGTATCTTCAACATTATGGTCTTGATATTGGACGTAAGAAGAAGACTACTGCTGCCAAGAAAGA
AGGAGAGGAGGCTGAGGCTGTANCTGAGGAAGCAAAGAAGAGCAACCATCTCCTGAGGAAAATTGAGGGTCGTCA
AGTAGATCACAAGCTTGACTCACATATTGAAGAGCAATTCAGTGGTGGACGATTATTGGCTTGTATCTCATCTCG
CCCTGGGCAGTGTGGTCGTGCTGATGGATACATTCTG

> SEQ ID NO:1885   215379 130406_300487_1b
GAATTCGGGCGCGCTACAGGAGGAAAGAAAAAGGGATGGAGGAAGAAGCGAAAGTACGAGCTCGGTCGTCAGCCT
GCTAACACCAAGCTGTCAAGCAACAAGACAGTGAGGAGAGTACGTGTTAGAGGAGGTAATGTAAAGTGGAGGGCA
CTCCGATTGGATACTGGAAATTACTCATGGGGAAGTGAAACCGTTACTCGTAAGACCCGTCTTCTTGATGTCGTT
TACAATGCATCGAACAATGAGCTTGTCAGGACACAGACATTAGTGAAGAGCGCTATTGTTCAAGTTGATGCTGCT
CCTTTCAAGCAATGGTACCTTCAGCACTATGGTCTTGACATCGGAAGGAAGAAGAAGACTGCTGCTGCCAAGAAG
GAAACCACTGAGGAGGGAGAAGCTGCTGCAGCAGAAGAAGCAAAGAAGAGTAACCATGTAATCAGGAAAGTTGAG
AAGCGTCAGGTGGATCACAAACTTGACCCTCATATTGAAGAGCAGTTTAGTGGAGGCAGACTATTGGCCTGCATT
TCATCTCGCCCTGGACAATGTGGTAGAGCTGATGGGTACATCTTGGAAGGAAAGGAGCTTGAATTTTACATGAAG
AAGCTACAAAAG

> SEQ ID NO:1886   215379 1171563_302055_1b
GCTTTAGGGAGGGGGTGAGGCTCGAAGCTACTGCGGCTGCCGGAGGAGGAGGAGGACCTGCCACGCCATGGGTAT
CTCACGAGATTCAGTGCACAAGAGGAGGGCCACTGGAGGGAAGAAGAAGGCATGGAGGAAGAAGAGAAAGTACGA
GATGGGCCGTCAGCCAGCGATGACAAAGCTGTCAAGCAACAAGACAGTGCGGAGGATCCGAGTGCGTGGTGGTAA
CTTCAAGTTCAGGGCTTTGCGTCTTGACACTGGAAACTACTCCTGGGGGTCAGAGGCCACCACCCGCAAGTCGAG
GATCCTGGATGTGGTCTACAATGCCTCCAACAATGAGCTTGTCAGAACCCAGACTCTGGTCAAAAGTGCCATTGT
CCAAGTTGATGCGACCCCTTTCAGACAGTGGTACAGTCAACATTATGGCCTGGATATTGGCCGCAAAAAGAAATC
CAGCAGCGCTGCCAAGAAGGAGACTGAGGAGGGTGATGCTGGAGATGAGGAAAAGAAGAAAAGCAAGCATGTTCT
GCGAAAGCTAACAAAGAGGCAGGAAGGTCAGAAGCTTGACTCTCATCTAGAGGATCAGTTTGCAAGTGGTCGTCT
CTTGGCATGCATTTCGTCCCGCCCGGGACAGTGTGGCCGAGCTGATGGGTACATTTTGGAAGGAAA

> SEQ ID NO:1887   215379 11794_300294_1b
TGGTATCAACGCAGAGTGGCCATTACGCCGGGGCGGCTAAGCTCTCAGCAACCATGGGTATCTCACGAGATTCTA
TGCACAAGAGGCGTGCCACTGGTGGCAAGAAGAAAGCTTGGAGGAAGAAGCGAAAGTATGAACTTGGCCGCCAGC
CTGCTAATACTAAGATCTCGGCTAACAAGACAGTCCGACGAATTCGTGTGCGTGGTGGCAATGTGAAGTGGAGGG
CACTGAGATTGGATACCGGAAATTACTCATGGGGTAGTGAGGCAGTCACACG

> SEQ ID NO:1888   215379 1101065_301473_1b
GAGGTTGAGGTCGCTACTCGGAGCAGGGCCAAGATGGGTATCTCTCGTGATTCGGTACATAAAAGGCGCGCAACT
GGAGGGAAGAAGAAAGCATGGCGCAAGAAGAGAAAGTACGAAATGGGAAGGCAACCTGCCATGACAAAACTCTCA
AGCAACAAAACTGTCCGAAGGATCAGAGTTCGAGGAGGGAATTTCAAGTTCAGGGCATTGAGGCTGGACACAGGA
AATTACTCTTGGGGATCTGAGGCAGCCACTCGCAAATCAAGAATCCTTGATGTTGTCTACAATGCCTCAAACAAT
GAGCTAGTGCGAACTCAAACCCTTGTGAAAGTGCCATAGTACAGGTTGATGCTACTCCTTTCAGGCAGTGGTAC
AAGCAACACTATGGATTGGACATAGGAAGAAGAAGAAAGCTTCTGGAGGAAAGAAAGAAGAGGATGTAGAGGCA
GGGGAAGAAGAGAAAAAAATAAGTAACCATGTGCAGCGCAAAGTTGCTAAAAGGGGTTGAAGGCAATAAATTAGAT
TCTCACTTAGAAGACCAATTTGCAAGTGGCCGTTTATTAGCCTGCATCTCATCTAGGCCTGNGCAGTGTGGGCGG
GCTGATGGATATATCCTTGAAGGAAAGGAACTTGAGTTCTATCAGAAAAAG

> SEQ ID NO:1889   215382 136965_300440_1b
CCCCCCCCCGCTTCCTTCTTCTTCCACGCCGGGCATCGCCGCCGCCGCCGCCGCCGGAGAGGGAGAGAGAGA
GAGAGAGATCGAGAGCAAGAGATGAAAACGATCTTGGCTTCGGAGACGATGGAGATCCCGTCGGGGGTGACGGTG
CACGTGGCGGCGAAGGTGGTGACGGTGGAGGGTCCCCGTGGGAAGCTGACGCGCAACTTCAAGCACCTGAACCTG
GACTTCCAGCTGCTGGAGGTGGAGGGGGTGAGGAAGCTGCAGGTGGACGCGTGGTTCGGCACCCGCCGCACCATG
GCCGCCATCCGCACCGCCATCTCCCACGTCCAGAACCTCATCACCGGCGTCACCAAGGGCTACCGCTACAAGATG
CGCTTCGTCTATGCCCATTTCCCCATCAACGCCTCCATCACCAACTCCAACACCGCCATCGAGATCAGGAACTTC
CTCGGCGAGAAGAAGGTGAGGAAAGTGGACATGCTTGAGGGTGTGACAATTTTGCGTTCTGAGAA

> SEQ ID NO:1890   215382 217771_300911_1b
AATTCGTGATCGCGGAAGGGACGACTCCAGATACCCTCAACGCCCCGACAACCCCCAAGTCACAGCAGCCATGAG
GTACATTCACTCTCAGGAGATCCTGGAAATTCAGAGGGCGTCAAGGTCAACATCAAGACCCGTATCGTCACCGT
TGAGGGTCCCCGAGGCAAGCTCACCAAGAACCTCGGTCACTTGGCTGTCAACTTCGGTCACCCCAAGAAGAACAC
CATCTCCATCGAGATCCACCACGGCAACCGTAAGAATGTCGCCACTCTCCGTACCGTCCGCTCCATCATCGAGAA

Figure 2 continued

CTTGATCACCGGTGTCACCAAGGGCTTCAAGTACAAGATGCGATACGTCTACGCCCATTTTCCCATCAACGTCAA
CCTGGACAAGAACAAGGAGACCGGTCTGTTCGAGGTGGAGATCCGAAACTTCATCGGCGAGAAGATCGTCCGACG
GGTTACCATGCACGAGGGTGTCGATGTTGAGATCTCCAAGGCCCAGAAGGATGAGCTCATCCTGACCGGCAACTC
ACTCGAGAACGTTTCCCAGAGCGCCGCAGATATCCAGCAGATCTGCCGGGTGCGCAACAAGGATATCCGAAAGTT
CTTGGACGGTCTGTACGTTTCCGAGAAGGGCAACGTTGTTGAGGAGGCTTAAATGTACCGGACAAGGATCTCTGT
TTCTTTTGCG

> SEQ ID NO:1891 215382 48461_300376_1b
GCTGCTAGGGTTTTAGCGATCGCCATTTTCACACACACAGAAGGAGAGCGGAAGAGAGAAACTAAGACAAGATGA
AGACCATTCTGTCATCAGAAACCATGGATATCCCCGACGGCGTGAGCATCAAGGTGAAGGCAAAGCAAATCGAAG
TAGAGGGACCAAGGGGCAAACTTGTCCGAAACTTCAAGCATCTCAACCTCGATTTTCAGCTGATCAAGGATGAGG
AAACTGGCAAGAAGAAACTGAAGATCGACGCTTGGTTTGGTTCTCGTAAGACTACCGCTGCTATCCGTACTGCTC
TTAGCCATGTTGAGAATCTCATCACTGGTGTTACGAAAGGTTACCGCTACAAGATGCGTTTCGTGTATGCTCACT
TTCCCATCAATGCCTCCATCACCGGTGGTAACAAGTCCATTGAGATCCGTAACTTCCTTGGCGAGAAGAGGGTTA
GGAAAGTGGACATGCTTGATGGGGTTACAGTTGTTCGATCTGAGAAGGTGAAGGATGAGCTTGTATTGGATGGAA
ATGACATTGAGCTCGTTTCTCGCTCTGCTGCCCTCATCAATCAAAAATGCCATGTGAAGAACAAGGATATCCGAA
AGTTTCTTGATGGTATCTATGTCAGTGAGAAGGGCAGAATTGCAGAAGAAGAATGAGCAGCTGTTTTAGAAGTAG
GCATATCACTGATGATTCATATCCAGAATGCCCTTTTTACTTTTC

> SEQ ID NO:1892 215382 258567_301697_1b
GCAATGAAGTCATCCAGTCCGACGTTCTGCTCGATATCCCCGAGGGTGTCACCGTTGACATCAAGGCCCGACGAA
TCACCGTCACCGGCCCCCGAGGTACCCTCAAGAAGAACCTGTCTCACATCAACGTTGCCTTCGAGAAGGTCTCCG
ATGACCAGATCAAGATCACCATCTTCGATGGTGACCGAAAGCACGTCGCTGCTCTGCGAACCGTCAAGACCCTCA
TCAACAACATGATCACCGGTGTCACCCGAGGTTACAAGTACAAGATGCGATACGTCTACGCCCATTTCCCCATCA
ACGTCAACCTCATTAAGGACGGTTCCGTCGTTGAGATCCGAAACTTCCTCGGTGAGAAGCGAGTCCGAGAAGTCC
CCATCCACGAGGGCTGCAGCGCTGAGATCTCTACCAACCAGAAGGATGAGATCTGCATCATCGGTAACTCCATCG
AGAACGTCTCTCAGACCTGTGCTGACATCCAGCAGATCTGGCGAGTCCGACACAAGGATATCCGAAAGTTCCTTG
ATGGTATCTACGTTTCCGAGAAT

> SEQ ID NO:1893 215382 237440_301287_1b
GGGTGCGAGGAGGAGGAGGCGGGCGCGATGAAGACGATCTTGTCGGCCCAGACGATGGACATCCCCGAGGGGGTG
AAGGTAGAGATCCGGGCGAAGCAGATCCGGGTGACGGGGCCGCGGGGGGTGCTGCACAGGAATTTCAAGCACCTC
AACCTCGACTTCCAGCTGCTGGAGAATGGGCGCAAGCTCAAGGTGGAGGCGTGGTTTGGGTCGCGCAAGACCATC
GCCGCCATCCGCACCGCCGTGAGCCACGTGAAGAACCTCATCACCGGCGTCACCAAGGGCTTCCAGTACAAGATG
AGGTTTGTCTACGCTCACTTCCCCATCAACGCCAACATCTCTGCCACCAAGCAAAACATCGAGATCCGGAACTTC
CTCGGCGAGAAGAGGGTGAGAACTGTCGACATGCTTCCGGGTGTGACTGTGACCAGGACGGAGAAGGTCAAGGAC
GAGCTTGTTCTCGAGGGGAATGACATCGAGCTTGTGTCGAGATCGGCCGCTCTCATCAACCAGAAATGCCATGTC
AAGAACAAGGATATCAGGAAGTTCTTGGATGGTATCTACGTGAGCGAGAAGGGAACGATCGCTGTGGAGGAGTAG
ACCTGTTGCCTGTTCTGAGTATAAT

> SEQ ID NO:1894 215383 212163_300874_1b
GGATTAATCGCAACTCCGAGATCCTGCTGAATCACAATGAGACCTACTCAGGTTCGTCTGGGCGGCGGCGCCCCT
CAACCCAAGACTGGCCACTGGCTCGGTGACTGGGGCTCCTTTGGTGAGTGTGCTCTACTTGACGAACGATTGCAT
CAGACCACCCGCGAAAGAGACTTTGAGGACGCAAGGAACCGGATGGTGGAGGGAAGATGAGGACGATTCAATGGG
CCGATATCTTGATTCAGCTGGAGCAATTGAGGCGGAAGACATTGAACACGCTACGGAGCAACAATTGGATCAGGA
ATTGCGTCGAAGGACCCGTCGGGACGAACTACAAAGATTGAAGGAGTCACTCGCATGCTAACATATGATGCTATA
GGTGGTGCCAAGCAGAAGGGCATTATCGACTACGGCCTGTCTGCCAACCGTCAGAACCCCTTTGCCGGTGCTGCC
CACGATGCCATCTTCAACACCTTCCGCCGCACCAAGTCCCAGATCTTCTACTGGCTCCCTCCTATGCTGGCTGGC
TACTACCTGCTGAGCTGGGCCACCGAGCGAAACCACTACCTCAACTCCAAGGCTGGCCGTGCTGAGTTTGCCGAC
TCGGAGTAAAATGGTGCACGAATATG

> SEQ ID NO:1895 215383 215303_300880_1b
GAAAAAGGATTAATCGCAACTCCGAGATCCTGCTGAATCACAATGAGACCTACTCAGGTTCGTCTGGGCGGCGGC
GCCCCTCAACCCAAGACTGGCCACTGGCTCGGTGACTGGGGCTCCTTTGGTGGTGCCAAGCAGAAGGGCATTATC
GACTACGGCCTGTCTGCCAACCGTCAGAACCCCTTTGCCGGTGCTGCCCACGATGCCATCTTCAACACCTTCCGC
CGCACCAAGTCCCAGATCTTCTACTGGCTCCCTCCTATGCTGGCTGGCTACTACCTGCTGAGCTGGGCCACCGAG
CGAAACCACTACCTCAACTCCAAGGCTGGCCGTGCTGAGTTTGCCGACTCGGAGTAAAATGGTGCACGAATATGT
TGAATTATGGGTGTCCAGGGGACACAGTGTATATCAGCGTCTAGATTAGGAGAAAACAATAGAAACGTTTGACTC
TACGAGATATTTGATTCTGTTCTTCGTCAAGAGATTGATACACTAATTTGACGAAAACACAAAAGAAA

Figure 2 continued

> SEQ ID NO:1896 215420 1100336_301459_1b
AAACTTACCGTCTCCCCCTTTCGTCCATTTGTGATCGAGTAGGAGAGAGAGAGAGAGAGGGAGGAAAGAGGAAGA
AGAAGAGGATGGCGCCTCCAGTTGTAGATGATGCCTACCGCGGAGCCATCGGGAAGGCCCGCCGTGACCTCCGCG
CCTTCATTGCCGAGAAGAACTGCGCTCCCATCATGCTCCGCCTTGCATGGCACGATGCTGGTACCTATGATGCCA
AAACAAAAACTGGTGGTGCAAATGGATCAATACGAAATGAGAAGGAACTTCTCCATGGGGCAAATAGTGGTTTGA
AAATAGCCATTGATTTTTGTGAAACACTGAAGGTGAAGTATCCAGCTATCACACATGCTGACTTTTACCAGCTGG
CTGGTGTTGTTGCAGTTGAGGTTACTGGAGGACCCACAGTTGAATTCATTCCTGGTCGTAAGGATTCCCTGGTTT
CTCCTTCGGAAGGACGCCTTCCAGATGCAAATAAAGGTGCGGCACATTTGAAGGATATATTCTATCGAATGGGTC
TTTCAGACAAAGATATTGTAGCTCTGTCAGGGGCACATACACTTGGAAGAGCACATGTACAGAGGTCTGGTTTTG
AAGGACCATGGACACAGCAGCCCCT

> SEQ ID NO:1897 215420 259424_301705_1b
GATCGAGGCTTGTGCCCTCCACACTCATTTGTGCTCGTCGTCGAGAGGAGACGAGAGGCGAGAGGAGAGGACGCA
TTCTTGGATCTAGATCGACAATCAGAATGGGCAAATCTTATCCTGCAGTGAGCGACGAGTACCTGGCCGCCGTCG
ACAAGGCCAAGAGAAAGCTTCGCGGCTTCATCGCAGAGAAGAACTGTGCCCCATTGATGCTTCGTCTTGCATGGC
ATTCGGCCGGGACTTTCGACTGTGCGTCCAAGACGGGTGGTCCCTTTGGAACCATGAAGCACGCCGAAGAACTCG
GCCACGGCGCGAATGCCGGCCTCGACATCGCTATCAAGCTTCTCCAGCCGATTAAAGACCAGTTTCCGGTCCTGA
GCTATGGCGACTTCTACCAGCTTGCTGGGGTCGTCGCAGTGGAGATCACTGGAGGCCCGGATATTCCATTCCATC
CGGGGAGAGTGGACAGGGAGACATGCCCCGTAGAGGGCCGGCTTCCAGACGCGACCAAGGGAGCCGATCATCTCC
GTGACGTTTTTGTGAAGCAAATGGGGCTCTCTGACAAGGACATTGTGGCTCTTTCTGGCGGTCACACTTTGGGAA
GAGCACACAAGGAAAGGTCGGGTTTTGAGGGCCCATGGACGCACAACCCTCTCCAGTTTGACAACTCCTACTTCA
CACTTCTGCTGAGCGGCGAGCAAGAAGGCATCCTGACGCTCAAGACGGACAAGGTTCTGGTG

> SEQ ID NO:1898 215420 255646_301644_1b
GAGAGAGAGAGAGGGAGGAAAGAGGAAGAAGAAGAGGATGGCGCCTCCAGTTGTAGATGATGCCTACCGCGGAGC
CATCGGGAAGGCCCGCCGTGACCTCCGCGCCTTCATTGCCGAGAAGAACTGCGCTCCCATCATGCTCCGCCTTGC
ATGGCACGATGCTGGTACCTATGATGCCAAAACAAAAACTGGTGGTGCAAATGGATCAATACGACCTGAGCAGGA
ACTTCTCCATGGGGCAAATAGTGGTTTGAAAATAGCCATTGATTTTTGTGAAACACTGAAGGTGAAGTATCCAGC
TATCACATATGCTGACTTTTACCAGCTGGCTGGTGTAGTTGCAGTTGAGGTTACTGGAGGACCCACAGTTGAATT
CATTCCTGGTCGTAAGGATTCCCTG

> SEQ ID NO:1899 215420 254329_301632_1b
GTGATTTTCTGTCGACGGTGAAGGAGCTCTCTGTAAAAATCAAAGGAGGGGGTTAGCCATGGCCAAGGTGTATCC
TGCTGTGAGTGAAGAGTACAAAGCCGCAGTAGATAAGGCAAAGAGGAAGCTCCGAGCAATGATAGCGGAGAAGAA
CTGTGCCCCCCTCATGGTCAGGATTGCCTGGCATAGTGCTGGAACCTATGATGTCAAAACCAAGACTGGTGGCCC
CTTTGGGACTATGAAAAATGCAAGTGAACTCGCCCATGGGGCCAATGCAGGCCTTAATAAGGCTGTTGCCCTCCT
TGAACCAATCAAGGAACAGTACCCCATTCTATCCTATGCAGACTTTTATCAGCTTGCTGGAGTAGTTGCTGTGGA
GGTAACTGGAGGGCCTGACATTCCCTTCCACCCTGGAAGAGAGGATAAAACTGAGAGCCCAGAGGAGGGTCGTCT
TCCAGATGCTACCAAAGGGCCGAG

> SEQ ID NO:1900 215420 230081_301053_1b
GAGGAGAGGGAGAGAATGCCGGTGCCGGTGGTGGACAATGCGTACCTCAAGGCGATCGAGTCGGCGAGGCGCGAT
CTCCGCGCGTTCATTGCGGAGAAGAATTCCGCGCCACTGATGCTTCGGTTGGCATGGCACGATGCCGGGACGTAT
GATGCTGTGTCCAAGACTGGAGGACCGAATGGATCGATCCGGAGCGAGCGCGAGTATACCCACGCTGCCAACAAT
GGGATCAAAATCGCCATAGACTTTTGTGAGCCTATCAAACAGAAATATCCCATTATCACGTATGCTGATCTCTAC
CAGCTTGCTGGCGTTGTTGCTGTGGAAGTCACTGGAGGTCCTACAATAAATTTTGTTCCTGGCCGCAAGGAATCG
GTCGCTACTACACCCGAAGGACGGCTTCCCGATGCTCATCTTGGGCAAAGCATATCCGCGATGTCTTCTACAGA
ATGGGTCTATCTGACAAAGATATCGTCGCTCTCTCTGGTGGTCACACACTGGGTAGAGGACACAAGGAAAGGTCT
GGGTTTGAGGGACCCTGGACATCACAGCCATTGAAGTTCGACAACTCATACTTCACGGAGCTTTTGAGAGGAGAA
TCGGAAGGCCTGTTGCAGTTGCCGACAGACAAGTGCTTGCTTGAGGATCCATCGTTCCGTCCATACGTGGAGCTG
TATGCAAAGGACGAAGACGCATTCTTCAAAGATTACGCCGAGTCGCACAAGAAGCTATCCGA

> SEQ ID NO:1901 215420 179507_300561_1b
ATCAAGATGGCCTCTTCCGGCCGTCAGTTCGCCCGCGTGGCAACCCGCACAACCACCCGCTCCTTCGCTGCCGTC
CCCCGACAGGCTTTCCGCCAGCAGGGTCGCCGCTTCTACTCTTCTGAGCCCGAGAAGAAGTCATCCTCCTCTCTC
CTGTACCTTGGTGCTGCCGCCGCCGCCGGTGGTCTCGGCATCTGGTTCTTCACCTCTGGTGCCTCTGCCTCTTCC
AAGACCTTTGTCCCCACCCAGGCCGATTACCAGAAGGTCTACAACGACATCGCCGAGCGTCTCGATGCCGATTAT
GATGATGGCAGCTACGGCCCCGTCCTGGTCCGTCTTGCATGGCACTGCAGCGGTACCTACGACAAGGAGACCAAA

Figure 2 continued

```
ACTGGTGGCAGTAACGGTGCTACCATGCGATTCGCTCCCGAGAGCGGCCACGGTGCCAACGCCGGTCTGATTGCT
GCTCGTGACTTCCTCGAGCCTATCAAGGCCAAGTATCCCTGGATCTTCCTACTCTGATCTCTGGATCCTCG
```

> SEQ ID NO:1902  215420  189010_300612_1b
```
TAGAACTAGTCACACCACACGCTTGGCTTGACGCCGCACGCCTCCGCTCCGCTCCGCCGCCGCGGCCGATCTCTC
TAGGGCTTCCAACCTCGCCGGCGACGCGACGCCACGCCATGGCCGCCCCGGTCGTGGACGCCGAGTACCTCCGCC
AGGTCGACAGGGCGCGCCGCCACCTCCGCGCCCTCATCTCCTCCAAGGGATGCGCGCCCATCATGCTCCGCCTCG
CATGGCATGACGCGGGCACTTATGACGTGAACACAAAAACTGGTGGTGCAAATGGTTCAATTAGATACGAGGAAG
AGTACACTCACGGTTCAAATGCTGGTCTAAAGATTGCTATTGATCTTCTCGAGCCTATTAAAGCCAAGAGCCCTA
AGATCACATATGCTGACCTTTATCAGCTTGCTGGAGTTGTTGCAGTTGAAGTTACTGGGGGTCCAACTGTTGAGT
TCATTCCTGGAAGACGTGATTCGTCAGTTTGCCCCCGTGAAGGGCGTCTTCCTGATGCTAAGAAAGGTGCACTGC
ACTTGAGGGACATCTTTTACCGGATGGGCTTATCAGACAAAGATATAGTAGCTTTATCTGGGGGTCACACTCTGG
GAAGGGCACATCCTGAAAGGTCTGGA
```

> SEQ ID NO:1903  215420  226334_300996_1b
```
CAAGACACACTCTCAAGATGCGATCTTTCCGAGCAGTCCGAAACTTCTCCACCACCGCCAAGCGCCTCAGCCAGG
CCCCCAAGGCCTCCACTCCTAACGCCTCCTCTGGAAACGGCTTTGTGTTGGCCTTTGTGGCCTCCGCCGCTGGAG
CCGGTGCCTACTACTACTACGCCAACTCCCCTGCCGCCAAGGTCGAGACCTTTAACGCCACCAAGGCCGACTACC
AGAAGGTGTACGACGCTATTGCCGACAAGCTGATTGAGGACGACGACTATGATGATGGATCTTACGGACCCGTCC
TCCTGCGACTCGCCTGGCACTCGTCTGGTACCTACAACAAGTCTGATAACAAGTTTGGCTCTTCCGGAGGTACCA
TGCGATTCAAGCCCGAGGCTTCTCATGCTGCCAACAATGGCCTGGTTAACGCCAGAAACTTCCTCAAGCCCATCC
ACGAGAAGTTCCCTTGGATCTCCACCGGTGATCTGTACACTCTTGGTGGTGTCACCGCCGTCCAGGAGCTCGGTG
GCCCTATCATCCCCTGGAAGCGAGGCCGTGTCGACGAGCCCGAGTCTGCTTCTCCTCCCGATGGATCTCTTCCCG
ACGCCTCTCAGGGCGCTACTCATGTGC
```

> SEQ ID NO:1904  215420  139236_300408_1b
```
CGAGTACTAGTCACACCACACGCTTGGCTTGACGCCGCACGCCTCCGCTCCGCTCCGCCGCCGCGGCCGATCTCT
CTAGGGCTTCCAACCTCGCCGGCGACGCGACGCCACGCCATGGCAGCCCCGGTCGTGGACGCCGAGTACCTCCGC
CAGGTCGACAGGGCGCGCCGCCACCTCCGCGCCCTCATCTCCTCCAAGGGATGCGCGCCCATCATGCTCCGCCTC
GCATGGCATGACGCGGGCACTTATGACGTGAACACAAAAACTGGTGGTGCAAATGGTTCAATTAGATACGAGGAA
GAGTACACTCACGGTTCAAATGCTGGTCTAAAGATTGCTATTGATCTTCTCGAGCCTATTAAAGCCAAGAGCCCT
AAGATCACATATGCTGACCTTTATCAGCTTGCTGGAGTTGTTGCAGTTGAAGTTACTGGGGGTCCAACTGTTGAG
TTCATTCCTGGAAGACGTGATTCGTCAGTTTGCCCCCGTGAAGGGCGTCTTCCTGATGCTAAGAAAGGTGCACTG
CACTTGAGGGACATCTTTTACCGGATGGGCTTATCAGACAAAGATATAGTAGCTTTATCTGGGG
```

> SEQ ID NO:1905  215420  120907_300518_1b
```
CCCACGCGTCCGCCCACGCGTCCGCTTCTCCCCTTCTTCTCCTCCTCCTCGATTCGGAGCTCCACCCGCAGCCAT
GGCGAAGAACTACCCCGTCGTGAGCGCCGAGTACCAGGAGGCCGTCGAGAAGGCCAGGCAGAAGCTGCGCGCCCT
CATCGCCGAGAAGAGCTGCGCCCCTCTCATGCTCCGCCTCGCGTGGCACTCGGCGGGGACGTTCGACGTGTCGTC
GAAGACCGGGGCCCGTTCGGGACGATGAAGACCCCGGCGGAGCTGTCGCACGCCGCCAACGCGGGCTGGACAT
CGCGGTGCGGATGCTCGAGCCCATCAAGGAGGAGATACCCACCATCTCCTACGCCGATTTCTACCAGCTTGCCGG
AGTTGTGGCCGTCGAGGTGTCCGGTGGACCTGCCGTCCCCTTCCACCCAGGAAGGGAGGACAAACCTGCACCCCC
ACCTGAGGGCCGTCTTCCTGATGCTACCAAGGGTTCTGACCACCTAAGGCAGGTCTTCGGTGCTCAGATGGGCTT
GAGTGATCAGGACATTGTTGCCCTCTCTGGCGGTCACACCCTGGGAAGGTGCCACAAGGAAAGATCTGGTTTTGA
GGGACCTTGGACAAGAAACCCTCTGCAGTTTGACAACTCTTACTTCACGGAGCTTCTGAGTGGTGACAAGGAGGG
CCTTCTTCAGCTTCC
```

> SEQ ID NO:1906  215420  1110134_301527_1b
```
GGTGAAGGAGCTCTCTGTAAATCAAAGGAGGGGGTTAGCCATGGCCAAGGTGTATCCTGCTGTGAGTGAAGAGTA
CAAAGTCGCAGTAGACAAGGCGAAGAGGAAGCTCCGAGCAATGATAGCGGAGAAGAACTGTGCCCCCCTCATGGT
CAGGATTGCCTGGCATAGTGCTGGAACCTATGATGTCAAAACCAAGACTGGTGGCCCCTTTGGGACTATGAAAAA
TGCAAGTGAACTCGCCCATGGGGCCAATGCAGGCCTTAATAAGGCTGTTGCCCTCCTTGAACCAATCAAGGAACA
ATACCCCATTCTATCCTATGCAGACTTTTATCAGCTTGCTGGAGTAGTTGCTGTGGAGGTAACTGGGGCCTGA
CATTCCCTTCCACCCTGGAAGAGAGGATAAAACTGAGAGCCCAGAGGAGGGTCGTCTTCCAGATGCTACCAAAGG
GCCGAGTCACTTGCGTGATGTGTTTGGTCACATGGGCTTGGGAGACAAGGAGATTGTTGCCCTCTCAGGAGCCCA
TACCCTGGGTCGTTGCCACAAAGATCGTTCTGGATTTGAAGGGCCATGGACGACAAATCCCCTTTTATTTGACAA
CTCCTACTTCACTGAATTGCTTACTGGTGAGAAGGAAGGACTGATCCAGCTCCCTTCT
```

> SEQ ID NO:1907  215429  103740_300027_1b

Figure 2 continued

TGGTATCAACGCAGAGTGGCCATTACGGCCGGGGCTCTTGAGATATGTACTAGTGTCCATTCTCACCAAGAAACC
CTAGCCCCCTACCGTGCTCGAGCTGCTTCGTTGCTAGGTTGCCAATTCTATCTCCACAACCATGGCGGATGTTGA
AGCCGATGTGACGGCAGGGCAGCCAAAGAAGAGGACGTTCAAGAAGTTTAGTTACAGAGGCGTCGATCTCGATGC
TTTACTTGACATGTCCACTGACGAGCTTGTTAAGCTCTTTAATGCTCGTCCTCGCAGAAGGTTCCAGAGAGGTTT
GAAGAGGAAGCCAATGGCCTTGATCAAGAAGCTGCGCAAGGCGAAACGTGAGGCACCACCAGGGGAGAAGCCAGA
GCCTGTCAAGACTCATCTGAGGAACATGATTATTGTTCCTGAGATGATTGGAAGTGTCATTGGCATCTACAATGG
AAAGACGTTCAATCAGATTGAGGTCAAACCTGAGATGATTGGTCACTATCTGGCTGAGTTCTCAATCTCATACAA
GCCTGTCAAGCACGGGAGGCCTGGTATTGGTGCTACTCACTCATCCAGGTTCATTCCTCTGAAGTAATATGGGAT
GTCAGGTTATTTAGTGCCTTCTTTTACTAGAATTTTGATGAAGGCCACAGATTATGAAAGAGTTGAGTCTTAAAT
TGCAGTGGTCAGCTGATAAATATCTATTTTTAGTTGTTTGTTATGAGGTTCGTTTCTTAGACTTTTCTTTTCAAA
TGCTCAATTTAGGAGAGGGCTTGATGCTCACAAGCCATATGTTCAAGTTCCCTCCTGATGTCCTAGCACTAAGTC
TTTTCTTGATTTC

> SEQ ID NO:1908 215429 255607_301644_1b
GGATACTCCAACGAAGCTCTCTCCCGTCGATCGAATCCTCGCTCTTCCGCAGCTATGGCAGATGTTGAACTGGAG
CCCGGAACAGTGCAACCCAAGAAGAGGACGTTTAAGAAGTTCACATTCCGCGGTGTTGATCTTGATGCCTTGCTG
GACATGTCATCTGACGAGCTTGTTGAGCTCTTCAACGCCAGAATCCGGAGAAGGTTCCAGCGTGGGTTGAAAAGG
AAGTCAGTGGCTCTCATAAAGAAGCTGAGAAAGGCGAAACTGGATGCACCAGCAGGTGATAAACCTGAACCAGTC
AGAACTCATTTGCGTAACATGGTAATTGTACCTGAGATGATTGGGAGTGTTATTGGTGTCTACAACGGGAAAACA
TTTAATCAAGTTGAAATCAAGCCTGAGATGATTGGTCATTATTTGGCTGAGTTTTCTATCTCCTACAAGCCAGTG
AAGCACGGCCGTCCTGGTATAGGAGCTACTCATTCCTCTCGGTTCATTCCTCTCAAGTAATTTGGAGCTAGTGAT
CGTCTGCCATTGGATCTGCAATTCTTCATTATGCTGCAGAAGGAGCAGAGAAGTAGGCTGGCTAATATATATTTA
ATGTTTTTCTGAGACAACCTGACAATTTTGAAATGTAGCTGTTCCTCCTTATTGCATCAAGTAGTGTGATGAATT
GTGGTAGGTAGCTGGTAATGTGCTAGTATAGCATGCTCCCTTAACTGTTTTTTTT

> SEQ ID NO:1909 215429 253306_301625_1b
AAACGACAAAAATGGCTGACGCTTCTGCTGAATCCCGAAAGGCTCGAACCTTCAAGAAGTTCTCCTACCGAGGCG
TTGACCTCAAGGATCTGCTCGAGATCTCCACCGACGAGTTCAAGGAGCTCGTTTCCGCCCGAGCCCGAAGACGGT
TCAACCGAGGCCTCAACAAGAAGCCTACCATTCTCATCAACAAGCTGCGAAAGGCCAAGCTCGCCGCCGGCCCCA
ACGAGAAGCCCGCCGTGGTCAAGACCCACCTGCGAAACATGCTCATCTTCCCCGAGATGATTGGCTCTGTTGTTG
GTGTCTACAACGGAAAGTCCTTCACCACCGTTGAGATCAAGCCCGAGATGATCGGCATGTACCTCGGTGAGTTCT
CCATCACCTACACCCCCACCCGACACGGCCGACCCGGTGTCTCCAACTCCAAGTTCATTCCTCTGCGATAAGGGA
TTGCATGGTAATAAAAATATGTATTGTATGATTGACATACGCG

> SEQ ID NO:1910 215429 212128_300874_1b
ATTCGCTCGTCGATACCCTGCGCGTCGATAGGCGAATCCTTGGAATCAACACACAACCGCGATCATGGCTGACGA
ATACAACGCCGAGGAGGCCGCTGAGATCAAGAAGAGAAGAACCTTCCGCAAGTTCTCTTACCGAGGAATCGACCT
TGACAACCTCCTCGACCTCTCCTCTGACCAGCTCCGAGATGTCGTCCACGCCCGTGCCCGCAGAAGGATCAACCG
CGGCCTGAAGCGCCGCCCCATGGGCCTCATCAAGAAGCTCCGAAAGGCCAAGCAGGAGGCCAAGCCCAACGAGAA
GCCCGACCTCGTCAAGACCCACCTCCGAGACATGATTGTCGTCCCCGAGATGATTGGAAGCGTCATTGGTATCTA
CTCCGGCAAGGAGTTCAACCAGGTCGAGATCAAGCCTGAAATGGTTGGCCACTACCTGGGTGAATTCTCTATCTC
ATACAAGCCTGTCAAGCACGGTCGACCTGGTATCGGTGCCACTCACTCTTCTCGTTTCATTCCCCTCAAATAAGA
AGGTTGTGGTCTTGGGTGGTTTCTGCATTCACGGACATTTTTGGGCGAAAAGGACTGGTTTTAGTAGACGGAGGA
AAGCCGCTACTGAAG

> SEQ ID NO:1911 215429 176141_300519_1b
CGTCAGCCTCCGCCTCCGCCTCCGCCTCCGCCGCCGCCGCCGAGCTCCTCCCGCGCGCTCCGAGCCCATCATGGC
GGACGTCGAAGTCGAGACGGAGGTCGCCGCCGGCGCACAGCCAAAGAAGAGGACGTTCCGCAAGTACAGCTACCG
CGGCGTCGACCTCGACGCGCTCCTCGACATGTCCACCGATGACCTCGTCCAGCTCTTCCCCGCGCGCGCCCGCAG
AAGGTTCCAGAGGGGTCTGAAGAGGAAGCCCATGGCGCTCATCAAGAAGCTGCGCAAGGCGAAAAAGGATGCCCC
TGCTGGCGAGAAGCCAGAGCCAGTGAGGACCCACCTCCGCAACATGATCATTGTCCCTGAGATGATCGGAAGCAT
CGTCGGTGTCTACAATGGCAAGACCTTCAACCAGGTTGAGATTAAGCCTGAGATGATTGGTCACTACCTTGCGGA
GTTCTCCATCTCCTACAAGCCGGTTAAGCACGGTAGGCCCGGTATTGGTGCCACCCACTCCTCTCGGTTCATCCC
TCTCAAATGAGTCATGCAGCTTCTAGCCATCCAGAATCAGAATTCAGTGTTAAGCGCCCATGGCTTGTCCTTCCA
GTATCACTTGTTTTTTGAGCAAGTTATATACCTAAG

> SEQ ID NO:1912 215429 175871_300522_1b
CCCGAACCGCCGCCGCCGCCGTCTCCTCCTCCTCATCCAAGCAGCTCGCGCCTCCGACCCCTCGCCTCGAGCTCC
AGCTCTCCCCAACCCCTTCAACAATGGCGGATGTCGAGGTCGAGGCGGAGGTGGCCGCGGCCGGAGCGCCGAAGA

Figure 2 continued

AGAGGACGTTCCGCAAGTACAGCTACCGCGGCGTGGACCTCGACGCGCTCCTCGACATGTCCACCGACGACCTCG
TCCAGCTCTTCCCCGCGCGCGCCCGCAGAAGGTTCCAGAGGGGCCTGAAGAGGAAGCCCATGGCGCTCATCAAGA
AGCTCCGCAAGGCGAAAAAGGATGCACCTGCTGGTGAGAAGCCAGAGCCTGTGAGGACCCACCTCAGGAACATGA
TCATTGTGCCTGAGATGATCGGAAGCATCGTCGGTGTCTACAACGGCAAGACCTTCAACCAGGTTGAGATCAAGC
CTGAGATGATTGGGCACTACCTCGCAGAGTTCTCCATCTCGTACAAGCCAGTCAAGCACGGTAGGCCTGGTATTG
GTGCTACCCACTCCTCACGGTTTATCCCTCTCAAGTGAGAGATCATCTGCAGCTGTTTGCGCTTCCAGTATGTAG
CTTGAGCTGTCGAACAAGGAACTCCAAAGTACTTTATTAATAGCGTGTCCACCGAGCAGCCACTTTTTGAACCTT
GGTTAATCTGATGTTATTTCCCCAGATATTTTGAAGTTATATCCAAACATGTTATTTCT

> SEQ ID NO:1913  215429  170212_300531_1b
CGAACCGCCGCCGCCGCCGTCTCCTCCTCGTCATCCAAGCAGCTCGCGCCTCCGACCCCTCGCCTCGAGCTCCAG
CTCTCCCCAACCCCTTCAACAATGGCGGATGTCGAGGTCGAGGCGGAGGTGGCCGCGGCCGGAGCGCCGAAGAAG
AGGACGTTCCGCAAGTACAGCTACCGCGGCGTGGACCTGGACGCGCTCCTCGACATGTCCACCGACGACCTCGTC
CAGCTCTTCCCCGCGCGCGCCCGCAGAAGGTTCCAGAGGGGCCTGAAGAGGAAGCCCATGGCGCTCATCAAGAAG
CTCCGCAAGGCGAAAAAGGATGCACCTGCTGGTGAGAAGCCAGAGCCTGTGAGGACCCACCTCAGGAACATGATC
ATTGTGCCTGAGATGATCGGAAGCATCGTCGGTGTCTACAACGGCAAGACCTTCAACCAGGTTGAGATCAAGCCT
GAGATGATTGGTCACTACCTTGCGGAGTTCTCCATCTCCTACAAGCCGGTTAAGCACGGTAGGCCCGGTATTGGT
GCCACCCACTCCTCTCGGTTCATCCCTCTCAAATGAGTCATGCAGCTTCTAGCCATCCAGAATCAGAATTCAGTG
TTAAGCGCCCATGGCTTGTCCTTCCAGTATCACTTGTTTTTTGAGCAAGTTATATACCTAAGGCATTTTGTTCTG
TTTAGATAAGCAGCACTGTGCACAATGATCTGTTTTGCCAAGTTTATGTGAGAATCTTGTTAACGTTGTCGTGAT
CGTATTGTTGATTCTTAATTCTTAAAATCCTGGTTTGGAATTTTCATTAATCTGGTACTCCTACCAGAATGGATT
AGCACC

> SEQ ID NO:1914  215429  146010_301063_1b
AAATCACACGAACCCTACACCTGTCCTTATATATGGCTCTCACGTCTCGGTAACTCATCATTCATCATCTTTCCC
TCGAAACCCTAGCCGCAGTCACTTCCGTAGGTGCTTGCTTAACTGCTAGTTCGATTCCAAACCATGGCGGACGTT
GAAGGTGCTGATGTTGCGGCCGGACAGCCAAAGAAGAGGACGTTTAAGAAGTTTAGCTACAGAGGAGTAGATCTG
GATGCTCTTCTTGACATGTCTACAGATGAGCTCGTCAAGCTCTTCCCTGCTCGCCCTCGCAGAAGGTTCCAGAGG
GGCTTGAAGAGGAAGCCAATGGCTTTGATCAAGAAGCTGCGTAAGGCGAAACGTGAGGCTCCACCAGGTGAGAAG
CCAGAGGTTGTCAGAACACATTTGAGGAACATGATTATTGTACCTGAGATGATTGGAAGTGTTATTGGAATCTAC
AATGGGAAAACATTCAATCAAATTGAGGTCAAGCCTGAAATGATTAGCCACTATTTAGCTGAGTTCTCAATCTCA
TACAAGCCTGTCAAGCACGGTAGGCCCGGTATTGGTGCTACTCACTCTTCAAGGTTCATTCCATTGAAGTAGTCT
AAAAAAGGTTCATTCCATTGAATTGATTCAGGCAGAGGTTTTCGTTATGGTTTCTAGTAATACTAGTACTTTATT
TTACTGCAATTTTGATGAGAACAATGGATGTTGATCTGTGATTAGTCTTGAGACTAGTATTCTGCTGATACATTG
CAGCAGACCAGTTATTTGTGCTTATCTAGAGGGTTGTTCCATTTTGATTTTAATTATGTGTTCAGTTAGATAATT
GAAGTGTTAAAAGTCCTACTGACATCCATTACTGGATGGTGTTGCCCT

> SEQ ID NO:1915  215429  124724_300437_1b
CCTACCGAACCCCGTCTCCGCCTCCCCCGAAGGTCGCTGATTTCCATCTTCACAACCATGGCAGACGTTGAAGCC
GATGTGACGAGTGGACAGCCAAAGAAGAGAACGTTTAAGAAGTTTAGCTACAGAGGCGTTGATCTCGATGCTCTT
CTCGATATGTCCACTGATGAGCTCGTGAAGCTCTTCAATGCTCGTCCTCGTAGAAGGTTTCAGAGAGGTTTGAAG
AGGAAGCCGATGGCACTGATCAAGAAGCTGCGGAAGGCTAAACGCGAGGCTCCACCAGGTGAAAAGCCAGAGCCT
GTCAAGACTCACCTGAGGAACATGATTATCGTTCCTGAAATGATTGGAAGTGTTATTGGAATTTATAATGGAAAG
ACTTTCAATCAGATTGAGGTCAAGCCTGAGATGATTGGCCACTATTTGGCGGAGTTCTCCATCTCATATAAGCCT
GTCAAGCATGGTAGACCTGGTATTGGTGCTACTCACTCGTCAAGGTTTATACCACTCAAGTGATCTGGCCGAGTT
CTCTATCTCATATAAGCATATCAAGCTTGGTAGACCTGGTATTGGTGCTACTCACTCGTCAAGGTCCATACAACT
CAAGTGATTTTGGCGCCAATGTCTACTTTTGCTTCTGTTCTAGCCTTGTCTGAACTATTTCGTACAACAATTTTG
ATGT

> SEQ ID NO:1916  215429  1114137_301843_1b
GAAAGGGAAGGAGGTTTTGCTGGAGGCCGAGGAGGAGGAGGAGGGAAGGAAGGAAGAAGAAGGCTGCTTTTTTTC
GAAGTCTTACGGCAGCTATGGAAGGTGGAGATGTGGAGCCTGGGACGCTTCAGCCCAAGAAGAGAACGTTCAAGA
AGTTCACCTTCCGAGGAGTCGATCTTGATGCCTTGCTTGATATGTCCTCTGATGAGCTTGTTGAGCTTTTCAATG
CCCGAATCCGAAGAAGGTTCCAGCGAGGATTGAAAAGGAAATCTGTGGCTCTGATTAAGAAGCTGAGAAAGGCGA
AAATTGATGCACCAGCTGGTGATAAGCCTGAACCTGTGAGGACTCATTTGCGCAACATGGTTATTGTCCCTGAGA
TGATTGGTAGTGTTATTGGTGTCTACAATGGCAAGACCTTCAACCAAGTTGAAATCAAGCCTGAGATGATTGGTC
ACTATCTTGGAGAATTTTCGATCTCCTACAAGCCAGTGAAGCATGGTCGCCCCGGTATTGGAGCTACACATTCAT
CTCGTTTCATTCCTCTGAAGTAAACCGAGTTGACGACGGTGATGTATTTATTGGTCCTGCCTCCCTGTCCTTTAA
TACCGGTTTGGGTTGCTTGCCAATGAAGTCACAATGCGGCTGACTTATGCCTTATTTGTT

Figure 2 continued

> SEQ ID NO:1917 215431 1118003_301852_1b
GGGCCAGGGATAGAGAGGAGGAGAGTCTGTCGTTGTACCAGGAGGAGGAGGAGGACGAGTAGGAGGAGTCCTAGG
GTTTAGTAGAAGACAGCAACCATGGTGGCCGCGGAGAAGAAGCTGTTGAACCCCATGAGGGAGATCAAGGTGCAG
AAGCTCGTCCTCAATATCTCCGTTGGTGAGAGTGGTGATCGCCTTACCAGGGCTGCTAAGGTGTTGGAGCAATTG
AGTGGACAGACTCCTGTCTTCTCGAAAGCTAGATACACTGTGCGTTCATTCGGTATCCGCCGTAATGAAAAGATT
GCATGCTATGTGACTGTCAGAGGAGAGAAGGCAATGCAATTGCTAGAGAGTGGCTTGAAAGTCAAGGAATACGAG
TTGCTGCGCAGGAATTTCAGTGACACTGGTTGCTTTGGCTTTGGAATTCAGGAGCACATTGATTTGGGAATCAAG
TATGACCCATCGACAGGTATCTATGGTATGGATTTCTTTGTAGTTCTGGAGAGGCCAGGATTCAGAGTTGCGAGG
AGAAAGAGGGCGCAGGCACGCGTTGGCATTCAGCAAAGGGTAACGAAGGAGGATGCCATGAAGTGGTTCCAAGTC
AAATATGAAGGAGTCATTCTCAACAAGTCCTCCAACATCAGTTAGTTAGTTATCTATCTAACTGCCTGCAGGCTT
TGTAGGACAAAATTAGTG

> SEQ ID NO:1918 215431 41636_300197_1b
CTCGAGCTTGCGGCCGCCTAATCTTGAGATGGCATCGGAGAAGAAGCTCTCGAACCCTATGAGGGATATTAAGGT
CCAGAAGCTAGTTCTTAACATCTCTGTTGGTGAGAGTGGTGATCGTCTCACTCGTGCCTCCAAGGTGTTGGAACA
GCTCAGTGGTCAGACTCCTGTCTTCTCTAAGGCGAGGTACACTGTGAGGTCTTTCGGTATCAGGCGTAATGAAAA
GATTGCGTGCTATGTCACCGTGAGAGGTGAGAAGGCAATGCAGCTTCTTGAGAGTGGCTTGAAAGTGAAGGAATA
CGAGCTGTTGAGGAGGAACTTCAGTGACACTGGCTGCTTCGGATTCGGTATCCAGGAGCACATTGATCTTGGAAT
CAAGTATGATCCTTCTACCGGTATCTACGGTATGGATTTCTACGTTGTTCTTGAACGTCCAGGATACCGTGTGGC
CCGTCGCCGTAGATGCAAGACTCGCGTTGGTATTCAACATAGAGTTACCAAGGATGATGCCATGAAGTGGTTCCA
AGTTAAGTATGAAGGAGTTATCCTCAACAAGTCTCAGAACATCACTGGTTGAAGAGCTTTTTTTTGTCATTTTGT
TTTGTTTCAAGTTCTTATATTTAAGATTCTGGATAGTAAGGATTTCGTGTTGTGGTAACCTTTTTGCGGCCGCAA
GCTCGAG

> SEQ ID NO:1919 215431 254679_301634_1b
GGGGATATTGAGGAGGAGAGTCTGTCGTTGTACCAGGAGGAGGAGGAGGACGAGTAGGAGGAGGCCTAGGGTTTA
GTAGAAGACAGCAACCATGGTGGCCGCGGAGAAGAAGCTGTTGAACCCCATGAGGGAGATCAAGGTGCAGAAGCT
CGTCCTCAATATCTCCGTTGGTGAGAGTGGTGATCGCCTTACCAGGGCTGCTAAGGTGTTGGAGCAATTGAGTGG
ACAGACCCCTGTCTTCTCGAAAGCTAGATACACTGTGCGTTCATTCGGTATCCGCCGTAATGAAAAGATTGCATG
CTATGTGACTGTCAGAGGAGAGAAGGCAATGCAATTGCTAGAGAGTGGCTTGAAAGTCAAGGAATACGAGTTGCT
GCGCAGGAATTTCAGTGACACTGGTTGCTTTGGCTTTGGAATTCAGGAGCACATTGATTTGGGAATCAAGTATGA
CCCATCGACAGGTATCTATGGTATGGATTTCTTTGTAGTTCTGGAGAGGCCAGGATTCAGAGTTGCGAGGAGAAA
GAGGGCGCAGGCACGTGTTGGCATTCAGCAAAG

> SEQ ID NO:1920 215431 236778_301261_1b
GGGTTGGAGGCGCCGCGGCATGGCGGAAAAGCAGAACCCCATGCGGGACATCAAGGTCCAGAAGCTCGTCCTCAA
CATCTCCGTCGGCGAGAGCGGCGATCGTCTCACCAGGGCCGCCAAGGTCCTGGAGCAGCTCAGCGGGCAGCAACC
TGTCTTCTCCAAGGCCCGGTTCACGGTCCGGTCTTTTGGCATCCGGCGTAACGAGAAGATCGCTTGCTACGTGAC
CGTTCGGGGCGACAAGGCGATGCAGCTACTCGAGAGCGGGCTCAAGGTCAAGGAATACGAGCTGCTGCGCCGCAA
CTTCAGTGACACTGGATGCTTTGGCTTCGGCATCCAGGAGCACATCGACCTGGGCATCAAGTACGATCCATCGAC
GGGCATTTACGGGATGGATTTCTACGTAGTGCTGGAGCGGCCTGGCTACCGCGTCGCGAGGAGGCGGCGGTGCAA
GTCCAAGGTTGGGATCAAGCACCGGGTGACCAAGGAGGACGCCATGAAGTGGTTCCAGCTCAAGTACGAGGGCGT
CATCCTCAACAAGTCCCAGGCCTTCTGACCTGCTTGACACATAAAAACCAAAGCCGGATGTAACCTCTCTTGTGG
TGTGTTTTATATCAGCTTTTTTCCAATGATCTAGAAAGTTTTCGGTCAG

> SEQ ID NO:1921 215431 228247_301019_1b
GATGCGGGAGATCAAGGTGCAGAAGCTCGTGCTCAACATCTCCGTCGGCGAGAGCGGCGACAGGCTCACCCGCGC
CTCCAAGGTGTTGGAGCAGCTGAGTGGGCAGAGCCCAGTTTTCTCCAAGGCGAGGTACACCGTGAGGTCATTCGG
TATCCGTCGTAACGAGAAGATCGCGTGCTACGTCACCGTCAGGGGCGAGAAGGCCATGCAGCTTTTGGAGAGTGG
CCTCAAGGTCAAGGAGTACGAGCTGCTGAGGAGGAACTTCAGCGAGACCGGATGCTTCGGGTTCGGTATCCAGGA
GCACATTGATCTTGGCATCAAGTACGACCCGTCAACTGGTATTTATGGCATGGACTTCTATGTTGTTCTTGAGCG
TGCTGGATACCGTGTTGCTCGCCGGCGCAGGTGCAAGTCCCGTGTTGGAATCCAGCACAGGGTGACCAAGGAAGA
TGCCATGAAGTGGTTCCAGGTCAAGTATGAGGGTGTCATCCTCAACAAGGCCCAAGCAAACACGTCGTAATTGGC
AAGGGTTTAACCAGTTATCCTGTAGAATTAAGTGAGGGTTCATTTGAATCATGGAACTGTCTTTCTTGAAAGCCA
AATGCACTGTCAATTTTGCCTCTGTTGGAGTTGACCTGCGTCTATATTTCCATTAAATGCTTAATGATATCCTTG
TTTTAAATCTTAATATTAAGGCAGACTTGGAATCAATCCACCCGCTTTGTTACCTGG

> SEQ ID NO:1922 215431 155570_301357_1b

Figure 2 continued

GAATCGAAATGGCTTCAGAGAAGAAGTTGAGCAACCCAATGAGGGAAATCAAGGTTCAGAAGTTAGTCCTTAACA
TCTCTGTTGGTGAAAGCGGAGATAGGCTCACCAGAGCAGCCAAGGTCTTGGAGCAACTCAGCGGCCAATCCCCTG
TTTTCTCTAAGGCTAGGTATACTGTCCGGTCCTTCGGAATTAGGCGTAATGAGAAGATTGCTTGCTATGTCACTG
TCAGAGGAGACAAAGCTATGCAGCTCCTTGAGAGTGGATTGAAAGTCAAGGAATACGAGTTGTTGAGAAGAAACT
TCAGTGAGACTGGCTGCTTTGGTTTTGGCATTCAGGAGCACATTGATCTTGGAATCAAGTATGACCCTTCAACCG
GTATCTATGGTATGGATTTCTATGTTGTGCTTGAGCGCCCAGGATACCGTGTTGCTCGTCGTAGGAGGTGCAAGG
CCCGAGTTGGAATTCAGCACAGGGTCACAAAGGATGACGCTATGAAGTGGTTCCAAGTCAAATATGAAGGTGTTA
TCCTTAACAAATCCTCAAACATTCAGTAAGTTGATTGTGGATCAGTTTGTCCCCCAGCAAGTTTATGTTTTCTAT
GCATTTTGTAGACCAACATTTAATACTCCTAGAGTTCAAAGGTTTTGAAGAGTTGCTGTTATTTGGCATATCAGG
ATAT

> SEQ ID NO:1923 215431 120067_300083_1b
CCCCCCCCATCTCATTACCCAACAACTCTTCCAGCTACTGCTGCTGTTACATCTTCCTGCGGTAGCGCCATGGCT
TCAGAGAAGAAATTGAGCAACCCCATGAGAGAAATTAAGGTCCAGAAGCTCGTTCTCAATATCTCCGTCGGTGAG
AGCGGAGATCGTCTCACCAGAGCAGCTAAGGTCTTGGAGCAGCTTAGCGGCCAATCCCCTGTTTTCTCCAAGGCT
AGGTATACTGTGCGGTCTTTTGGAATCAGGCGTAATGAAAAGATAGCTTGCTATGTAACTGTCAGAGGGGAGAAA
GCTATGCAGCTACTTGAGAGTGGATTGAAAGTTAAGGAATACGAGTTGTTGAGAAGGAACTTCAGTGAGACCGGC
TGCTTTGGGTTTGGTATTCAGGAGCACATTGATCTTGGAATTAAATATGATCCGTCAACTGGTATTTATGGCATG
GACTTCTATGTTGTATTGGAGCGTCCTGGATACCGTGTTGCCCGTCGGCGCAGGTGCAAGTCTCGAGTTGGGATT
CAGCACAGAGTCACAAAGGAGGATGCGATGAAGTGGTTCCAGGTCAAATATGAAGGTGTTATCCTTAACAAGTCC
TCAAACATTCAGTGATAAGCTTAGAAAGCCAACTTCTGGATCAGTCTGTCTCCTCGCAAGTTTATGTTTATGTAT
TTTGTTGACCTGCATCTATATCACTCGTAGAGGGAAGTTTTGGAGAGTTTCTAGTAGTGGCGTATGAGGATGTTT
TAGTTCTCATTTTGGCTATCAGATCAATTCAATCTTTTTTTGGTCATTTTCTTTTGTTCCAATTAAATCAGATTC
ATTGAACTCCACAATCTAGTACAATAGATG

> SEQ ID NO:1924 215431 187284_300675_1b
GCAGTCGAACCCGATGCGGGAGATCAAGGTGCAGAAGCTCGTGCTCAACATCTCCGTCGGCGACAGCGGGGACAG
GCTCACCCGCGCCTCCAAGGTGTTGGAGCAGCTGATTGGGCAGAGCCCAGTTCTCTCCAAGGCGAGGTACACCGT
GAGGTCATTCGGTATCCGTCGTAACGAGAAGATCGCGTGCTACGTCACCGTCAGGGGTCGATAATGCCATGCAGC
TTTTGGAGAGTGGCCTCAAGGTCAATGAGTACGATCTGCTGATGAGGAACTTCAGCTAGACCGGATGCTTCGGGT
TCGGTATCCAATAGCACATTGATCTTGGCATCAAGTACGACCCGTCAACTGGTATTTATGGATGGACTTCTATG
TTGTTCTTGAGCGTGCTGGATACCGTGTTGCTCGCCGGCGCAGGTGCGAGTCCCGTGTTGGAATCCAGCACAGGG
TGACCAATGAAGATGCCATGAAGTGGTTCCAGGTCACGTATGAGGGTGTCATCCTCAAC

> SEQ ID NO:1925 215431 15381_300239_1b
CTCGAGCTTGCGGCCGCAAAAAGGGTTACCACAACACGAAATCCTTACTATCCAGAATCTTAAATATAAGAACTTG
AAACAAAACAAAATGACAAAAAAAAGCTCTTCAACCAGTGATGTTCTGAGACTTGTTGAGGATAACTCCTTCATA
CTTAACTTGGAACCACTTCATGGCATCATCCTTGGTAACTCTATGTTGAATACCAACGCGAGTCTTGCATCTACG
GCGACGGGCCACACGGTATCCTGGACGTTCAAGAACAACGTAGAAATCCATACCGTAGATACCGGTAGAAGGATC
ATACTTGATTCCAAGATCAATGTGCTCCTGGATACCGAATCCGAAGCAGCCAGTGTCACTGAAGTTCCTCCTCAA
CAGCTCGTATTCCTTCACTTTCAAGCCAC

> SEQ ID NO:1926 215461 1112736_301793_1b
TTACAACCATGGCTGACGTCGAGGCACTCAAGGCAAAATACGTTCTCCAAACCGCCGGCTTTGATGCCCGGTTCC
CCAACGCTAACCAGAGCAAGCACTGCTTCCAAAACTACCTCGACTACCACAAGTGCATCAATGCCAAGGGCGAGG
ACTTTGCCCCCTGCAAGCAGTTCTACCGTGCATATCGCTCGCTTTGCCCCAACGATTGGGTCTCTCGCTTTGACG
AGCAAAGGGAGAACGGTACCTTCCCTGCTTCCCTCGAACCTTGAATGTAAACACTGTCCATTTGTTACGAACCAA
GGCCAATAAAAATGTTTCTCACAC

> SEQ ID NO:1927 215516 221159_300942_1b
TCATCCATCGTCTTTGATTCATCAAACAGGTAAACAGCCTTGATAGTCCCTTTGGCATCTTCTGCATCTCCGGCT
TACACAGTCAATCCAGCTCTTGGATCCGTTCTGATCCAGCCAACCAACCATCGCCATGTCTGAACCTCTCACCAA
GGTCGACTCCGCCGTTCAAGGCCTGTCATCATCACCGCCCAAAGAGAAGGGCCATAGGAGAACAAGCTCTAGCGC
GGCTGGTGTTATGACCATTGCGGAAATCAATGAAAGCCATGCTCCTCTAGAACTCGCAATAGAGACACAGCAGAC
AGCGTGGAAATAAATCAGCGGCCCAAGGATCTCGACAATGATCAGCTGCTACAGGTTCCCCTCACCAAGCCTCC
CATCAAGAGCATAACATTGAGGTTCCCTCATGGCAAAGAAGTCGTGGCTCGCAACCTGAAGGGCCTGACAATAGG
TGACGCCCTGTCGGCCATTCACAAGGCAAACAAGAACCGAGCTGATGATGAGCTTGATAATCCATACCTCAAGGG
CTTCGCATGGGATCAGGGCGAGAACTACTTTGAAGTACATCTCCAGAGCCAGCCGGCGACGGGCTCGTCAAGCGG
CGGTGGCGGTGGCAAGAAGAAGAAGAAGTCCAAGGACAATGACGAGTAAATGAATATCCACCCATCCTAATGTCT

Figure 2 continued

GTTCAATAGTTCCTTCAATTGTTTTTTGTTTGGCTTCGCCTGGTTCGTGCGAGTCGGCGCCCGGGATATTGCAA
CTAGATGTTG

> SEQ ID NO:1928 215550 210454_300889_1b
TTCTCTCTGCATACCAAACCACTTCCTCCCCCCGCAAGCAAACACAGTCTTTTCAGCTCTCTCTGGGCTTTTATA
TACGCATAGACTCTTCCATCGTTCTTTGTCAAATTCATCCTCCTCTTCAACCACAACAAGCCTTCGTTACACCGC
TTTACGAAGCCCCTTCTTCTCTCCTCTCCTCCATTCTTCTACCTTTTCCACACAACAAACACACACAGTCACA
ATGGCCTTCTCTACTCGAAGCGTACTGCGCGCCTCTCGCGCCGTCAACTTCTCAGCTGCCTCCCGTGTTGCTGCT
CCCAGCAACGCCGTCCGCTTCTTCTCGGCCTCCCGTGCCGTCCGCGTGTCTGACACTGCCAACAAGAAGAGCGTT
GTTCGCGAGAAGGAGGTTCCCGTCACCGTCTATGGCGCTGGCCAGGGTGACAAGCAGACACTGCAGGTTCCTGAT
GGCGCCTCCAAGGTCCCCTACGACAGCCCCGTCCCCGCTGAGCGTGAGGAGGTCGAGCCTCTTAACAAGAAGGTC
TACGACCAGCTGCCTCACACCGTCAAGAGCATGACGGTTCAGGACAAGGTCATCATCATCACTGGTGGTGCTCGA
GGCCTGGGCAACCACATGGCCCGAGCCTGTGCCGAGGCTGGTGCCAAGGCCATCATCATCTTCGATGCCAACCAG
GAGCTGGGCGACGCTTCCGCTGCTGAGCTGCACCAGAAGTCTGGTCTCCCCGTCTCCTTCT

> SEQ ID NO:1929 215552 258632_301698_1b
ATCTAGTCATCTCACGACATTTGACTAACGACTCTATTTATTAACCTGACGGTGCACCCCAACCCAGTAACACGT
TACTAACTACCCCGTCTCTATCACCACGTGACTCTGAACCAAATCTTTGGCTTTATTTTCACGTTCCCAACACAA
AATCCAAACCGCCAATCACCCCATCTTTTTAATCAGCAACTCTCCCCTCAACACTACGGTTTTCGAAGTAGTTAT
TTATTCATATTTATAATGTCATACTTTGCATCAGTCCCCGCAGCTCCCGCAGATGCCCTTTTCGGCCTCATGGCC
AAGTACAAGGCCGATACCTTCGACAAGAAGGTCGACCTCGGAGTCGGAGCCTACCGAGATAACACCGGAAAACCC
TGGGTCCTCCCTGTCGTCTCCAAGGTCGATTCTCTGATTGTCGCCGACCCCACTGCCAACCACGAGTACCTCCCC
ATCACTGGTCTGCCAGACTTCACCAAGTCTGCCGCCAAGCTGATTCTGGGGCCTGACTCTCCTGCCATCAAGGAG
AACCGAGTTGCCTCTTGCCAGACAATCTCTGGAACTGGAGCAAACCATCTGGGATCTCTCTTCCTGTCGCGGTTC
CCCTCCTCCGCCGCTCCCCCAAGAGCGTCTTCCTCAGCCGTTCTCCCCCTTCCCTGGAGCAACCGGAGATACT
CCTCCCCGAGCTGCTGGCGGCCGAATCTGGATCTCCAACCCCACCTGGGCCAACCACAAGCAGATCTTCGAGAAC
GTCGGTCTGACCG

> SEQ ID NO:1930 215552 256651_301674_1b
GATCAGCTATGGAGAGCGTGGCGCTCAAGCGAGTTTCTGCTGTAGCCAACCATCTCAATCCCGAGCAGCAGCAGC
AGCAGCAGCAGCAGCAACTCTCCATGGCTGTCGCCGCCAGCGCCGGCGCCTCTTCGGTGTTTGATCATCTGGAGC
AGGCGCCCGAGGATCCCATTCTGGGAATAACTGTGGCATACAACAAGGACCCTCATCCCGGGAAAGTGAACCTTG
GAGTCGGAGCTTACCGCACAGAGGAAGGGAAACCCCTTATTTTGCATGTGGTTCATCGTGCTGAGGAACGTCTTC
TAGCTGATCGCTCCAGAAACAAGGAATACTTGTCAATCACTGGGCTGGCAGACTTTAACAAGCGAAGCGCGACGC
TCATTCTTGGGAGCGATAGCCCTGCTATCGTGGAGAAGAGATTGGTAACTGCGCAGTGCCTTTCTGGAACGGGTT
CCTTGCGTGTAGGAGCCGAGTTTCTTTCAAGACATTATGGTGTGAAGCTGGTTTTCCTTCCTACCCCGACGTGGG
GAAATCACTTCAAGGTTTTCATGAATGCTGGACTTGGTGTTAAGACGTATCGTTACTATGACAGCAAAACTCGTG
GTCTTGACTATGAGGGTATGCTCGAGGACATAAGTGCAGCTCCGACCGGATCGGTTATTCTCTTGCATGCATGTG
CTCATAATCCCACTGGCGTGGATC

> SEQ ID NO:1931 215552 239752_301307_1b
ATCAGCTATGGAGAGCGTGGCGCTCAAGCGAGTTTCTGCTGTAGCCAACCATCTCAATCCCGAGCAGCAGCAGCA
GCAGCAGCAGCAACTCTCCATGGCTGTCGCCGCCAGCGCCGGCGCCTCTTCGGTGTTTGATCATCTGGAGCAGGC
GCCCGAGGATCCCATTCTGGGAATAACTGTGGCATACAACAAGGACCCTCATCCCGGGAAAGTGAACCTTGGAGT
CGGAGCTTACCGCACAGAGGAAGGGAAACCCCTTATTTTGCATGTGGTTCATCGTGCTGAGGAACGTCTTCTAGC
TGATCGCCCTGCTATCGTGGAGAAGAGATTGGTAACTGCGCAGTGCCTTTCTGGAACGGGTTCCTTGCGTGTAGG
AGCCGAGTTTCTTTCAAGACATTATGGTGTGAAGCTGGTTTTCCTTCCTACCCCGACGTGGGGAAATCACTTCAA
GGTTTTCATGAATGCTGGACTTGGTGTTAAGACGTATCGTTACTATGACAGCAAAACTCGTGGTCTTGACTATGA
GGGTATGCTCGAGGACATAAGTGCAGCTCCGACCGGATCGGTTATTCTCTTGCATGCA

> SEQ ID NO:1932 215552 226694_300999_1b
TCCCCTCCTCACAACTCCACCAGACTCTCAAAACGATGCTCCGAACCATCGCCCGAACCCACGCTGTGGCCGCCA
CCAAGGTCGTGCGAGCCTCCACTTTTTCTGCCACCCCCGCCGCCTCTTTTGTGCGATTCCAGTCCGTCTGGGCCA
AGGTCCCCCAGGGTCCCCCCGACGCCATTCTCGGAATCACCGAGGCGTTCAAGAAGGACGCCTTTGAGCAGAAGA
TCAACCTCGGTGTTGGCGCCTACCGAGATGACGGCGGAAAGCCCTTCGTTCTTCCCTCCGTCCGAGAGGCCGAGA
AGGAGGTGGTGAACAAGGCCCTCGACAAGGAGTACGCCCCATCACCGGAGTCCCCGCCTTCACCAAGGCTGCTG
CCGAGCTCGCTTACGGCGCCGACTCCCCCGCCGTCCTCGAGGACCGAATTGCCATCACCCAGACCATCTCCGGTA
CCGGTGCTCTGCGAATCGGAGCCGAGTTCCTCAACAAGTTCTACTCCTCCAAGAAGATTCTGCTCCCCCAGCCTT
CTTGGGC

Figure 2 continued

> SEQ ID NO:1933 215553 1097838_301448_1b
GGATAGGTTGTTTCTCAGCTAGGTCAGAAGCCAGAGGTGAGGCAGAATGAAGCACAACAACGTGATCCCGAATGG
GCATTTCAAGAAGCATTGGCAGAACTATGTCAAGACGTGGTTCAACCAGCCTGCCAGGAAGAAGCGCAGACGCGT
CGCGAGGCAAAAGAAGGCTGTGAAGATCTTCCCCCGACCTACCGGGGGACCCCTCCGGCCCGTTGTCCACTCACA
GACTCTGAGGTACAACATGAAGGTTCGTGCTGGCCGAGGCTTCACTCTGGAGGAGCTCAAGGCAGCAGGCATTTC
TAGAAAACTGGCTCCAACAATTGGTGTTGCAGTAGACCATCGAAGGAAGAATCGTTGCCTAGAAAGCCTTCAAGT
CAATGTGCAGAGGCTCAACACATACAAGGCCAAGCTTGTTGTTTTCCCTCGACGTGCACGAAAGACCAAGGCTGG
TGACTCTTCTCCTGAGGAGCTTGCCAATGCTACACAGATCCAAGGATCTGCCCTTCCTATTATAAAGGACAAGGC
GGTTGTTGAGCTTGTGCCTCTTACAGATGAGCTCAAGGCCCAGAAGGGCTACGCCAAGCTTCGTGTTGAGAGGAT
GAATACGCGAATGATAGGCATCAGAAACAAGAGGGCTGCCGAGGCAGAGAAAGATGAGAAAAAGTAGGAAGAGCC
TGATTTGAGTAT

> SEQ ID NO:1934 215553 1123664_301914_1b
AGCAGGTAGGGGAAGCGGAACACAGCATTGTCGCTCCCTTGACGGCAGGCTGCAGTCTTAGCAGCAGCAATGAAG
CACAACAATGTGATCCCGAACGGGCATTTCAAGAAGCACTGGCAGAACTACGTCAAGACGTGGTTCAACCAGCCA
GCCCGGAAGAAGCGCAGACGTCTCGCGAGGCAGAAGAAGGCGGTGAAGATATTCCCGCGGCCAACCGCAGGGCCC
CTCCGCCCGGTTGTCCACTCGCAGACCCTGCGCTACAACATGAAGGTCCGCGCTGGACGTGGTTTCACTTTGGAA
GAGCTTAAGGCAGCTGGTATTTCCAGGAAACTAGCTCCGACTATTGGTGTCGCTGTTGATCATCGAAGGAAAAAT
CGCTGTCTAGAAAGCTTGCAGGCCAATGTGCACAGGCTAACCACATACAAGGCTAAGCTTATCGTTTTCCCACGT
C

> SEQ ID NO:1935 215553 127671_300471_1b
AGTAGCTAACCAGGTAAGAGATGAAGCACAACAATGTTATACCTAATGGGCACTTCAAGAAGCATTGGCAAAACT
ATGTAAGGACTTGGTTCAACCAGCCAGCTAGGAAAACAAGGAGACGTGCTGCTAGACAGCAGAAGGCTGTGAAGA
TCTTCCCTAGGCCGACTGCAGGATCACTTCGACCTATTGTTCATGGACAAACACTGAAATACAACATGAAAGTCC
GGGCTGGGAGGGGATTTTCTCTTGAAGAACTGAAAGCAGCTGGTATTCCCAAGAAACTAGCACCAACCATTGGCA
TTGCTGTTGATCATCGCCGCAGGAACAGATCATTGGAAGGTCTCCAAACCAATGTCCAGAGGCTCAAGACTTACA
AAGCTAAGCTTGTCATCTTCCCAAGGCGTGCTAAGAAAGTCAAGGCTGGTGATTCTAGTGTAGAGGAACTTGCTA
CTGCCACCCAGGTCCAAGGTTCTTACATGCCTATTACTAGGGAGCAGCCAGCTGTTGAACTTGTCAAGGTCACAG
ATGAGATGAAATCATTCAATGCCTATGGCAAGCTGCGTATCGAGCGTACAAATGCGCGACACATCGGAGCCAGGT
TGAAGAGGGCAGCTGAAGCAGAAAAGGAAGAAAAGAAATAAGCAATTAGAATTGTCGTGTAGCTTGTTAAGCATG
ATCAGTTTTCTGGTGGACTGAGTGATGAAGCTTTTGATACAATCATATTCAGGATCTTGAGCTTT

> SEQ ID NO:1936 215553 186930_300672_1b
TCGCCCCATTGTTCAGTGCCAAACACTTAAGTACAACATGAAGTCTAGGGCTGGAAGGGGCTTCACCCTTGAAGA
GCTGAAGGCAGCTGGGATCCCCAAGAAGTTTGCCCCAACCATTGGCATCTCAGTGGATCACCGCCGTAAGAACCG
CTCACTTGAAGGTCTGCAGGCCAATGTCCAGAGGCTGAAGACCTACAAGGCCAAGCTTGTCATCTTCCCAAGACG
TGCTCGCAAGGTCAAGGCTGGTGACTCGACTCCTGAGGAGCTTGCCACAGCCACCCAGGTCCAGGGTGACTACAT
GCCTATCACCCGTGGCGAGAAGCGTTCGGTTCAGGTCGTGAAGGTCACGGATGACATGAAGGCATTCAAGGCCTA
CGCCAAGCTGCGTGTGGAGAGGATGAACCAGCGCCACATCGGTGCCCGGCAGAAGAGGGCGGCCGAGGCTGAGAA
GGAAGAGAAGAAGTGAAAGGATTGCAACCTGCAACGTTAAGAATAGATGCCCTAAGTTTTATTACCATTATTGTT
ATCAGCTTCTCCTGATGCGAGACTAGCATTCTGATCTTGCTGCTGTCTGTCTACTCTTCAGTTTGAGCTTGTTTG
GGTTTCTGTCTGAAGTGAACCAAACTAAGCGCATACTACT

> SEQ ID NO:1937 215553 285304_200104_1b
GCTCCACTCGTTCTGCTCGGTGTCCTCGTCGTCGTTGTCGTGTTTAAGTCATGAAGCATAACAATGTTATTCCGA
ATGGACACTTCAAGAAAACTGGCAGAACTATGTGAAGACCTGGTTCAATCAGCCAGCACGCAAGACCAGGAGAA
GAATTGCAAGGCAAAAGAAGGCTGTGAAGATTTTCCCCAGACCAAATGCTGGAACTCTTCGCCCTATTGTCCATG
GTCAGACACTCAAATACAACATGAAAGTTAGGTCTGGTAGAGGATTCTCCCTTGAGGAGCTCAAGGCTGCAGGTA
TCCCTAAGAAACTGGCTCCAACAATTGGTATTGCTGTTGATCATCGTCGCAGGAATCGGTCACTTGAGGGCTTC
AAACTAATGTTCAAAGGCTGAAGACATACAAGGCCAAATTAGTCGTCTTCCCAAGACGTGCTCGCAAGGTCAAGG
CTGGTGATTCTGCCCCTGAGGAATTGGCTACGGCAACACAAGTCCATGGTGCTTACATGCCTATTGCACGTGAGA
AGCCATCAGTTGATCTTGTCAAGGTTACTGAAGAGATGAAGTCGTTCAATGCCTATGGCAAGCTACGTGTGGAGC
GGACGAATGAGCGTCACATTGGTGCTAGGATGAAGAGAGCTGCAGAGGCTGAGAAGGAGGAAAAGAAGTAGTGAG
GCTTATCTTGGTTGATTTACTTGTCCCATCTTTTTGAGTCCTATTTCGTTAATTAATTACAGAATTTGCTTTGAA
CTTTTTAGCTATAGCATTCAATGTCAGCTGGGTGTATGATTTTCAACACTTGTTACTTTGTTGATGAGATTTT

> SEQ ID NO:1938 215553 284635_200100_1b

Figure 2 continued

AAGAAAGCTGCAACAATCTTCCCTAGGCCAACAGCTGGACCACTTCGACCTATTGTTCATGGACAAACACTAAAA
TACAACATGAAAGTCAGATCTGGCAGGGGATTCTCCCTAGAAGAGCTGAAAGCAGCTGGTATTCCAAAAAAACTT
GCTCCAACTATAGGTATTGCTGTGGATCATAGGCGCAGGAACAGATCCTTATAAGGTCTCCAGACCAATGTCCAG
AGGCTCAAGACATACAAAGCTAAGCTAGTCATCTTCCCAAGGCATGCTAAAATAGTCAAGGCTGGTGATTCTAGT
CCCGAGGAACTTGCCACTGCCACTCAGGTCCAGGGTACTTACATGCCCATTACTAGGGAGCAGTCCACTATTGAG
CTTGTGAAGGTCACAGATGAAATGAAATCATTTAATGCCTATGGCAAGTTGCGTATTGAGCGTACAAATGAGCGT
CATATTGGTGAGAGGTTGAAGAGAGCAGCTGAAGCA

> SEQ ID NO:1939 215553 224628_300974_1b
GCTAAAAGAAGCTGGGTTTCGTAGGCGGCGGGCAGCGGCGATGGTGAAG

> SEQ ID NO:1940 215553 224179_300979_1b
CGTCGCTCGACAAAAATGGCTATCGGTAAGAACTACCCCCTCGTCAAGAACCATTTCCGAAAGAACTGGCAGGAG
CGGGTCAAGACCCACTTTGACCAGCCCGGCAAGAAGTCTTCTCGACGACTTGCACGAACCAAGAAGGCCGCTGCT
ATCGCTCCCCGACCTCTGGATCTTCTCCGACCTATTGTCCGAGCCCCCACTATCCGATACAACCGAAAGGTCCGA
GCTGGCCGAGGTTTCTCTCTTGAGGAGCTCAAGGCTGCCGGTATCCCCCGAGACTACGCTCGAACCATTGGTATT
GCCGTTGACCACCGACGACAGAACCGATCCGTTGAGGGTCTTGAGGCCAACGTTCTGCGACTCAAGGAGTACCAG
TCCAAGCTGATTGTCTTCCCCCGAAAGCTCAAGAAGGGTGAGACCAACGAGGCCAAGTCCGCCGTCCAGGTCCTC
TCCACCTCTGCTACCTTCCCCATTGTCCAGCAGGCTGCCGAGTCCGAGCCCCGAGCCATCTCTGCCGAGGCCAAG
GAGCAGAACGCATACAGAACCCTCCGAATGGCCCGATCCACCCAGCGATACGCCGGAATCCGAGCCAAGCGAGCC
AAGGACGCCGCTGACGCCGAGGCCGAGAAGAAGACATAAGCAGGTTGGCGA

> SEQ ID NO:1941 215553 200937_300711_1b
CCCACGCGTCCGGACCACTTCGCCCCATTGTTCAGTGCCAAACACTTAAGTACAACATGAAGTCTAGGGCTGGAA
GGGGCTTCACCCTTGAAGAGCTGAAGGCAGCTGGGATCCCCAAGAAGTTTGCCCCAACCATTGGCATCTCAGTGG
ATCACCGCCGTAAGAACCGCTCACTTGAAGGTCTGCAGGCCAATGTCCAGAGGCTGAAGACCTACAAGGCCAAGC
TTGTCATCTTCCCAAGACGTGCCCGCAAGGTCAAGGCTGGTGACTCGACTCCTGAGGAGCTTGCCACAGCCACCC
AGGTCCAGGGTGACTACATGCCTATCACCCGTGGCGAGAAGCGCTCGGTTGAGGTCGTGAAGGTCACGGATGACA
TGAAGGCATTCAAGGCCTACGCCAAGCTGCGCGTGGAGAGGATGAACCAGCGCCACATCGGTGCCCGGCAGAAGA
GGGCGGCCGAGGCTGAGAAGGAAGAGAAGAAGTGAAAGGATTGCAACCTGCAACGTTAAGAATAGATGCCCTAAG
TTTTATTACCATTATTGTTATCAGCTTCTCCTGATGCGAGACTGGCATTCTGATCTTGCTGCTGTCTGTCTACTC
TTCAGTTTGAGCTTGTTTGGGTTTTTGTCTGAAGTGAACCAAACTAAGTGCATACTACTTGTCTTAAGATG

> SEQ ID NO:1942 215579 224107_300979_1b
GACCCAAGATGCTTAGAACAATCAGATCCCAATCCATGCGAATGGCCTCCGCCTCGTCGCGAAGAATGCTGTCTT
CCGCCGCCTCCACATCCATGCTAAGACAAACGCTCAAGGCTCCCTCCATGACCGCTCAGGTCACTCGACCCACCG
TCATGACCTTCAAGCCTGTTCTGCTGTCCCGAGGATACGCCGACGTTGTTGAGGTGCCTCCCATGGCCGAGTCTC
TGACTGAGGGTACTCTGACCGCCTTTGAGAAGGACATTGGAGACTTTGTCGAGGCCGATGAGGAGATCGCCACCA
TCGAGACCGATAAGATTGATGTTGCCGTCAACGCTCCCTTCGCCGGAACCATCACCGAGTTCCTGGTCAAGCCCG
ACGACACCGTCACTGTCGGCCAGCCTCTTCTCAAGATTGAGCGAGGCGAGGGCTCCAGCAGCGGTGGCTCCAAGC
CTCCCAAGGAGAAGAAGGAGGAGAAGACGGAGGAGAAGGAGGAGCCTGCTCCCAAGGAGGAGTCTGCCCCTGCCC
CTAAGAAGGAGGAGGCCCCCAAGAAGGAGGAGTCTGCCCCTGCTCCCAAGAAGGAGGAGAAGAAGCCCGCTCCCA
AGGAGGAGAAGAAGACCGATGCCACCGAGGGTCTCGGCGGCTTCCGAAAGGAGGAGCGAGTCAAGATGAACCGAA
TGCGACTTCGAATTGCTGAGCGACTCAAGGAGTCCC

> SEQ ID NO:1943 215593 218695_300920_1b
GCCTTCTACCACTTTGCTCTCCTTTCAAGGCATCGCGAAGACTCTTGTCAACTCTTTTTATAATACTCTGACTCT
TCGTCCACTCTCTGCTTCTGAACCACTTCGACTCATACTACTTGCACTTGCATACACTCGGGACTCTTCCCCCGC
CTACTCTACTCTTCTACACAACCAACCACCAACGCAATGGCTCTCGACATGTGGACTCACGAGTTCTGCCTTACT
TGCACCGACAGGTCCAGGTCGACGGCGACGCCTACTGCTCTGAAGCATGCAGAATGTCCGACTTCGAAAAGACT
CCCTCTACTCCCAGCTCGCAGGCCAGCTCGCCCGGCTTCTCTCCCGTCTCCTACGCTAGATCAGGCAGCCTCTCC
AGCCGACCTGCTCCCACCAAGTTCTTCCTGTCTCCCGCCTACGACTTCAACCAGGCCCAGCCCTACGGCTCAACT
CCTCGGTCGTCATCGTCGTTTGGCAGCTACATGTCGGACATGTCACCTCTCTCCTCCAACCGGGGCCTCACCCCC
TCGAGCTCACACAGCAGCCTCTGCTCCATGCAGAGCGTATCCTCTACCGCCGAGGCGAGCCAGCTGTCAGACAAG
GCACGCATGGAACTGCGAGCATACGCTGTTTCATTCGAGCAGGTCAGACTGCAGCGCCGGCGATCATACTAAATA
AACAACATCATCATCCTACAAACAACACATACACACACATACCACACTCTACCATC

> SEQ ID NO:1944 215611 223896_300976_1b
GACACATACAAAAATGGCTACCAAGTCCGGAATCGCTATTGGACCCAACAAGGGCCACAAGGTCACTGCCCGAAC

Figure 2 continued

CCCCGCCACTCGAGTTTCTCGACGAAAGGGTGCCCTCTCTAAGCGATCCGCTTTTGTCCGAGACCTCGTAAAGGA
GGTTACCGGCCAGGCTCCTTACGAGCGACGAATCATTGAGTTGCTGCGAAACTCCAGTGATAAGCGAGCTCGAAA
GCTCGCTAAGAAGAAGCTCGGTACTTTCGGCCGTGCTAAGGCTAAGGTTGAGGACATGAACAACGTCATCACCGC
TTCTCGACACGCCTAAATTAGCTAGCATATGTATTAAAAGTATGGAAATACACCCAAAAATGTTTGATT

> SEQ ID NO:1945 215615 159833_200026_1b
AAATTTGATTGAAGCCGGAGAAAATGGCGATAGGGAGCTTAGCAAGACGAAAGGCCACAACAATTTTATCTTCTA
GATATCTCTATAGCACATCCAAATATTCATTTTCTCTTAACAGATATTACTCTTCGGGATCTGATGAAAACGACG
TCGTTGTTATCGGCGGTGGACCCGGCGGCTATGTGGCGGCGATTAAAGCTGCACAGCTTGGGCTCAAAACTACTT
GTATTGAGAAACGTGGTACCCTTGGTGGTACCTGTCTCAATGTTGGTTGTATTCCTTCTAAGGCACTTCTTCACT
CCTCCCACATGTACCATGAAGCTCAACATTCATTTGCTAGTCATGGTGTGAAGTTCTCTTCCGTTGAGGTAGATC
TTCCTGCCATGATGGGCCAAAAAGATAAAGCTGTGGCTAACTTAACACGAGGTATTGAGGGTCTATTCAAGAAGA
ACAAAGTGAACTATGTTAAGGGCTATGGCAAATTCCTTTCTCCTTCTGAAGTTTCTGTCGACACTGTGGAAGGTG
GTAATACTGTTGTTAAGGGGAAGAATATTATAATTGCCACTGGTTCTGATGTCAAAAGTCTACCTGGGCTAACTA
TTGATGAGAAGAGAATTGTATCATCCACTGGAGCTTTAGCTTTGACCGAAGTTCCAAAAAAGCTGGTTGTTATTG
GTGCTGGCTACA

> SEQ ID NO:1946 215615 181932_300658_1b
CAATCTCGGCAAATCTTCATCATCGTCATTTAAATATTCGTTTTCAGTTTCAAGAGGTTTTGCTTCTGGATCGGC
TACTGATGAGAACGATGTTGTTATCATTGGAGGTGGTCCTGGTGGTTATGTAGCAGCGATTAAGGCTGCTCAATT
AGGTCTTAAGACCACTTGTATTGAAAAACGTGGTGCTCTTGGTGGTACTTGTCTTAATGTTGGTTGTATCCCTTC
TAAGGCCCTTTTACACTCCTCCCACATGTACCATGAAGCCAAGCATGCATTTGCTAATCATGGTGTTAAGGTTTC
AAACGTGGAAGTTGATTTGCCTGCAATGCTTGGTCAGAAAGATAAAGCGGTTTCCAATCTCACTCGAGGTATTGA
AGGCCTCTTCAAGAAAAACAAGGTAACATATGTCAAGGGTTATGGTAAGCTTATCTCTCCATCTGAGGTCTCTGT
CGAAACCATTGAAGGGGAAAAACACTGTTGTCAAAGGTAAAAACATTATAATTGCAACAGGGTCAGATGTGAAACC
TCTTCCAGGTATAGCTATTGATGAAAAGAGGATTGTTTCATCAACGGGAGCTCTATCTTTATCAGAAATCCCCAA
GAAACTTGTTGTCATTGGAGCAGGTTATATTGGTCTCGAGTTAGGTTCCGTCTGGGGCAGGCTTGGATCAGAGGT
GACTGTTGTTGAGTTTGCGTCTGACATTGTCCCCTCCATGGATGGTGAGATTCGCAAGCAATTTCAGCGTTCCCT
TGAAAAACAGAAGATGAAGTTCATGCTCAAGACTAAAGTGGTAGGAGTA

> SEQ ID NO:1947 215638 204359_300792_1b
CCCACGCGTCCGCCCACGCGTCCGACATTCGTTGTCTGAACACTAAACCAAAAAACTCCAAAAAAAACAACTTAA
TACACACCCCCCCAACAACACTTAATACCGACAAGATGAAGGCCGCTTTCGTTGCTGTTGCTCTCGCCGCTCTGG
CCCAGGCTCAGACCCGCGCTGATATCCCATCCTGCGCTCTGCCCTGCCTCGACGACGCCGTCAAGGCCAACACCA
AGTGCTCCACCACCGACTACGCCTGTATCTGCAAGGACTTCAACGCTGTTCAGGGCGCTGCCACCGGCTGTGTCG
TTGAGAAGTGCGGTACCGACGTTGCCATCAACAAGGTCCTCCCCGCCACTCAGGCTCTCTGCGCCGCCAACTCTG
GATCCGGCTCTGGCTCTTCTTCTGCTGCCAACACCACTCCCGCCCAGCAGACCACCTCTGCCGCCCAGTCTTCTT
CTGCTGCCCAGTCTTCCTCTGCTGCTCAGTCCTCT

> SEQ ID NO:1948 215638 218769_300936_1b
TTTCACAGTCCAGCTACATTCGTTGTCTGAACACTAAACCAAAAAACTCCAAAAAAACAACTTAATACACACCCC
CCCAACAACACTTAATACCGACAAGATGAAGGCCGCTTTCGTTGCTGTTGCTCTCGCCGCTCTGGCCCAGGCTCA
GACCCGCGCTGATATCCCATCCTGCGCTCTGCCCTGCCTCGACGACGCCGTCAAGGCCAACACCAAGTGCTCCAC
CACCGACTACGCCTGTATCTGCAAGGACTTCAACGCTGTTCAGGGCGCTGCCACCGGCTGTGTCGTTGAGAAGTG
CGGTACCGACGTTGCCATCAACAAGGTCCTCCCCGCCACTCAGGCTCTCTGCGCCGCCAACTCTGGATCCGGCTC
TGGCTCTTCTTCTGCTGCCAACACCACTCCCGCCCAGACCACCTCTGCTGCCCAGACCACTCCCGTCATTCCCGT
TGGCACTGGCACTGGCGTTCCCCCCGCTGGCAACAAGACCACCACCGGTGCTCCCACCGCCCCTACCAGCGGCGC
TTCCACCATCCTGGCCGGCCTTGCCTTCATCGCCGCTCTCTGCGCCTTTGCCCT

> SEQ ID NO:1949 215638 219580_300946_1b
GCTTTCACAGTCCAGCTACATTCGTTGTCTGAACACTAAACCAAAAAACTCCAAAAAAACAACTTAATACACACC
CCCCAACAACACTTAATACCGACAAGATGAAGGCCGCTTTCGTTGCTGTTGCTCTCGCCGCTCTGGCCCAGGCT
CAGACCCGCGCTGATATCCCATCCTGCGCTCTGCCCTGCCTCGACGACGCCGTCAAGGCCAACACCAAGTGCTCC
ACCACCGACTACGCCTGTATCTGCAAGGACTTCAACGCTGTTCAGGGCGCTGCCACCGGCTGTGTCGTTGAGAAG
TGCGGTACCGACGTTGCCATCAGTATGTTTCCCCTGGTCGATCTGGGATGAAATGAGCTTCGTCTGTATACTAAC
CAATTCCCTACAGACAAGGTCCTCCCCGCCACTCAGGCTCTCTGCGCCGCCAACTCTGGATCCGGCTCTGGCTCT
TCTTCTGCTGCCAACACCACTCCCGCCCAGCAGACCACCTCTGCCGCCCAGTCTTCTTCTGCTGCCCAGTCTTCC
TCTGCTGCTCAGTCCTCTGTCGCCAGCGCTCCCCCA

Figure 2 continued

> SEQ ID NO:1950 215672 111122_300052_1b
CGGACGCGTGGGCGGACGCGTGGGCGGACGCGTGGGCGGACGCGTGGGGTCGAGTTCCAGCCA
TCTCCGAAAATGACTTTCAAGAGAAGGAACGGAGGTCGCAACAAGCATGGACGTGGCCACGTCAAATTCGTCCGT
TGCTCCAACTGCGGCAAATGCTGCCCTAAGGACAAAGCCATCAAGAGGTTTCTTGTGAGAAATATTGTTGAGCAA
GCAGCTGTTAGGGATGTGCAGGAAGCTTGTGCTTTTGAAACGTACACTCTGCCTAAGCTGTATCTGAAGATGCAA
TATTGTGTATCATGTGCCATCCACTCAAAGGTGGTTAGGGTCCGCTCTCGAACTGATAGGAGGGTCCGTGAGCCT
CCACAGCGATTCAGGCGCCCAAGGGATGATGCTCCAAAGCCTGGTCAAGCTCCACGGGTTCCTGGAGCTGCTCCG
ACAGCAGCAGCTCGTACTTGAGTGCCTGCTGTTTTGATCATGTTGTTTA

> SEQ ID NO:1951 215672 111127_300052_1b
CCCACGCGTCCGCGCCATTAGAGTTCCATCGTATTCACTGCTCAGCAGCTGCTACAACTCGTCCGGCCAAAATGA
CATTCAAGAGAAGAAACGGAGGTCGTAACAAGCATGGACGTGGCCACACTAAATTCATTCGCTGCTCTAACTGCG
GCAAGTGCTGCCCTAAGGACAAAGCAATCAAGAGGTTCCTTGTGAGGAACATCGTTGAGCAAGCAGCAGTGAGGG
ATGTTCAGGAAGCTTGTGCTTTTGAATTGTACACTCTTCCTAAGCTGTACTTGAAGATGCAATATTGTGTCTCAT
GTGCCATCCACTCCAAAGTTGTTAGGGTCCGCTCTGTTACTGATAGGAGGGTCCGTGAGCCTCCACAGCGCTTCA
GACGCCCAAGGGATGATGCTCCCAAGCCTGGTCAAGCTCCACGCCCTGCCGGAGCTCCTACTGCAGCTCGTTCTT
AAGTGCCTACATTTTGATCAACTACTGTTAGGCTTTTGGGTTTTAGTTAATTTGAGATGTATTTTTGAAGTCGAT
TTCTCTATTTAGTTTTACTGGAACTATCATTAAATTTGTGTATGCAAATCTCAAGCAAACAGGCCTGTTGTTCGT
CCTATAGCTTATATATCCTTTGCAATTAAACTC

> SEQ ID NO:1952 215672 1113974_301907_1b
ATCCACAGCTATGACTGTGAAGCGGCGGAGCCGTGGGCGTAGCAAGCATGGGCGTGGCCATGTCAATCCCATCCG
ATGCTCCAATTGCGGTCGCTGCTGCCCTAAGGACAAGGCAGTGAAGAGGTTTCTTGTTCGAACATTGTTGAGCA
AGCTGCAATTCGGGATGTCCAGGAAGCATGCGTTTACGATGGCTATGTTCTTCCCAAGCTATATACTAAGATACA
GCACTGCATCTCATGTGCAATCCACTCGCGCGTGGTGCGTGTTCGCTCCCGAGAGGCTCGGAGGAACAGGGAGCC
ACCCCAACGATTCCGCCGAAGGGAGGACACTGCTGGACCAAACCGCCCGCCTGCACCTCCACGCCCTTGAGCATA
GGGCTTACAATTGAACATCCTTTTAATCTTTAGACTCCCAATATGCTTATTATAGAGTTTCTATTTTGTGATTCA
CAAAGGTTGCGTGTCTTTTGAAAGGCTTTGCAACTAGGAATTTTCTTTGGTTTAGCAATGAGGCAAAGCTCACTC
TAGTTCAATTTTAAGCTATTTCATGATTACTGCTATTTTGTTGCCATGATGAATATAAATATTTTCACTTCTCT

> SEQ ID NO:1953 215672 255704_301643_1b
GGAAGAGGTAGAGGACTCTTTGTAGGTTTTGCTTGCAGGGTAGAAGACTCTTTTACTAGGGAGCTATGACGGTTA
AGCGTAGAAGTAGGGGACGAAGTAAGCATGGCCGTGGTCATGTTAATCCCATCCGATGCTCCAACTGTGGTCGAT
GCTGCCCTAAGGACAAAGCAGTGAAGAGGTTCCTTGTCCGCAACATTGTCGAGCAAGCGGCAATCAGGGATGTCC
AGGAAGCATGTGTTTATGATGGATATGTTCTTCCAAAGCTTTACACAAAGATCCAACATTGCATCTCTTGCGCTA
TCCACTCCCGTGTAGTACGTGTCCGCTCCAGAGAGGCTCGGAGGAACAGGGAGCCACCACAGCGTTTCCGTAGAA
GGGAGGATAATGCCCCAGGACAGAACCGTCCCCCTCCCCCTCCCCGCCCTTGAGATTTGTCAGGCAGTTCATTAA
TCCTCGAGACTTAGTGCTTTTTAATATCTTAGTTGCAGCCTATATGAAGCTCCCACTGGGGCCCTTATTTTTGTC
TTAAAACCAATTTGTGCTCCAAAC

> SEQ ID NO:1954 215672 226419_301034_1b
GCAAAGATGGTCAAGAAGCGAGCTTCCAACGGACGAAACAAGAAGGGTCGAGGACACGTTACCTCCATCCGATGC
TCTAACTGTGCCCGAATGGTCCCCAAGGACAAGGCCATCAAGCGATTCACCATCCGAAACATGGTCGAGGCCGCC
TCCATCCGAGATCTTTCCGAGGCCTCCGTCTACCAGGAGTACGTGCTGCCCAAGCTCTACCTCAAGATCCAGTAC
TGCGTGTCTTGCGCCATCCACTCCAAGGTTGTCCGAGTCCGATCTCGAGAGGGCCGAAAGGTTCGAACTCCTCCC
CAGCGAGTCCGATTCAACAAGGACGGTAAGAAGATCAACCCTGCTGCCGCCGCCAAGGTTGTCGTTTAGGCGATG
TATAAAAATTGCACTGTGTATGAAG

> SEQ ID NO:1955 215672 1120040_301861_1b
ACTAGGAAGAGGTAGAGGACTCTTTGTAGGTTTTTCTTGCAGGGTAGAAGACTCTTTTACTAGGGAGCTATGACG
GTTAAGCGTAGAAGTAGGGGACGAAGTAAGCATGGCCGTGGTCATGTTAATCCCATCCGATGCTCCAACTGTGGT
CGATGCTGCCCTAAGGACAAAGCAGTGAAGAGGTTCCTTGTCCGCAACATTGTCGAGCAAGCGGCAATCAGGGAT
GTCCAGGAAGCATGTGTTTATGATGGATATGTTCTTCCAAAGCTTTACACAAAGATCCAACATTGCATCTCTTGT
GCTATCCACTCCCGTGTAGTACGTGTCCGCTCCAGAGAGGCTCGGAGGAACAGGGAGCCACCACAGCGTTTCCGT
AGAAGGGAGGATAATGCCCCTGGACAGAACCGTCCCCCTCCCCCTCCCCGCCCTTGAGATTTGTCAGGCAGTTCA
TTAATCCTCGAGACTTAGTGCTTTTTAATATCTTAGTTGCAGCCTATATGAAGCTCCCACTGGGGCCCTTATTTT
TGTCTTAAAACCAATTTGTGCTCCAAACTTGTCTGTTTTCAGTTATAAATGAAGTTTTTTATTATGGATACA

> SEQ ID NO:1956 215678 206212_300820_1b

Figure 2 continued

ACCATCAAACAACAATACAATCCATACAGGATTACCTCTCAATTCAACCACCTTTACGACAATCGCAACTCAATA
AAATCCT

> SEQ ID NO:1957 215907 205109_300796_1b
TTAAAAACAACAGACCGAAAAACTCAAGTCATCATGTCGCACCCAGAGTCCCCCGAATTTCTCCAGGCGCAGCAG
GCCACTGAGGCTTTCACCACGAAGCCTACCAACGACGAGCTCCTTCGCCTCTACGCTCTTTTCAAGATCGGCAAG
GGCTTCGATTTGGAGTCGGCCCCCAAGCCTGGAATGTTCGACATGAAGAACAAGGCCAAGTACAACGCGTGGAAG
GCCGCTGTAGAGGAGGAGAACATCACCGACCCCGAGGAGGCACAGAAGAAGTATGTTGAGTTTGTCGAGGGGCTC
AAGTCCAAATACGCCTAATCTCGACAAGACTCGAGGATTGAATTAGAAGGGGGCACGCTGCGAGTGTAATACATG
GTACTAGAGACGCATGGCTTTTGGGATAGAATGCCAGTTAGCATGAAGAAATAAAGTAAACAAATTGTCCACAAA
AAAAAAGAACAGATAAC

> SEQ ID NO:1958 215915 195415_300634_1b
CGCCAAAAAAGTCATCTTTAGGCTTCAAAAGAGGTTGGAAAGCTCTCTATTCGCAACGGCTATCGCTCCGATCAC
TGGAATGCTGGGGCGACAGGTCATCCTTGACCTCGGCGTGGGTCTTGGATCCGGATTCATCATGGCCAAATGGTA
TTGGGACTGATAGCACATGCCGCGAAGCACAGGTCTGGACGCCTACTAGGCCGATAAAGAAGCCGAACGGGCCGG
CGCGGGATCACAGTAAGGGGGGCACTTGTATAC

> SEQ ID NO:1959 215915 205083_300795_1b
CCAAACCGCCAAACAACGCATCTTACGGCTTCACAACAGCTTGGAAAGCTCTCTATTCGCAATGGCTATCGCACC
GATCACTGGAGTACGTCCCTATTCCGGCCAATGGCGCAGCGTCGCACTGGGAATCGTGGCAGGTCCTGCTATAAA
TTCATTGGAGTAGCTAACACAGGATGCAGATGCTGCGGCGACAGCTCATCCTTGACCTCGGCGTTGGTCTTGGAT
CCGGATTCATCATGGCCAACTGGTACTGGTACGGCTACCACATGCCCCGAACCAACGGCCGAGACGCCTACTACG
CCAAGAAGGAGGCCGACCGTGCCGCCGCGGCATCACAGTAAGGGGGGCACTTGTATACTCGATGGACCGAGAGGG
AATGCGGCATGAACAACTGCTGGTCGAATAGAAGGGGAATGACTGGGCCAACGGGCTGTTCATGCCTGCAGGAGC
ATAGTTGCTGGACAGATGTCGAATATCACTGAAGAAAGGCAACCGGGCGAACCTCTACTTAGACCAATAAGTCGC
GGGGCAATACGATTCAATTATCTCGATTGGCTTATTATATGTTTTTGCCATGCCGACTCCCCTTTGTTTATTGCT
GAAAATAGTGCTGGTGGTTTCTTTCCAATTATGTACAAATTATGTGCTATACGAAGCCAATTCTCTGA

> SEQ ID NO:1960 215915 220220_300953_1b
AACAACGCATCTTACGGCTTCACAACAGCTTGGAAAGCTCTCTATTCGCAATGGCTATCGCACCGATCACTGGAG
TACGTCCCTATTCCGGCCAATGGCGCAGCGTCGCACTGGGAATCGTGGCAGGTCCTGCTATAAATTCATTGGAGT
AGCTAACACAGGATGCAGATGCTGCGGCGACAGCTCATCCTTGACCTCGGCGTTGGTCTTGGTAAATATTGGCCC
CCGACTGTCCGCAGAGCTTTGGCACAGCTATGCGGCTATTTGTTTTATTATCCGCTTTGACTCACGTTTCGTTAT
AGGATCCGGATTCATCATGGCCAACTGGTACTGGTACGGCTACCACATGCCCCGAACCAACGGCCGAGACGCCTA
CTACGCCAAGAAGGAGGCCGACCGTGCCGCCGCGGCATCACAGTAAGGGGGGCACTTGTATACTCGATGGACCGA
GAGGGAATGCGGCATGAACAACTGCTGGTCGAATAGAAGGGGAATGACTGGGCCAACGGGCTGTTCATGCCTGCA
GGAGCATAGTTGCTGGACAGATGTCGAATATCACTGAAGAAAGGCAACCGGGCGAACCTCTACTTAGACCAATAA
GTCGCGGGGCAATACGATTCAATTATCTCGAT

> SEQ ID NO:1961 215917 205004_300795_1b
ACCACGCGTCCGGGTTTGGGCAGAGGTTGCCCCCACCCCGCCGTAAGGTCCCGTACGTGTGGGTGGTTGATGGGT
TGAGTTTGGATAGCAGGAATCTCAGCTTGGGCAGCCGCCTGCGTCGCAAATGCATGCAATCTCAGGCAGTGGGAA
TCGCATCTGTGATGCAGGTCCTCAAAGCAGTCAATGTTAGCCG

> SEQ ID NO:1962 215918 1007654_301402_1b
GAAGCAAAGCGTGTATCAACGCTCCTTTCTCGTCTCTCTCTCTCTCTCTCTTCTCTTCCGGGCTGCTCCTCTTTT
TCTCTCTCTCTCTTTCTCCCTCTCTTCTCGCGACGGAAGGAAGGCGGAATACTCCTTTCTCTTTCTCTTTCTCTC
TCTCATACCGAGGTATTTAGGGTTTCCACAGGCGGAGAGAAGAGAGAGAGAGAGAGCGTCTTTCTTCCTCTAC
CGCTGCTACTACTACTGCTACGACCATGTCGGGGATCGCCAATGCTAACCTACCGCGGCGGATCATCAAGGAAAC
TCAACGGTTATTGAGCGAGCCAGCCCCTGGCATAAGTGCATCACCTTCTGAGGATAACTTACGGTATTTCAATGT
TATGATTCTTGGCCCAACTCAATCTCCCTATGAAGGCGGGGTTTTCAAATTGGAATTGTTTCTACCCGAAGAATA
CCCAATGGCGGCTCCAAAGGTCCGATTCCTGACAAAAATTTATCATCCGAATATTGACAAGCTGGGCGCATCTG
CCTCGACATTTTGAAAGACAAGTGGAGCCCTGCACTCCAAATTCGGACAGTCCTTCTAAGTATTCAGGCCCTTTT
GAGTGCACCGAATCCTGACGATCCACTTTCTGAGAACATTGCGAAGCATTGGAAGACTAACGAGGCAGAAGCTAT
GCAAACAGCAAAGGAGTGGACCAGGATGTA

> SEQ ID NO:1963 215918 103561_300363_1b
TGGTATCAACGCAGAGTGGCCATTACGGCCGGGGGTTACATAGGAATAAGTAATATATTTATTGTTTTCCCCTTC

Figure 2 continued

> SEQ ID NO:1964 215918 104744_300367_1b

```
GTCCAAACTATAGGCTCAAATACCTTATCCAAGCTCAGCAGATCTCCGTTTTCACCTAATTCAATCAATCGCCTC
GCATCTTCTAGGGCTTGGATTTGAAGGTATACGAGCTAATCTATGGCGTCGAAGCGTATATTGAAGGAGCTCAAG
GATTTGCAGAAGGATCCTCCGACATCATGCAGCGCTGGTCCAGTTGCTGAGGATATGTTCCACTGGCAAGCAACT
ATCATGGGTCCTACGGATAGCCCTTATGCAGGAGGCGTATTTTTGGTTTCGATTCATTTCCCTCCTGATTATCCT
TTCAAGCCTCCAAAGGTTGCATTTAGAACTAAGGTTTTCCACCCCAACATCAATAGCAATGGAAGTATATGTTTG
GATATTCTTAAAGAACAGTGGAGTCCAGCTTTGACCATATCCAAGGTCTTGTTGTCCATCTGTTCTCTGTTGACT
GATCCAAATCCAGACGATCCACTTGTACCAGAAATTGCTCATATGTACAAGACTGACAGGGCCAAGTACGAGGCC
ACTGCTCGTAGCTGGACACAGAAATATGCTATGGGATGATGCGGAAAGTGTCCTTGGACGTGCCTGAGACACTTT
TAATTGCAACAGTTTCATTGTGCTTTCACCCTTAAGTGCAATGTCTTTGTGCTTGGATGAAAGTAAAATATTG
```

> SEQ ID NO:1964 215918 104744_300367_1b

```
CCCACGCGTCCGCCCACGCGTCCGCCCACGCGTCCGCCCACGCGTCCGGCTCAGCATCTCTAGGCTTCAGCACTG
CAATCTTCGTCTTTCTGCAAACTCAATTAATCCCCTCTACCACTCTGCCACCTTCAGATTTGAGCTTGGGTTTGA
AGGTAAGGAAGTAACATATGGCGTCAAAGCGCATATTGAAGGAGCTGAAGGATCTGCAGAAGGACCCTCCCACGT
CATGCAGCGCTGGTCCTGTGGCTGAGGACATGTTCCATTGGCAAGCAACAATCATGGGCCCTACAGATAGCCCTT
ATGCAGGGGTGTATTCTTGGTTTCTATTCATTTTCCTCCTGATTATCCGTTCAAGCCACCTAAGGTTGCATTTC
GAACTAAGGTTTTCCACCCTAACATCAATAGCAATGCATTTGTCTGGATATTCTTAAAGAGCAGTGGAGTC
CAGCATTGACCATATCTAAGGTCCTGTTGTCCATCTGCTCTCTATTGACAGACCCAAATCCAGACGATCCTCTTG
TACCAGAAATTGCTCATATGTACAAGACTGACAGGTCCAAATATGAGGCCACTGCTCGTAGCTGGACACAGAAAT
ATGCCATGGGATAATAGCAAAAGTGTCACCGGGCATGTCAGAGACTTTGTAGCTGCACCGTCTTAATTGTGCTTG
GGTG
```

> SEQ ID NO:1965 215918 107417_300264_1b

```
ATCGAGTAGGAGGATCTCTGAGGGATATGGCATCCAAGAGAATTCTGAAAGAGCTCAAGGATCTGCAGAAAGATC
CTCCCACCTCTTGTAGCGCTGGCCCAGTTGCTGAAGATATGTTTCACTGGCAAGCAACACTTATGGGTCCATCTG
ACAGTCCTTATGCTGGCGGAGTGTTTCTTGTTACCATTCATTTTCCACCTGATTATCCATTTAAGCCTCCAAAGG
TAGCTTTTAGGACAAAAGTTTTTCACCCAAACATCAACAGCAATGGTAGCATTTGCCTCGACATTTTGAAGGAAC
AGTGGAGCCCGGCACTCACAATATCTAAGGTGTTGCTGTCCATCTGTTCTCTTCTAACAGACCCAAATCCTGATG
ATCCTTTGGTGCCTGAGATTGCTCATATGTACAAGACTGATAAAAGCAAGTACGAAGCCACTGCTCGGAGCTGGA
CTCAAAAATATGCCATGGGTTAGTTGCTGAAACACAAATATTTGGCTTTTATCTATGATGTATTAAGAAATTGTG
TTATGCATAATTAACTCAAGGGAAAGGTTGAATTGTGGCCCTCTGTAAAACACTTAATTTTCCTCATGTTTGTAA
GATTAAATGGTTTTGAAATTCTG
```

> SEQ ID NO:1966 215918 1099839_301451_1b

```
TAAGAGTATCTGCGTTGAATTGAAGCGAAAGGACTTTAAGGAATGGCATCCTCTGCTCAGCTTCGATTGATGTCC
GATCTGAAGGCCATTAGCCATGAGCCACCTGAGGGATGCAGTGCCAGCCCTTATAGCGATGCGGACCTTTTTGTT
TGGGACGCCACAATATTTGGTCCCGAAGATACTCCATGGGAATGTGGCATTTTCTGCCTCCGTTTGGTCTTTGGA
GAGCATTACCCTGCCAAACCACCTCGTGTCAGGTTTACTTCCGAGATATTTCACCCCAATGTGTACAATGATGGC
ACCTTATGCATGGACATTATACAAGATGCTTGGTCTCCTTGCCACAACATCTGTACAATTCTAACATCTGTTCAG
TCATTGCTAACAGATCCGAATCCCGCAAGCCCAGCTAACTCGGAAGCTGCACATTTATATCAAACTGATATTCAA
GCATATAACAGGCGAGTTCGGCGTTGTGTGAGGAAGTCTTTGGAAAGCACATAGTATACT
```

> SEQ ID NO:1967 215918 1100258_301458_1b

```
AGAGAAGAGTAGAGTAGAGTAGTGAAGAGAGGAGAGAGCATGTCTGGAGGAATAGCTCGAGGTCGTCTAGCAGAG
GAGCGCAAAGCATGGCGCAAGAATCACCCTCATGGGTTTGTGGCGAGGCCTGATTCTCAACCGGATGGTTCAATG
AACTTGATGCTTTGGCAATGCATTATACCTGGAAAAGTTGGGACTGATTGGGAAGGTGGTTTCTTCCCTTTGGCA
ATTCATTTCAGCGAAGACTATCCCAGCAAGCCACCCAAGTGCAAATNTACCCAAGGGTTTTTCCATCCGAATGTG
TACCCATCTGGGACAGTGTGCCTGTCCATATGGAATGAGGATTCGGATGGAGACCTGCCATAACTGTCAAACAA
ATACTTGTGGGAATTCAGGACCTTCTTGATTCACCGAATCCTGCAGATCCTGCCCAAAGTGATGCATATCAACTC
TATGTTCAAGATCCCATTGAGTATAAAAAGAGGATTAGACAGCAATCCAAGCAATATCCTCCCCCTATTT
```

> SEQ ID NO:1968 215918 1171183_302053_1b

```
GTACAAATGTCTTCTCTCTCTCTCTCTCTCTCGTTCCTTTCGTTTCTTTGCCTTCCCTATAACGGCGGTGG
CTATTTAAGAACTCCAAGTAGCAGAAGTTATAGTTGAAGAGGGATCTGGATCTGAATCTGAATCTGTGTCATGGC
TAGCAAGAGGATTTTAAAGGAACTCAAGGATCTGCAAAGGGATCCCCCAACCTCTATGTAGTGCTGGTCCTATTG
CAAATGATATGTTCCATTGGCAAGCCACTATCATGGGTCCCTTTGATAGTCCATATGCTGGAGGAGTTTTTCTGG
TTACCATTCATTTCCCCCCAGACTACCCATTTAAGCCTCCTAAGGTGTCCTTCAAAACCAAAGTCTTCCATCCAA
ATGTCAATAGTAATGGAAGCATTTGCCTTGACATCTTGAAGGAACAATGGAGTCCTGCTCTAACAATAGCAAAGG
TCCTACTCTCGATATGCTCTCTTTTGACTGATCCCAATCCTGATGACCCTCTCGTTCCAGAAATAGCCCACATGT
```

Figure 2 continued

ATAAAACAGACAGGGCAAAGTACGAGACAACTGCAAGGAGTTGGACCTTGAAGTATGCTATGCCCTAAATAAAGC
TCACCTCTTGCCTTGCATATAGTTGAGGTATATATATTATATATATACACACGTTATTACATATGCA

> SEQ ID NO:1969 215918 116594_300078_1b
CCCACGCGTCCGCTCCTCCTCTTCCTCCCTCCCGATCCCCTGGCCCGCACGAAACTCAAAGCATCCCCGGCGCCG
CAGCTCCCCGGAGGAGGAAGCCCCCGCGCCCCGCCCCGACCAGATCCGATGGCCAACAGCAACCTCCCCGGCGA
ATCATCAAGGAGACGCAGCGACTCCTCAGCGAGCCAGCGCCGGGAATCAGCGCGTCTCCGTCGGAGGAGAACATG
CGCTACTTCAACGTCATGATCCTTGGCCCGGCACAGTCCCCTATGAAGGTGGAGTTTTTAAGCTTGAACTCTTT
TTACCCGAGGAATATCCTATGGCTGCTCCAAAGGTTAGGTTCCTGACCAAAATATACCACCCCAACATTGACAAG
CTTGGTAGGATATGCCTTGACATTCTCAAGGACAAATGGAGCCCAGCCCTTCAGATTCGGACAGTTCTTTTGAGT
ATCCAGGCACTCCTAAGTGCACCAAACCCTGATGATCCTCTCTCTGATAACATTGCAAAGCACTGGAAAGCCAAT
GAAGCAGAAGCTGTTGAAACAGCAAAGGAGTGGACTCGCCTGTATGCCAGCGGTGCATAAAACCCAATGCCTCTC
GTGATGTAATAACCCGTCATGCTTTAGCCTTAATCAAATGCCATTTGCTTGATAAGAACAAACTGGAGATATTGG
CAGTGGAAGGGAGTTTAAATGACTACC

> SEQ ID NO:1970 215918 112154_300040_1b
CGGACGCGTGGGCTGAATTGCAACGTGTAGGAGGATCTCTGAGGGATTTGGTGAATCATGGCATCCAAACGGATT
CTCAAAGAGCTCAAGGATCTCCAGAAAGATCCTCCTACCTCTTGCAGCGCTGGTCCAGTTGCTGAAGACATGTTT
CATTGGCAAGCAACAATTATGGGTCCGCCTGACAGCCCTTATGCTGGCGGAGTGTTTCTTGTTACCATTCATTTT
CCACCTGACTATCCATTTAAGCCACCGAAGGTAGCTTTCAGGACAAAGGTTTTCCACCCAAACATCAACAGCAAT
GGTAGCATTTGCCTCGACATTTTGAAGGAACAATGGAGTCCGGCACTTACAATCTCCAAGGTATTGCTGTCAATC
TGTTCTCTGTTGACAGACCCTAATCCTGATGATCCATTGGTGCCGGAGATTGCTCATATGTACAAGACTGATAAA
AGCAAGTACGAAACAACTGCCCGGAGCTGGACTCAAAAGTATGCCATGGGTTAGTTGCAGTGACCATCTCTGGAG
GGGCTCCTTTTCTTCTGTGGTATTCTGTATATCTATTATGTATTAAGAAATGGTGTTCTTATGCATAATCAACTC
AAGGGGAAATGTTGAACAGGCCCTGTAACAATTTG

> SEQ ID NO:1971 215918 1118391_301855_1b
AGAATGGCTACTTCTGCGCAGCTCCGCCTCATGTCGGACCTCAAAGCCATCCTCAGCGAGCCTCCCGAGGGATGC
AGCGCAAGCCCTTACAATGATGATAATCTCTTTGTGTGGAATGCTACTATCTTTGGCCCTGAGGACAGCCCTTGG
GAAGGTGGGATTTTTTCTCTTCGTTTGATATTCGGAGATCAATATCCTGAAAAGCCACCTCGTGTTAGATTTACT
AGCGAGATNTTCCATCCAAATGGTGTACACAATGGAAACTTATGCATGGATATAATTCAGGATGCTTGGTCTCCC
TGCCACAACATCTGCACTATATTGACTTCAATACAGTCTTTATTGACGGATCCAAATCCAG

> SEQ ID NO:1972 215918 1117116_301818_1b
TTCCCATCTCTCTCTTTCTCTCTCTCTAGGTATGGCGTCGAAACGGATACAGAAGGAGCTGCAGGACCTGCAGAA
GGACCCCCCGACGTCATGCAGTGCCGGGCCGGCTGGGGAGGACCTCTTCCACTGGCAGGCCACCATCATGGGCCC
CTCTGATAGCCCCTACGACGGCGGCGTCTTCTTCATCACCATTCACTTCCCCCCTGACTACCCCTTCAAGCCCCC
CAAAGTCAGCTTCCAGACCAAGGTTTATCATCCAAACATCAGCTCGAACGGGAGCATTTGCTTAGACATTCTAAA
GGAACAATGGAGTCCAGCGTTGACGATTTCAAAGGTGTGGTTATCCATCTGCTCTCTGCTTACGGATCCAAATCC
AGATGACCCTCTTGTCCCTGAGATCGCTCACATCTACAAAACCCAGAAGGCTCGCTACGAGGAGACCGGCCGAGC
ATGGACCCAGAAATATGCAATGAACTAGTTGAAAAATTTCCTTACATATCCTTGCCCACCCTTCAAACTATAATA
AGCAT

> SEQ ID NO:1973 215918 1113883_301841_1b
TCTTTCTCTCCTATCTCTCTCCTCTCTCTCTCATGGCTTCCAAAAGGATTCAGAAGGAGCTGAAAGACTTGCA
GAAGGACCCCCCCACATCATGCAGTGCAGGTCCTGTTGCGGAAGATATGTTTCACTGGCAGGCAACAATTATGGG
ACCAGATGACAGTCCTTATAGTGGTGGTGTGTTTTGGTGACGATTCATTTCCCCCCAGATTATCCCTTCAAGCC
CCCCAAGGTTGCTTTTAGGACCAAGGTTTTCCACCCAAACATCAACAGCAATGGGAGCATTTGCCTGGATATATT
AAAAGAGCAATGGAGTCCAGCTCTGACAATATCTAAGGTCTTGCTTTCAATCTGCTCACTTCTCACTGATCCAAA
CCCCGATGATCCTCTGGTACCTGAGATTGCACACATGTACAAGATAGACAGAGCAAAATATGAAGGTATTGCAAG
GAGTTGGACACAGAAGTATGCAATGGGTTGAGCCTTTTTTTCGGCAAAAGATAACAACTTTTATCAGTCTATCT
CATATCTAAAAAGAATCGGTTTACAACTTTCTGTTTCTGCATCTTGTTGGTCCAAAGCTCAAATCACACGTGTAT
CTTTACTTTCATAGCCAAGGAGTTGATATAGAAGTAGTGCAAGGAACAGGTAC

> SEQ ID NO:1974 215918 1111370_301534_1b
AGGAAAGGAGCGCATCTCAAAAGCCCCAAGCCTAGGGCCTGTCTTCCCCTTGGAACAAAAGCACCCCCCACCCAT
AGCCATTAGCCATTAGCCATTATGTCAGAAACTCAGGCTAGCCTTCTCCTTGGCAAACAACTTAGAGAGCTTTTA
AAATCTCCAGTGGAAGGTTTCTCAGCAGGGCTGGTGGATGATTCTAACCTCTTTGAATGGAATGTGACCATTATT
GGTCCTCCTGATACATTATATGAAGGTGGTTTCTTCAATGCCATTATGAGCTTTCCCAAAAATTATCCAAATAGT

Figure 2 continued

CCTCCAACAGTCAGGTTCACCTCTGAGATGTGGCACCCAAATGTGTATCCGGATGGCCGTGTTTGTATTTCCATT
CTTCATGCCCCGGGGGATGATCCAAATGGATACGAACATGCTAGCGAGCGGTGGTCACCAGTGCACACGGTGGAA
ACCATTCTATTGAGCATCATTGCAATGCTTTCCAGTCCGAACGACGAGTCTCCGGCAAATATAGATGCAGCAAAG
GAATGGAGAGAGAACAGGGCGGAGTTTAAGAAGAAAGTGCGTCGCATTGTACGGCGATCTCAAGAGTGTCTCTGA
ATTTGGCAATATACCAGGGTATGTATCCTCATTGAGAAACCCTTGAAACTTCTCTGAATTGATAGAAAAAAGGAA
GGGACATACATATATATCAGA

> SEQ ID NO:1975 215918 1110673_301541_1b
GGTGCTTACAGGCGTTAGAAGAGAAGACGGAGAGAGAGAGAGAGAAGGGAAGTCCAGGCGTCTCTATCTTTCTTA
CTCTGCCCTTCTCAGCATTCCCACTGCCATGTCCACCCCTGCACGGAAGCGCTTGATGCGTGACTTCAAGCGGCT
TCACCATGATCCCCCTGCTGGCATAAGTGGTGCTCCTCAGGACAACAACATTATGCTTTGGAATGCTGTCATCTT
TGGGCCGGATGACACACCATGGGATGGAGGTACGTTCAAGCTGACATTACAATTTTCTGAGGACTATCCAAATAA
GCCTCCGACGGTCCGTTTTGTGTCGAGGATGTTCCACCCAAACATTTATGCCGATGGAAGTATCTGCCTGGATAT
TCTGCAGAACCAATGGAGCCCAATCTATGATGTCGCAGCAATACTTACATCCATTCAGTCTTTGCTCTGCGATCC
AAACCCGAACTCTCCGGCAAATTCCGAAGCAGCACGAATGTATAGCGAAAACCGGCGAGACTACAACCGGAAAGT
GCGCGAAATAGTGGAGCAAAGCTGGACGGCTGAATGATGGATGAACTGTCTACCTCTAGTGATATACAAGTGTGT
CGAAACAGTTGCATGAGGTTGAACTAATTCTCTCCTTTTACAAGTTTGGCACTTTCGTAAAAATTCT

> SEQ ID NO:1976 215918 197269_300700_1b
CCCACGCGTCCGCCCACGCGTCCGCTCACCTGGCGCGCCGAAGCTTCTCTCCTCTCTCTCAACTCCGGCGAGAGG
AGGAGGCGGCGGTGGGGCGTTCGTCGGGAGAGAGACCAGGGCCGGGGGGCTAGGGTTCGGCCGTTCAGAGAGGCG
GCGGCTGAGGAGGAGGAGGAGGAGGAGGGGGTGAGGAGAGATGTCGACGCCGGCGAGGAAGCGGCTGATGCG
GGACTTCAAGCGGCTGCAGCAGGACCCGCCCGCCGGAATCAGCGGCGCGCCGCACGACAACAACATCATGCTCTG
GAACGCCGTCATATTCGGACCGGATGACACGCCGTGGGATGGAGGCACGTTCAAGCTGACACTACAATTTACAGA
AGATTATCCCAACAAACCACCAGTTGTTCGGTTTGTCTCAAGGATGTTTCACCCAAATATTTATGCAGATGGAAG
TATCTGCTTGGATATCCTACAAAATCAATGGAGCCCTATATATGATGTTGCTGCGATATTGACCTCTATCCAGTC
CCTGCTCTGTGATCCAAACCCAAACTCCCCTGCAAACTCCGAAGCAGCCAGACTGTTCAGCGAGAACAAGCG

> SEQ ID NO:1977 215918 187420_300677_1b
CTCCACGCCTCCACAAATAAAGCTCGTCCCGAGGAAGGGCGGCGACCCACCCCCTCCCAATCGCCAAAACCCTAA
CTCCGATCCGATCGAGCTCTGCTTCCCATGGCGACTGCCGCGAGCCAGGCGAGCCTCCTGCTCCAGAAGCAGCTC
AAAGATCTCGCGAAGAACCCCGTGGATGGGTTCTCGGCGGGGCTTGTGGACGATAGCAACGTGTTCGAGTGGCAG
GTCACCATGATCGGCCCGCCCGATACCCTGTATGATGGAGGCTACTTCAATGCAATAATGACCTTCCCCCAGAAT
TATCCGAATAGTCCCCCATCAGTAAGGTTTACCTCTGAGATGTGGCATCCAAATGTTTATCCTGATGGGCGCGTA
TGCATTTCTATCCTTCATCCACCTGGTGAAGATCCCAACGGTTATGAGCTTGCGAGCGAACGGTGGACACCTGTG
CATACAGTTGAAAGTATAGTTCTGAGCATCATTTCGATGCTCTCTAGTCCAAATGATGAGTCTCCAGCAAATATT
GAAGCGGCTAAGGATTGGAGAGAAAAGAGGGACGATTTCAAGAAAAAGGTTAGACGCATTGTTCGTAAATCACAG
GAAATGCTCTGAA

> SEQ ID NO:1978 215918 182315_300660_1b
GAATTCAGCAGCTAACAACAATACCCCAATACCAAACCCTAACCCTTAATCTCCCGCAGCTGTATAAAACCCTAA
TCATTAGATCCTGAGAAGAATCGGAGTTTTTTCTCACAGCTTTTTCTTACGGCTGTGAGGATGTCGACCCCTTCG
AGGAAGAGGTTGATGAGAGATTTCAAGAGATTGCAACAGGATCCTCCAGCAGGCATCAGCGGTGCACCGCAGGAC
AATAACATAATGCTATGGAATGCTGTTATATTTGGCCCAGATGATACTCCCTGGGATGGAGGTACCTTTAAGTTG
TCTCTGCAGTTTTCGGAGGACTATCCAAATAAGCCACCAACAGTTCGGTTTGTTTCGCGGATGTTCCATCCAAAT
ATCTATGCAGATGGAAGTATTTGCTTGGATATCTTACAGAATCAGTGGAGTCCTATTTATGATGTAGCTGCTATT
CTAACTTCTATCCAGTCGTTGCTTTGCGACCCGAACCCAAATTCTCCTGCTAATTCTGAAGCTGCAAGAATGTTT
AGTGATAACAAGCGTGACTACAACAGAAAAGTACGCGAAGTCGTTGAGCAAAGCTGGACAGCAGATTAACTGCTC
ATCCCTAACATGTGGATGTCATTTGACTTATTCTGTAAAGTTTGAAGTCTACGTAAGTAAACATTTCCACTTGAA
AACAATTGTAATACAGACATAAGAGTTATATA

> SEQ ID NO:1979 215918 167862_300551_1b
GAATTCAAAAAGACTATAAAATCCAATCAACCTCTCCAATTCCCGGAATCCTCCTTCCTCCTCCGGTTTCTTCCT
TTTTCAGAGCACCGAGTTCCTCTGGATCCTCTCTCCTGGTTTCTTCAAATACCCTTTGGTTTTTTTCCTTTACCC
CTCTTGTAAAATCTAGGGTTTCGAGAGAAAAAAATCTTCAGAGAGGATGGCCTCCAAACGGATCTTGAAAGAACT
CAAGGATCTTCAGAAAGATCCTCCTACTTCTTGCTCCGCAGGTCCTGTTGCCGAAGACATGTTTCACTGGCAAGC
AACAATAATGGGTCCCCCAGACAGTCCATACGCAGGAGGAGTCTTTCTAGTTACTATTCATTTCCCTCCAGATTA
TCCATTCAAGCCACCAAAGGTTGCCTTCAGGACAAAGGTATTCCACCCTAATATCAACAGCAATGGGAGCATCTG
TCTTGACATCTTGAAGGAGCAATGGAGCCCTGCCTTGACCATTTCCAAGGTGTTGCTATCCATTTGCTCATTGTT

Figure 2 continued

GACGGACCCAAACCCAGACGATCCTTTGGTGCCAGAGATTGCTCACATGTACAAAACCGACAGGAGCAAGCATG

> SEQ ID NO:1980 215918 158243_200002_1b
TGTTTTTAGTGAGACAAAGAGTGTGAAACTCTCTTACAATTTCTACTTTCTCTCTCTAGAAAAAAAGAGACCCTT
AGCGTAAATTTTCTGCGATCAAAAAAAGAATTCGATTCAATTCAATGGCCAACAGCAATCTTCCTCGAAGAATTA
TTAAGGAAACTCAACGTCTTCTCAGTGAACCCGCGCCGGGAATAAGTGCCTCTCCTTCGGAAGAAAATATGCGAT
ACTTCAATGTCATGATTCTTGGTCCAACACAATCTCCTTATGAAGGAGGTGTTTTCAAACTGGAACTCTTTTTGC
CTGAAGAGTACCCAATGGCTGCTCCGAAGGTTCGATTTCTCACCAAAATATACCATCCCAACATTGATAAGCTTG
GTAGGATATGCCTTGATATTCTCAAGGACAAGTGGAGTCCTGCTCTTCAGATTCGCACCGTTCTTTTGAGCATTC
AAGCACTTCTGAGTGCACCAAATCCAGATGATCCACTCTCAGAGAACATTGCGAAGCATTGGAAGTCGAATGAGG
CTGAAGCTGTTGAAACGGCTAAAGAATGGACACGCCTGTATGCAACCGGTGCCTGAAACGGCATGACTAAGTGAT
TTTGAAAAGAAAAAGAAAAAAGATGTGGAATGTAATTTATCCACTGTCTAATCAGGGGACATGGGAGGACTGAAA
GCTAAATTACCATCTATAATATTTTCCCTACCCTTGAAATTGTATAGTCAAATATTGCACCTTTTTATTCCAAGT
TGAAGAAACTT

> SEQ ID NO:1981 215918 145271_301058_1b
TACGAAACCAACAAGGAAGAGAATCAAATTCTTCTATTCCCAATAATTCTCTATTCAGATTCGATCTCGGTCTCT
GAGTGATGGCTTCGAAACGGATCTTGAAGGAGCTCAAGGATCTCCAGAAGGATCCCCCTACCTCTTGCAGCGCCG
GCCCCGTCGGAGAGGACATGTTCCATTGGCAGGCCACAATTATGGGTCCCCCAGACAGCCCTTATACCGGTGGTG
TATTCCTAGTTACTATACATTTTCCTCCTGATTATCCATTCAAACCTCCTAAGGTTGCTTTTAGAACAAAAGTTT
TCCATCCAAATATTAACAGTAATGGCAGTATATGCCTGGACATATTGAAGGAGCAGTGGAGCCCTGCATTAACTA
TTTCCAAGGTTTTGCTTTCAATTTGCTCTCTTTTGACGGACCCAAATCCCGATGACCCCTGGTGCCGGAGATTG
CTCACATGTACAAGACAGACAGAGCTAAATACGAATCAACTGCCAGGAGTTGGACCCAGAAATATGCCATGGGTT
AGAACATTACCTATACGGGCCCGAGTCCATGTAAAAAGAATTCATGTGCCTGTTCTCTCTCCTCTCTCAACCAGC
AAAGTGTAGAATAGCATTAAATGTTGTCCTCTCCAAGAAAAAGAGATGCTTTGAATATTTTTATATGGATTCTAA
CATTTTAAGAAATCTGGGAACTGTTTATTTATCTGGTT

> SEQ ID NO:1982 215918 6887_300090_1b
CCCACGCGTCCGCGCACGGTGATATTGAGAATCGCCGACCTGAATCGATCGGAAAACTTTCTCTGATTACCGGCG
GTCAACACCGCTGAACACATATGTTTGTTTGACGACCTCTTCTCTCCGCGATCTTTACCTCAACAACGAGATCTG
TTTCCACGAAAGAAAGGAGGATGTCGACGCCAGCAAGGAAGAGGTTAATGAGGGATTTCAAGAGGTTGCAGCAAG
ACCCACCTGCGGGTATTAGTGGTGCTCCACAGGACAACAACATTATGCTCTGGAATGCTGTCATATTTGGGCCTG
ATGACACACCATGGGATGGAGGTACTTTCAAACTCTCACTGCAGTTCTCTGAAGATTATCCCAATAAACCACCAA
CAGTTCGGTTTGTGTCACGGATGTTTCATCCTAATATTTATGCAGATGGGAGTATCTGCTTGGACATTCTACAAA
ACCAGTGGAGTCCAATCTATGATGTTGCTGCTATACTTACCTCCATCCAGTCCTTGCTCTGTGACCCTAATCCGA
ATTCTCCTGCAAACTCGGAAGCTGCTCGGATGTACAGCGAAAGCAAGCGCGAGTACAACAGGAGAGTGCGTGATG
TTGTTGAGCAAAGCTGGACTGCTGACTAGTAGTAGTTTGTTGTAAGCGTTGTAGCTCTCTCTACTTTCTCTCAAT
CACGATTCAGCAACAGCTTTCTTCTCTTTTCATTCATGTCTTGTGTTTCCAAAACTATTTAAGTGATTCCATGCT
TTGATGTAACCCAACATCCTTAAAAAAACAACTTTGTTCCACAC

> SEQ ID NO:1983 215918 57194_300378_1b
CCCACGCGTCCGATCTCTTCTATTCATAAGTTGTAAATTCTTATTATTGGGATTTTTTCCCTTTTTAATTCAATC
CAAGAATTGAGTAGGACTAATGGCATCCAGGAGAATTCACAAGGAACTAAGGGAGTTGCAAAGAGACCCTCCTAC
TTCATGCAGTGCAGGTCCGGTGGCACAGGATATGTTCCATTGGCAAGCAACCATTATAGGTCCAAATGACAGCCC
TTATGCAGGTGGTGTTTTCCAAGTGGCCATCCATTTTCCTCCTGATTACCCTTTCAAACCTCCCAAGGTGGCTTT
CAAGACCAAAGTTTTCCATCCAAATATAAATAATAATGGAAATATTTGTTTGGACATTCTTAAGGATCAATGGAG
TCCTGCCCTCACCATATCAAAGGTTTTGCTTTCCATATGTTCACTACTAACAGATCCAAATCCAGATGATCCATT
GGTTCCAGAAATTGCTCATATGTACAAATCTGATCGGAAGAAATATGAATCAATGGCTCGTAATTGGACCCAAAA
GTTTGCTATGAATTGAGTTGTTGTATTCATATAAAGCTCATGTGCTATAATTTGTAACAAAAGATCAATGATTTT
CTCCTCCGCAGGCATGTAATAAAAGCACAAAATTATAATACTTGTGAAATGAGAATTTTTCACACTTGATA

> SEQ ID NO:1984 215918 52729_300086_1b
TTTTAAATCGTAATACATATATACACAAAAGTGAATAATTGAGATGGTTTGGTACAAAGTTGTTTTTTTAAGGAT
GTTGGGTTACATCAAAGCATGGAATCACTTAAATAGTTTTGGAAACACAAGACATGAATGAAAAGAGAAGAAAGC
TGTTGCTGAATCGTGATTGAGAGAAAGTAGAGAGAGCTACAACGCTTACAACAAACTACTACTAGTCAGCAGTCC
AGCTTTGCTCAACAACATCACGCACTCTCCTGTTGTACTCGCGCTTGCTTTCGCTGTACATCCGAGCAGCTTCCG
AGTTTGCAGGAGAATTCGGATTAGGGTCACAGAGCAAGGACTGGATGGAGGTAAGTATAGCAGCAACATCATAGA
TTGGACTCCACTGGTTTTGTAGAATGTCCAAGCAGATACTCCCATCTGCATAAATATTAGGATGAAACATCCGTG
ACACAAACCGAACTGTTGGTGGTTTATTGGGATAATCTTCAGAGAACTGC

Figure 2 continued

> SEQ ID NO:1985 215918 38614_300209_1b
GCAGTGCTGGCCCAGTTGCTGAAGACATGTTTCATTGGCAAGCTACAATAATGGGTCCATCTGATAGTCCTTATT
CAGGCGGTGTCTTTCTCGTAACCATTCACTTCCCTCCGGATTATCCTTTCAAACCACCAAAGGTTGCATTCAGGA
CAAAAGTGTTCCACCCTAATGTCAACAGCAATGGAAGCATTTGCCTTGACATTTTGAAAGAACAATGGAGTCCTG
CACTCACCATATCGAAGGTTTTGCTTTCGATATGTTCATTGTTAACGGACCCAAACCCAGATGATCCATTGGTTC
CAGAGATTGCTCACATGTACAAAACCGATAGAGCAAAGTATGAGTCTACTGCGAGAAGCTGGACTCAGAAATATG
CAATGGGATGAAAGTTTGTGTCCTTTGATCCCTCACAGACTCGGTTTTAATAGAGAGAAGAGAGAGAAAGAGAGAG
GACTTCTTCACATAGGGATCTTCCATGAAATAAGTTAGATTCCTATGTTTTATCATCTCTTTGTTTGAAACCTCT
TTAATCTCAAACAAAAACATTACTTCACCTCTTTATTATCC

> SEQ ID NO:1986 215918 37480_300390_1b
AAGGATCCTCCTACTTCATGTAGCGCAGGACCCGTTGCGGAAGACATGTTTCATTGGCAGGCCACTATAATGGGT
CCATCGGATAGCCCTTATTCTGGAGGAGTTTTTCTTGTAACCATCCATTTCCCTCCAGATTACCCATTTAAGCCT
CCTAAGGTGGCTTTTAGGACGAAGGTGTTCCATCCAAACATTAACAGCAATGGAAGCATCTGCCTCGACATCTTG
AAGGAGCAGTGGAGTCCTGCTCTCACAATTTCCAAGGTGCTGCTATCGATCTGTTCTTTGTTAACGGATCCAAAC
CCAGATGATCCTTTGGTCCCTGAGATAGCTCACATGTACAAGACAGACAAGAACAAGTACGAGTCCACTGCTCGG
ACCTGGACCCAAAAGTATGCCATGGGCTGACACAAATACTGTCCTTAAGGAAGAGCCCTAATAATTAAACTCTTC
TTATTTCTATGTAATGATCTTTTATAGACTTGTCTGTCTTATAAAATTTGTGAAGACAGGATCAGTAAGAAATTA
TTTGATCTCCATTCAA

> SEQ ID NO:1987 215918 3194_300098_-1b
CCCACGCGTCCGAAGGCTCTCTCTGTCTCTTTCTCAAAATCATCTGCAGGAAGTGAATCGTCAAAACCGAGTTTG
GAGGATCTGTCTTGAGGGTTTGGTTTTTTGGATCTAGGAGTTTTTTTTTGGTTGAGAAATGGCTTCGAAACGGAT
CTTGAAAGAGCTCAAGGATCTCCAGAAGGATCCTCCAACTTCCTGCAGTGCTGGCCCAGTTGCTGAAGACATGTT
TCATTGGCAAGCTACAATAATGGGTCCATCCGATAGTCCTTATTCAGGCGGAGTGTTTCTCGTAACCATCCACTT
CCCACCGGATTATCCTTTCAAACCACCAAAGGTTGCATTCAGGACAAAAGTGTTCCACCCTAATGTCAACAGCAA
CGGAAGCATTTGCCTTGACATTTTGAAAGAACAATGGAGTCCTGCACTGACCATATCGAAGGTTTTGCTTTCGAT
ATGTTCATTGTTAACGGACCCAAACCCAGATGATCCATTGGTTCCAGAGATTGCTCACATGTACAAAACCGATAG
AGCAAAGTATGAGTCTACTGCGAGAAGCTGGACTCAGAAATATGCAATGGGATGAAAGTTTGTGTCCTTTGATCC
CTCAAAGACTCGGTTTTAATAGAGAGAAGAGAGAAAGAGAGAGGACTTCTTCACATAGGGATCTTCCATGAAATA
AGTTAGATTCCTATGTTTTATCATCTCTTTGTTTGAAACCTCTTTAATCTCAAACAAAAACATTCCTTCTCCT

> SEQ ID NO:1988 215918 265904_200082_1b
AATCTCCAGTGCCTTTTAAGCCGGCGACGAACATAAGGCCGCCGCCTATCATTTAACCTCCCGTCGACGTCTATC
ATTCAATTCTCGCCGCTTTTTGCTCGTAGGTCAACAATTCCGTATTTCTTATGCGGTGAGGATGTCGACACCGGC
GAGGAAGAGACTGATGAGGGATTTTAAGCGATTACAGCAGGATCCCCCGGCCGGCATCAGCGGAGCTCCGTGTGA
CAACAATATAATGCTATGGAATGCA

> SEQ ID NO:1989 215918 252709_301604_1b
TCTGACTCCTCTCTCTCTCTCTTTAGATCTCTGGTCTCCGTCTCCGTGTCCGTCTCCGTTACTGTGTCTGTCT
CCCTTCCGTCGAGATCTGTGGATCTTATAGCCTAGCCCTAAAGGGGAACAGCAAGCTTTGGACTTTCCATGGCCT
CCAAACGGATCCTGAAGGAGCTCAAGGATCTGCAGAGGGATCCTCCCACATCATGCAGCGCAGGACCTGTTGGGG
AAGATATGTTTCACTGGCAGGCAACAATCATGGGACCGAATGATAGTCCATATGCTGGCGGTGTGTTTATGGTGA
CCATTCATTTCCCACCGGATTACCCCTTCAAGCCGCCAAAGGTTGCTTTCAGGACTAAAGTTTTTCACCCTAACA
TCAACAGCAATGGGAGCATTTGCTTGGATATATTAAAAGAGCAATGGAGTCCTGCTCTTACAATATCGAAGGTCC
TGCTGTCAATTTGTTCGCTCCTGACGGATCCAAACCCGATGATCCCCTTGTTCCTGAGATTGCGCATATGTACA
AGACAGACAGAGCCAAATATGAAGGCACTGCAAGGAGTTGGACGCAGAAGTATGCAATGGGCTGAATCTCTGACC
TCTCTCGCCCCTTTGTAATAATCAAAGATA

> SEQ ID NO:1990 215918 252320_301670_1b
TCCTTGACAGTGTGTGTTCTTCTTTCTCGCACTTGTTCCGTGTGCCCGGGGTTAGCCCTAGGGCGATCTTTGCGC
GATCCGGGCAGGGATCGGGGCCGCGGCGCATCCACGCGGGCGATGCGCTAGATTGGGCACCCGGCGGCGAGGAT
CAGGGTTTGGATTTGTCGGTAGCAATAGCCCTATCGATCTCCATCGATCGATCGAGCTGGGCGGCGGGGGAATGG
GCGAGAGCCAGGCGAGCCTCCTCTTGCGCAAGCAGTTGAAAGATTTGACAAGAAATCCTCTGGATGGATTCTCGG
CTGGATTGGTGGACGATTCCAATGTGTTTGAGTGGGCGGTGACCATCATCGGGCCACCAGACACCTTGTATGAAG
GTGGTTATTTCAACGCTATCATGAGCTTTCCTCTGAATTATCCGAATAGTCCTCCGACCGTGAGATTTACGTCGG
ATATGTGGCATCCAAATGTTTACCCGGATGGTCGTGTTTGCATCTCCATCCTTCACGCTCCTGGAGACGATCCAA
ATGGCTACGAGCTGGCGAGCGAACGATGGTCTCCAGTTCACACGGTAGAAACTATTCTTTTGAGTATAATCTCGA

Figure 2 continued

TGCTTTCGAGCCCAAACGACGAGTCCCCAGCCAACATCGACGCCGCTAAAGAGTGGCGAGAGCGAAGAGA

> SEQ ID NO:1991 215918 248560_301584_1b
GGACAGTATGTCTACTCCATCCAGGAAGCGCTTGATGCGAGATTTCAAGCGCCTCCAGCATGATCCACCCGCCGG
GATCAGCGGCGCGCCGCAGGACAACAACATCATGCTGTGGAATGCGGTGATTTTCGGGTAAGAGAGGCCGCTTCT
AGGGTTTAGAGTTTCTAAAGGACTTTTTTCGTGGTTTGCTGCAGGCCTGACGATACTCCCTGGGATGGAGGGACA
TTCAAGCTGACATTGCAGTTTACGGAGGACTACCCCAACAAACCTCCCACTGTGAGATTTGTTTCAAAGATGTTC
CATCCCAATATTTATGCTGACGGAAGTATTTGCCTCGACATCCTGCAAAATCAATGGAGTCCAATCTACGATGTC
GCGGCCATTCTTACTTCCATACAGTCATTGCTTTGTGATCCTAACCCGAACTCGCCGGCCAACTCCGAGGCAGCT
CGGATGTACAGCGAAAACCGCCGAGAGTACAACAGGAGAGTTCGCGACATAGTCGAGCAGAGTTGGACGGCGGAG
TAGCTCCCCTTGGTTCAAGAGCTTGTAAGAGTGGCCATCACAGAGAGATGTGTGCTGCTCCGAGCACACATAAAG
AATCTTGTCAAAAAACAATCCGGAAAGCTGTCGCCTCTACAGACCAGCGTTGAAGGTCGACCATCGAACTCGTTT
GCTTCTGTTGGAACCAGGGCCAGTGTTCTGGTACTCACCATAGAACAGGGTGCTGAGAGCGAAGTCCCCGTTCCA
TTCCAACCATCCACGGGGTTGAATTATGTCACTGATGAACGACTTCATGAACACCGTCCGCGAGTAGAGCTTCCA
CGGCCTTCCGAGTTTATGAAAGACAGCCCCGTGTTCTGTCGCTTATCGACG

> SEQ ID NO:1992 215918 247566_301621_1b
GGGGGAAGGGCGATTAGGGTATATTGGCTTTGTCGCGGCTATGGCGTCCAAGAGAATCCTCAAGGAATTAAAGGA
CTTGCAGAAGGATCCGCCCACTTCGTGTAGCGCAGGTCCTGTGGCCGAGGATATGTTTCATTGGCAAGCGACGAT
AATGGGTCCTCCCGATAGCCCCTACGCAGGGGGTGTGTTTTTGGTCACCATCCATTTCCCCCCGGATTATCCCTT
TAAGCCCCCCAAGGTCGCATTTAGAACGAAAGTTTTCCACCCAAACATCAACAGCAATGGCAGCATCTGCCTCGA
CATTCTCAAGGAGCAGTGGAGCCCGGCCTTGACAATCTCCAAGGTGCTGCTATCAATCTGCTCGTTGCTAACCGA
TCCAAACCCGACGATCCACTGGTGCCCGAGATTGCTCACATGTACAAGACAGACAGGCCCAAGTATGAATCGAC
CGCCAGGAACTGGACGCAGAAGTACGCCATGGGGTAAGCCCGGGCTTGTGAGCGGCGGCGGCGGCGGTGGCGGTG
GCATGGCTCGCTATGATGTTTGTGATACCATTTGGTTGCCTATCTATAAGTTGAAAGCAGGGATTGTCTTTGATT
ATGGAATTCTTTTGATTACTGTATATAGAATTTCTATCACGTC

> SEQ ID NO:1993 215918 244825_301562_1b
CGCGATTGTAGATGCTATAGATCCAGGTCGCCTCGTCGTCGTCCCGTGGCGCCGCTGTAGATAGGGTTTGATTCA
TCGCGCAGCAGCGGCAGCGGCGATGTCTACGCCGGCGAGGAAGCGGCTGATGCGGGATTTCAAGCGGCTGCAGCA
CGATCCACCGGCGGGCATCAGCGGCGCTCCACAGGACAACAACATCATGCTGTGGAATGCGGTCATCTTTGGGCC
GGATGATACGCCATGGGATGGAGGAACATTCAAGCTCACCTTGCAGTTCACAGAGGATTATCCAAACAAGCCACC
AAATGTGCGGTTTGTTTCGAAGATGTTCCATCCCAATATTTATGCGGACGGAAGCATTTGCCTGGACATTCTCCA
AAACCAGTGGAGCCCGATCTACGATGTTGCTGCAATATTGACATCGATCCAGTCTCTACTATGCGATCCAAACCC
GAACTCTCCTGCTAATTCCGAAGCCGCACGGATGTACAACGAGAACAGGCGAGAGTACAACAAGAAAGTTCGCCA
AGTCGTGGAGCAGAGCTGGACAGCGAACGACTGAAACCGAGAGTTCTGCTCGGCTGCTCGACATGCTGGTACGCG
ATTTTCTGGCGATCACGGACGGAATTCTACTAACCAGCAGGAGCACTGTATATCCTCTGTACTCGGATTTTTTTT
CTTAGGTGATGTGGTTGCAACTAAGAAAGT

> SEQ ID NO:1994 215918 244061_301554_1b
GCGAGAGAGAGCAGGAAGGCGATCGATCAGCTCCCGGCGGCGCTGTCGGAATCCGGATCTTGGAGCCGCTGCCAT
GGCCAGTACCATCGCCAACAGCAATCTCCCGCGGCGGATCATCAAGGAAACGCAGCGATTACTGACCGAGCCAGC
CGAAGGCATCAAAGCTTCGCCTGCCGAAGATAATTTGCGATACTTCAATGTGATGATCCTTGGCCCCGCACAGTC
ACCCTATGAAGGTGGTGCTTTTAAACTGGAGCTTTTTCTTCCGGAAGAATATCCAATGGCTGCTCCAAAGGTTCG
CTTCTTGACGAAAATTTACCATCCAAACATCGACAAGCTGGGCCGGATTTGCTTAGACATTCTAAAAGACAAATG
GAGTCCTGCTCTCCAGATTCGAACAGTGCTTTTGAGTATTCAAGCTCTTTTGAGTGCTCCCAATCCTGAGGATCC
CCTGGACGAGAACATCGCGAAGCACTGGAAGACAGACCAAGGAGGAGCCATCGCGACTGCAAGAGAGTGGACTCA
ACTCTACGCGACCCATAATTAAATCAAAATGCGGACCATTCGTCATCTTGGTTCGTTTAGTTTTTTCTGCTTTGG
TCATATTTGT

> SEQ ID NO:1995 215918 237695_301289_1b
GGGAACGCGGGAAGGGGCGGCAACGGCGATGGCGCTGGCGTCGGCGGCGGCCTTGTGACAGTCAACCACAGCATG
CTCGTTGCGGCTGCCGCCACTGCCACTACAGCGTCGATCGAATTCTTGTATTCCTGCAAGCTAGGGTGGGGCGAG
AATGCTGTCGTCGGCCCAGTTGCGGCTCATGTCCGACCTCAAGGCGATTCAACAGGAGCCGCAGAGGGATGTAG
TGCTAGTCCACAAGGCGAAGAGAATCTCTTTGTGTGGGGAGCCACTGTGTTTGGGCCGGATGAAACACCATGGGA
AGGGGCGATCTTGCCTCTTCGTCTCACCTTTGGCGAGCACTACCTGGCGAAGCCACCGCGCGTGAGATTCACGTC
CGAAGTGTTCCATCCAAATGTCTACAGTGACGGCGCACTGTGCATGGATATCATCCAGGATGCATGGTCTCCTTG
CCACAACGTCAGCACCATTCTCACCTCGATTCAGTCTCTCCTGACTGATCCAAATCCAGCGAGTCCAGCGAATCC
CGAAGCCGCGCATATGTATCAAAACGATCTCCAAGCATACAACAGGAGAGTGCGCCAGTGTGTGAGGAAGTCCCT

Figure 2 continued

AGATATATAAAACTCCAAAGTTTTATTTATCTATCTATCATAGTGATTATCTA

> SEQ ID NO:1996 215918 230618_301070_1b
TACTCCATCCAGGAAGCGCTTGATGCGAGATTTCAAGCGCCTCCAGCATGATCCACCCGCCGGGATCAGCGGCGC
GCCGCAGGACAACAACATCATGCTGTGGAATGCGGTGATTTTCGGGCCTGACGATACTCCCTGGGATGGAGGGAC
GTTCAAGCTGACATTGCAGTTTACGGAGGACTACCCCAACAAACCTCCCACTGTGAGATTTGTTTCAAAGATGTT
CCACCCCAATATTTATGCTGACGGAAGTATTTGCCTTGACATCCTGCAAAATCAATGGAGTCCAATCTACGATGT
CGCGGCCATTCTTACTTCCATACAGTCATTGCTTTGTGATCCTAACCCGAACTCGCCGGCCAACTCCGAGGCAGC
TCGGATGTACAGCGAAAACCGCCGAGAGTACAACAGGAGAGTTCGCGACATAGTGGAGCAGAGTTGGACGGCGGA
GTAGCTCCCCTTGGATTTGTGGGTAAGACAGCATTTATGGGTGATCTTTTGCAATATATATGTTGCATTGGTTAG
ATCACAGCACTGGCTTCTTGAGTATGTATATG

> SEQ ID NO:1997 215918 226366_300996_1b
ACGACACCAATTTTAAAAAATGGCTTTGAAGCGAATCAACAAGGAACTCAGTGATCTTGGACGTGATCCCCCCTC
CTCTTGCTCTGCTGGTCCTGTTGGCCAGGATCTGTTCCACTGGCAGGCTACTATCATGGGACCCTCAGACTCTCC
TTACTCCGGAGGTGTTTTCTTTCTGTCTATCCACTTCCCCACTGACTACCCCTTCAAGCCACCAAAGGTGACCTT
CACTACCCGAATCTACCACCCCAACGTCAACACCAACGGATCCATCTGTCTGGATATTCTCAAGGAGAACTGGTC
TCCCGCACTCACCATCTCCAAGGTGCTGCTGTCCATCTGCTCCATGCTCACAGACCCCAACCCTGACGATCCTCT
CGTGCCCGACATTGGCCACCTGTACAAGAACGACCGAGCACGATACGACGCCACTGCCAAGGAGTGGACCAAGAA
GTATGCCGTCTAGGATGTATATAGGGAGCAGGCATGAGCCTATGCAAGCGAATGGCTGTGACGATACAACTAGCC
AATGTTAGATTTATGGATGGTAAAACAATGTGTGTCGAGGAAAAA

> SEQ ID NO:1998 215918 215413_300881_1b
ACAGGACCGCCATCAGGGACTCTGCACCCCCGATCAGATAAAGCCTCTACCTAGCGCTCAGGACTTGCAGACGGT
CGCCTTGCATCGTCTCCAACGTCCGCCTAGGATCTTTTGATTCTTTCTTTGCCTCCTCGATCCGAGATCGATCTT
CCACCACCCTTTTAGATACCACATACCCTCATCACAATGGCCCTGAAGCGCATCAACAAGGAGCTCAAGGACCTC
GGCACTGACCCGCCATCATCCTGCTCCGCTGGTCCTGTTGGAGAAGATCTGTTTCACTGGCAAGCTACAATCATG
GGACCCGGTGATTCACCATACTCAGGAGGCGTCTTCTTCCTGAAGATCCAGTTCCCTACGGATTACCCCTTCAAG
CCCCCGAAAGTCAACTTCTCCACCAGAATCTACCACCCCAACATCAACAGCAACGGCAGCATCTGCCTCGATATT
CTTCGAGACCAGTGGAGCCCTGCTCTGACCATTTCCAAAGTTCTCCTTTCCATCTGCTCTATGCTGACAGACCCG
AACCCCGATGATCCCCTTGTGCCTGAGATTGCGCACGTGTACAAGACCGACCGGCCCCGGTACGAGGCGACTGCT
AGGGAATGGACCCGCAAGTACGCCGTC

> SEQ ID NO:1999 215918 127807_300473_1b
CCCCTTTTGGCTACCCTACAACCTTCTTGAGACCCCTTTAAATTCCTCACTTTCTCTCTCTAGAATCTCTCTCTT
TTTCTCTCTCTATCTCTCTCTGAAGTCGTATGGCTTCAGGTTCTCCTTCACAAGCCAGTCTTCTCCTTCAGAAAC
AACTCAAAGATCTCAATAGAAACCCAGTTGATGGATTTTCAGCAGGTTTAGTTGATGAAAATAACTTATTTGAAT
GGAGTGTTACAATTATTGGCCCCCAAGATACTCTATATGAAGGGGGTTTCTTTAATGCTATCATGAGTTTTCCTC
AAAATTATCCCAACAGTCCTCCAACTGTGAGATTTACCACAGATATCTGGCATCCTAATGTTTACTCCGACGAA
AAGTTTGCATCTCAATTCTTCACCCGCCCGGTGATGATCCAAATGGCTATGAGCTTGCCAGTGAACGTTGGTCTC
CTGTCCACACGGTAGAGAGTATAGTTTTAAGCATCATATCCATGCTTTCGAGCCCTAACGATGAGTCTCCTGCTA
ACGTTGAAGCTGCTAAGGAATGGAGGGAAAAAAGAGATGAATTCAAGAAAAGGGTCAGTCGTTGTGTAAGACGGT
CACAAGAAATGTAGTAAACATGCATGCCAACCTGCATTTCTGCGATT

> SEQ ID NO:2000 215918 12575_300252_1b
CCCACGCGTCCGAGAGGACTCTATCATCATCATCCATGGCTTCGCAAGCTAGCCTTCTCCTTCATAAACAACTCA
AAGATCTCTGTAAGCATCCTGTTGATGGATTCTCTGCTGGTCTCGTTGATGAGAAGAATATATTCGAATGGAGCG
TTACCATTATCGGACCTCCTGATACTCTCTATGAAGGAGGATTCTTTAACGCGATTATGACATTTCCGCAAAACT
ATCCGAATAGTCCGCCAACCGTGAGGTTTACTTCGGATATGTGGCATCCTAACGTTTATTCTGATGGTCGTGTTT
GCATATCTATTCTTCATCCTCCCGGTGATGATCCTAGCGGTTATGAGCTTGCAAGCGAGCGTTGGACTCCTGTTC
ATACAGTTGAGAGTATTATGTTGAGTATCATATCAATGCTTTCTGGTCCTAACGATGAGTCTCCAGCAAATGTTG
AAGCTGCCAAAGAATGGCGAGATAAGAGAGATGAGTTCAAGAAGAAAGTGAGCCGTTGTGTCAGAAAGTCTCAAG
AAATGTTTTGATCAACGTCAAACTTCACACCTTTGAGATCTCTGGAGTTTCAATCAAAAGTTCTTCATATTCCTA
TCTGAAACCCTTTGAAACGCAACTTGTTATAACTCGGTTTACATCTCTTTTTGTCGCGTTCGAGAACCAGAGCGT
TTTGAAAGGTGTTTGGTTGAGAAAAGTGCTGTTCTTGAGAAACTGGTATTAAAATTATAAATTTCATTTGTTAAG
AATCTTCTTTGCTTATAAAGTTATCCCCCT

> SEQ ID NO:2001 215918 124677_300424_1b
CTCTCTCCCCCTTTCCACCCTCCCCGCTACCCCACCCAACCCCCATCAACTGAAGTCTATGGCTTCAGCTTCTCA

Figure 2 continued

```
AGCTAGTCTCCTCCTTCAGAAACAACTCAAAGATCTCTGTAAAAGACCAGTTGATGGATTTTCAGCTGGTTTGGT
TGATGAAAACAACTTATTCGAATGGAGTGTCACCATTATCGGACCCCCAGATACTTTATATGAAGGGGGTTTCTT
TAATGCTATCATGAGCTTTCCTCAAAATTATCCCAACAGTCCTCCAACTATTAGGTTTACCTCGGAGGTGTGGCA
TCCTAATGTTTATTCTGATGAAAGGTTTGCATCTCAATACTTCACCCACCTGGTGATGATCCAAATGGATATGA
GCTTGCTAGTGAGCGTTGGTCTCCTGTCCATACGGTTGAGAGCATAATATTGAGCATCATATCAATGCTTTCAAG
TCCTAATGATGAGTCTCCTGCTAATGTGGAAGCCGCTAAGGAATGGAGAGATAATAGAGATGAATTCAAGAAAAA
GGTCAGTCGTTGTGTAAGACGGTCTCAAGAAATGACATAAAGACACGAATGCCAAAATCGGACTTCTTTCATCAG
TTGTTGTTTGATACAAATGTAGAATTGTTGTCAAGGTCTGTCATACCTTTTGTAATATTTGCGAGTACGGTCATT
ATTTACATTT
```

> SEQ ID NO:2002 215918 120926_300518_1b

```
CGGACGCGTGGGCGCAAACGGCGAAGCAGAAGGGGGAAGAGAGAGAGAGAGAGAGAGAGAGAGAGGGGACTCA
GCGAGCGGTGGGCGAGAGGGGGAGATCGAAACCCTAGCTAGGGTTTGCGCGCGGCGGCGGCGGGGATGTCGACGC
CGGCGAGGAAGCGGCTGATGCGGGACTTCAAGCGGCTGCAGCAGGACCCGCCCGCGGGGATCAGCGGCGCGCCGC
ACGACAACAACATCATGCTCTGGAACGCCGTCATCTTCGGGCCGGATGATACGCCGTGGGACGGAGGCACGTTCA
AGCTTACCTTGCAGTTTACAGAAGATTATCCCAACAAGCCGCCGACTGTTCGGTTTGTTTCTAGGATGTTCCACC
CAAATATTTATGCAGATGGAAGCATCTGCTTGGATATTCTACAGAACCAGTGGAGCCCTATATATGATGTTGCTG
CCATATTGACTTCAATTCAGTCTTTGCTGTGTGATCCAAACCCCAACTCTCCAGCAAACTCAGAAGCTGCCAGAC
TGTTTAGTGAGAACAAGCGAGAGTACAACCGCAAGGTTCGTGAGATCGTGGAGCAGAGCTGGACAGCTGACTAGG
GCATGCAGCAGGGCAACGGGTGGTATCCACCATGCC
```

> SEQ ID NO:2003 215918 1109176_301542_1b

```
GGAATGGCATCCTCTGCTCAGCTTCGATTGATGTCCGATCTGAAGGCCATTAGCCATGAGCCACCTGAGGGATGC
AGTGCCAGCCCTTATAGCGATGCGGACCTTTTGTTTGGGACGCCACAATATTTGGTCCCGAAGATACTCCATGG
GAATGTTGTTCCTGTGACCGGATCCATCTTTCGAAACTTGAAAATTAGATCAATGAACCTATCTGTAACTTTGTG
TTCTATTGTATGCTTGTGTTTCTTGTAGGTGGCATTTTCTGCCTCCGTTTGGTCTTTGGAGAGCATTACCCTGCC
AAACCACCTCGTGTCAGGTTTACTTCCGAGATATTTCACCCCAATGTGTACAATGATGGCACCTTATGCATGGAC
ATTATACAAGATGCTTGGTCTCCTTGCCACAACATCTGTACAATTCTAACATCTGTTCAGTCATTGCTAACAGAT
CCGAATCCCGCAAGCCCAGCTAACTCGGAAGCTGCACATTTATATCAAACTGATATTCAAGCATATAACAGGCGA
GTTCGGCGTTGTGTGAGGAAGTCTTTGGAAAGCACATAGTATACTTTGCTTTGCTTGTT
```

> SEQ ID NO:2004 215918 176210_300520_1b

```
CCCCCCCGACCTGCGAACTCTCCACGCCTCCACAAATAAAGCTCGTCCCGAGGAAGGGCGGCGACCCACCCCCC
CAATCGCCAAAACCCTAACTCCGATCCGATCGAGCTCTGCTTCCCATGGCGACTGCCGCGAGCCAGGCGAGCCTC
CTGCTCCAGAAGCAGCTCAAAGATCTCGCGAAGAACCCCGTGGATGGGTTCTCGGCGGGGCTTGTGGACGATAGC
AACGTGTTCGAGTGGCAGGTCACCATCATCGGCCCGCCCGATACCCTGTATGATGGAGGCTACTTCAATGCAATA
ATGACCTTCCCCCAGAATTATCCGAATAGTCCCCCATCAGTAAGGTTTACCTCTGAGATGTGGCATCCAAATGTT
TATCCTGATGGGCGCGTATGCATTTCTATCCTTCATCCACCTGGCGAAGATCCCAACGGTTATGAGCTTGCGAGC
GAACGGTGGACACCTGTGCATACAGTTGAAAGTATAGTTCTGAGCATCATTTCGATGCTCTCTAGTCCAAATGAT
GAGTCTCCAGCAAATATTGAAGCGGCTAAGGATTGGAGAGAAAAGAGGGACGATTTCAAGAAAAAGGTTAGACGC
ATTGTTCGTAAATCACAGGAAATGCTCTGAAAGATAAGGAGCACAAGGGGGAGTAAGCGAGTGCTACAACAGGTG
CACTACACTTAACTGTCTGTCGTCAAACGACTACCTAAAGATAGCATTTTTGCTTCTTCCCCTGTATATTTCCCC
CTCAGTGTCATTCGAGTGGTGATGTTGGTCTTGTCTCCGAGATGCTCGGAAATGTTGCCTATT
```

> SEQ ID NO:2005 215918 175563_300545_1b

```
CCCAACTCCATTATTGATTCTTGCAAGGGGGAAGAGCAGCTAGAGGCGAGGCAAGAAAAGAAGTGAAATCTCTCC
GTTAGACAGGAAGAGGAAAAGCAAGGGGGAATTGGGGATGGCGTCAAAGAGGATACAGAAGGAGCTCAAGGATCT
GCAGAAGGATCCCCCTACATCATGCAGTGCAGGTCCTGTTGGTGAAGACATGTTCCACTGGCAGGCAACGATAAT
GGGTCCATCTGATAGCCCATATGCTGGTGGAGTTTTCCTAGTTACCATCCACTTCCCTCCTGATTATCCCTTCAA
ACCACCCAAGGTGGCGTTTCGCACCAAGGTTTTCCATCCAAACATCAACAGCAACGGGAGCATTTGCCTTGACAT
CCTTAAGGACCAATGGAGCCCAGCACTAACCATTTCCAAGGTGTTGCTGTCAATCTGTTCCCTGCTGACTGATCC
GAACCCTGATGATCCTCTGGTCCCTGAGATCGCCCACATGTACAAGACAGATAGGCACAAGTACGAGAACACAGC
AAGGACCTGGACTCAGAGGTACGCCATGTAGCACCTCAGATATCGATGGACATGTCGATGTTGTAACAACATTAT
CAACGGGTGTGTCTCCCTCTCGCCTTGTGTGGTGTAAGGATCAAAACCGGCTTTGCAGTGCACTCT
```

> SEQ ID NO:2006 215918 1100623_301462_1b

```
AGGGGGGAGAGTTCCTGACCTTTCGTAGCCACGTTTCTTTTCTTCTCTCTCTCTCTCTCTCTCTCTCTGTCTT
TCGCTTTCTCTCTCCTCTCCTTTCCTCTTTTCCTTCTCATTGTTCTCAAACTACACCCGCTCTCTCTCCCCTT
CTCTCCTTCTCTCTCTCTCTCTCTTTTGGGTGCCTTCCTTGCGTATCGGGAGGAGAACGGAAGAATGGCTTCG
```

Figure 2 continued

```
AAGCGGATCCTGAAGGAACTGAAGGATTTGCAAAGGGATCCTCCCACTTCCTGCAGTGCAGGTCCTGTTGGGGAA
GATATGTTTCATTGGCAGGCAACTATCATGGGGCCAACTGATAGTCCTTATGCCGGTGGCGTCTTCATGGTCACT
ATTCATTTCCCCCCGGACTACCCCTTCAAGCCTCCCAAGGTTGCTTTCCGGACGAAAGTGTTCCACCCAAATATC
AACAGCAATGGGAGCATCTGCCTTGATATATTAAAAGAGCAATGGAGTCCAGCCCTTACAATATCGAAGGTCTTG
CTTTCGATTTGTTCACTTCTCACTGATCCGAATCCCGATGACCCCCTTGTGCCGGAGATTGCACACATGTATAAG
ACGGATCGAGCCAAATACGAAGGTACTGCAAGGAGTTGGACACAGAAGTATGCAATGGGTTGAGTTGAGTCTTTC
TTCACTCAATTGCTACTCGCTCTTAATATATCCCCCCCCCTTGATGTAATAAATATATGTTGGCAGACAAGTTAA
AATATCGGCATACAAAAAGCCGTGTTTCTGAATGATCTTGTTTCAAAACTGAATGAATG
```

> SEQ ID NO:2007 215918 1099675_301449_1b
```
TTTTTGCCGCCATCGCCGTCTTTCCTTCCTTCGATCGATCCATCCCTCCTCCTCTTCGCGATCAAGCTTCTCCTC
CTCCCCCCCCCCCCAATGGCCTCCAAACGGATCCTCAAAGAGCTCAAGGACCTACAGAAGGACCCCCCCACCTC
GTGTAGCGCCGGCCCTGTTGCGGAAGACATGTTCCATTGGCAGGCAACGATCATGGGACCCGTTGATAGCCCTTA
CGCCGGAGGTGTGTTCATGTTGACAATCCACTTTCCCCCAGACTACCCTTTCAAACCTCCCAAGGTTGCTTTCAA
GACAAAAGTATTTCATCCAAACATCAATAGCAATGGGAGTATTTGCTTGGATATTTTGAAAGAGCAATGGAGCCC
AGCTTTGACAATCTCCAAGGTTTTGCTTTCGATTTGTTCTCTTCTCACTGACCCAAACCCCGATGATCCTCTGGT
TCCTGAGATAGCACACATGTACAAGATAGACAGAGCCAAGTACGAATCTACTGCAAGGAATTGGGCACAGAAGTA
TGCTATGGGCTAATAGTTATTATAATGGACGTCCCATTGCAATGGTAGACAGGCCGAGGGATTGATTACACTTTC
CTGTTCTTGTTTTCAAACCATGGGGGGTTGGATGTATCTTGTG
```

> SEQ ID NO:2008 215918 109206_300044_1b
```
CAAATTCTTAAAACTATCTCCACTATCTCTTTCTCTCTCTAGACAAATTAAGAACCCTTAGCGTAAACTCTGCGA
CCGAAGAACCCCACCCACCCAGGCAGCCTTCAATTCAATTCCAATGGCGAACAGCAATCTTCCTCGCCGAATTAT
CAAGGAAACTCAACGGCTTCTCAGCGAACCTGCACCAGGAATAAGTGCATCTCCATCGGAAGATAATATGCGATA
CTTTAATGTCATGATTCTTGGTCCTACACAGTCTCCTTATGAAGGAGGCGTCTTCAAGCTCGAACTCTTTTTGCC
TGAAGAGTACCCGATGGCTGCTCCTAAGGTTCGATTCCTCACCAAAATCTACCATCCGAACATTGATAAGCTTGG
AAGGATATGTCTTGATATTCTTAAAGACAAGTGGAGTCCTGCACTTCAGATCCGTACTGTACTTTTGAGCATTCA
AGCACTTTTGAGTGCTCCAAATCCGGATGATCCACTCTCTGAGAATATCGCAAAGCACTGGAAGTCAAATGAGGC
TGAAGCTGTTGAAACGGCTAAGGAGTGGACACGCCTATATGCAAGTGGTGCATGAAGGCATTAGCAACGAAATAT
TTAAAAATAACAAAAATTATGGACTGTATCCTATTGACTTGCTTATCAATATGGATGGCTGTTAATGCCTGGACT
CTTCCGATTGCCTCCCATAATTGCTTCCCTGTCCTTG
```

> SEQ ID NO:2009 215918 107664_300380_1b
```
TGCGAACTCCAGGGGCACCTCCTCCAACACAAAGCAGGAGTTCAACGCAGAATCAAACCAAAACCCTAGCTCACC
GCCTTGTTTCCTCCGTATTGGTGGTTACAATGTCGACTCCGGCTAGAAAGAGGTTGATGAGAGATTTCAAGAGGT
TGCAGCAGGACCCTCCTGCTGGTATTAGTGGTGCACCTCAAGACAACAACATTATGCTTTGGAATGCCGTGATAT
TTGGTCCTGATGACACTCCTTGGGATGGTGGTACGTTCAAGCTGACTCTTCAATTCTCTGAGGATTACCCCAATA
AGCCACCAACAGTGCGGTTTGTTTCTCGCATGTTTCATCCTAACATTTATGCAGATGGAAGTATATGTTTGGATA
TTCTTCAAAATCAGTGGAGTCCAATATATGATGTTGCAGCTATACTTACATCCATTCAGTCATTGCTGTGCGATC
CCAACCCCAATTCACCTGCAAATTCGGAAGCAGCTCGGATGTTCAGCGAGAATAAAAGGGATTACAACCGCAGAG
TTAGAGAAGTTGTGGAGCAGAGCTGGACTGCAGACTGATTCTAAGGAAGAAAGATGTCATTGCTGACCGCAATTC
GGGAGCACCAGGGTTCATCTATGTTACATTTACGGATTGAAACCTCTTCTTGGAAATTTTATTGGAACACATTTG
TTTTGGCCCTAGTATTATGGCTTGGTGCTGTTTGCCTTACCGTTTGCTGCATTGCATTGACAAGCTCCTGTAATA
TATGAATG
```

> SEQ ID NO:2010 215918 105302_300373_1b
```
CAGTTTAAGAGAGAAATATAGGACTTCTTCCAACGTACTGGGGTACTATTATTGGCCCAAAATCCTCTTCCAGCT
CTGCAATCTCCGTCTCCGTCAATTTTCAGTCAACCGAAATCCACCATCTTTCATTGTTCATCACCTTCAGGTTAG
GGTTTGGATTTGAAGGTACAAGGGGCTAATTGATGGCGTCGAAGAGGATATTGAAGGAGCTCAAGGATCTGCAGA
AGGATCCTCCTACATCATGCAGTGCTGGTCCAGTGGCAGAGGATATGTTCCATTGGCAAGCAACTATCATGGGGC
CTACAGATAGCCCTTATGCCGGAGGTGTATTTTGGTTTCAATTCATTTCCCTCCGGATTATCCTTTCAAGCCTC
CAAAGGTTGCCTTTAGAACTAAGGTTTTCCACCCTAACATCAATAGCAATGGAAGTATTTGTCTGGATATTCTAA
AAGAGCAGTGGAGTCCAGCGTTAACCATATCTAAGGTCCTGCTCTCCATCTGCTCCCTATTGACTGACCCAAATC
CAGATGATCCACTTGTACCAGAAATTGCCCACATGTATAAGACTGAAAGGTCTAAATACGAGACCACTGCTCGTA
GCTGGACTCAGAAATATGCTATGGGATAATGGCAAAGGTGTCACCAGGCATGTCTGAGACTTTGTAACTGCAATG
TCTTATTGTGCTTGTAGTGAATGAATAAATTCGGCTAAAGAACTTAGTTTACTTCTTAATCTCCCTTAAAGTGGG
TTGTCAACAGACATTTCTTTTCAATTTGTGAATATCTATTTGGTGACTATTAGTAAGGGAGACACTTCAGTGTAA
TTTTACTTCGTTTGCCAGTTT
```

Figure 2 continued

> SEQ ID NO:2011 215930 1119139_301894_1b
AGAGAGAGAGAGAGAGAGAGAGAGGGTAGGTAGGAAAGGGTAGCAGCAGCAGCAATGGGTAGAGTTATCAGGGC
TCAGAGGAAGGGAGCAGGTTCCGTTTTCAAGTCCCACACGCACCGGAGGAAGGGCCCTGCCAGGTTTCGGTCCCT
CGACTATGCGGAGCGCAACGGGTACATCAAGGGCGTCGTGTCGGAGATCGTTCACGACTCTGGCCGCGGGGCGCC
CCTCTGCAAGGTCACCTTCCGTCACCCGTTCCGGTTCAAGCACCAGAAGGAGCTCTTCGTTGCCGCCGAGGGCAT
CTACTCCGGGCAGTTCCTCTACTGCGGGAAGAAGGCCACCCTCTCCATCGGAAACGTGCTGCCGCTCAAGTCGGT
CCCCGAGGGGCCGTCGTCTGCAACGTGGAGCAGCGCGTTGGGGACCGGGGTGCTATCGCCAGGGCCTCCGGCGA
CTACGCCATCGTTGTCAGCCACAACCCCGACAACAATACCTCAAGGATCAAGCTTCCCTCCGGTGCAAAGAAGAT
TGTCCCTAGCGACTGCCGGGCGATGATTGGTCAGGTTGCAGGAGGAGGTAGGACTGAGAAGCCGATGCTGAAGGC
CGGCAATGCCTATCATAAGTACAAGGTGAAGAGGAACTCCTGGCCCAAGGTGCGAGGTGTGGCCATGAATCCTGT
TGAGCATCCCCATGGAGGA

> SEQ ID NO:2012 215930 146263_301064_1b
TTCACAGAGTGAGCAGAGAGCCAAACAGAGAACGCCGAAATGGGTCGTGTTATCAGAGCACAACGTAAGGGAGCA
GGCTCCGTTTTCAAATCCCACACTCACCACCGTAAGGGCCCTGCCAAATTCCGTTCACTCGATTACGGTGAACGG
AACGGTTACCTTAAAGGTGTGGTCTCAGAAATCATACATGACCCAGGTAGGGGTGCACCGTTGGCACGCGTAACA
TTCCGAAACCCGTTCCGTTACAAGCACCAGAAAGAGTTGTTCGTTGCTGCTGAGGGGATGTACACTGGTCAGTTT
ATTTACTGTGGTAAAAAAGCTAATCTAATGGTGGGTAATGTTGGCACTTAGATCTATCCCTGAAGGTGCTGTC
GTTTGTAACGTGGAACACAAAGTTGGTGACCGTCGGTGTTTTTGCTAGATGCTCAGGTGATTATGCTATTGTCATC
AGTCACAACCCTGATAATGGAACTACTAGGATTAAGCTTCCATCTGGAGCAAAGAAGATTGTGCCCAGTGGGTGT
AGAGCCATGATTGGCCAGGTTGCTGGTGGAGGAAGAACTGAGAAACCAATGCTCAAAGCTGGAAATGCATACCAC
AAATACCGGGTTAAGAGGAACTGCTGGCCTAAGGTTCGTGGTGTTGCTATGAATCCTGTGGAGCATCCTCATGGT
GGTGGTAACCATCAACATATTGGTCATGCCAGTACTGTCCGCCGTGATGCACCACCTGGACAGAAGGTTGGTCTT
ATTGCTGCAAGGAGAACTGGTCGTCTTCGTGGTCAAGCTGCTGCTACTGCTGCCAAGGCTGACAAGGCTTAAGAT
ATTAAGTTTGTTACTTTTTTCATTGTCGTTGTATTCTGATCGGATTTGAGACCGTCTTTATACTAAGTTCTGTTT
GGATATTATTTAGTAAGGTTTGTTTAGGAACCCTCGTTTGGACAAGTTTGCCACTTATAAATGTGTTTTAGCTTG
GCTCT

> SEQ ID NO:2013 215930 201719_300719_1b
AACCAGGTAAAAACTTCTTTAGGTGGAATGTAAAATCCAGACCATGACCACGAAAACTGCGAACATTCATCACAA
ATGTGACCAGAGTACCAAGCAAAAAGCACGACCATACTGGAATACATGTCCTTTAATCTAGCGATGATAAGCATG
GTAGCGAATATGGATAGTAACAACAATAAGTAACACTCTAAGTGGCCTTGTCGGCCTTGGCAGCGGTAGCGGCGG
CCTGGCCTCTGAGACGACCAGTCCTCCTTGCAGCGATGAGACCAACCTTCTGGCCAGGAGGTGCATCACGGCGGA
CGGTGGACGCGTGACCAATGTGCTGGTGGTTACCTCCTCCGTGGGGATGCTCAACGGGGTTCATGGCCACACCAC
GCACCTTAGGCCAGCAGTTCCTCTTCACGCGGTACTTGTGGTAGGCGTTTCCAGCCTTGAGCATCGGCTTCTCAG
TCCTGCCACCACCAGCAACCTGACCGATCATGGCACGGCAGCTGCTGGGGACAATCTTCTTGGCACCAGAGGGGA
GCTTGATCCTGGATGTGCCGTTATCGGGGTTGTGGCTGA

> SEQ ID NO:2014 215930 206193_300819_1b
AGCGGCCGGACTCAGCTACCCGTAACATCGCAGCCAGCGACGTCGAGTCACCATGGGTAGAGTTATTCGCAACCA
GAGAAAAGGCCGTGGCTCCATCTTCACGGCCAACACCCGCCTGAACAAGGCTCCCGCCAAGTTCCGCACCCTCGA
TTACGCCGAGCGCCATGGCTACGTCCGTGGAATCGTGAAGGACATCATCCACGACCCTGGTCGTGGTGCTCCTCT
CGCCAAGGTCCAGTTCCGCCACCCTTATAAGTATAAGCAGGTCACCGAGACCTTCATCGCCAACGAGGGCATGTA
CACCGGCCAGTTCATCTATGCCGGAAAGCGCGCTGCTCTGACCGTCGGCAACGTCCTGCCCGTCGGTGAGATGCC
CGAGGGTACCGTTGTCTCCAACGTCGAGGAGAAGATTGGCGACCGTGGCACTCTCGGCCGTAACTCTGGTGGCTA
CATCACCATTGTTGGCCACAACCCCGATGAGGGCAAGACCCGTATCAAGCTTCCCTCTGGTGCCAAGAAGGTCGT
CCACTCCCGATCTCGTGGCATGATCGGCATCGTTGCCGGTGGTGGCCGTACCGACAAGCCTCTGTTGAAGGCTTC
TCGTGCCAAGCACAAGTTCGCTGTCAAGCGTAACAGCTGGCCCAAGACTCGTGGTGTTGCCATGAACCCCGTGGA
CCACCCTCACGGTTGTGGTAA

> SEQ ID NO:2015 215930 223831_300976_1b
GATAATCAACAATGGGTCGTGTCATTCGAAACCAAAGAAAGGGTGCTGGTTCTATCTTCACCGCCCACACCCGGC
TCCGAAAGGGCGCTGCCAAGCTCCGAGATCTCGACTACGCCGAGCGACACGGATACATCCGAGGTGTTGTCAAGG
AGATCATCCATGACCCCGGTCGTGGTGCTCCCCTCGCCAAGGTCGTCTTCCGAGACCCCTACAAGTACAAGCAGC
GAGTTGAGACCTTCATTGCTAACGAGGGTGTCTACACTGGCCAGTTCATCTACGCCGGTAAGAAGGCTACTCTGA
ACGTCGGAAACGTTCTGCCCCTGGGCTCTGTCCCCGAGGGTACCATCCTCTCCAACGTCGAGGAGCACGCCGGTG
ACCGAGGTGCCATTGGCCGAACTTCCGGTAACTACGTCATTGTCATCGGCCACAACCCCGATGAGGGCAAGACCC
GAATCAAGCTTCCTTCCGGATCTAAGAAGATTGTCCCCTCTACCGCTCGAGGTGTCATCGGTGTTGTTGCCGGTG
GTGGACGAATCGACAAGCCCCTGCTCAAGGGCGGCCGA

Figure 2 continued

> SEQ ID NO:2016 215930 230527_301069_1b
AAAGCGAGGAAGCAGCAATGGGTCGCGTGATCCGGGCACAGCGTAAGGGTCGCGGCTCCGTCTTTAAGTCGCACA
CGCACCACCGCAAGGGGCCGGCGCGGCTGCGGAAGCTCGACTTCTCGGAGCGCAATGGCTACATCAAGGGCGTGG
TGACGGAGCTGATCCACGACAGCGGGCGAGGGGCGCCGCTCTGCAAGGTGACGTTCCGCCACCCCTTCCGGTTCA
AGCACCAGAAGGAGCTCATGATCGCGGCCGAGGGCATCTACTCGGCCAGTTCATGTACTGCGGCAAGAAGGCCC
AGCTCGCCATTGGGAATGTCCTGCCGCTGCGGTCGGTCCCCGAGGGAGCAGTCGTTTGCAATGTCGAGCACCGTG
TCGGGACAGGGGTTCATTCGCCCGGCCTCTGGGACTACGCGATTGTTGTTAGCCACAACCCGGATATGGGAA
CCTCACGTATCAAGCTTCCGTCGGGCGCCAAGAAAATCGTCCCCAGCGGCTGCCGCGCGATGATCGGTCAGGTGG
CGGGCGGTGGCAGGACCGAGAAGCCGCTGCTCAAGGCCGGGAACGCGTACCACAAGTTCCGCGTCAAGCGCAACA
GCTGGCCCAAGGTGCGTGGTGTGGCTATGAATCCCGTGGAGCATCCCCACGGAGGAGGTAACCACCAGCACATTG
GTCACGCCAGCACTGTCCGCCGCGACGCCCCTCCGGGCCAAAAGGTGGGTCTCATTGCCGCCAGGAGGACCGGAC
GTCTCCGCGGGCAAG

> SEQ ID NO:2017 215930 227302_301027_1b
GTCTCGCCGCGACGAGGAGATGGGTCGCGTGATCCGCGCGCAGCGTAAGGGTGCGGGCTCCGTGTTCAAGTACCA
CTACCCACCAGCAGAAGGGCCCCGCGAGGTTCCGCTCCCTCGACTTCGGCGAGCGCAACGGCTACCTCAAGGGCG
TCGTCACCGACATCATCCACGACCCCGGCCGCGGCGCGCCGCTCGCCAAGGTGACGTTCCGCCACCCGTTCCGGT
ACAAGCACCAGAAGGAGCTGTTCGTCGCGGCGGAGGGGATGTACACGGGGCAGTTCGTCTACT

> SEQ ID NO:2018 215930 38923_300081_1b
CCCACGCGTCCGCTCAAAACCCTAATATCTGAACTTCGCCGTCGAGAGCATCCATGGGTCGTGTCATCAGAGCTC
AACGTAAGGGTGCGGGTTCCGTCTTCAAATCCCACACTCACCACCGCAAAGGTCCGGCTAAGTTCCGTAGCCTCG
ATTTCGGCGAGAGAAATGGTTACCTCAAGGGCGTCGTGACGGAGATCATCCACGATCCTGGTCGTGGTGCTCCTC
TTGCTCGTGTCACTTTCCGTCATCCTTTCCGTTTCAAGAAACAAAAGGAGCTCTTCGTCGCCGCCGAAGGTATGT
ACACCGGTCAGTTCTTGTACTGCGGTAAGAAAGCTACTCTCGTCGTTGGAAATGTTCTCCCTCTTAGATCTATTC
CTGAAGGAGCTGTTGTCTGCAACGTCGAGCATCACGTCGGTGATCGTGGTGTCCTCGCTAGAGCTTCTGGTGATT
ACGCCATTGTTATCGCTCACAACCCTGACAGCGACACTACTAGGATTAAGTTGCCATCGGGTTCGAAGAAGATTG
TCCCAAGTGGATGCAGGGCTATGATTGGACAAGTTGCTGGAGGTGGAAGAACTGAGAAGCCGATGCTCAAGGCAG
GAAACGCGTACCACAAGTACCGTGTGAAGAGGAACTCATGGCCTAAGGTTCGTGGTGTGGCTATGAATCCAGTGG
AGCATCCTCATGGAGGAGGTAACCATCAGCACATTGGTCACGCCAGTACTGTTAGGCGTGATGCACCTCCTGGAC
AAAAGGTTGGTCTTATTGCTGCAAGGAGGACTGGTCGTCTCAGAGGTCAAGCTGCTGCTTCAGCTGCCAAGGCAG
ACTAGAGTTAAAAGAGATAAACTTTGTTTCTCTTGTTTTCTATGTTTCAAGTTTTGTTGTCTGTGTTTCCTTTTG
AACCTCATTCTGAAATCCTAAAAGATTTTTATGATAAACCTTTCTCTCTTCTCGAAAAGCTTATGTTATTCACAT
TGCATCCT

> SEQ ID NO:2019 215930 266886_200031_1b
CGTTATTTATTATGCATCTTGACTACCCCTCGACCACGCGTCCGGCCGAGCAAGCTCGAGAGAGGGAGAGAGAGA
GACGGCGAAATGGGTCGTGTGATCAGAGCACAACGTAAGGGAGCAGGGTCAGTCTTCAAGTCCCATACCCACCAC
CGTAAAGGCCCTGCCCGTTTCCGTTCCCTGGACTTCGGCGAACGGAATGGTTACCTCAAGGGTGTCATAACGGAG
GTTATTCATGATCCAGGTAGGGGTGCCCCATTGGCGCGTATCACTTTCCGTCACCCGTTCCGTTACAAGCACCAG
AAGGAACTGTTCGTGGCTGCTGAGGGTATGTACACTGGCCAGTTCGTTTACTGTGGGAAGAAGGCTACTCTCATG
GTTGGGAATGTTCTCCCACTCAGATCTATCCCTGAAGGAGCTGTCGTTTGCAATGTGGAACACAAGGTTGGTGAC
CGTGGCGTTTTTGCCAGGTGCTCTGGTGATTATGCTATTGTCATCAGTCACAACCCCGATAACGGAACCACTAGG
ATTAAGCTGCCATCAGGATCCAAGAAGATTGTGCCCAGTGGGTGTCGTGCCATGATTGGTCAAGTAGCTGGAGGA
GGACGTACTGAGAAACCAATGCTTAAGGCTGGTAACGCGTACCACAAGTACCGGGTAAAGAGGAACTGCTGGCCC
AAGGTTCGTGGTGTTGCCATGAACCCTGTGGAACATCCTCATGGTGGTGGTAACCATCAACATATTGGTCATGCT
AGTACTGTCCGTCGTGATGCACCACCCGGCCAAAAGGTCGGTCTTATTGCTGCAAGGAGGACTGGTCGTCTTCGT
GGTCAAGCTGCTGCTACAGCTGCCAAGGCTGACAAAGCTTAAAAAGTTTAGCTTGTTACTGTTTTTCCCTACTTG
TTTCCTGATTA

> SEQ ID NO:2020 215930 265928_200082_1b
CCCCCGCTCCTCCGGCGCGAGAGAGAGAGAGAGAGACGGCGAAATGGGTCGTGTAATCAGAGCTCAACGTAAG
GGAGCAGGGTCCGTTTTCAAATCCCACACTCACCACCGTAAAGGTCCGGCCCGATTCCGTACCCTCGATTTCGGC
GAACGTAATGGTTACCTAAAGGGAGTAATCACAGAAGTGATTCACGATCCTGGTAGAGGAGCACCACTCGCGCGC
GTGACATTCCGTCACCCGTTCCGTTACAAGCACCAAAAAGAGTTGTTCGTTGCTGCCGAAGGGATGTACACTGGT
CAGTTCGTTTACTGTGGTAAAAAAGCTACTCTTATGGTCGGTAATGTGTTGCCTCTTAGATCTATACCAGAAGGA
GCTGTTGTATGTAACGTGGAGCATAAAGTAGGAGATCGTGGTGTTTTTGCTAGAAGCTCTGGTGATTATGCCATT
GTTATCAGTCACAACCCTGATAATGGTACCACTAGAGTTAAGCTTCCATCAGGAGCCAAAAAGATTGTACCCAGT

Figure 2 continued

GGATGTCGTGCCATGATTGGTCAAGTTGCTGGAGGAGGACGTACTGAGAAACCAATGCTCAAAGCTGGTAATGCT
TACCACAAGTACCGGGTAAAGAGGAACTGCTGGCCTAAGGTCCGTGGTGTTGCTATGAATC

> SEQ ID NO:2021 215930 236324_301249_1b
AACATCTCGACGACGACTGAGGCCACGTCAGGATGGGAAGAGTTATTACAAATCAGAGAAAGGGCCGCGGCTCGA
TCTTCACCGCCCATACTCGACTGAACAAGGCACCGGCGAAGTTCCGATCCCTCGACTACGCTGAGCGACATGGCT
ACGTTCGTGGTGTTGTGAAGCAGATCATTCACGATCCTGGCCGAGGCGCACCACTCGCAAAGGTCCAGTTCCGCG
ACCCATACCGATACAAGCTGCAACAGAGACCTTCATCGCCAACGAGGGCATGTACTCTGGCCAGTTCATCTATG
CCGGCAAGAACGCTGCTTTGACTGTTGGCAACATCCTGCCTCTGAGCGCTGTTCCTGAAGGTACCGTCGTTTCCA
ACGTCGAGGAGAAGATGGGTGACCGTGGCGCACTTGGACGCACTTCCGGTAACTACGTCACCGTCAT

> SEQ ID NO:2022 215930 233340_301089_1b
TGCTCCTCTTGTCAAGATCGTCTTCCGCAGCCCTACAAGTTCAAACAACAGACCGATACCTTCATCGCCAACTA
GGGCATGTACACTGGCCATTTCATCTACGCCGGAAAGAACGCTGCTCTTACCGTTGGAAACGAGCTGCCTCTGGG
CTCCATGCCCGAGGGTACC

> SEQ ID NO:2023 215930 187639_300679_1b
GTTCTAGATCGCGACGGCCGCCCTTTTTTTTTTTGTTGAAGACTACTGACAATTACCATGAGCTAATTCAACAA
CTCAAGGATTAAATAACCAGGTAAAAACTTCTTTAGGTGGAATGTAGAATCCAGACCATGACCACGAAAACTGCG
AACATTCATCACAAATGTGACCAGAGTACCAAGCAAAAAGCACGACCATACTGGAATACATGTCCTTTAATCTAG
CGATGATAAGCATGGTAGCGAATATGGATAGTAGCAACAATAAGTAACACTCTAAGTGGCCTTGTCGGCCTTGGC
AGCGGTAGCGGCGGCCTGGCCTCTGAGACGACCAGTCCTCCTTGCAGCGATGAGACCAACCTTCTGGCCAGGAGG
TGCATCACGGCGGACGGTGGAGGCGTGACCAATGTGCTGGTGGTTACCTCCTCCGTGGGGATGCTCAACGGGGTT
CATGGCCACACCACGCACCTTAGGCCAGCAGTTCCTCTTCACACGGTACTTGTGGTAGGCGTTTCCAGCCTTGAG
CATCGGCTTCTCAGTCCTGCCACCACCAGCAACCTGACCGATCATGGCACGGCAGCTGCTGGGGACAATCTTCTT
GGCACCAGAGGGGAGCTTGATCCTGGATGTGCCGTTGTCGGGGTTGTGGCTGATGA

> SEQ ID NO:2024 215930 171222_300535_1b
CGCCGACGAGGAGATGGGTGGCGTGATCCGCGCGCAGCGTAAGGGTGCGGGCTCCGTGTTCAAGTCCCACACCCA
CCACCGCAAGGGCCCCGCGAGGTTCCGCTCCCTCGACTTCGGCGAGCGCAACGGCTACCTCAAGGGCGTCGTCAC
CGACATCATCCACGACCCCGGCCGCGGCGCGCCGCTCGCCAAGGTGACGTTCCGCCACCCGTTCCGGTACAAGCA
CCAGAAGGAGCTGTTCGTCGCGGCGGAGGGGATGTACACGGGGCAGTTCGTCTACT

> SEQ ID NO:2025 215957 1106996_301503_1b
GGAGGAGAGAGGAGAGAGGAGGGAGGAGGAGGAGGAGGAGGAGGAGGAGAAGGCAGACATGGTGGAAAGACTGAG
AAAGCCTTTTTGAAGCAGCCCAAGGTTTTTCTCTGGTGGCAAGAAATCAGGGAAAGGTAAAAGACCAGGAAAGGG
CGGAAATAGGTTTTTTAAGAGCATTGGATTGGGGTTCAAGACTCCCAAAGAAGCGATCAATGGCACTTACATAGA
CAAGAAGTGCCCGTTTACTGGGAATGTCTCAATCAGAGGTAGAATCTTAACTGGGACTGTCTACTGCTCCAAAAT
GACGAGAACTATCATTGTTAG

> SEQ ID NO:2026 215957 279226_200060_1b
TAGGGTTTTGCCGCCGTGCATCTATCCTCGTCCAGTTCAGCTTGTAGTCCTCAATCATGGCGGAGCAGACGGAGA
AGGCGTTTTTGAAGCAGCCAGGTGTTTTTCTAAGCTCGAAGAAGACAGGGAAAGGGAAAAGGCCAGGAAAGGGAG
GCAATCGCTACTTTAAGAGTATCGGTCTAGGGTTCAAAACTCCTCGTGAGGCTGTTGAAGGTACATACATTGACA
AGAAATGCCCATTCACTGGCAATGTTTCTATCCGAGGTCGTATCCTTGCTGGTACATGCCACAGTGCTAAGATGA
ACAGAACCATCATTGTTCGACGCAACTACTTACATTATGTCAAGAAGTACCAGAGATATGAGAAGAGGCACTCAA
ACATTCCAGCGCACATCTCACCATGCTTCCGTGTGAAAGAGGGAGATCATGTTATCATTGGACAGTGCAGGCCTT
TGTCCAAAACCGTGAGGTTCAATGTCTTAAAGGTGATTCCAGCTGGTTCTGCTGGTGGAGGAAAAAAGGCTTTTA
CCGGGATGTGAGCTTTGTGCTTCCATTTCAACTGTTATTTCTAGGAATGATGTCAAGACTTTTCTGCTTTTACTG
AATTGTTGCCTTCATTGATTTTCCTTTGAACATCAAATTTTGTAACTTAAATCTTAGCAATTTTTTTTAAGCCTA
TGTACTACTCCACTTA

> SEQ ID NO:2027 215957 253363_301625_1b
GACCAGCAAAATGTCCGAGCTTCACGTCCAGAACGAGCGAGCTTTCCAGAAGCAACCTCACATCTTCCAGAACGC
CAAGTCCAAGGTCAACCGAAAGACCAAGCAAGCGATGGTATAAGGAGGTCGGTCTCGGATTCAAGACCCCCTCTGCCGC
CATCACCGGTGACTACATTGACAAGAAGTGCCCCTTTGTTGGTGACATTTCTATCCGAGGCAAGATCCTGACTGG
TAAGGTTGTCTCCACCAAAATGCACAGAACCATCATCATCCGACGAGAGTACCTCCACTACATCCCCAAGTACAA
CCGATACGAGAAGCGACACAAGAACCTCGCTGCCCACGTCTCTCCCGCTTTCCGAGTCGAGAACGGCGATATGGT
TACCGTTGGTCAGTGCCGACCTCTCTCCAAGACCGTTCGATTCAACGTTCTCCGAGTTCTGCCTGCCACCGGTAA

Figure 2 continued

GGCTAACAAGGCCTTCTCCAAGTTCTAAACTTGAAAAAATCTAGTAAGATATTGTATTAAAAATCGTCAAGCTT

> SEQ ID NO:2028   215957   237072_301250_1b
GGTGTAGATTTTGTTAAAATCAGGGTTAGGGTTTATCAGCGGGCGGCTAGAGGAGCAAAAGAAGCGCCATGGCGG
AGCAGACCGAGCGCGCGTTCCTCAAGCAGCCGAAAGTCTTCCTTCTCGCCAAGAACACTGGAAAGGGAAAGAAGC
CAGGTAAGGGCGGGAATCGATTCTGGAAGAACGTTGGATTGGGCTTCAAGACCCCGCGGGAGGCAATCGAAGGGA
CTTACATCGACAAGAAATGTCCCTTCACGAGCAATGTGTCCATCCGTGGACGTATTCTCTCTGGAACTGTGGCCA
CGACCAAGATGACCCGCAGTATCATCGTGAGGCGGGATTACCTGCACTACGTGAAGAAGTACCAGCGGTATGAGA
AGAGGCACTCGAATGTGGCTGCTCATGTCTCGCCGTGCTTTCGCGTGAAAGAAGGTGACAAAGTGATCATCGGCC
AGTGCAGACCTCTCTCGAAGACGATTCGCTTCAACGTCTTGAAGGTGATGCCGAGAGGAGC

> SEQ ID NO:2029   215957   211573_300900_1b
CTCTAGTTACGGTATCTCTCCGGAGCAGGATAATTCAAGATGGCGACCGAGTTGACCGTCCAGTCGGAGCGTGCT
TTCCAGAAGCAGCCTCACATCTTCTTGAACTCCAAGACCAAGACCAAGAGCGCCCGACCGGGTAAGGGAGGACGA
CGATGGTACAAGGATGTTGGTCTGGGTTTCCGTACCCCCAAGACTGCCATTGAGGGCAGCTACATCGACAAGAAG
TGCCCTTTCACCGGTCTCGTCTCTATCCGTGGCCGTATCCTGACCGGCACCGTTGTTTCCACCAAGATGCACCGA
ACCGTCATCATCCGAAGAGAGTACCTTCACTACATCCCCAAGTACTCTCGTTACGAGAAGCGACACAAGAACCTT
GCCGCCCACGTCTCTCCTGCTTTCCGTGTTGAGGAGGGTGACCAGGTTACCGTTGGCCAGTGCAGGCCTCTCTCC
AAGACTGTCCGCTTCAACGTCCTCCGCGTTCTGCCCCGAACTGGCAAGGCGGTCAAGTCCTTCTCCAAGTTCTAA
ATTGGGTTTCTCTACTGGCATTTTTGGCGTGATAAACATCGGGGGGGAACGAATCATCCCCGCTGGAGGGTCGGC
ATGGGAAGTTGCTTTACAAAATGAGTTGTAGACGCAATCGTGAATAAAAAAGGATTCATGACCACGATCTCGACG
TCTCAGGGTTGTTTACGACGCTTAATTCGATTCCCAATCACGGAGCCCGGTGCAAAAAAGAAATCTTGATGAGGC
CCTCAGGTGATGAATGAATAAAAACCCAATGTTTAAATATCAACAACAGGTCTCATGGTACAGCGGAAGCAGTGA
TTGTACAACAGAGAAAATATCGCGTGATATCAATGCACACGGCATA

> SEQ ID NO:2030   215957   176096_300524_1b
CCCCCGGCCGCCGCATCCTCCTTCGCAAGCCTCGCCTCCACTCCCCGCGCCGCCGCCGCCGCCGCCGACTCGCCG
GTCGTCACCCTCGCCCCGCAGCCATGGCTGAGCAGACTGAGAAGGCTTTCCTGAAGCAGCCAAAGGTTTTCCTCA
GCTCAAAGAAGTCTGGCAAGGGTAAGAAGCCAGGCAAGGGTGGCAACCGCTTCTGGAAGAGCATTGGCCTTGGCT
TCAAGACCCCCAGGGAAGCAATTGAAGGGACATACATTGACAAGAAGTGCCCATTCACTGGAACTGTTTCTATCA
GAGGCAGAATCATTGCTGGAACATGCCACAGTGCCAAGATGAACAGAACTATCATTGTTCGCAGGAACTACCTCC
ATTTTGTCAAGAAATATCAGAGGTATGAGAAGAGGCATTCCAACATTCCGGCTCACGTCTCCCCATGCTTCCGTG
TCAAGGAAGGTGACCATGTCATCATTGGCCAGTGCAGGCCGCTGTCGAAAACTGTGAGGTTCAACGTCCTGAAGG
TCATCCCAGCTGGATCCACCGGCGGCAGCGGCGGCAAGAAGGCCTTCACCGCAGCATGAGCTTGTACTCGCATTA
TTCATGGGTAGTTTATAGACAGATCCTTTTGCTTGAAGTCCTGGCAGGGCTG

> SEQ ID NO:2031   215957   13845_300247_1b
CCCACGCGTCCGCCTTTGCCTACAAGCTTTCACGCGGGAGCTCAACATCAGCCATGGCGGAACAGACTGAGAAAG
CTTTTCTTAAGCAGCCTAAGGTCTTCCTTAGCTCGAAGAAATCTGGAAAGGGAAAGAGACCTGGAAAAGGTGGAA
ACCGTTTCTGGAAGAACATTGGTTTGGGCTTCAAGACTCCTCGTGAAGCCATTGATGGAGCTTACGTTGACAAGA
AATGCCCCTTCACTGGAA

> SEQ ID NO:2032   215957   127812_300473_1b
AGCCACTCCCCTCGTTCCAGTTAAGCTTTCAGCTCCTTCAACTCCACAGCCATGGCCGAACAGACGGAGAAGGCG
TTCTTGAAGCAGCCAGGTGTTTTTCTTAGCTCGAAGAAGACAGGGAAGGGGAAGAGACCAGGGAAGGGAGGTAAC
CGCTACTTCAAGAGCATTGGTCTAGGGTTCAAGACTCCTCGCGAGGCTATTGAAGGTACGTACATTGACAAGAAA
TGTCCATTTACTGGAAATGTTTCAATCAGAGGTCGTATCCTTGCTGGTACATGCCATAGTGCCAAGATGAACAGA
ACCATCATTGTTCGTCGGAACTACCTGCATTACGTTAAGAAGTACCAAAGATATGAAGAGGCATTCCAATATC
CCAGCTCACATATCACCTTGCTTCCGTGTGAAAGAGGGAGATCATGTTATCATTGGACAGTGCAGGCCTTTGTCC
AAGACTGTGAGGTTAATGTGTTAAAGGTGATTCCAGCTGGTTCTGCTGGTGGTGGCAAGAAAGCATTTACAGGA
ATGTGAGCAGGTGTTTCTTGAGTTTACTGTCACTTCTAGAGTATGAAAGTAATTATGCTTGAGACTGAGAAGAGG
AGTGACGTTGAGACTTCTCTACTAAAAGCTGTTTGCGTTTGCCTTTGAAGGCTTAAATTTTGTATGGATACTTGC
TACCTATCATTAGTATAAGGAGTTCAGATTTCAGTTTTTTTGTTACCATTGTTATTTCCAATCAAATGTTCTTCC
TGATTGCCCCAC

> SEQ ID NO:2033   215957   1119515_301898_1b
TTTCTAGGTTTTAGGTTTAGGAGGAAGAAGAGGAGAGGAGCGCCGTAGGCCAGAGGAGGAGCAAGGCGATGGCGG
AACAGACTGAGAAAGCCTTTTTGAAGCAGCCAAAGGTTTTCCTCTGTAGTAAAAAAACAGGGAAAGGCAAAAGGC
CTGGAAAGGGTGGAAACAGGTTTTTTAAGAGCATCGGATTGGGCTTCAAGACTCCAAAAGAAGCCGTTAATGGTA

Figure 2 continued

CTTATATTGACAAGAAATGCCCATTCACTGGGAATGTTTCAATCCGGGGTCGAATCCTCACAGGGACGGTCCACT
GTGCAAAAATGACTAGAACCATTATTGTTCGAAGAGACTATCTCCACTTTGTCAAGAAGTATCAAAGGTACGAGA
AAAGGCATTCTAATCTTGCTGCCCATGTTTCACCTTGTTTCCGAGTCAAGGAAGGCGATAAGGTTATCATTGGAC
AGTGCAGGCCCTTGTCTAAGACTGTCAGGTTTAATGTTCTGAAGGTAATTCCAATGGGGTCATCTGATGGAGGAA
GCAAAAAATCATTTGCAGGAATGTAAGCGTAGTCACTATCTGCACTAGATGTAGTGGTCATACATTTGCAGGGAT
TTAGCAGATTTTTCCATTGGGCTTTTGTGCCGCTGGTTCATGAGTAGTTTGAGTTATGGATAATTTAACACTTAA
TTTATCCC

> SEQ ID NO:2034 215962 1100320_301459_1b
GGTTAAAGCTTAGAGAGACATCTGCCCTTGCAAGTGAAGAGGATCAATCGATCGATCAGCCATGGCAGCGAGGGT
AAGACTATTCAAGGAATACAAGGAAGCAATGAAAGACAAGGCTGTTGACTCAGATATTGTACTTACTTGTGATGA
TACAAACATATACAGGTGGACAGGACACATCAAGGGTCCAGAAGATACACCATACCAAGAAGGTGTTTTTCAGCT
AGCCATAAATGTTCCAGATCAGTACCCTCTGGTGCCACCCCAAATACGGTTTGTGACCAAGATTTTTCACCCAAA
CGTTCACTTTAAGACAGGGGAGATATGCCTAGATATTTTGAAGGCGGCTTGGAGCCCAGCATGGACATTGCAATC
TGTTTGCCGTGCTATAATAGCCCTAATGGCTCATCCTGAGGCAGATAGTCCTTTAAATTGCGATTCCGGCAATCT
ACTAAGATCGGGTGATAACCGTGGATTTTATTCGATGGCTCGTATGTACACCCGATTGGCGGCGGCGCCAAAGCC
TTGATTCTCTTCACATCTTTTCAAAAAATATCAAGGATTTCTCATAGCTACTAAGATGCTTTCCATGTGAAGAAT
TATATATTCGGGCACAAATGATTTGGACACGTGGGTTTTAGAG

> SEQ ID NO:2035 215962 136820_300439_1b
CCCCCCGAACGGCTGCGCGTCTTCCCGTTCGTCCTCCTGTCCGGTCCGAGCCCCTCTGACGACGCGACTTTCCCC
ACGCCGGGATCGAGCTCCGGGGAGGGGAGCTGCGAGCTGAAACACTTTGTCATATCAGTCAACAGTAGAGAGGAG
ACCAGATGCAGGCATCTAGAGCTAGGCTCTTTAAGGAGTATAAGGAGGTGCAGCGAGAAAAGTCAGCTGATCCAG
ATATCCAGTTAATCTGCGATGATTCAAACATATTCAAGTGGACTGCTCTTATCAAGGGCCCTTCGGAGACACCTT
TTGAAGGTGGTGTATTTCAACTTGCATTCTCTATTCCTGAGCAATACCCTCTCCTTCCTCCGCAAGTTCGCTTCT
TGACCAAAATTTTCCACCCGAATGTGCATTTCAAGACAGGTGAGATTTGCCTGGATATCTTGAAGAATGCGTGGA
GCCCAGCATGGACACTACAATCCGTTTGTAGAGCCATAATTGCATTGATGGCCCATCCTGAACCAGACAGTCCAC
TTAACTGTGACTCAGGCAACCTCCTGCGCTCAGGCGACATCAGAGGCTATCAATCCATGGCAAGAATGTATACTA
GGTTGGCTGCCATGCCAA

> SEQ ID NO:2036 215962 156775_301369_1b
AAAATAAAACCCCCTTTTTCCCATTCCGATCAAATTGAATCAATTGATTTAAGGTTCTTCTGAGCTGTGAAGTGC
TTGTTCTGATTATAAAGGATTGAATAAGGATGCAGGCTTCAAGGGCAAGGCTTTTCAAAGAGTACAAAGAAGTAC
AGAGAGAGAAATCTGCTGATCCAGATATTCAATTAGTTTGTGATGATTCTAATATCTTTAAATGGACGGCTCTTA
TTAAAGGGCCATCTGAAACTCCTTATGATGGCGGAGTTTTCCAGCTTGCTTTCTCAGTTCCGGAGCAGTATCCTT
TGCAACCTCCTCAAGTGCGGTTCCTGACCAAAATATTTCACCCAAATGTTCATTTTAAGACTGGAGAGATTTGCC
TTGATATTTTGAAGAATGCATGGAGCCCAGCATGGACACTCCAGTCTGTTTGTCGAGCTATAATTGCTTTGATGG
CTCACCCCGAAGCTGATAGTCCACTAAACTGTGACTCAGGCAATCTTCTTCGATCTGGTGATATCAGAGGATATC
AGTCAATGGCAAGGATGTACACTAGACTTGCAGCAATGCCCAAGAAAGGCTAAAACAATGAGCTACAACCTCGTT
CGCACAGCTTGTAATAATGGCATTAACAAAAGTTGAATTGTTGCATATCCGTGTTTAGTGTTTTCTAACAGCAGT
GCATGACCTATTGTTTATTAATCCTTTTGTTTTTTCGCATATTTCTGATACAGCTCATCTCATTTAGCAGGTTTC
TTGTGTGCCTTTAGCAAGTGGAATATGTATAAA

> SEQ ID NO:2037 215962 238009_301291_2b
ATCATAAGTGGGGCAAAAAAAGGGTTCATGGCGAAGGCGCACGAATCCACTGCGGCACTCCTCTTCTTGATCGAT
TAGGTCAGATCGAAGTAGGTCGATCGATTGATAGATAGATTGGAAAAGGATTGGCGAAGATGCTCGATGTGTCCC
GCGTCCAGAAGGAGCTGGTGGAGATCGAGCGCGACAAGAAGCTGTCGGGCGTGAGCATTCAAGTCTTCGACGATG
GGTTGAGTCGAATGCGAGGAACAATCACGGGGCCTGTTGGCACCCCCTACGAGGGCGGAATCTTCACCATCGATA
TTCAGTTACCTTCTGCTTATCCTTTCGAACCACCAAAGATGCAATTCATGACTAAAGTCTGGCATCCAAACATCA
GCAGCCAAAACGGAGCTATCTGCCTGGACATTCTAAAGGATCAGTGGAGTCCAGCGCTGACGCTAAAGACTGCGC
TACTGTCGCTACAAGCGCTGCTTTCGACGCCGGAGCCGGGGGACCCTCAAGACGCGGTCGTCGCAAAGCAGTACC
TGAGTGAGTATCCGGTTTTCGAGAGCACTGCGAGATACTGGACCGAAACGTTTGCAAAGAGATCGTCCCTTGGCA
TGGAAGAAAAGGTAGCGAAGCTAGTCGAGATGGGATTTACGGATGAGGTTGCGACCGCTGCTCTAGAGTGCTGTG
GCGGCGACGAGAATG

> SEQ ID NO:2038 215962 210910_300894_1b
AAGCCTCTTCGACCACCCTCTGCCATCGTCAGCCTTCGACTCTCTTCACCAAACCTCAACAAGCGACAAATTATC
GCCAGGGTGCTCCAACGCTCGCTCCGCCATCGCCAGTATCCTTTGGACCCATACTTTCGCTCTACAACACACACA
ACCCCTCTTACGCCCACATAGCTTCGGCTACGTCAAGTTTCGGCATCATGTCTAGCAGAGATCGCCGTATAATGA

Figure 2 continued

AGGAGCTGCAGGATCTGACCGAGGACAAGGACACTTCCGGCATTCATGCTGCCCTAGAACAAGAGGGCTCGCTGA
CCGCTCTCAAGGGCTGGTTCTTTGGCCCTGGAAATACGCCGTACGCTGGTGGCAAATTCGTGATTCACATTCAGC
TTCCCACCGACTACCCCTTCAAGCCACCCAAGATGAAGTTTGAGACCAGGATCTGGCATCCTAATGTCAGCAGTC
AGACGGGCGTCATTTGTCTCGACACCCTCAACAAGAACTGGTCGCCTGTCCAAACGATCAAGACGGCTCTCCTCT
CCGTCCGAATGCTTCTCGAAAACCCAAACCCCTCAGATCCACAGGACGGCGAAGTTGCACGGATGCTGCTCGACA
GTCCCGACTCGTTTGTCCAGATGGCTCACGAGTGGGCAGTCAGGCACGCCGGTGCGCCGCGACAGCGAAACCTCG
ACGTAACTATATTCAGAAGCCTGGCCAGACCAACAACTGCTGTCGATGCGAGCCGATACCATGGATACAAGCCAG
TC

> SEQ ID NO:2039 215973 206792_300825_1b
CCCATCCCATCCCATCTTCCAAACCACATCATCAATCTCTAAGCGTTGCCCATTATGAAGAGCGCTTTGATCGCC
GCCGCGGCGCTTGTTGGCTCCGCCCAAGCTGGCGTCCACAAGATGAAGCTGCAGAAGGTCTCCCTCGAGCAGCAG
CTGGAGGGTTCAACCATCGAGTCCCAGGTCCAGCAGCTCGGCCAGAAGTACATGGGCATCCGCCCTACTAGCCGT
GCCGATGTCATGTTCAATGACAAGGTGCCCAAGGTCCAGGGCGGTCACCCAGTGCCCGTCACCAACTTCATGAAC
GCCCAATACTTCTCCGAGATTACCATCGGTACTCCCCCTCAGACCTTCAAGGTTGTCCTTGACACTGGAAGCTCC
AACCTTTGGGTTCCCTCCCAGTCGTGCAACAGCATTGCCTGCTTCCTGCATTCCACGTACGATTCGTCCTCCTCG
AAGACGTACAAGCAGAATGGATCCGACTTCGAGATCCACTACGGATCAGGCAGCTTGACTGGCTTCATCTCCAAT
GATGTCGTCACCATTGGTGACCTCAAGATCGAGAAGCAGGACTTTGCCGAGGCTACCAGCGAGCCCGGCCTTGCC
TTTGCTTTCGGTCGCTTCGACG

> SEQ ID NO:2040 216036 206402_300822_1b
ACGCGCATCATTATGCCGGCATGGGCCCGGGGTCTGACCCTCACCATTTCCGAGACCAGAGCGTGCCGCATTTCG
ACAAGGCGGGCCATACGCGGACGCACGAGCGGGAGGATCACCGGCGGTGGCAGCGGCAGAGAAGGGCTGTGGGGG
ATGATGGCATAGAGTTTGAGCCGCAGACGAGCCTGGCCGGGCACTTTTTGATTGTGGCGGGGATATTGGCGGCGA
CGCTGTTTGTGCCGGCGGTGTATTTGCAGTTTATGCGCCTGGGGAGGCAGAAGAAGGAGAAGGAGTCGTGAGGCG
GGTATGGCGTCTGGAGTGTGATAGGGAAGGCTGTACAAAGAATAGAGCAGACTTATATAGAAATAGGCAATGGGG
GGGCATGAGCGAACAATGCCGATTTTAACGTTACG

> SEQ ID NO:2041 216046 12073_300276_1b
ACAAACAACACTGATGAATCCCCTAATGATTTTGGTAAAAATCATTAAGTTAAGGTGGATACACATCTTGTCATA
TGATCAAATGGTTTCGCGAAAAATCAATAATCAGACAACAAGATGTGCGAACTCGATATTTTACACGACTCTCTT
TACCAATTCTGCCCCGAATTACACTTAAAACGACTCAACAGCTTAACGTTGGCTTGCCACGCATTACTTGACTGT
AAAACTCTCACTCTTACCGAACT

> SEQ ID NO:2042 216046 206428_300822_1b
AAAATCATTAAGTTAAGGTGGATACACATCTGTCATATGATCAAATGGTTTCGCGAAAAATCAATAATCAGACAA
CAAGATGTGCGAACTCGATATTTTACACGACTCTCTTTACCAATTCTGCCCCGAATTACACTTAAAACGACTCAA
CAGCTTAACGTTGGCTTGCCACGCATTACTTGACTGTAAAACTCTCACTCTTACCGAACTTGTCCGTAACCTGCC
AACCAAAGCGAGAACAAAACATAACATCAAACGAATCGACCGATTGTTAGGTAATCGTCACCTCCACAAAGAGCG
ACTCGCTGTATACCGTTGGCATGCTAGCTTTATCTGTTCGGGCAATACGATGCCCATTGTACTTGTTGACTGGTC
TGATATTCGTGAGCAAAAACGACTTATGGTATTGCGAGCTTCAGTCGCACTACACGGTCGTTCTGTTACTCTTTA
TGAGAAAGCGTTCCCGCTTTCAGAGCAATGTTCAAAGAAAGCTCATGACCAATTTCTAGCCGACCTTGCGAGCAT
TCTACCGAGTAACACCACACCGCTCATTGTCAGTGATGCTGGCTTTAAAGTGCCATGGTATAAATCCGTTGAGAA
GCTGGG

> SEQ ID NO:2043 216062 207919_300830_1b
GCCAGTACGAACGAACATTCAGCCTTGTGCAGGGGAAGCAGAAGATCATATAGAGCATTTATCAAGCGAATAACA
GACCCTGAGACACTGAATCAGAGAAGCTTTAGAAGCTCTTCTTCTCTGTCTCCGCGCCTCTTATCGCAAACAG
CCCCTCTACTGCTGCTGCTGCCTTTGTCAGGCCTGTCTTTTCAGTGTCGCATGCCCCGCCTCATCTTTCTACCTT
GCACAACTCAGCCTTTGCGCTAATCAACGACATCTGCGATCTGTGTCGGCAGCAGAAGAGTCCCAGATCACTGGT
CTCTCTTTTATTCTCCTTCTTCTAAACAGATCTGTGTTGCCCCCAAAGCAAGCGAGAATACGTCAAGATGGCTCT
TCCGAAACGCATCATCAAAGAAACCGAACGCCTTATGGCGGAACCAGTTCCCGGAATCAGCGCCGTGCCTCACGA
AGATAACCTGCGATACTTTGACGTCGAGATCCACGGCCCTGCATCGTCACCATACGAAGGCGGCATTTTCAAGCT
TGAGCTCTTCCTCCCAGATGACTATCCCATGACTCCGCCCAAAGATTCGATTCCTTACTAAGATTTTCCACCCAA
ACGTTGACAAGCTGGG

> SEQ ID NO:2044 216071 1109639_301523_1b
GTCTGTAAGAGGTTGCATTGTCAGTCAGGATCTCTCTGTCTTAAACCTTGTCATTGTCAAGCAAGGAGATCAGGA
CTTGCCGGGGTTGACAGATGTTGAGAAGCCAAGAATGAGAGGTCCGAAAAGAGCCTCAAAGATTCGAAAGCTATT

Figure 2 continued

CAATCTCTCCAAGGAGGATGATGTGCGTAGATATGTTAACACATACCGTCGAACGTTCACTACCAAGACAGGCAA
GAAATGCAGCAAGGCACCAAAGATCCAGAGGCTGGTTACTCCTCTAACTTTGCAGAGGAAGAGAAGAAGAATTGC
TTTGAAGAAGAAGAGAGAGGCAAAGGCAAAGACTGAAGCTGCTGATTATCAGAAGCTTCTGGCCTCACGCCTCAA
GGAACAACGAGACCATAGAAGTGAGTCTCTTGCCAAGAAGAGGGCAACCCGGGTTTCCGTCGCCTCTAAATCTTC
TGCTTGAATTGCTACTTGCATAGGATAATGCTAGTCAGACTTGGAGTGCATTGTTATACTGAGGGGAATGCTTGT
TTTTCAGGGAGAGTTGAATAGAATTAGACTATAAATTGTCTTATTCTT

> SEQ ID NO:2045    216071    239929_301309_1b
GCAGCTTCCACACGCCATCGAGACGCCGCCGTCAAAACCGCCGTCAAAATGAAGCTCAACATCTCCTACCCCAAC
AATGGAACCCAGAAATTGATCGAGGTCGAAGATGAGCGCAAGCTCCGCGTCTTCATGGACCGCCGCATGGGTCAC
GAAGTGCCTGGCGACAGTGTCGGCGACGAGTTCAAGGGCTACATCTTCAGGATCACGGGTGGCAACGACAAACAA
GGTTTCCCGATGAAGCAGGGTGTCATGCACCCTACCCGTGTCCGCCTCCTCCTCAGTGAGGGCCACTCCTGCTAC
CGTCCCCGCCGCAATGGCGAGCGCAAGAGGAAGTCGGTCCGCGGATGCATCGTCGGCATGGACCTCTCTGTCCTC
GCTCTGAGCATCGTCAAGAAGGGCGACGAGGACGTTCCCGGTCTTACCGACGTCGTCCACCCCAAGCGTCTCGGT
CCCAAGCGCGCGACCAAGATCCGCCGCTTCTTCGGTCTCAGCAAGGAAGATGATGTTCGCAAGTTCGTCATCCGC
CGTGAGGTTACCAGCAAGAAGGAGGGTGCGAAGCCCTACACCAAGGCCCCCAAGATCCAACGT

> SEQ ID NO:2046    216071    190972_300737_1b
CGAGCGAACCCTAGCTCTAGCGCCGCCGCCGCCGCCGCCAGGAAGTTCAACATCGCCAACCCGACCACCGGGTGC
CAGAAGAAGCTCGAGATCGATGACGACCAGAAGCTCCGGGCATTTTATGACAAGAGGATCTCCCAGGAAGTCAGT
GGTGATGCTCTTGGCGAAGAATTCAAGGGCTATGTATTCAAGATCATGGGAGGCTGTGACAAGCAAGGTTTCCCC
ATGAAGCAGGGTGTGCTTACTTCTGGACGTGTCCGCCTTCTCCTCCACAGGGGTACCCCCTGCTTCCGTGGATAT
GGCAGGCGTGATGGTGAGCGCAGAAGGAAGTCAGTCCGTGGTTGCATTGTCAGCCAAGATCTCTCTGTTATCAAC
TTGGTGATTGTAAAGAAGGGTGATAATGACCTTCCTGGCTTGACTGACACTGAGAAGCCCAGGATGAGGGACCC
AAGAGGGCATCTAAGATCAGGAAGCTGTTTAACCTTGCCAAGGATGATGATGTCCGCAAGTATGTCAACACTTAC
CGCAGAACCTTCACTACCAAGAACGGCAAGAAGGTTAGCAAGGCTCCTAAGATCCAGAGGCTTGTCACTCCCCTG
ACTCTTCAGAGGAAGAGGGCGAGAATCCGCCAGAAGAAGCAAAGAATTGCCAAGAAGA

> SEQ ID NO:2047    216071    1113029_301794_1b
TTGGTCTTTGTTCTTTGCTGGGGGGCTTAGGAGGGTTGCCAAGGCAGGGCACAGGGCTGGGAAGAAATGAAGCTC
AACATTGCAAACCCTACGACAGGGTGTCAGAAGAAGGTGGAGATTGATGATGACTCAAAGCTCCGTACTTTTTAT
GACAAGCGGTTGTCTCAGGAAGTTAGCGGTGATGCCCTTGGCGAGGAGTTTAAGGGTTATGTTTTCAAAATCATG
GGAGGGTGTGACAAGCAGGGCTTCCCCATGAAGCAAGGTGTTTTGGTGCCTGGCCGAGTTCGCCTTCTCATGCAC
AGAGGCACACCATGCTTCCGTGGTCACGGAAGGCGCAATGGAGAGCGACGCCGTAAGTCAGTAAGAGGGTGCATT
GTTAGCCAGGACCTCTCCTGTCTTAACCTTGTTATTGTCAAGCAAGGTGAGCAGGACTTACCAGGGTTGACTGAT
GTGGAGAAGCCCAGAATGCGAGGCCCGAAAAGAGCTTCTAAGATTCGGAAGCTTTTCAACCTCTCAAAGGACGAT
GATGTCCGCCGATATGTCAACACATATCGCCGGACTTTTACCACTAAAACAGGTAAGAAGTGCAGCAAGGCGCCG
AAGATTCAAAGGCTGGTGACGCCTCTTACTCTGCAGAGGA

> SEQ ID NO:2048    216071    171875_300624_1b
GAAGCTGCGTGCATTTTTTGACAAGAGGATCTCTCAGGAGGTCAGTGGCGATGCTCTGGGCGAGGAATTCAAGGG
CTATGTCTTCAAGATCATGGGGGGTTGTGACAAGCAGGGTTTCCCTATGAAGCAGGGAGTGCTCACTGCTGGACG
TGTCCGCCTTCTTCTTCACAGGGGCACACCTTGCTTCCGTGGGTATGGCAGGCGTGATGGTGAGCGCAGGAGGAA
GTCTGTCCGTGGTTGCATCGTCAGCCAGGACCTATCTGTTATTAACTTGGTGATTGTCAAGAAGGGTGAGAATGA
CCTGCCTGGCCTTACTGACACTGAGAAGCCCAGGATGAGGGACCCAAGAGGGCCTCCAAGATCAGGAAGCTCTT
CAACCTTTCCAAGGATGATGATGTCCGCAAATATGTCAACACCTACCGCAGGACATTCACTACCAAGAATGGCAA
GAAGGTGAGCAAGGCTCCTAAGATCCAGCGTCTTGTGACTCCCCTCACCCTCCAGAGGAAGCGTGCCAGAATCGC
TGACAAGAAGAAGAGGATCGCCAA

> SEQ ID NO:2049    216071    143175_200007_1b
AGAGAGGAGCTCAGCGTAAAATTTGAGAGTTTCATTGTCAGCTTGGCGGCCTCCACTGAGTTCGACCGAAAATGA
AGTTCAACATTGCAAATCCGACAACTGGATGCCAGAAGAAGCTCGAGATCGACGATGACCAGAAACTCCGGGCTT
TCTTTGACAAAAGGATCTCCCAGGAGGTTGCTGGAGATGCTTTGGGAGACGAGTTCAAGGGATATGTTTTTAAGA
TTATGGGAGGATGTGACAAGCAAGGTTTCCCAATGAAGCAGGGAGTGTTGACTCCAGGCCGTGTTCGTCTTCTGC
TGTACAGAGGTACTCCTTGTTTCCGGGGCTATGGTAGGCGAAATGGGGAGCGCAGAAGGAAGTCTGTCCGTGGAT
GCATTGTTAGTCCTGATCTTTCTGTTCTGAATTTGGTTATTGTGAAAAAGGGTGAGAATGATCTGCCTGGACTGA
CAGACACCGAGAAACCAAGGATGAGAGGACCCAAAAGGGCTTCCAAGATTAGGAAGCTCTTCAACCTTTCCAAGG
AAGATGACGTCAGGAAGTACGTCAATACCTACCGTCGAAATTTCACAACCAAAACTGGAAAAAGGCTAGCAAGG
CTCCTAAGATCCAGAGGCTGGTAACACCATTGACTCTC

Figure 2 continued

> SEQ ID NO:2050 216076 206520_300823_1b
GATATTCTTATGTGTGTTCGTTCAAGAGTGTAATGATAATACTGTTTGGTAAATGGTGGAATTTTGGTGGTGTGT
AGATGTGATAACCGTAAGGTGGACG

> SEQ ID NO:2051 216093 214860_300865_1b
GGGGAGCGGCTCTCCCTGACATTCATTCCACCATGGCGCGCCGCCAGCATCTCACAGCGTCCATCCTGTTGGTCG
TCGTCCTGTTCTTCAGCTTCTCGTATTTCCTGTCCGGCTCGTCCAGCCACGATGTGGACCGAATCCATGAGCCTG
CGGGAGAGCCCAAGTCGGAATTCAAAGTGGACCTGGGTGGCATGCCAGCTAGTCTGCTTGACGGAGAGTCTATAG
CCCCCAAGCTGGAGAATGCAACACTCAAGGCCGAGCTGGGTCGTGCAACATGGAAGTTTATGCACACAATGGTCG
CCAGATTCCCCGAGCAGCCCTCAAAGGAAGAGCGTAAGACTCTCGAGACGTTCATCTACCTCTTCAGCCGCCTAT
ATCCCTGCGGTGACTGTGCGAGGCACTTCCGGGGCTGCTGTCAAAATACCCTCCCCAGACGAGCAGTAGGAATG
CGGCGGCTGGATGGCTGTGCTTTGTGCATAACCAGGTTAACGAGAGACTGAAGAAGCCGATATTTGACTGCAACA
ACATTGGCGACTTTTACGACTGCGGCTGCGGAGATGAAGATAAGAAGAAGGGGGA

> SEQ ID NO:2052 216157 258894_301700_1b
ACACCCATTCACTGTCGATAGCCAGACCCGAGACAGTACCAGTCGCCGCCATTTCAACCAACTCATCACGTGATA
ACACATCATCCCCCCACCTCACCCCTACCAACAATAAGAGCTCTGTAAAACCACAAAGCTCTAACACACCTCAAG
ACAACACCCCATACCAGCACAGACCTACACTACAATGGCAGCACAGCGAGCGCGAAAAATCGCCGTGGTAGGCTC
CCGAGCCGTCGGCAAGTCATCCATGACCGTGCAGTTCGTCGAGCAGCATTTCGTGGAGTCGTACTACCCCACAAT
CGAAAACCAGTTCTCCAAGACCATTGTGTACAAGGGCATTGAGTATAACACGGAGATCATCGACACAGCAGGCCA
GGATGAGTTTAGTATCATGAACCAGAAGCATCTCCTGGGTGTCCATGGATACCTACTGGTGTACTCGGTCACTTC
ACGATCCACCTTTGACGTGCTGCCCATCATCCACGACAAGATTCTCAACGCTACAGGCTCGTCGTCAATCCCGCT
GGTCATTGTAGGCAACAAGTCAGATCTAGACTCCCAGCGACAAGTGTCTG

> SEQ ID NO:2053 216189 208347_300834_1b
CAATCATCAGTCAAACTCCAAACGAGGTATGTATGGCCTTGGTCACCGCTGACGGCGATTCGGACCTGGCAGGAT
GACGCCTTTTATCGTGGCTGGGGACAGCAATCGAAGACGCCGGCCCCGATGAGCGACAATGAACGCGCGATGATG
CATCACATCACATCATGCGGTTTTCTGTTTGGCACACAACGGCTTTGGCTGGCGTTTCTCGATACGCTGCTTCCC
CTTCGGCAATGAGCGGGCTGAACCCTCGTCGACGGATCGCTGAGGGCACTCTCCACGCTTCTGGGCCACTCCTAG
TCTAACATGTGTTTCCCTTCTGGCAGATACCTCATTTCCAACTCCGACTTGAGAATCTCCTTTTCATCAATACCG
CCAAGATGGTCCGCACTTCCGTTCTCCACGATGCCCTACAGCATCAACAACGCCGAGAAGGCCGGCAAGCGTC
AGGTCCTGATCCGACCTAGCTCCAAGGTCATTGTCAAGTTCCTCCAGGTCATGCAGCGCCACGGCTACATTGGCG
AGTTCGAGGAGGTCGATGACCACCGCTCCGGCAAGATTGTCGTCCAGCTGAACGGCCGTCTCAACAAGACTGGTG
TCATCTCCCCCCGCTACAACGTCCGCCTGGCCGACCTCGAGAAGTGGGTCGTCAAGCTGCTGCCTGCCCGTCAGT
TCGGCTATGTCATCCTCACCACCTCTGCTGGTATCATGGACCACGAGGAGGCCCGACGAAAGCACGTTGCCGGCA
AGATCATCGGCTTCTTCTACTAAAAAAATTGGCGGAGAGAGGAATGAAAAAAAAGTGAATTTGTGGCATTCTCGG
CGTTCCAATGGTGGTCGCGGTGACGGTAATCAGCATCCTCTGATTTACAGCTGGGATAGTCACCCTTTAGCTTAG
CGTACACTGGCAATAAATCACAGATGAGAAG

> SEQ ID NO:2054 216228 156747_301369_1b
CACTTTCATTTTAGGTCTTCAGCGCCAAAAATAAATAGAAAGAAAAATGGAAGGTAAACATGTATCAACTCATCC
AGAAGTTCCAGGTGAACCAACGAAGACAGGAACAGCAATTCTTGAAACAGCAACTGCTACTATTCAAGGCTTTGG
TCCTATCAACAAGATTCATCAGCACCTTTGCGCGTTCCATTTCTATGGACATGACATGACACGACAAGTCGAGGC
ACACCACTTCTGCGGTCACCAAAATGAAGAATTCAGGCAGTGTCTCATCTACGACAGGCCAGACGCTGATGGCCG
CCTGATTGGGCTCGAGTACATNGTTTCAGAGGAACTGTTCTTAACATTACCAGATGATGAAAAGAAATTCTGGCA
TTCCCATGAGTTCGAGGTGAAAAGTGGTGTACTCTTCATGCCTGGCATTCCTGGTCCGATTCAACGACAAGATCT
CGAAAAAGTTGCTAAAACCTATGGCAAGGTCATCCATTTCTGGCAGGTAGATAGAGGTGACACACTCCCCCTAGG
AATTCCTCAAGTTATGATGGCACTCACTAGAGATGGTCAGCTCTATGACAATCTTGCTCAAGATATGGAGAAACG
TTATGGAGTATCATTTGCTGAAGAAAGAGAGAAGAGGGCAAATATGGAAGGGTTAGCTCATGGAATACA

> SEQ ID NO:2055 216228 236627_301247_1b
GAGAAGAGGAAAGGAAGAATGGCTGCTGCTGGGCCGGGACCTGTGGCGACGAAGGACTATCTCCCTGGCAGGGAG
AAGGAGACCAAGAGCAAGATCTTGGAGACCACAGCTTCGGTGCTCCAGGGCTTCGCCCCGATCAAGAAGATCCAT
CAACACCTTTGCGCGTAAGTTCTCTATGCCTTTGCATGCAAGACCTCTTCGTTCTTGTTGTTTCGCTTGATCCAG
CTTCCACTGCTATGGAAACAACTTGAGCCGCCAAGTCGAAGCTCACCACTACTGCGGCCATGTAAACGAAGACCT
GAGGCAGTGCGCCATCTACGACACCGATGCCGCAGATGCGAGGCTCATCGGGATCGAGTATCTCATCTCCGAGTC
TCTCTTCCGGGGCCTCCCGGACGAGGAGAAGAAGCTCTGGCACTCTCACGAGTACGAGGTGAAGAGCGGCATCCT
CTTCTGTCCGGGGCTGCCGGAGGTTGCCGAGCATGCCGAGCTTTCCAAGGTTGCCAAGACGTATGGCAAGACGTT

Figure 2 continued

CCACTTCTGGCAGTTTGATCGCGGTGACGCGCTGCCTCTGGGACCTCCGCAGCTCATGATGTCCTTCACGAACGA
CGGTCAGGTCAATGAAGGCATGGCAAAAGGTAAGATAATCGACTACCTTCTCCCTTCTTAACTTTGCGATTGTTT
AGTCGTCGAGGAACGGTATGGTGTCTCGTTTGAGGCCAAGAGGAAGAAGCGAGCTGACATCGAAGGACCGGATTT
CGGCATTGATCCTCAGGCTGACTACTGGCAGAAGGGAAAAGGCTTCGAGACTGTTGTCAAGGAGATGGTGTAGTC
TGTAAAGTTCCAACTGTTAGTTCCAGGAAAATAAAGTCATGATGGTAGAACTACGGTTGTTT

> SEQ ID NO:2056 216259 217553_300909_1b
GGTTAATTTCGGATTGCCACAGAATAGGAGACTTGCCACTCCGGTGGTTATTCTCGGCATATATGCGACGTTAGA
ATAACCTGTTTAATCGTATATAGTCACTGTGAAGGAATCCATGAGGGCAATGTTGATGAATGTTGTCAGTGAAGT
TGGAAGTATAGAACTTAGCCGGCTACAAACTTAAAGAGCGTTGCCCAAAATGAAGCCCTATCCATTCCAATTCAA
CAGCACATCCTCGT

> SEQ ID NO:2057 216268 103453_300026_1b
TGGTATCAACGCAGAGTGCCATTACGCCGGGGACTCACAACAGAAATAGCTACTAAACAAACAGCAAAAGATAAC
CAGAAAAGATGGCGACTTTCCCTGTTGTTGATTTGGGGTTGCTTCAAACTGGGAAAAGGGCTGAAACATTGGATA
AAATCAAAGATGCATGTGAAAACTGGGGTTTCTTTGAGCTTGTGAATCATGGGATTTCCCATGAAGTGCTGGACA
CAGTTGAGAAGCTTACTAAGGAGCATTACAAGAAATGCATGGAGCAAAGGTTCAAGGAAATGGTGGCAAGTAAAG
GTCTTGAGGCTGTCCAAACTGAGATTGATGATCTGGATTGGGAAAGCACTTTTTACTTGAAACACCTCCCTGTTT
CCACTGTGTATGAAGTTCCAGACTTAGAGGATAAATACAGAAATGTTATGAAAGACTTCGCGTTGAGTCTAGAGA
AACTAGCTGAAGATCTTCTTGATTTGCTGTGTGAAAATCTCGGGCTCGAGCAAGGTTATTTGAAGAAAGCATTTT
ATGGTTCAAAGGGTCCAACTTTTGGTACCAAAGTTAGCAACTATCCTCCTTGCCCCAAACCAGAACTGATCAAAG
GCCTACGTGCTCACACTGATGCTGGTGGCCTAATCCTGCTTTTCCAAGATGACAAAGTCAGTGGTCTTCAGTTAC
TGAAAGACGGTAATTGGATTGATGTCCCACCTATGAAACACTCGATTGTTATCAACCTTGGCGACCAGCTGGAGG
TCATAACAAATGGAAAGTACAAGAGTATTGAGCACAGAGTTATTGCACAACAAGATGGCACTAGAATGTCAATTG
CTTCATTTTATAATCCAGGAAGTGATGCTGTGATATTTCCAGCACCAGAATTGGTTGAAAAGGCAGAAGAAGAGA
ACAAGTTGAAGTATCCCAAATTTGTGTTTGAAGATTACATGAAGCTGTATGCAGGT

> SEQ ID NO:2058 216268 11669_300291_1b
TACGCCGGGGACTCACAACAGAAATAGCTACTAAACAAACAGCAAAAGATAACCAGAAAAGATGGCGACTTTCCC
TGTTGTTGATTTGGGGCTGCTTCAAACTGGGAAAAGGGCTGAAACATTGGATAAAATCAAAGATGCATGTGAAAA
CTGGGGTTTCTTTGAGCTTGTGAATCATGGGATTTCCCATGAAGTGCTGGACACAGTTGAGAAGCTTACTAAGGA
GCATTACAAGAAATGCATGGAGCAAAGGTTCAAGGAAATGGTGGCAAGTAAAGGTCTTGAGGCTGTCCACACTGA
GATTGATGATCTGGATTGG

> SEQ ID NO:2059 216268 283443_200093_1b
AAACAGCAAAAGATAACCAGAAAAGATGGCGACTACTTTCCCAGTTGTGGATTTGGGGTTGCTTCAAACTGAGAA
AAGGGCTGAAACAATGGATAAAATCAAAGATGCATGTGAAAACTGGGGTTTCTTTGAGCTTGTGAATCATGGGAT
TTCCCATGAAGTGTTGGACACAGTTGAGAAGCTTACTAAGGAGCATTACAAGAAATGCATGGAACAAAGGTTCAA
GGAAATGGTGGAAAGTAAAGGTCTTGAGGCTGTCCAAACTGAGATTGATGATCTTGATTGGGAAAGCACTTTTTA
CTTGAAACATCTTCCTGTTTCCACTGTGTGTGAAGTTCCAGACTTGGAGGATAAATACAGAAATGTAATGAAGGA
TTTCGCGTTGAAGCTGGAAAAACTAGCTGAAGATCTTCTTGATTTGCTGTGTGAAAACCTCGAACTCGAGCAAGG
TTATTTGAAGAAAGTATTTTATGGCTTAAAGGGTCCAACTTTTGGTACCAAAGTTAGCAACTATCCTCCTTGTCC
CAAGCCAGAACTGATCAAAGGCCTACGCGCTCACACTGATGCTGGTGGCCTAATCCTGCTGGTTCAAGACGACAA
AGTCAGTGGTCTTCAGTTACTGAACGATGGCAAATGGATTGATGTCCCACCTATGAAACACTCAATTGACATCAA
CCTTGGCGACCAGCTCGAGGTGATAACAAATGGAAGATACAAGAGTATTGAGCACAGAGTTATT

> SEQ ID NO:2060 216268 267836_200119_1b
GTCCGGGAGATTCCGGTGATTGACTTAGTAAGCTTGACGGCGAGGAGAGAAGTGCAACCATGGCACTTCTCCATA
CGCTTGTGAGAAATGGGGCTTCTTTATGATAGAGAACCATGGAATTGACACTAACCTGATGGACAATGTGAAGCA
GCTCGTGATTCAGCACTATGAAGCCAATATGAAGAAACGGTTCTATGAATCAGAGCTACCTATGAGCTTAGAGAA
GAAAGAAAAACTCAGCAACACAGACTGGGAAAGCACCTTCTTTCTTTGGCATCGTCCAAGTTCTAACATCTATGA
GATTGAAGGTCTCTCAAAGGATCTTTGCAACGCAGTAGATGGATACATTGATCAGCTGATTAATCTTGCTGAAAA
TCTTTCAGAACTAATGTGTGAGAACCTTGGCCTAGAGAAGAGTTACATTAAGGAAGCATTTTCAGGAAGCAAGGG
TCCTTCTGTTGGAACAAAAGTGGCAATATATCCTCAATGTACGCGCCCTGAATTAGTCAGGGGATTGCGTGAGCA
CACAGATGCTGGTGGTATCATTCTCTTACTCCAAGATGAACAAGTTCCTGGTCTGGAATTCTTTAAAGATGGACA
TTGGGTGAAAATTCCACCTTCCAAGAACAACAGAATTTTTGTAAACACTGGTGATCAAATCGAAATTTTAAGCAA
TGGGAT

> SEQ ID NO:2061 216268 209068_300811_1b

Figure 2 continued

```
GACACACAGACGCACTCACACACTCAGCTGAAGCGAGCGAGCGAGTGAACGAGAGAGAGAGACAGAGATGGCGAG
TGTTGCCTCCTTCCCGGTGATCAACATGGAGAACCTGGAGACCGAGGAGAGGGGCGCAGCAATGGAGGTCATCCG
CGACGCCTGCGAGAACTGGGGCTTCTTCGAGATGCTGAACCATGGCATCGCGCACGAGCTGATGGACGAGGTGGA
GCGGGTGAGCAAGGCGCACTACGCCAACTGCCGGGAGGAGAAGTTCAAGGAGTTCGCGCGGCGGATGCTGGAGGC
CGGCGAGAAGGGCGCCGACGTGAAGGGCATCGACTGGGAGAGCACCTTCTTCGTCCGCCACCGCCCCGTCTCCAA
CCTCGCCGACCTCCCCGACGTCGACGACCACTACAGGCAGGTGATGAATCAATTTGCGTCGGAGATCGAGAAGCT
CTCGGAGAGGGTGCTGGACCTGCTGTGCGAGAATCTGGGCCTGGAGAAGGGTTACCT
```

> SEQ ID NO:2062 216268 1889_300334_1b
```
AATTCGGCACCAGGAAATTTTGAGAGTTTCCCAGTGGTTAACATGGAGTTGCTTAACACTGAACAAAGGGCTGCA
ACAATGGAGAAAATTAAGGATGCTTGTGAGAACTGGGGCTTCTTTGAGGTGGTAAATCATGGGATCTGTCATGAG
CTTCTGGACACAGTGGAGAAGTTGACAAAGGGACACTACAAGAAGTGTATGGAACAAAGGTTTAAGGAAATGGTT
GCAAGTAAAGGGCTTGAAGCTGTTGAGACTGAAATAAAGGATTTGGATTGGGAAAGTACTTTCTTCTTGAAACAC
CTTCCTGTTTCAAACATCTCAGAAGTTCCTGATCTTGAAGATGAATACAGGAAAATCATGAAGGAGTTTGCTGAA
AAGCTAGAGAAATTAGCAGAGCAACTTTTGGACTTGCTCTGTGAAAATCTAAGACTGGAGCAAGGTTACTTAAAG
AAAGCCTTTTATGGTTCAAATGGTCCTACTTTTGGCA
```

> SEQ ID NO:2063 216268 187871_300681_1b
```
CACAACCCAGCTGGTGAAAGAGAGGAACTTGAGAGTTAGCTAGCATGGCGGCAGCATTGTCGTTCCCGATCATCG
ACATGAGTCTGCTCGACGGGGCAGAGAGGCCCGCGGCGATGGGGCTGCTCCGCGACGCATGCGAGAGCTGGGGCT
TCTTTGAGATCCTGAACCACGGCATCTCGACGGAGCTGATGGACGAGGTGGAGAAAATGACCAAGGACCACTACA
AGCGTGTGCGCGAGCAGAGGTTCCTCGAGTTCGCGAGCAAGACGCTCAAGGAAGGCTGCGACGACGTGAATAAGG
CGGAGAAGCTGGACTGGGAGAGCACCTTCTTCGTCCGCCACCTCCCGGAGTCCAACATCGCCGACATACCCGACC
TCGACGACGACTACAGGCGCCTCATGAAGCGCTTCGCGGCGGAGCTGGAGACGCTGGCGGAGCGGCTACTGGACC
TGCTCTGCGAGAACCTCGGCCTCGAGAAGGGCTACCTCACCAAGGCCTTCCGTGGCCCCGCGGGCGCACCCACCT
TCGGCACCAAGGTCAGCAGCTACCCGCCGTGCCCGCGCCCCGACCTCGTC
```

> SEQ ID NO:2064 216268 176055_300524_1b
```
CCCCCCGGCACACACAGACACACAGACGCACTCACACACTCAGCTTAAGCGAGCGAGCGAGTGAACGAGAGAGA
GAGACAGAGATGGCGAGTGTTGCCTCCTTCCCGGTGATCAACATGGAGAACCTGGAGACCGAGGAGAGGGGCGCA
GCAATGGAGGTCATCCGCGACGCCTGCGAGAACTGGGGCTTCTTCGAGATGCTGAACCATGGCATCGCGCACGAG
CTGATGGACGAGGTGGAGCGGGTGAGCAAGGCGCACTACGCCAACTGCCGGGAGGAGAAGTTCAAGGAGTTCGCG
CGGCGGATGCTGGAGGCCGGCGAGAAGGGCGCCGACGTGAAGGGCATCGACTGGGAGAGCACCTTCTTCGTCCGC
CACCGCCCCGTCTCCAACCTCGCCGACCTCCCCGACGTCGACGACCACTACAGGCAGGTGATGAAGCAAT
```

> SEQ ID NO:2065 216268 141827_300429_1b
```
CCCGACTAGATTCTTAATACACAACCCAGCTGGTGAAAGAGAGGAACTTGAGAGTTAGCTAGCATGGCGGCAGCA
TTGTCGTTCCCGATCATCGACATGAGTCTGCTCGACGGGGCAGAGAGGCCCGCGGCGATGGGGCTGCTCCGCGAC
GCATGCGAGAGCTGGGGCTTCTTTGAGATCCTGAACCACGGCATCTCGACGGAGCTGATGGACGAGGTGGAGAAG
ATGACCAAGGACCACTACAAGCGTGTGCGCGAGCAGAGGTTCCTCGAGTTCGCGAGCAAGACGCTCAAGGAAGGC
TGCGACGACGTGAATAAGGCGGAGAAGCTGGACTGGGAGAGCACCTTCTTCGTCCGCCACCTCCCGGAGTCCAAC
ATCGCCGACATACCCGACCTCGACGACGACTACAGGCGCCTCATGAAGCGCTTCGCGGCGGAGCTGGAGACGCTG
GCGGAGCGGCTACTGGACCTGCTCTGCGAGAACCTCGGCCTCGAGAAGGGCTACCTCACCAAGGCCTTCCGTGGC
CCCGCGGGCGCACCCACCTTCGGCACCAAGGTCAGCAGCTACCCGCCGTGCCCGCGCCCCGACCTCGTCAAGGGC
CTCCGCGCCCACACCGACGCCGGCGGCATCATCCTGCTCTTC
```

> SEQ ID NO:2066 216268 128550_300476_1b
```
AAAATACATAGAAAGATGGAGAGTTTCCCAGTGGTTAACATGGAGTTGCTTAACACTGAACAAAGGGCTGCAACA
ATGGAGAAAATTAAGAATGCTTGTGAGAACTGGGGCTTCTTTGAGGTGGTAAATCATGGGATCTGTCATGAGCTT
CTGGACACAGTGGAGAAGTTGACAAAGGGACACTACAAGAAGTGTATGGAACAAAGGTTTAAGGAAATGGTTGCA
AGTAAAGGGCTTGAAGCTGTTGAGACTGAAATAAAGGATTTGGATTGGGAAAGTACTTTCTTCTTGAAACACCTT
CCTGTTTCAAATATCTCAGAAGTTCCTGATCTTGAAGATGAATACAGGAATGTAGGGAAAATCATGAAGGAGTTT
GCTGAAAAGCTAGAGAAATTAGCTGAGCAACTTTTGGACTTGCTCTGTGAAAATCTAGGACTGGAGCAAGGTTAC
CTGAAGAAAGCCTTTTATGGTTCAAATGGTCCTACTTTTGGCACCAAAGTTAGCAACTATCCACCATGTCCCAAG
CCTGATTTGATTAAAGGCCTTAGGGCTCACACCGATGCTGGTGGAATCATCCTTCTATTCCAAGATGACAAAGTC
AGTGGTCTCCAACTGCTCAAAGACGACAAATGGATCGACGTTCCACCAATGCGCCACTCCATCGTCATCAACCTC
GGAGACCAACTTGAGGTGATTACTAATGGAAAGTACAAGAGTGTGGAGCATAGGGTGATTGCTCAGCCTGATGGA
AACAGAATGTCCCTAGCTTCGTTCTATAACCCGGGGAGTGATGCTGTCATCTATCCAGCACCAGAATTGTTGGAG
AAAGAGAACAAAGTCATTTATCCTAAGTTTGTATTTGAGGACTATATGAAATTATATGCAGGTCTTAAGTTCCAG
```

Figure 2 continued

GCTAAAGAGCCAAGGTTTGAAGCAATGAAGGCTGTGGAAACTACTGTCAACTCTGCCCCAATAGCTACTGTTTGA
GACTTTGATGGAGTATTAATTAGAAAACTGATTAATGAGAAGAAAATGGCTTAGTATTAAGATTATGATGATGTA
TTGATGAT

> SEQ ID NO:2067 216268 56232_300126_1b
AACAAAAGTTCAATGACATGCTCAAGTCCAAAGGTTTGGATAATCTTGAGACAGAAGTCGAAGATGTGGATTGGG
AAAGCACTTTCTACGTTCGTCACCTCCCTCAATCCAATCTCAATGACATTTCAGATGTGTCTGATGAATACAGGA
CGGCCATGAAAGACTTTGGTAAGAGACTGGAGAATCTTGCTGAGGATTTGTTGGATCTACTGTGTGAGAATCTAG
GGTTAGAGAAAGGGTATTTGAAGAAA

> SEQ ID NO:2068 216277 136763_301608_1b
AGCAATTATACATTAAAATCACCTCATCACCTGCGGATACTATTATGCATATTAATTACTCGACCGGCAACAGCC
ATCCCAGCATCCTCTTTTGGTAAAGTAGTGGCCTTCACATGCAAACATCGGCTATCGCAACTAACACCCCCTTCC
CCTGTCC

> SEQ ID NO:2069 216408 1109927_301526_1b
ATTCTCTTGGAGGCAAAGGAGAGAGAGAGAGAGAGAGAGAGAGGTTGCAGGTTCCGGTAGCAAGGAAGGCGCA
ACCATGGTGGCAGCAAAGAAGACGAAAAAGGCTCAAGAGAGCATCAACAACAGGTTAGCCCTGGTCATGAAGAGT
GGCAAATTCACTCTTGGATACAAGACTGCCTTGAAATCTCTCCGTGGTGGCAAAGCAAAACTTGTCATCATCTCG
AACAACTGCCCCCCACTAAGGAAGTCTGAAATTGAGTACTACGCTATGCTCTCCAAGACAGGGGTGCATCAGTAC
AGTGGAAACAATGTGGACTTAGGCACAGCCTGCGGGAAGTACTATCGCGTCAGCTGTCTTAGTATCACAGACCCT
GGTGATTCTGACATCATCAGGACTGTGGAGTAGGGATGAGAGTTCAAACCAAGTTTAGTGTGGAAGTAGGACGTC
TTTTAATTCCTCTGAGCATGCAAGGGGGCCGAGTTTTGCCTCTTCACTGGAATTTATTGATTAGCCTGTTAACCT
CTGCTTAAAGAGAACTTGGCTATTTTGTAGATGGCTAAGTCTTGATTGATGATGAAATATGGTCATTGCGTTTTC
TTTTCC

> SEQ ID NO:2070 216408 1121540_301876_1b
GGAAAACCCTAGCAAGAAGAAGAAGAAGAATATTAGTTCCATCTCTTTGCCGGAAGTTCAACAGAGAAGGCAATC
ATGGTGGCCGCTAAGAAGACGAAAAAGGCCCAAGAGAGCATCAACAATAGGCTAGCCCTAGTCATGAAGAGTGGC
AAGTTCACTCTTGGATATAAGACCACATTAAAGTCTCTACGCGGTGGCAAAGGGAAGCTTATTATTATCTCCAAT
AACTGTCCCCCCTTAAGGAAATCAGAAATCGAGTACTATGCTATGCTCTCTAAAACTGGAGTTCATCAGTACAGT
GGAAACAATGTGGACTTAGGCACAGCCTGCGGGAAGTACTATCGGGTTAGCTGTCTTAGCATCACAGATCCCGGT
GATTCGGACATTATCAGAACTGTTGAATAGAGCTTAGAGAGGATTAAAGGCGGTAATGCTTATCATATTAGCTCA
TCTCGAGGGGCTTCTTTGGAAGACTTGCATGAATTTCCCTAGTTTTCTTTTCTTGCTTTATTGGATCAGAGAAA
CCAATTAATATATATGGCTAAATTAAACATGGAAAATTAAATTTGTAGTAGCCGACTGTTTT

> SEQ ID NO:2071 216408 138763_300727_1b
CCGACCTCGCAGTCGCCACCCCGAGCAGAAGCCGCCGCCGCCGCCCGAAACCCTCGCCGCCGTCGCTTCTCCTCG
GGGCGCAGCCATGGTGGCCGCAAAGAAGACGAATAAGTCCACGGACAACATCAACAACAAGCTGCAGCTCGTGAT
GAAGAGCGGCAAGTACACGCTCGGCTACAAGACCGTCCTCAGGACCCTCAGGAACTCCAAGGCGAAGCTAGTGAT
CATTTCTAACAACTGCCCACCTCTTCGGAAGTCAGAAATTGAGTACTACGCTATGTTGGCCAAGGTCACCGTCCA
CCATTTCCACGGAAATAATGTCGATCTGGGGACAGCCTGTGGTAAATACTTCCGTGTTTGCTGCCTCAGCATTAT
TGATCCTGGTGACTCGGATATCATCAAGACCACGGGTGAGCAGTAAGGATGAGCGGTTCCGCTGGCGCTTCAGAT
GCTGTCACACTGAGCTGTTCTAGACATTGTAGTTGTTGCTGGACTTGATTTGGTCTCTCTCGTGTATCGAACAGC
TTTTACCAGTCAACCAAAGTTTCGTGGGAACATTGTTCTTGGATTGGAAAATTTTGTTCCTGGCCCGAATCATGT
TTTCAATTAAAACGCTTGGCTGTTTGTTCACTGAACTTCGCATCATTA

> SEQ ID NO:2072 216408 57491_300120_1b
GCCATTACGGCCGGGGATATAACTAACATTAGAAACCTCGGCCACTTCCCTTTCCCCGTTGTTTCAGAGTGTTTT
TATCAACAAAAATGGCGACAACAGGGAAGAAAACGAAGAAGACCCATGAGAGCATCAATAACAGGTTAGCTCTGG
TAATGAAGAGTGGCAAGTACTCTCTCGGTTACAAGACCGTTCTGAAGACCCTCAGGAGCTCTAAAGGGAAGTTGA
TATTGATATCTAACAACTGCCCACCATTGAGAAAGTCAGAGATTGAGTACTATGCTATGCTTGCTAAAGTTGGTG
TTCACCATTTCAATGGAAACAATGTTGATCTTGGAACAGCATGTGGGAAGTATTTCCGTGTTTCATGCCTCAGCA
TCATTGACCCAGGTGATTCGGACATCATCAAGTCTCTACCTGGTGATCACTAAGAGATATTCACCAGGGTTTTGC
TAAACCATTTTAGTGAGTTGAGAAAATCTGTACTATCTTTTTATTCTTGTATTTCAGAGTTATACCAAGATTATA
GAGGATGTTGGTATTATCTAGTTTTGTTGGTTTTATCATTTCTCCAGAAGTTTTGAGGTCAGGTACATTATGATT
TTATTCACAGATCAATTTCCCTATACCATTTTGCTTTTCTAAATGAGTTCACTAGATTTTCTTGTTGTTAAAGGA
AAAAA

Figure 2 continued

> SEQ ID NO:2073 216408 256592_301673_1b
GGCGACGAAGAGAGAGGAGAGATCCAAGATGGTGGTCGCCGGGAAGAAGCAGAAGAAGACCCAGGAGAGCATCAA
CAACAGGTTGGCGCTGGTGATGAAGAGCGGCAAGTTCACTCTGGGCTACAAGACGGTGCTCAAATCGCTGCGGAG
TGGGAAAGGCAAGCTCGTTCTCATCTCCAACAATTGCCCGCCGCTCCGCAAGTCGGAGATCGAGTACTACGCGAT
GCTCTCCAAAACCAACGTCCACCATTACAGTGGAAACAATGTGGAGCTTGGTACCGCTTGCGGCAAGTACTATCG
GGTCTCTTGCCTTACCATCACAGATCCAGGCGATTCGGATATCATCAAATCCATGTCCGCCGAGTGAAAATCCAT
CCATCGATCAGCGCTCCTCTGTTTTGTTTCGCTGTTCAACTTCTTGTAGGCCTCTTACTCTAGAAATATGGAACT
TTAATGGAAAAACATTTCCTTCATAG

> SEQ ID NO:2074 216408 252893_301605_1b
GTTATGAGATTTGGAAAACCCTAGCAAGAAGAAGAAGAAGAATATTAGTTCCATCTCTTTGCCGGAAGTTCAACA
GAGAAGGCAATCATGGTGGCCGCTAAGAAGACGAAAAAGGCCCAAGAGAGCATCAACAATAGGCTAGCCCTAGTC
ATGAAGAGTGGCAAGTTCACTCTTGGATATAAGACCACATTAAAGTCTCTACGCGGTGGCAAAGGGAAGCTTATT
ATTATCTCCAATAACTGTCCCCCCTTAAGGAAATCAGAAATCGAGTACTATGCTATGCTCTCTAAAACTGGAGTT
CATCAGTACAGTGGAAACAATGTGGACTTAGGCACAGCCTGCGGGAAGTACTATCGGGTTAGCTGTCTTAGCATC
ACAGATCCCGGTGATTCGGACATTATCAGAACTGTTGAATAGAGCTTAGAGAGGATTAAAGGCGGTAATGCTTAT
CATATTAGCTCATCTCGAGGGGGCTTCTTTGGAAGACTTGCATGAATTTCCCTAGTTTTCTTTTCTTGCTTTATT
GGATCAGAGAAACCAATTAATATATATGGCTAAATTAAACATGGAAAATTAAATTTGTAGTAGCCGACTGTTTTG
CCGTGTCATTGGTGTTGCAAGTAAGGTTCTCGTTTTTGTGCCAAAAAAAAAAAACAA

> SEQ ID NO:2075 216408 223888_300976_1b
GCTGGCAACACCCCTGCTCTGCGAAAGTCCGAGATTGAGTACTACGCCATGCTCGCCAAGTGCACCGTCCACCAC
TTCCAGGGCGGCAACAACGAGCTCGGTACCTCTTGTGGTCGACTCTTCCGAGTTGGCGCCGTCACCATCATGGAT
GCCGGTGACTCCGACATTCTGACTGCTGAGCTTTCTTAAGCAGTTTGAAGACCCCCAAAATAAAAATTAATGTAC
TTTAGTGCCG

> SEQ ID NO:2076 216408 206031_300804_1b
GCTAATCGCAAGATCGCAGCTCGCGCCCAAAATCAGTCAAAATGGCCCCTCAGAAGAAGAGCAAGAAGGATGCCA
ACAGCATCAACTCCAAGTTGGCGCTTGTTATGAAGTCCGGAAAGGTCACTCTCGGCTACAAGTCTACTCTCAAGT
CTCTGCGATCCGGCAAGGCCAAGCTGATCATCATTGCTGGCAACACTCCTCCCCTGAGAAAGAGTGAACTCGAGT
ACTACAGCATGCTGTCCAAGGCTCCCATCCACCACTTCGCTGGTAACAACGTAAGTTTTGCAATCTCAGACGCCC
TGGACAAGTGAAGACCTGGAAACGGGTATATCTACTTGCGCCATTACACACTTCTCGCTTCTTTCAGAAGCTACT
CTTGCTACCCGAGAATTGCCAATTCTTGCGGAATTGCCCAGAGAAGAAGTCTTTCAGACTTTGGAGGGTTCACAT
TGGCTTACATTATTCGTAAAACAGATTGAGCTCGGCACTGCCTGCGGAAAGCTCTTCCGCTGCTCCACCCTTGCC
ATCCTGGATGCTGGTGACTCTGATATCCTCAGCGACCAGCAGGCTTAAATAGCCGAAATCTAGTGCATTCAAAAC
GGCGTTGGGGGTAAAACGGTTCAAGGGCAATATGGATACCATACACTTTCACATTATGTG

> SEQ ID NO:2077 216408 195754_300637_1b
CCCACGCGTCCGCCCCGAGCAGAAGCCGCCGGCGCCGCCCGAAACCCTCGCCGCCGTCGCTTCTCCTCGGGGCGC
AGCCATGGTGGCCGCAAAGAAGACGAAGAAGTCCACGGACAACATCAACAACAAGCTGCAGCTCGTGATGAAGAG
CGGCAAGTACACGCTCGGCTACAAGACCGTCCTCAGGACCCTCAGGAACTCCAAGGCGAAGCTAGTGATCATTTC
TAACAACTGCCCACCTCTTCGGAAGTCAGAAATTGAGTACTACGCTATGTTGGCCAAGGTCACCGTCCACCATTT
CCACGGAAATAATGTCGATCTGGGGACAGCCTGTGGTAAATACTTCCGTGTTTGCTGCCTCAGCATTATTGATCC
TGGTGACTCGGATATCATCAAGACCACGGGTGAGCAGTAAGGATGAGCGGTTCCGCTGGCGCTTCAGATGCTGTC
ACACTGAGCTGTTCTAGACATTGTAGTTGTTGCTGGACTTGATTTGGTCTCTCTCGTGTATCGAACAGCTTTTAC
CAGTCAACCAAAGTTTCGTGGGAACATTGTCC

> SEQ ID NO:2078 216408 188351_300698_1b
CCCCGGGACCTCGCAGTCGCCACCCCGAGCAGAAGCCGCCGCCGCCGCCCGAAACCCTCGCCGCCGTCGCTTCTC
CTCGGGGCGCAGCCATGGTGGCCGCAAAGAAGACGAAGAAGTCCACGGACAACATCAACAACAAGCTGCAGCTCG
TGATGAAGAGCGGCAAGTACACGCTCGGCTACAAGACCGTCCTCAGGACCCTCAGGAACTCCAAGGCGAAGCTAG
TGATCATTTCTAACAACTGCCCACCTCTTCGGAAGTCAGAAATTGAGTACTACGCTATGTTGGCCAAGGTCACCG
TCCACCACTTCCACGGAAATAATGTCGATCTGGGGACAGCCTGTGGTAAATACTTCCGTGTTTGCTGCCTCAGCA
TTATTGATCCTGGTGACTCGGATATCATCAAGACCACGGGTGAGCAGTAAGGATGAGCGGTTCCGCTGGCGCTTC
AGATGCTGTCACACTGAGCTGTTCTAGACATTGTAGTTGTTGCTGGACTTGATTTGGTCTCTCTCGTGTATCGAA
CAGCTTTTACCAGTCAACCAAAGTTTCGTGGGAACATTGTTCTTGGATTGGAAAATTTTGTTCCTGGAAAAAAAA
AAA

> SEQ ID NO:2079 219159 190483_300818_1b

Figure 2 continued

CCGGTGATGCAGACCTTGGTCCAGTGATCAGCAAACAGGCTAAGGAACGTATCTGCAAATTAATACAAAGTGGTG
CTGATAATGGTGCTCGTGTGCTGCTTGATGGAAGAGATATTGTGGTTCCTAACTTCGAGAATGGTAATTTTGTTG
GTCCAACACTCCTTGCTGATGTTAAAAGTGAAATGGAATGTTACAAGGAGGAGATTTTTGGTCCAGTTCTTCTCT
TGATGAAGGCTGAGAGCCTAGATGATGCTATCCAAATTGTGAACAGAAACAAATATGGCAATGGAGCATCCATAT
TTACAACATCTGGTGTGTCTGCAAGGAAATTTCAAACAGACATTGAAGCTGGCCAGGTGGGCATCAACGTGCCGA
TTCCAGTACCCCTGCCGTTCTTCTCCTTCACCGGCAGCAAAGCCTCCTTTGCAGGAGACTTGAATTTCTACGGCA
AGGCGGGCGTGCAGTTCTTCACCCAGATCAAGACGGTCACGCAGCAGTGGAAGGAGTCGCCGGCTCAGCGCGTCT
CCCTCTCCATGCCCACCTCGCAGAAGTGAGGTGAAAAAAAAGAAAGGCATCTTGTACGTTCTTCATTTGCCCATC
CATGGAAATAGACACATGCACCAATGCGAAATGAACAGAAGAATAATCGATAGGCGCGGGATGCCATGCCATGCC
AATAAAGGTAGCTGGTCTCGT

> SEQ ID NO:2080 219218 199449_300749_1b
TTTCCTACCAATTCATCCCTCCATATAATAAAAACCATGTGTGGTACAGACGCCCCCGACGCCGCCGCTGGTCCC
GTGTCCAACGGGTCGCATGCCAGCAAGGCCAACCCAGCCAGCTCTCCGTATCAGAACGTCAACGACTTCATCTCC
AATGTCGCCCGATTCAAGATCATCGAGAGCACTCTTCGTGAGGGCGAGCAGTTTGCCAATGCCTTCTTTGACACT
GAAACCAAGATTAAGATCGCCAAAGCTCTTGACGAGTTTGGTGTCGACTACATAGAGCTCACAAGTCCTGTGTCT
TCTCCTCAGTCATATGAGGATTGTAAGACTATCTGCGGGCTTGGCCTGAAGGCCAAGATTCTCACTCACGTGCGA
TGCAACATGGAAGACGCCAAGAAGGCCGTCGAGTGTGGTGTTGACGGCGTCGACCTCGTCATTGGTACTTCCAGC
TTCCTACAAAAGTACAGCCACGGAAAGAGTATCGCTATCATCAAGGAGACTGCCCTGGAAGTGATTCAGTATGTC
AAGAGCCAGGGCGTAGAGGTCCGCTTCTCTTCAGAGGACTCGTTCCGAAGTGACCTCGTCGACCTCCTTACTCTC
TACAAGGCTGTCGATCAGGCTGGAGTT

> SEQ ID NO:2081 48411 104460_300410_1b
GCCATTACGGCCGGGGACACAAATTCACATTCAAGTCCTCACATTTCTCCTACTCTCTCTCATATTTCATTTCTC
TCTCTAGTGTTTCCACAATGGCACCAAAAGCCGAGAAGAAACCCGCCGAGAAGAAGCCAGCAGCTGAGAAGGCAC
CAGTAGCAGCAGCTGCAGCGGAGAAGAAGCCAAAGGCTGGGAAGAAGCTTCCCAAGGACGGCGCCGGAGCAGCTG
CAGGAGACAAGAAGAAGAAGAGGTTAAAGAAGTCTGTTGAAACTAACAAGATCTACATCTTCAAGGTGTTGAAAC
AGGTTCATCCTGATATTGGTATCTCTAGTAAGGCTATGGGGATCATGAACAGTTTTATTAATGACATTTTCGAGA
AGCTGGCTCAGGAATCTTCTAGATTGGCCCGTTACAACAAGAAGCCTACTATCACTTCTCGGGAGATTCAGACTG
CTGTGAGGCTTGTGCTTCCTGGTGAATTGGCTAAGCATGCTGTTTCTGAGGGTACCAAGGCTGTTACTAAATTTA
CTAGCTCTTAATCAATTTTAGAGTTTGTGTTTTGATTAGGGTTTGTAGATGTAAAGAATTGTCCAATTAGGGTTG
CATTTGACATTTGTGGCATGTAATGGACATCTATATTATGAATGAAGAGTTTTCTGTTTTCTCTGACAAAAAAGA
AACAAGAAAGAAAAAAAAAAACCATGTCGGCCGCCTTGGCC

> SEQ ID NO:2082 48411 126529_300464_1b
TTCAAGTCCTCACATTTCTCCTACTCTCTCTCATATTTCATTTCTCTCTCTAGTGTTTACACAATGGCACCAAAA
GCCGAGAAGAAACCCGCCGAGAAGAAGCCAGCAGCTGAGAAGGCACCAGTTGCAGCAGGTGCAGCGGAGAAGAAG
CCAAAGGCTGGGAAGAAGCTTCCCAAGGACGGTGCCGGAGCAGCTGCAGGAGACAAGAAGAAGAAGAGGTTAAAG
AAGTCTGTTGAAACTTACAAGATCTACATCTTCAAGGTGTTGAAACAGGTTCATCCTGATATTGGTATCTCTAGT
AAGGCTATGGGGATCATGAACAGTTTTATTAATGACATTTTCGAGAAGCTGGCTCAGGAATCTTCTAGATTGGCC
CGTTACAACAAGAAGCCTACTATCACTTCTCGGGAGATTCAGACTGCTGTGAGGCTTGTGCTTCCTGGTGAATTG
GCTAAGCATGCTGTTTCTGAGGGTACCAAGGCTGTTACTAAATTTACTAGCTCTTAATCAATTTTAGAGTTTGTG
TTTTGATTAGGGTTTGTAGATGTAAAGAATTGTCCAATTAGGGTTGCATTTGACATTTGTGGCATGTAATGGACA
TCTATATTATGAATGAAGAGTTTTCTGTTTTCTTTGTTAAATTTGCTTGGTTATG

> SEQ ID NO:2083 48435 116450_300068_1b
AGAAGCGTCAGGAGGAACTCAAGGAGAAGTTCGAGGGTCTGTGCAAGGTGATCAAGGAGGTGCTCGGTGACAAGG
TGGAGAAGGTTGTGGTCTCTGACCGTGTGGTTGACTCTCCCTGCTGTCTAGTCACTGGGGAGTATGGCTGGACTG
CTAACATGGAGAGGATCATGAAGGCCCAGGCTCTGAGGGACTCCAGCATGGCCGGCTACATGTCTAGCAAGAAGA
CCATGGAGATCAACCCGGAGAATGCCATCATGGACGAGCTCCGCAAGCGTGCCGATGCGGACAAGAATGACAAGT
CCGTGAAGGACCTGGTGATGCTGCTCTTCGAGACTGCCCTGCTGACCTCCGGTTTCAGCTTGGAGGACCCCAACA
CCTTCGGCACCAGGATCCACCGCATGCTCAAGCTCGGCCTGAGCATCGACGAGGACGAGTCCGCCGAGGCTGACG
CCGACATGCCTCCGCTGGAGGACGACGCCGGCGAGAGCAAGATGGAGGAGGTCGACTAAACGTCATGGACCCATG
GATGCCATTCTGTCCCTTCTAGTTATCCCTCTCCTAGTTCTCTTCTCATAGCTTTCTGACTGCTGCTGTTCGCTT
TCTTTTTGGTACGTTGGATGCATCAGTTTTGTCTTTGTCTTAGCTCTTAAACAATGCGTGGTACCTTGTCATACT
GTTTGCGTTGCAATGCTACT

> SEQ ID NO:2084 48435 142840_300444_1b
CGGACGCGTGGGGGAATTTGAGGGTAAGAAGCTTGTTTCTGCTGCCAAGGAAGGTCTCAAACTTGATGAAAGTGA

Figure 2 continued

GGATGAGAAGAAAAAGAAGGAAGAATTGAAGGAGAAATTTGAGGGCCTGTGCAAGGTGATTAAGGATGTACTTGG
TGACAAGGTGGAGAAGGTTGTCGTTTCAGACCGTGTTGTTGACTCTCCCTGCTGTTTGGTTACTGGTGAGTATGG
CTGGACTGCAAACATGGAGAGAATCATGAAAGCACAAGCACTTCGGGATTCTAGCATGGCTGGATACATGTCTAG
CAAGAAGACCATGGAGATAAACCCAGACAATGCCATCATGGATGAGCTTAGGAAGAGGGCTGATGCGGACAAGAA
TGACAAGTCTGTCAAGGATTTGGTCCTGTTGCTGTTCGAGACTGCTCTTCTCACCTCGGGTTTCAGCCTCGATGA
TCCCAACACCTTCGGTAACAGAATTCACAGGATGCTGAAACTTGGTCTCAGCATTGATGAGGAGTCCGGGGATGC
AGATGTTGACATGCCAGCACTTGAGGATCCTGAAGCTGATGCTGAGGGAAGCAAGATGGAAGAAGTTGATTAAGT
TTTTAGTCTGTAGAAGTTCATTTGATATTTTGTTATCACAAAAGTTCCATTCTCTTTTACCCTACGCATAAGGGG
CCGTTTTTGACATTAGTAGTTCCAATTCAATCG

> SEQ ID NO:2085 48435 57326_300056_1b
TGCTGAACTGCTGAGGTACCACTCCACAAAGAGTGGTGAGAGATGACCAGCTTGAAGGACTATGTCACAAGGATG
AAAGAAGGCCAGAATGATATTTACTACATTACTGGTGAGAGCAAGAAGGCTGTTGAGAACTCACCCTTCCTTGAG
AAGCTGAAGAAGAAGGGCTATGAGGTTCTTTACATGGTTGATGCTATTGATGAGTACTCAGTTGGTCAATTGAAG
GAATTTGAGGGTAAGAAACTTGTTTCTGCTACCAAGGAAGGGCTCAAGCTTGATGAGAGTGAAGATGAGAAGAAA
AAGCACGAAGAACTAAAGGAAAAGTTTGAAGGTCTGTGCAAGGTGATTAAGGATGTTCTAGGTGACAAGGTTGAG
AAGGTGGTCGTCTCTGACCGTGTTGTGGATTCTCCTTGCTGCTTGGTTACCGGAGAGTATGGCTGGACTGCCAAC
ATGGAGAGAATTATGAAGGCACAGGCTCTGAGGGACTCTAGCATGGCTGGATACATGTCTAGCAAGAAGACTATG
GAGATCAACCCTGAGAATGCCATCATGGAAGAGCTCAGGAAGAGAGCTGATGCTGACAAGAACGATAAGTCTGTC
AAGGATTTGGTTCTATTGCTGTTTGAGACTGCTCTTCTCACC

> SEQ ID NO:2086 48435 201214_300714_1b
AGAGTGGCTCAGCTTTGTCAAGGGCATTGTTGATTCTGAAGACCTTCCCCTCAACATCTCACGTGAGATGCTCCA
GCAGAACAAGATCCTGAAGGTGATCCGCAAGAACCTTGTGAAGAAGTGCGTGGAGCTCTTCTTTGAGATCGCTGA
GAACAAGGAAGACTACAACAAGTTCTACGAGGCCTTCTCCAAGAATCTCAAGCTTGGCATCCATGAGGACTCCAC
CAACAGGACCAAGATTGCTGAGCTCCTGAGGTATCACTCCACCAAGAGTGGTGATGAGTTGACCAGCCTCAAGGA
CTACGTAACCCGGATGAAGGAGGGCCAGAGTGAGATCTATTACATCACTGGTGAGAGCAAGAAGGCTGTTGAGAA
CTCCCCCCTTCCTTGAGAAGCTGAAGAAGAAGGGATATGAGGTCCTGTACATGGTTGATGCCATTGATGAGTACGC
TGTTGGTCAGCTTAAGGAGTTTGAGGGCAAGAAGCTCGTCTCTGCCACCAAGGAAGGTCTGAAGCTTGATGAGAG
TGAGGACGAGAAGAAGCGGCAGGAGGAACTCAAGGAGAAGTTCGAGGGTCTGTGCAAGGTGATCAAGGAGGTGCT
CGGTGACAAGGTGGAGAAGGTTGTTGTCTCTGACCGTGTGGTGGACTCTCCCTGCTGTCTAGTCACTGGGGAGTA
TGGCTGGACTGCTAACATGGAGAGGATCATGAAGGCCCAGGCTCTGAGGGACTCCAGCATGGCCGGCTACATGTC
GAGCAAGAAGACCATGGAGATCAACCCGGAGAATTCCATCATGGACGAGCTCCGCAAGCGTGCCGATGCTGACAA
GAACGACAAGTCTGTGAAGGACCTGGTGATGCTGCTCTTCGAGACTGCCCTCCTGACCTCCGGCTTCAGCCTTGA
GGACCCCAACACCTTCGGCACCAGGATCCACCGGATGCTCAAGCTCGGCCTGAGCATCGACGAGGACGAGTCTGC
TGAGGCTGACGCCGACATGCCGCCGCTGGAGGACGACGCCGGCGAGAGCAAGATGGAGGAGGTCGACTAAGCGCC
ATGGTTGTCATTCGGCCCCATCTCCTGGAGCCCTAGTTCTCTATAGCTTTATCTGACTCTGTGCTCTTCGCCAT
TTTTGCTATGCTGGATGTATCGGTA

> SEQ ID NO:2087 48435 143586_200010_1b
GAGGCCTTCTAAAGAACCTCAAGCTTGGCATCCATGAGGATTCCCAAAACAGGTCTAACTTTGCTGAACTGCTGC
GGTACCATTCCACCAAGAGCGGTGATGAGATGACCAGTTTGAAGGACTATGTGACCAGAATGAAGGAAGGCCAGA
ATGATATTTACTACATTACCGGTGAGAGCAAGAAGGCCGTTGAGAACTCGCCCTTCCTTGAGAAACTGAAGAAGA
AGGGTTATGAGGTTCTTTACATGGTTGATGCCATTGATGAGTATTCAATTGGTCAGCTGAAGGAATTTGAGGGCA
AAAAGCTTGTTTCTGCTACCAAGGAAGGTCTCAAGCTTGATGAGAGTGAAGATGAGAAGAAAAAGCAGGAAGAAT
TGAAAGAGAAGTTTGAGGGACTATGCAAGGTCATCAAGGATGTTCTAGGAGACAAGGTAGAGAAGGTTGTTGTCT
CTGACCGTGTTGTGGACTCTCCCTGCTGCTTGGTCACTGGGGAGTATGGCTGGACTGCTAATATGGAAAGAATCA
TGAAGGCACAAGCACTTAGGGACTCTAGCATGGCTGGATACATGTCTAGCAAGAAGACCATGGAGATCAACCCAG
AGAATGCTATTATGGAAGAGCTGAGGAAAAGGGCTGATGCAGACAAGAATGACAAGTCTGTGAAGGACTTGGTTC
TCTTGCTGTTTGAGACTGCCCTCCTCACCTCGGGTTTCAGCCTTGAGGAACCTAACACCTTTGGCAACAGAATTC
ACAGGATGCTGAAGCTTGGGCTGAGCATTGATGAGGATTCGGAGATGCAGATGCTGACATGCCGGCTTTGGAGG
ATCCTGAAGCTGATGCTGAGGGTAGCAAGATGGAGGAGGTTGACTAAGTGCATAGTAGCTTGGCTGATGTTCTAT
GGTTCCCCTAGTATTTCCCTATTTTTTGTTTTACCCCATCAACGAACAGTATGTATTACTTCTTTGTGCCATTTT
TTGAGAATGGCAGTTCAATGTAGGGTATAAATTTATTGG

> SEQ ID NO:2088 48443 1107215_301505_1b
AAGAGAGAGAGAGAGAGAGAGAGCTCATATTGGTTAGGGAAAAGGGAGAAGGAAGAAGAGAGAGAATGGCGAGTA
TGGTGGCATCTAGTGCATTGAGGACCCCTGTGGTCGGCTTGGGGGATTCGAACCTCCGACTCAGACGGAGCAACC
CCACCCCTCTCCGCTCATCTTTCCTCCGACCTGTCGCAAGAACTGTTAACCCATTGGGTTCGCATGGCAATGCTC

Figure 2 continued

```
GGGTCACCTGCTTTAACCGAGATTGGCTCCGGAAGGATCTGTCCGTGATCGGATTTGGCCTCATCGGGTGGCTAG
CGCCTTCTAGTATCCCAGCCATCAATGGCGACAGCCTTTCAGGGCTCTTCTTTAGCAGCATAGGGACAGAGCTAG
CCCACTTCCCGACCGGGCCCGCCCTTACGTCCCCTTTCTGGTTATGGCTGGTCACATGGCATTTTGGTTTATTTG
TTGTTCTAACTTTCGGACAAATCGGATTCAAGGGAAGGAAGGACGCGTACTGGTAATAATAATAATAAATCCTTT
GCGCGATCATTGTCAGATGCTCGGCTTAGAAGCTAGAAAAAGAATCTGTAACTCAATGTAGCTTTCCCTTCTGTT
GTTGGCTATTGTTTGATTACACTATCCTTTGATAGCTGCGAGGGATGATGTCTTCTTTTATGTAATCCTGCACTT
AAAATTTGAGTTTTTTTCCT
```

> SEQ ID NO:2089  48443  57835_300037_1b
```
TTCACCTCTTCATACACCAAAATCCAAGTTCAAAATCAAGTCAAGAAAACAAAGCAAAAAAAGGGAAGAAAATTA
AGAAAGATGGCAGCAAGAATGGCTTCTACATCAACTGTTGTAGGTTTGGTCAGTTCCTCTCTTTCTTCCCCAAAA
AAGACATCCCTCAACTCAGGCTTCTTAAAATCACCAGTGACAGCAAGAAACCCTCTAAGGATCGCCCAAGCTTCA
GGAGGCAAATTTACATGCTTTGAGAGAGATTGGCTGAGGAGAGATTTGAATGTGATTGGATTTGGTTTAATTGGA
TGGCTGGCACCTTCAAGCATTCCAGCAATTAATGGCAAAAGTTTAAGTGGTCTCTTTTTTGAGAGTATTGGCACT
GAGCTCTCTCATTTCCCTACTGGCCCTGGTGTCACTTCTCAATTCTGGCTATGGATGGTCTGTTGGCACCTGGGC
TTGTTCCTCTGCCTCACTTTTGGGCAAATTGGATTCAAAGGAAGGACTGAGAAATATTTTAAATGGAATTTTTT
CTGATAATTTGTGTATAATGAAGAATCTTTTAATGTCTTAACTCTCCTTTCTCAATCTTCAGAATATAATAGGAG
ACAAACCCCTTCTACTTTTTAATACTTAAAG
```

> SEQ ID NO:2090  48443  116720_300514_1b
```
CTCGCCGACCAGGGACAGAGAGAGACCATCTGCTAGCTTAGCTGCCATGGCCGCCTCCACCGTCTCCGGCCTCGC
CGGCGCCACCCTCGCCCGCCGGCCGGCCTTCTCCACCGGCTTCACGACGGGCGCCCGGGTGTCGGCGAGGAACCC
GCTGATGACGAGGAACCTGGAGAGGAACGGCAGGATCACCTGCATGACGTTTCCGCGGGACTGGCTTAGGAGGGA
CCTGAACGTGATCGGGTTCGGGCTGATCGGGTGGATCGCGCCGTCGAGCGTCCCGGCGATCAACGGCAACAGCCT
CACGGGGCTCTTCTTCTCCAGCATCGGCCAGGAGCTCTCCCACTTCCCCTCGCCGCCGGCGCTCGACTCGCCGTT
CTGGCTGTGGTTGGTGACGTGGCACCTTGGGCTGTTCCTGGCGCTCACCTTCGGCCAGATCGGGTTCAAGGGCAG
GACCGAGGGCTACTTCGACAAGTGAATGAATCCATAGTGGCTTTTGGTTAGCTTGACTGTACGGACGGATGTGTG
CGCTGCATATCCTTCCTTTTGTATAGGGCTCTGATTTGATCCTCTTGCGGATGTACGCTGTTGTAATTCTCCTCA
ACTCCTTAAAACTTTAAAGGACAAATATATGTG
```

> SEQ ID NO:2091  48443  118060_300063_1b
```
CTTTTATTGCTCCAAGTAAAACAATGTCATATGTTATACTTGGAGCAACAAATGGGAAATAAGTTATGCAGGCGA
ACAGCCGATGCAGTATAATAACACAATGATATATGTTATTATGACAGTAAAGTCGAAGGTATTTCTGACGCTCAT
AGCATGCTGAAATGAAGGGAAAATACCAATATTAAGGAACTGAAAAAGTATTAAGAGAAGCAAAAATGGCAGCAA
CAATGTCCACTGTTGTAGGCTTAGTTACTTCATCTCTTTCTTCTCCAAAGAAGGCTTGCCTCAGCTCAGGCTTCT
TGAAATCACCAGTGACAGCAAGAAACCCTTTAAGGGTAGCACAAGCTTCAGGAGGCAAATTTACATGTAATTTTC
AAAGAGATTGGCTGAGGAGAGACTTGAATGTGATTGGATTTGGTTTGATTGGATGGCTGGCTCCTTCTAGCATTC
CAGTAATCAATGGCAAGAGTTTGAGTGGGCTTTTCTTTGATAGCATTGGCACTGAACTCTCTCATTTCCCCACTG
GACCTGCTCTCACTTCTCAGTTCTGGCTATGGTTGGTGTGCTGGCACTTGGGCTTGTTCATCTGCCTAACTTTTG
GACAAATTGGATTCAAGGGACGGACTGAGGACTATTTCTCAAAGTAAAATATTCCCTTCTGAAAATTTGTGTATA
AATAAGAAATACGCTATTTCAGTTCCTTAATATTGGTATTTTCCCTTCATTTCAGCATGTTATGAGCGTCAGAAA
TCCCTTCTACTTTAATGTCATAATAACATATGACATTGTGTTATTAAACTGCATCGGCTGTCCGCCTGCATAACT
TATTTTCCTTTTATTGCTCCAAGTATAACATATGACA
```

> SEQ ID NO:2092  48443  227263_301009_1b
```
CCCGACGGAGACAACACACGCAGCTCGCCGACCAGAGACAGAGAGAGACCATCTGCTAGCTTAGCTGCCATGGCC
GCCTCCACCGTCTCCGGCCTCGCCGGCGCCACCCTCGCCCGCCGGCCGGCCTTCTCCACCGGCTTCACGACGGGC
GCCCGGGTGTCGGCGAGGAACCCGCTGCTGACGAGGAACCTGGAGAGGAACGGCAGGATCACCTGCATGACGTTT
CCGCAGGACTGGCTTAGGAGGGACCTGAACGTGATCGGGTTCGGGCTGATCGGGTGGATCGCGCCGTCGAGCGTC
CCGGCGATCAACGGCAACAGCCTCACGGGGCTCTTCTTCTCCAGCATCGGCCAGGAGCTCTCCCACTTCCCCTCG
CCGCCGGCGCTCGACTCGCCGTTCTGGCTGTGGTTGGTGACGTGGCACCTTGGGCTGTTCCTGGCGCTCACCTTC
GGCCAGATCGGGTTCAAGGGCAGGACCGAGGGCTACTTCGACAAGTGAATGAATCCACAGTGGCTTTTGGTTAGC
TTGACTGTACGGACGGATGTGTGCGCTGCATATCCTTCCTTTTGTATAGGGCTCTGATTTGATCCTCTTGCGGAT
GTACGCTGTTGTAATTCTCCTCAACTCCTTAAAACTTTAAAGGACAAATATATGTGTTGTGGCTAA
```

> SEQ ID NO:2093  57821  243372_301338_1b
```
AAGCATCGGCTATGGCGGGCGGGTTTAAGGCGCTGGCGATGTGGATCAGGTATTTCCTCGTCAAGCTCGCGCAT
TCGGTGGCCACTGCTGCCAAGAGCTATGACAAGGGACAGATCAGTGAGAAGCAGCTAGGCGATAGAATCTGGAAG
AATTTGTTCCAAGGGCGGCTTACATTCTTCCACCATGTCAAGGGAGAGCAAATGGCGCCCACATTCAAGAGCCAG
```

Figure 2 continued

GGAGAGACTCTACTCGTGAGATCGGTACCTCTTCCATCTCCTAGGTGTATTTTTATCGGTGATGTTGTGGTCTTT
AAAGATCCGCAGGACACTGCAGAGAGTTTAGTACGTAGGGTGGCGGCTCTGGAAGGTGACGAGCTTGTATCCACC
GATGAGAAGGACGAGCCTTTCTTTCTCGAGGAAGGCCAGTGCTGGGTGGTCGCGGATAACGAGTCTTTAAGTCCA
AAGGAAGCGAATGATAGTAGAAGTTTCGGACCATTGCCCATGAAGAACATCTTTGGACGGGCAATCTACTGCAGT
CACTCGGCTGTGGATCACGGTCACGTACTTAATAGTTCCGAGGCTATGCACAAAGATACTCCTGTTGTTGCCGTG
GAGCTGGATTT

> SEQ ID NO:2094 216187FL 208071_300831_1e
ATTTATCGAGTTTCACAGGGCTTACAACTCCTGTCCGGGGGGATTGGCAGATCTTGACAACTGAGGAGGACCGGA
TGCCGTGACGTGTAGCTGCTAGGATGAATCTTGGATTGGAGATTTGCCAGTCGATTTGGATGGTGCCTTTCGGGA
TGGAGGGGTGGAGGGTGGAGAGATATGACTAGTGTGGAGGTATCACAGCGTCGGGGGGCTGTGGAGAGTTCAGGG
TAAGCCATTTGCGGCTTTCACGCTCAGTAACACTCGGGGGTTTAAAACTGACTGATGGCCCATCTATACCTTGCA
GAAMRAATTTAGGTCCTCGCAAGACTCTCCCTAGAGCCGCGTCCCGTCACTACTGCTGCTTTGGCATCAAATAGT
GCTCAATGGCTAGGCCGAGGGATTTGAAGACGATAGCAATGTAACCCATACGATCTGACTGAACGA

> SEQ ID NO:2095 DR-VX 213184_300847_1e
TGAAGATTTGCTTTGTTTTCTAAGTTCAKGGGGTGCAATTGAGTCTTCTAAAGCGTGCTGGTGCAACATTCAAGC
TGACGTTGGATAAACCTTCAACCGTAACTCTTGTACCTCTCAAGACATCAGAATCAGATGATGGATGGATTGATG
AACTGACCTGCATCTGCCCACTCAACAATTTAATCCAGTCGAGCTTCTACAACGCCAATCTCAAAGCTCACAACT
CTGTATTCACTCATCTTGACCAATTCTCTTTCAGTTTGACCTCAATCACTCTTTCCCTCATGAAGACCGACGACG
CAGTGTCACAAACCAAAAAAATAAAAAAAAATGCTC

> SEQ ID NO:2096 212363FL 208329_300959_1c
GCGCTTGCGCACATTGCATTGCTGTTCAGAATGGCTCTACTACCTGTGTCATTGCTGCTTGTGGCGTATCTGTCG
CCAT

> SEQ ID NO:2097 212454FL 195581_300635_1c
ATCTAGATACCCTCCCCTTCTTCTTCTCTTCTTTCCCCCCCTTCACATTTGTGTCTTGACGTCGTATTTCGCTTC
AGCGTCATCCCCCATCACACATACACACATAGCAACTTGCCGACGTCATGGCTGAGCAACTGAGATACGACGGCC
AGGTCGTGGTCATCACCGGAGCTGGCGGTGGTCTGGGCAAGGCCTATGCCACTTTCTTCGGCTCTCGAGGCGCCA
GCGTGGTCGTCAACGACCTGGGCGGCACGTTCAAGGGCGAGGGAAACTCTACAAAGGCTGCTGATGTCGTCGTCG
ACGAGATCAAAAAGGCCGGCGGCAAGGCCGTTGCCAACTACGACAGCGTCGAGTTCGGCGAGCGCATCATCGAGA
CCGCCATCAAGGCCTTTGGCCGCATCGACATCCTCATCAACAATGCCGGCATCCTGCGCGACATTGCCTTCAAGA
ACCTCAAGGACGAGGACTGGGACCTCATCATGAAGGTCCACGTCACGGGCGCCTACAAGTGCTCCCGCGCCGCCT
GGCCCTCACTTCCGCAAGCAAAAGTACGGCCGAGTCATCAACACCGCCTCGGCCGCCGGTCTGTTTGGCAGCTTTG
GCCAGACCAACTACTCTGCTGCCAAGCTCGCCATGGTTGGCTTCAACGAGACACTGGCC

> SEQ ID NO:2098 212492FL 212448_300849_1c
GTTTCGGAGGCTGATTGAGTCGGAGGGGCTGCCTTATTGCGGCAGAGGAATAGTGACGTCATGACTATCAAGGAC
CCTGGAGGTTACCTAAAAGAAAAGCATCTGGACGAGGTGACGTAGCCATCAATGCGATCGATTGTTTGCTCTATC
TCCTCGGGTCGGCTGTTGATTTAGTATTAAACTAATGGATATGAATAGTGTTAGAGTGTGCGAATGGATCTCATT
GTTTGAATTGATGAATCTCGGAAGATCTGAGCTAGCTGCAAGATGCCTCAAGCCATGCGCAAGGCACGTGTGGAT
GGAGGCAAGATTGGATGGAGATTTACTGTAAATCTTCCAACTTTAACTATAGAAGGGAAAGGGGGAAAGAGGCGA
TCGCTATACCGCTGGTTGGATTCAGCTCCAGGGACAGATTTCATCAAAACAAGCGATGAACTGTGTGGTGACATA
TATATACGAGTACGGGTTTGATCATAATTCGC

> SEQ ID NO:2099 213120FL 220480_300955_1c
GGTTTGGCTTGCAGTAAGACCGGCTTATGAGAAAGACCATTGTGAGAGATGTAAGGCTGATCCGGAGCTCTACGT
CATCTGAGACATGACATTGGCATGATGAGGGTCCAGTAACTACCTGATGATTGGGGTAATCGAAAGAGATGCAGA
GAGAAACACGCAACTCTGAGAAAGCGTCCCGTTACACACGGAACACACTGCCTCCGGACAGCGGCTTGTGGCTCA
TTGCTTGAGTCCCTTAATCAGCAATCCCCAGGTTCTCTTGACAGCTCAGCGGTGCAGTTTTGCGGGCACAGCTGA
TCCACCCGTCAACGGGGCGGGACGCCGGGAAGCCGGGACTCCGGGGCTAAATGACATCGCCATGACATCCGCAC
CGTCCGACCAGAACTGCTACTACTCAAGACGGTAAGCAAGTGCTAGCAAAAGTGAGTTTTACGAGGTAAGCAAGT
AGGAACGTGGCTTATAAAGCCACAGCTAGCTTGAGGCGAAGGCTGCTAGTAGGAACTAAAGTCAGCTTATACTAT
TTATAAGCTCACTGCATGGGCTAGTAATAATAGCTC

> SEQ ID NO:2100 213827FL 199626_300751_1c
AAACGAAGTACTGTAATCGTACGTACTCAATTGACGGGCTTTCGACCCCTGTTTTGCATCTGCGGTCGAATAAAC
ACCGACTGCATCTCCATCAGATTGCGCTTGGCGGCCGGGTCTACTGTTGCAGTTGATGCCGCCCAACTCTGGCAA

Figure 2 continued

AACCTGGCGCTGCGGCTGCGGCTGGAGACCGGGGGAGCGATTCTGGCTGCCCAAACGAGAACCGGGGGGGATGTC
AATGCACAGTTGCATCGAAATTTGGCGATTAATTTTTTTACGAGGGAGGATTAGGATTAGGACTTTGCACGGTAG
G

> SEQ ID NO:2101 213882FL 213839_300861_1c
ATGTGGCCACGGGAATGACGCAAAAGGCGCCGAGAGCGGAAATGGAGAGAAAAAAAACCCAATTGCACCTCGTGA
TGATGCCACTCAAATGTCTGTGGTCGAGCCACTGGCTTCTACCTACGCTTACATTACCTAACAAGGAACGAAACA
TTTTGCGGCAAGGAGAATTGGATCATTGACTTGGCGAATGGGCTAATGAATGTCGTCAATTGCAGGCCTCGTGGT
TTGGCG

> SEQ ID NO:2102 214267FL 205829_300802_1c
TGAGTGCAGTGTAAGACAACATGGAAGACATGTATGTCAGCAATACGGATGTTTCCATACAGTCAAAGCGTTGCA
TCAACCCCGGCATGTCAGGAAGATGCTCTGGATACTAAGCGGGAAAATCTTCCGGATGCTGACCTGGCTGCTTCC
AATTGCCCTGTTGTCGATTCTTAATTTGCGCAGGCGATCAGGCCACATGCCACATGCAAGTCCGAGTGCAGGTCC
AAGCCGAGCCGCAGAGGAGACAATGGGTCCAAATGCAAATGCATACAGGTAGTACTGCCTACGTGCGCTGCTACA
GTACCGCTGGCTGTTCATTTCGTCTTCAGGGACAAAGGGGGATGGATGTACACCGATAGATCGGCCTAGTCGAAT
GTTACTTGGTCCATTCGTTCCTTCTAAGCCATATTAGGCATCCAAGATGCTCGGTACTCGCATGGCCATGTACGG
TCTCACGGCTCACCGCTAGGCCTTTTTTGAATGTCGTTACTTCGTTACGATTATTGGGACAGATGGCGTAGAGCT
ACCAGTGCTAGTGGTGTAATCGACAAAGTTCGCTCCTG

> SEQ ID NO:2103 214411FL 216318_300868_1c
GTGGATAGCGGATGGATACTTGCAGTAATATGGGGTAAGTGAGTGAGTGAGTGAGTGATATGGATACAGCGGGAT
GATGATGATGGTGGTGGTGGTGTTGTCACTGATGTTGTCGAGTGAGTTGTTTGTTTTGTTTACCTTTGGAAT
TGATTGAAATGAAATGAAATGAAACAGCCCAATGCACAGCCTAAGTCCAAAGAAAACAAACCAG

> SEQ ID NO:2104 214441FL 218691_300920_1c
GTCGCAATCGATCAAACAAACACCAGCACAAACCGGCAAAGAAATACCCTGCAGTCCTCGAGACTCGCGATAGAG
CAGAAGTACATCAGTCTTATTTACTAGCGAGCAAGACAGTCAAAATGTCGTGGCGGGATTCAAGAAGAATGTGA
ACCGCGCGACGACGCAGGTGATGATGAAGACGGGGCATGTGGAAAAGACAAACGATCGCGATTACGAGGTCGAAG
AGAGACGGTTCAAGACGATGGAAACAGCTGCACTGCGGCTGCAGAAAGAATCAAAGGGCTACCTTGACTCTTTGA
GAGCCATGACAGCTTCACAGATGCGAATCGCCGAGACGATAGATGCGTTTTACGGCGACTCCGGTGCGAAGGATG
GCGTGAGCAGGAGCTACAAGCAGGCCGTCGAAGATCTCGACGCCGAAACCATCAAGGCCCTCGACGGGCCTTACC
GAATGACGGTGCTCGACCCCATTGGCCGGTTCTGCGCCTACTTCCCCGACGTCAACGAATGCATCAAGAAGCGCT
CGCACAAGCTTCTCGACTACGATGCTCTCCGAGCTAAAGTGAAGAAG

> SEQ ID NO:2105 214473FL 215157_300878_1c
GGGAAAATAGACTGCGAGAGAGAGAGCGACGAAAAGAAGGAAATGCTCCGATCACGATTAGGGGCGGAATTGGAA
ATCCGGAGCTCCGACAGAGTGCGAAATGCGAATGCGATAGTTCAAATGTATGATTGATTTACTGTATGAGGCGAC
GATGATGCGATGAAGAAGAACGGAAAATATCCCGAGCTGATGCATACATTGCGGGCTTTCCGGATATCTCGTCAG
CCCTCCTTCCATTATGTCAGAAGCTATTATGCAGTTGGTTTTGATGGATGGGCGAATTTGATGACAAGGTGCAGT
TTACTGGACGGGACCGG

> SEQ ID NO:2106 214533FL 207606_300827_3c
GTTGTTTTTTGTTTTTCATCTTTCTTTCTTTTGTCACAATCACTTTGCCGTCTTCCACGGACATTTCCGCAGATCT
GCATCACAGAGATCTGCATCAGAGAGGATTTCAAGCTTTTCCTCTTTGTTTGCCTTCCTCTCCTCTTCTCTTCTT
GGATCACAAAACAATCGGCAAAATTGACATCTCGATATTTTCTGCCTCCAATCACAGCCGTCATACCACCTGTGG
CGTCTTTGCCATCAATTCTCTGCTGCGGTGCTACCCGCCCTGCAGCAATTTTCCCGCTGGCCGTCTGCAGGCTT
GCCTCGGCTGTGGGTTTTTCGTCGACCACTGAGGCTTAGTGCCCATCAGCCACTAAAGCGGCTTGACGTCGATTC
TCAACTTTGAACCCTTTTGAGCTGCCTCTGGCCTCTGCCTCATCTCTCCCACACCCTCACGCGCGCAGTCTTGAA
TCAACACCCCTTCACGCACTCGCCATTGCCGCGCTCCTCGTCACGCTCTGCTCGATTAGCCGTCTCTCGCCCATT
GATTGAACCTGCTCTCGGCCTCTGCAGCCACCCTCACGCAACCTACGCCTGACATCCTCTGCGTCGCTCGGCTGT
CTCCCGGTTTTATCCATCAGCTGAACCTTCACCTTCGCCTTCGCTCTCAAGAGGGAATCCGAGGGCCCGGCCGTT
CTCTGCCATCTATTGTTATTGCCATTAACGCTGCTGCTGCTGCCACTGTCTCCTCTACTCCTGTTTCGCCCTCAT
ATGTCTCAGCCGCCTCGCCGGATGCCTCTACTATCACACCCTAAACACCGTATTAGCATACTTGATCTTACCAAA
CTGCCGTTGCAGTAACGCCGGCTTCATCTTCTTGACAATGCCGTCGAAACTAACAATGGTGTGGGAGTTCAGGT
CGAGGACACAAAGATATGCGTTGTCATGGTTGGTCTCCCGGCCCGCGGGAAGAGCTACATTGCCCAGTTAGCCCA
GAGATACCTGCAATGGCTGTCGATTCCGGCAGCGACTTTCAATGTCGGCAACTATCGGCGCAATGACGCTCCACA
GCCGACTGCCGACTTCTTTGATTTTAACAATCCCGAAGGAGAGCGGAAGCGCCGTGCGGCTGCCGAGGCCGCCGT
TGCTGACATGCTTGCCTGGTTCCGCACCGGCGGCGTCGTCGGCATCCTTGACGCGACCAATTCTACAAAGGAGCG

Figure 2 continued

CCGTAAATGGGTCATGGACACGTGCACCGCTCACGGCATTGAAGTGCTCTTTGTCGAGAGCAAATGCGATGATGA
AGAGGTCATCATGGCCAATATCCGTGACGTCAAGCTAACGAGCCCCGACTATCGAGGCCAAGATCCCGAGGCCGC
GGCGCAAGACTTTCGCAATCGCATCAGCCACTACGAGAAAGTTTACAAGACCATCAACGCCGACGAGGATGAGGA
CAACTACACCTACCTAAAGCTGATGAACGTCGGCAAGCAAGTCATCA

> SEQ ID NO:2107 214613FL 108349_300381_1c
CACACTCCAATTTCCAATTTCCAATTTCCCAATCTGCAATTTTCTCTTTCCCTTTCAACAAAGAAAAATCTCAGA
GAGAAAAATGGCGGATCAGCTCACCGACGATCAGATCTCTGAGTTCAAAGAAGCCTTTAGTCTCTTTGACAAGGA
CGGAGATGGTTGCATCACAACTAAGGAGCTTGGAACTGTAATGCGGTCATTGGGGCAGAACCCAACCGAGGCTGA
GCTTCAAGACATGATCAATGAAGTTGATGCTGATGGGAATGGGACCATTGATTTCCCAGAGTTCCTTAACCTGAT
GGCTCGCAAGATGAAGGACACTGATTCCGAGGAGGAGCTAAAGGAAGCTTTCAGAGTGTTCGACAAGGATCAGAA
CGGATTCATCTCGGCAGCTGAGCTTCGTCATGTCATGACAAACCTAGGCGAGAAGCTTACAGATGAAGAGGTTGA
TGAAATGATCCGTGAAGCTGATGTGGACGGCGATGGGCAAATCAACTACGAGGAGTTTGTCAAGGTCATGATGGC
CAAGTGAGAACTGACGAATCCAACTTTTAATCTTTATTAGAAGTAAAAAATACGAAGAGAAGGAAACAGGGCAGA
TAAGTTTGTTGAGATTCTGTTTCAAATTAGGACATATTTACCTGTCTCAGTGCTTGCCTATTTTCCTA

> SEQ ID NO:2108 214613FL 226347_300996_1c
AAAAATATTACAAATGTCGCAAAACTCCAAATCTTTCAAGGACGCCTTTTCCCTGTTCGACAAGAAGGGCACCGG
CAAGATTCCTGCTGAAGCTCTCGGTGATCTTCTCAGAGCTGTGGGCCAGAACCCCACCCTCGCTGAGATTGATGA
TCTGAAGCAGACCATTCCCGCTGAGTTCGACTACGAGACCTTCTCCAAGATCGTCAACCGACCAAGCGGTTTCAA
GTCTCTCGGTGAGCCCGAGGATTACATCCGGGGATTCCAGGTGTTCGACAAGGACTCCACTGGGTTCGTGGGTGT
CGGCGAGATGCGATACATCCTTACCTCGCTGGGCGAGAAGATGTCTGATTCCGAGGTTGATGAGCTCCTTAAGGG
AGTCAACGTTACTCGAGACGGCAACGTCAACTACGTTGACTTCGTCAAGTCCATTCTGGCCCAGTAGATACCTAA
TATATTTTTTATGTTTGAGC

> SEQ ID NO:2109 214613FL 225436_301049_1c
GCTCCATCGATCCATCCACCGATCGATCGAGCTCTACATCCTGCGCAAGAACACACGATGGTAGAGGAGCTCACC
GAGGAGCAGATTGCAGAGTTTAAGGAGGCATTCAGCCTCTTCGACAAGGACGGCGATGGCTGCATTACCACCAAA
GAGCTCGGAACGGTGATGCGATCGCTGGGACAGAACCCGACGGAGGCAGAGCTCCAAGACATGATCAATGAGATC
GATGCCGACGGCAGCGGCACGGTCGATTTCCCAGAGTTCTTAAACCTCATGGCCAGGAAGATGAAAGACACCGAC
TCCGAGGAAGAGCTCAAGGAGGCGTTCCGAGTCTTCGACAAGGAACAGAACGGCTTCATCTCCGCGGCGGAGCTG
CGGCACGTCATGACCAACCTCGGCGAGAAGCTCACCGACGACGAGGTTGACGAGATGATCCGCGAGGCAAACGTC
GACGGCGATGGACAGATCAACTACGAAGACTTTGTAAAGATGATGATGTCCAAGTGATCCAGGGAAGTCGCCATT
GATTGCTCTGCTCGCTCTATAGATCAAGGGAATGCGACCACGATGTATTGCTCTGTCTCTATTGTGCAATTCCTT
GCCACCTCTGTCTTGTATGGAATA

> SEQ ID NO:2110 214613FL 147736_301255_1c
GCAGATCAGCTCACAGATGATCAGATCTCTGAATTCAAAGAAGCTTTCAGCCTTTTCGATAAGGATGGAGATGGT
TGCATCACCACTAAGGAGCTTGGGACAGTGATGCGGTCATTGGGACAAAATCCAACTGAGGCTGAGCTTCAAGAC
ATGATCAATGAAGTAGATGCTGATGGAAATGGAACCATCGACTTTCCCGAGTTCCTTAACTTGATGGCTCGCAAG
ATGAAAGACACTGATTCTGAGGAGGAGCTCAAGGAAGCTTTCAGAGTGTTCGACAAGGATCAGAATGGATTTATT
TCTGCAGCCGAGCTGCGACATGTCATGACAAACCTAGGCGAGAAGCTTACTGATGAAGAAGTTGATGAGATGATT
CGTGAAGCTGACGTGGATGGTGATGGCCATATCAACTATGAGGAGTTCGTCAAAGTCATGATGGCCAAGTGAGAA
CTGATCAACTTGACTTAATTCTTAGTAGTAAAAAATTACAAAAAAAGAAGCTGGCAACGGAGCAGATAAATTGGA
TGAGATCTCTATATTTG

> SEQ ID NO:2111 214613FL 146586_301066_1c
TTCAAACTTCAAAGACCAATCTTTTTGTTTCTCCCTTTACGTTCTCTGAATTCCAGAAGCTTCTTCTCCCTCTCT
CAATGGCGGATCAGCTGACCGATGATCAGATCTCTGAGTTTAAGGAGGCTTTCAGCCTATTCGACAAGGACGGCG
ATGGTTGCATTACAACTAAGGAGCTTGGGACTGTGATGAGGTCATTGGGACAGAACCCAACTGAAGCTGAGCTCC
AGGACATGATAAATGAAGTGGATGCTGATGGTAATGGAACCATTGACTTCCCAGAGTTTTTGAACCTCATGGCCA
GGAAGATGAAGGATACAGACTCGGAGGAGGAGCTGAAGGAGGCATTCAGAGTTTTTGACAAGGACCAGAATGGTT
TCATTTCTGCTGCTGAGCTCCGTCATGTGATGACCAACCTTGGTGAGAAGCTTACTGATGAAGAAGTTGATGAAA
TGATTAGGGAGGCCGATGTCGATGGTGATGGACAAATTAACTATGATGAGTTTGTTAAGGTCATGATGGCCAAGT
GATTTCCCTCTTCTGCAGTTTACCTTTTTTACACTGAAGAAAGACCAAACATTCATCAGACTGGGTCAGC

> SEQ ID NO:2112 214613FL 142414_300435_1c
AGCCATTCTCTCCGCGACGGTCTCGTCTTCCCCACCCCTCGCCTCCTCGCGCGCTCGGTGAGAGAAGCGAAGAAG
AAGAAGAAGAGGAGGAGGAAGAAGCCAGGCTAAGCCCAGCGGCATGGCGGACCAGCTCACCGACGACCAGATCGC

Figure 2 continued

CGAGTTCAAGGAGGCCTTCAGCCTCTTCGACAAGGACGGCGATGGTTGCATCACAACCAAGGAGCTGGGAACCGT
GATGCGTTCGCTGGGGCAGAACCCAACGGAGGCCGAGCTCCAGGACATGATCAACGAGGTCGACGCGGACGGCAA
CGGCACCATCGACTTCCCGGAGTTCCTCAACCTGATGGCACGCAAGATGAAGGACACCGACTCGGAGGAGGAGCT
CAAGGAGGCGTTCAGGGTGTTCGACAAAGACCAGAACGGCTTCATCTCCGCCGCCGAGCTCCGCCACGTCATGAC
CAACCTCGGCGAGAAGCTGACCGACGAGGAGGTCGACGAGATGATCCGCGAAGCCGACGTCGACGGTGACGGCCA
GATCAACTACGAGGAGTTCGTCAAGGTCATGATGGCCAAGTGAGGCACCACTTCCCCTGCCGATGATGGCATAGT
ACCCTGGGAGGAGGAAACCGTGCATTGCCGTATTAGTAAGGGGATGCAAACACTGGTTTCAGTCGTCTTCCCTGA
TGAAGAAAACCGAACCGTACTAGTTGTAGTTGCTGAACATTTTTCTATCTCTCCAGTCTCTCCGGTGTGCCATGG
AACTTCTTGCTTGATTTTTCTGTGTGAATCTGTT

> SEQ ID NO:2113 214613FL 130580_300488_1c
GAATTCACAACAGAGACTCGGCCATCATAATTCCGCGTTCTCTAAAATTTACCTTTTAGAGATCCCATCTTCCTC
TTGTTCTTCGTTGATATTATATCACACAGGGAAGAAACAAAATCATGGCTGATCAATTAACTGACGACCAGATCT
CTGAGTTCAAGGAAGCTTTCAGCTTATTCGACAAGGATGGAGATGGTTGCATCACAACCAAGGAACTGGGAACTG
TCATGCGTTCACTAGGTCAGAACCCAACAGAAGCAGAGCTCCAGGACATGATAAACGAGGTTGACGCTGATGGAA
ATGGAACAATTGATTTTCCAGAGTTCCTCAACCTTATGGCACGTAAAATGAAGGATACTGACTCAGAGGAGGAAC
TAAAAGAGGCTTTTAGGGTATTCGACAAGGACCAGAATGGTTTCATTTCTGCAGCTGAGTTGCGCCATGTCATGA
CCAACCTAGGGGAGAAGCTTACAGACGAGGAAGTTGATGAGATGATTCGTGAAGCTGATGTAGATGGTGATGGTC
AAATCAACTATGAGGAATTTGTCAAAGTCATGATGGCCAAGTAAGGAGACTCATCCCCTTACCACTAAAAAGGGA
AAAGAGAAACA

> SEQ ID NO:2114 214613FL 1112638_301803_1c
TTCTCTCTCTCTCTCTCTCTCTCTCACTCTGTCCAGCTCCTCCTCCTCCTCAGCAATGGCAGACCAGCTGACA
GAGGAGCAAATCGCAGAGTTCAAGGAAGCCTTCAGCCTCTTTGATAAGGATGGAGATGGTTGCATCACAACGAAA
GAGCTGGGTACCGTCATGCGTTCCTTAGGGCAAAATCCAACTGAAGCAGAGCTTCGAGACATGATCAATGAGGTT
GATGCTGATGGAAACGGAACAATTGATTTTCCGGAATTCCTGAATTTGATGGCCCGTAAAATGAAGGACACGGAC
TCTGAAGAGGAGCTGAAGGAGGCATTCAAGGTCTTTGATAAGGATCAAAATGGCTATATTTCTGCCGCCGAGTTG
CGTCACGTGATGACTAATTTGGGAGAGAAGTTGACGGATGAGGAGGTCGATGAGATGATTCGTGAAGCGGACATT
GATGGGGACGGCCAGGTTAACTATGAGGAGTTTGTCAGAATGATGCTTGCAAAATAAAATCCCCCATTCCTTGCA
CTCAATCTAACACAAATAGGTTGCTAATTTGCTTTTTGGGATAGGTTGTATTAAGCTTGCACTCCCTAAGGAATG
AATTGTTTTTTTTCTTTCCCTTTTTTGTTCATATAGCCATGGCTGAAATGCTTGGGCACAATTATCAGTTATGC
TTCATTGAGACACCATACGGGCTTTATGAGCTTGTGTAACTTTGATGAAG

> SEQ ID NO:2115 214613FL 1108616_301519_1c
GTTTTGGAGAGACGGGGAGCTGAGATGGCCGACCAGCTGACGGAGGATCAGATCGCAGAGTTCAAAGAAGCCTTC
AGTCTTTTTGATAAGGATGGAGATGGTTGCATCACAACGAAGGAACTGGGGACTGTGATGAGGTCTCTGGGCCAG
AATCCAACGGAAGGAGAGCTACAGGACATGATCAATGAAGTGGATGCAGACGGAAGTGGAACCATTGACTTCCCC
GAGTTCCTCAACCTCATGGCCCGCAAGATGAAGGACACCGACTCTGAGGAGGAGTTGAAAGAGGCCTTCCGTGTG
TTTGACAAGGACCAGAATGGATATATCTCTGCCGAAGAGCTTCGTCATGTCATGACTAACTTGGGAGAGAAGCTG
ACCGACGAAGAAGTTGATGAGATGATACGGGAGGCGGACGTGGACGGCGATGGCCAAATCAATTACGAGGAATTT
GTGAAGATAATGCTGTCCAAGTGAGGAGACCGAACGGGAATACTTGGGTTGTGTGTGAGGGGACTTTCTCTTACT
CGTAGCAATTCTTTCAGTATGAAATTGAGCAACTATTGCCCTAGTCTCTTGTAGGCCTTGCATTGACTTGCCTTG
CCTTGCAAATCAGTAAT

> SEQ ID NO:2116 214613FL 109275_300044_1c
CCCGGAAATGAATTGAAAAGACGATTATTTTGTCTGAAATTCCAGAACAATCTTCTCTCTTAAGTTTTCTCTGTT
GTTGAATTGAAGAAGAAAATGGCAGATCAGTTAACCGATGACCAGGTCTCTGAGTTCAAGGAGGCCTTCAGCCTA
TTCGATAAGGACGGAGATGGTTGCATCACGACTAAGGAGCTTGGGACTGTGATGAGGTCGCTCGGACAGAACCCC
ACCGAAGCAGAGCTCCAAGACATGATAAACGAGGTGGATGCAGATGGTAACGGAACCATTGACTTCCCTGAGTTT
CTAAACCTCATGGCCCGGAAAATGAAGGATACTGACTCCGAGGAGGAACTGAAGGAGGCGTTCAGAGTGTTCGAC
AAGGATCAAAATGGCTTCATCTCCGCTGCTGAGCTTCGTCATGTGATGACTAACCTTGGGGAGAAGCTTACTGAT
GAAGAAGTTGATGAGATGATTAGGGAAGCAGATGTCGATGGTGATGGTCAAATTAACTATGAGGAGTTTGTTAAG
GTCATGATGGCTAAGTAATTTCACCATCTCTTATTGAAGTTGAAGTTTAGACTTGTTAAAAATGTGAAAATTCCA
AAAATATTTCATTGGATAGGATTTGCCTAGTGTAATGTGTTCCGTTGTACCATCTTGGATGTATTGGACCTGGAA
TGAATGTAATGCTTTATTGT

> SEQ ID NO:2117 214613FL 1101059_301473_1c
ACCCCTCTCTCTCTGTCTGTGCCTCTCTCTCTCTCTCTTTATATATATATATTCTCTTTCCTCCGGTCAAA
CGTTGGGAGTAGCATGGCCGAACAGCTGACTGAGGATCAGATCGCAGAGTTCAAGGAAGCCTTCAGTCTCTTCGA

Figure 2 continued

CAGAGATGGCGATGGTTCCATCACCACCAAAGAGCTAGGTACAGTTATGCGTTCTTTAGGGCAGAATCCAACGGA
AGCTGAGCTTCGAGACATGATCAATGAGGTTGACGCTGACGGAAATGGAACAATTGATTTTCCAGAGTTCCTTAA
TTTGATGGCTCGCAAAATGAAGGATACTGATTCTGAGGAGGAGCTGAAGGAAGCATTTAAAGTCTTTGATAAGGA
TCAGAATGGCTACATTTCTGCTGCAGAGTTGCGTCACGTAATGACAAATCTTGGAGAGAAGCTGACTGATGAGGA
GGTTGATGAAATGATTCGTGAAGCTGACATAGACGGGGACGGCCAGGTTAATTATGAGGAATTTGTGAGAATGAT
GCTTTCAAAGTAATTCCAAACTTGTTCTTGTTGCCGTTCGTATTCAAATAGCAGATCTACTGCTAACAAAGATTT
GCTTTGGCACATAATTGAGCCGCTTTTTCATGTGGAAGGAGGCAAAAAAAAGGCCACAAAGTTCACCAGAACAAT
TAGCTGCTGTGTATTTTGAGGTAGTAGGTTATATAACGTTTGTAGTGG

> SEQ ID NO:2118 214613FL 282850_200090_1c
CCTTATTTCAAATTTCCAGTAAAATAATCGAAAGAGATTATGGCGGATCAGCTGACTGACGATCAGATCTCTGAG
TTTAAAGAAGCCTTTAGCCTCTTCGACAAGGACGGCGATGGTTGCATCACTACGAAGGAGCTTGGAACCGTGATG
CGGTCACTGGGGCAGAACCCAACCGAGGCTGAGCTTCAAGACATGATCAACGAAGTTGATGCTGATGGGAATGGG
ACCATTGACTTTCCTGAGTTCCTTAACCTGATGGCTCGCAAGATGAAGGACACTGATTCCGAGGAGGAGCTCAAG
GAAGCTTTTAGAGTGTTTGACAAGGATCAGAATGGATTTATCTCTGCAGCTGAGCTTCGCCATGTCATGACAAAC
CTAGGTGAGAAGCTTACAGACGAAGAGGTTGATGAGATGATTCGTGAAGCTGACGTGGATGGCAATGGGCAGATC
AACTATGAGGAATTCGTCAAGGTCATGATGGCCAAGTGAGAATCCAACTTAATCTTTAAAATTAAAGTACAACAA
AAAGGAACGGCGGATAAGTCTGATGAGGTTTCTATTTCTGGTTAGGATGTCTTCTTTGGCTTATTAGC

> SEQ ID NO:2119 214613FL 279978_200222_1c
TTTCTTTAAAAACGGTCAAAGTGCCAAAAACGAAATCAAAAGGCATAAAACTTGCGCATAGGGTTCTTTGAAATC
GTGAAAAGAGAGAGAGAGAGAGAGAAATGGCAGAGCAGCTAACGGAGGAGCAGATCGCTGAGTTCAAGGAGGCCTTT
AGCCTTTTCGACAAGGACGGCGATGGCTGTATTACTACCAAGGAATTGGGAACAGTGATGAGATCACTTGGTCAG
AATCCCACTGAAGCTGAACTACAGGATATGATCAGCGAGGTTGATGCTGATCAGAATGGAACCATTGATTTTCCA
GAGTTCTTGAATCTGATGGCACGTAAGATGAAGGACACTGATTCTGAGGAAGAACTCAAAGAAGCTTTCAAGGTT
TTCGATAAAGATCAGAATGGCTTTATTTCTGCAGCTGAGCTTCGTCATGTAATGACAAACCTTGGAGAGAAGCTG
ACTGATGAAGAGGTTGATGAGATGATCCGAGAAGCAGATATTGATGGCGATGGGCAAGTTAATTACGAGGAGTTT
GTCCGCATGATGCTTGCCAAGTGACTTTAGATTCTCGTGTATTTTGCGACGGCCACTTAGTTACCTATAACTTCT
AGCTGTCAGTTTATATTCTGTGTTGCTGTTAAGACAAACAAATGTGCCCTATGCTTTTACTAGTATCTAGACTCC
TTTCAGTTTATATGTTTTAACTTCCGGGCTAATGGTGTATACAGCTATAGTCCCTTGCCCATTCAGAGGGTAAAA
GAAAAGGAGAAATTAGATAGTGGCATTGGTAATATCTTGTTAGTTG

> SEQ ID NO:2120 214613FL 254332_301632_1c
GCCACGCGTCCGCCACGCGTCCGCTTCTCTCTCTCTCTCTCTCTCTCTCACTCTGTCCAGCTCCTCCTCCTCC
TCAGCAATGGCAGACCAGCTGACAGAGGAGCAAATCGCAGAGTTCAAGGAAGCCTTCAGCCTCTTTGATAAGGAT
GGAGATGGTTGCATCACAACGAAAGAGCTGGGTACCGTCATGCGTTCCTTAGGGCAAAATCCAACTGAAGCAGAG
CTTCGAGACATGATCAATGAGGTTGATGCTGATGGAAACGGAACAATTGATTTTCCGGAATTCCTGAATTTGATG
GCCCGTAAAATGAAGGACACGGACTCTGAAGAGGAGCTGAAGGAGGCATTCAAGGTCTTTGATAAGGATCAAAAT
GGCTATATTTCTGCCGCCGAGTTGCGTCACGTGATGACTAATTTGGGAGAGAAGTTGACGGATGAGGAGGTCGAT
GAGATGATTCGTGAAGCGGACATTGATGGGACGGCCAGGTTAACTATGAGGAGTTTGTCAGAATGATGCTTGCA
AAATAAAATCCCCCATTCCTTGCACTCAATCTAACACAAATAGGTTGCTAATTTGCTTTTTGGGATAGGTTGTAT
TAAGCTTGCACTCCCTAAGGAATG

> SEQ ID NO:2121 214613FL 248465_301583_1c
ATCGATCCATCGATCCACCGGGCATTTCGTCAAAGAGGAGATGGCTGATCAGCTGACCGAGGACCAGATCGCCGA
GTTCAAGGAGGCGTTTAGCCTGTTCGACAAGGATGGAGACGGCTGTATCACAACTAAGGAGTTGGGAACGGTGAT
GCGATCGCTTGGACAAAACCCGACCGAGGCGGAGCTCCAGGACATGATCAACGAGGTGGACGCCGACGGCAATGG
GACCATCGACTTCCCCGAGTTCCTCAACTTGATGGCGCGCAAGATGAAGGACACTGACTCGGAGGAGGAGCTCAA
GGAGGCGTTCCGCGTCTTCGACAAGGACCAGAACGGCTTCATCTCGGCTGCCGAGCTCCGCCATGTAATGACCAA
CCTCGGCGAGAAGCTCACGGACGACGAGGTGGACGAGATGCCGCGAGGCTGATGTGGACGGGGACGGGCAGAT
CAACTATGAGGAGTTCGTCAAGATGATGCTAGCTAAGTAGTAGAACATCTGTTTCCTTTTTCTCTACTTTGTTCC
TCGCCTTTCCTCTCTCTGTCTTTTCTCTTTCCTTTTTGTTTTGGTAAAGTCCTGCTTCCATGTTAGGATGATGAT
TCCACCACGTCTAAAACCTTTTAAATTATTTGTTCCTGTCCTTGCAAAAAAAAA

> SEQ ID NO:2122 214613FL 245055_301564_1c
AGGAACACAGCAGCAAGCTTGGTGCTTCGTCGTCCGGTACCCCTGTTCTTCGCAGGGCCTGAAAAGGAAGGAAGA
GTTTTAAGCAAGAGACATCGATGGCCGCCTCTGCTGCCGAGCAGCTCACACAGGAGCAATTGGCAGAGTTTAAGG
AGGCCTTCAGCCTGTTTGACAAAGATGGCGATGGCTGCATTACCACCAAGGAACTGGGGACGGTGATGAGATCCC
TGGGACAGAACCCCACCGAGGCGGAGCTGCAGGACATGATCAACGAGGTGGACGCCGGACGGGAACGGGACCATCG

Figure 2 continued

ACTTTGCCGAGTTCCTGAGCCTTATGGCCAGGAAGATGAAGGACACCGACTCGGAGGAGGAGCTCAAGGAGGCGT
TCCGGGTGTTCGACAAGGACCAGAACGGCTTCATCTCGGCGGTGGAGCTGCGGCATGTAATGACCAACCTCGGGG
AGAAGCTCACCGACGAGGAGGTGGACGAGATGATCCGGGAGGCGGACGTCGACGGCGACGGGCAGATCAAC

> SEQ ID NO:2123 214613FL 201036_300712_1c
GTCTCTCCTCCTCCCATCTCCGCTTCCCTTCTTCTTCTTCTTCGTTGATCCACTCACCCGCCGCGCGCAGAGGAG
GCCATGGCGGATCAGCTCACCGACGACCAGATCGCCGAGTTCAAGGAGGCCTTCAGCCTCTTCGACAAGGACGGC
GATGGTTGCATCACAACCAAGGAGTTGGGAACTGTCATGCGTTCACTAGGGCAGAACCCAACGGAAGCTGAGCTC
CAGGACATGATCAACGAGGTTGATGCTGATGGCAATGGAACCATTGATTTTCCTGAGTTTCTCAATCTGATGGCT
CGCAAGATGAAGGACACTGATTCAGAGGAAGAACTCAAGGAGGCCTTCCGGGTGTTTGACAAGGACCAAAATGGC
TTCATCTCCGCTGCTGAGCTCCGCCATGTGATGACAAATCTTGGCGAGAAGCTAACTGACGAGGAGGTGGATGAG
ATGATCCGTGAGGCTGATGTTGATGGTGATGGTCAGATAAACTATGAGGAGTTTGTGAAGGTCATGATGGCCAAG
TGAGCCATGGAACCATACTCTAAGGCAGAGGAGATTGTGTGTTGCATAGTCCTAGTTAAGATGCAACACTTGTTT
TATCAATTTCCAGTGAAGCATCCTACTAGCT

> SEQ ID NO:2124 214613FL 190460_300818_1c
CACAGCCCGCGCACCTCCACACCATTAGCCATCAACGACCAGCATCTCGGCTTTGCTCGCCTTCTCGAAGCTTCT
GCTGCCATGGCGGACCAGCTCTCCGAAGAGCAGATTGTAGAGTTCAGGGAGGCCTTCAGCCTCTTCGACAAGGAC
GGCGACGGTTCTATCACCACCAAGGAGCTAGGAACCGTGATGCGAAGTCTGGGGCAGAACCCAACAGAGGCGGAG
CTGCAGGACATGATCAGCGAGGTGGACGCGGACAGCAACGGCAACATCGAATTCAAGGAGTTCCTGGGCCTGATG
GCGCGCAAGCTGAGGGACAAGGACTCCGAGGAGGAGCTGAAGGAGGCGTTCCGCGTCTTCGACAAGGACCAGAAC
GGGTTCATCTCCGCCGCCGAGCTCCGCCACGTGATGGCCAACATCGGGGAGCGGCTCACCGACGAGGAGGTCGGC
GAGATGATCAGCGAGGCCGACGTCGACGGCGACGGGCAGATCAACTACGAGGAGTTCGTCAAGTGCATGATGGCC
A

> SEQ ID NO:2125 214613FL 176172_300519_1c
CGCCACTCGTTCCCCTTCCTTCCTCTCCTCCTCTCGCGGAACCTTCTCGAAGCTTCCACACCCCCAACCTCGCCT
CCACCACCAACCCCCCATGGCGGACCAGCTCACCGACGAGCAGATCGCCGAGTTCAAGGAGGCGTTCAGCCTCTT
CGACAAGGACGGCGACGGTTGCATCACTACTAAGGAGCTTGGAACCGTGATGCGGTCCCTTGGTCAGAACCCAAC
TGAGGCGGAGCTGCAGGACATGATCAACGAGGTTGATGCTGATGGCAATGGGACCATTGACTTCCCAGAGTTCCT
GAACCTGATGGCGAAGAAGATGAAGGATACCGACTCTGAGGAGGAGCTCAAGGAGGCCTTCCGTGTGTTTGACAA
GGACCAGAACGGTTTCATCTCGGCTGCTGAGCTCCGCCACGTCATGACCAACCTTGGTGAGAAGCTGACCGACGA
GGAAGTCGACGAGATGATCCGTGAGGCTGACGTCGATGGCGATGGCCAGATCAACTACGAGGAGTTCGTTAAGGT
CATGATGGCCAAGTGAGGAGGGTTCCCATTAAATAAGTTCTGTCTGAAGTGAACTAAAACTGTCAGGGCCTACAA
CAAAGCTGTACTTTGTGATG

> SEQ ID NO:2126 214613FL 174890_300527_1c
CTCTCCGCGACGGTCTGGGCTTCCCCACCCCTCGCCTCCTCGCGCGCTCGGTGAGAGAAGCGAAGAAGAAGAAGA
AGAGGAGGAGGAAGAAGCCAGGCTAAGCCCCGCGGCATGGCGGACCAGCTCACCGACGACCAGATCGCCGAGTTC
AAGGAGGCCTTCAGCCTCTTCGACAAGGACGGCGATGGTTGCATCACAACCAAGGAGTTGGGAACTGTCATGCGT
TCACTAGGGCAGAACCCAACGGAAGCTGAGCTCCAGGACATGATCAACGAGGTTGATGCTGATGGCAATGGAACC
ATTGATTTTCCTGAGTTTCTCAATCTGATGGCTCGCAAGATGAAGGACACTGATTCAGAGGAAGAACTCAAGGAG
GCCTTCCGGGTTTTGACAAGGACCAAAATGGCTTCATCTCCGCTGCTGAGCTCCGCCATGTGATGACAAATCTTG
GCGAGAAGCTAACTGACGAGGAGGTGGATGAGATGATCCGTGAGGCTGATGTTGATGGTGATGGTCAGATAAACT
ATGAGGAGTTTGTGAAGGTCATGATGGCCAAGTGAGCCATGGAACCATACTCTAAAGCAGAGGAGATTGTGTGTT
GCATAGTCCTAGCTAAGATGCAACACTTGTTTTATCAATTTCCAGTGAAGCATCCTACTAGCTGTAGTCGCTAAA
AAGGATTTTCCTGCTATGTTCCTCTG

> SEQ ID NO:2127 214613FL 1100495_301460_1c
GTTCCACGTGCTTTTCTGCTCTCTTTTGGTTTCACGACTGCCCAACTCAACCTGCCCAGCGCTCTCTCTCTCTCT
CTCTCTCTTCCTGGTTTGGGTTTCTATGGCCGCAGTGATGGTCGAGCAGCCCCTGACAGAGGAGCAAATAGCC
GAATTTAAGGAGGCCTTTAGTCTTTTTGATAGAGATGGAGATGGGTGCATCACAACAAAGGAGTTGGGCACGGTG
ATGAGGTCGTTAGGGCAGAACCCCACTGAGGCCGAGATCCAAGACATGATCAATGAAGTGGATGCAGACGGCAAT
GGGATCATCGACTTCATGGAGTTTGTGGGCCTCATGTCTAGGAAGATGAAGGATACTGACTCAGAAGAGGAGCTC
AAAGAGGCCTTCAAGGTCTTTGACAAGGATCAAAATGGCTTCATCTCAGCCCTTGAGCTCCGCCACGTCATGACC
AACCTCGGTGAGAAGCTCAGTAACGAAGAGGTTGACGAGATGATCCGAGAAGCCGATGTGGACGGGGATGGCCAG
ATTAACTATGAAGAATTTGTCTTAATTATGATGAGTAGTAAGTAAGTAGGACCCCCATATAGAAGCCTCTTAAAC
CCTTCTCTAAGTCTTGTGTGTACTCATGAAAGGAAACATCCCCAGACTGAGCCCTTTGGTGTACTAAAGCATCAC
CAAAGC

Figure 2 continued

> SEQ ID NO:2128 214623FL 220615_300937_1c
GCGCGATTGTGAATTCGCGAGCGAATGAAACTCGTCGCATGCTTTGGATCCTGCTTCCGACAAGCTCCCACGACT
TGGCTTGGATAAACCTCTAACCTCCATTTTGGAATCGAGTGTCCTCCATGGCTCGAGAATAAGTCACATATTCAA
TCAACAGTATACATAGTTGTAATCGATACACCAATTTCTACTGGAAACGAGGTTTCCATGGGCTTCATCGAACTT
CTCTTGGAGAAATTCTCCATCACGAGGTTCTTCCTCATCATGGCTGGCGTCTGGACAGCTGTATTCATCGTCGGC
CGCATACGAGAACACCAGAAAATCAAGAGCCTCGGCAGCTACGGCCCTTCTCTAAAGCCTCTTCTTCCATTTGGA
CTGGATTTTATCTACCACGGAGCTCGTGCCACATTCCGCCAACAGACCTTTGCGCTATGGAGGGACGTCCTCTTC
TCCCAATTCTGGACCGTCGAGATGCGCGTCCTCAACGAACGAGTCTGCTTCACCGCTGACCCCGAGAACATCAAC
GCCGTGC

> SEQ ID NO:2129 214637FL 200156_300815_1c
GGTTCTCAAAGTCTTCCGGTGCCGCCGGCCGTTTGGCTGCGGACCGAAAGGTGGACAGGAATCAACTCGTGATGA
GATCCGGGAAATGGCGGCCTCCGCCGGGATTTGGATTCCATTCTTTCGTTTTTTGTTGGTTTCTAACGTTGATGA
CCATTCAGTGGCGGCGGCTATGAAGGATATGATGAGAGGTGGTGCTTATGCCGGTGTGTATCAAGTAACGAGTCC
GCCTGGTCCAGGCATCATCATACGATCCATCAATCATAATCAAGGGGAACACAGAGGCAAATCTTCT

> SEQ ID NO:2130 214666FL 211667_300901_2c
TCGACCATTACCATCATACAGCCAACCTCTACATAAGCACAAATACCATTCAAAATGTCTTACGGCGGTGACAAC
AACGACAACTACGGCTCTCGCCGTAATGACGACAACTTTGGCTCCGGAGGAGATTCTTTCGGCTCTGGTGGAAAC
CAGCAATATGGCTCCGGAGGAGACTCATTTGGCTCTGGGGGAGATTCATACGGCTCTGGTGGAAATCAATTCGGC
TCCGGCAACCGCCGTAACGATGACAGCTCATTTGGTACCAGTGGCCAGGGCGAGTTCGGCTCTGGAGGTAACTAT
GGCAGCTCTGGCGGTGACTCCTATGGGTCTGGAGGAAACACCTATGGCTCCGGCGGCAATGACAACTTTGGCTCT
GGGGGCAATGATACGTACGGCTCGTCCCGTAACCAAGAGTCTTCTTTTGGATCCA

> SEQ ID NO:2131 215114FL 221072_300941_1c
GAATGAAAGGGGAAAAAAGGCCAGCATGGCACGCTCGCACCCAAGAACAAAAAAAGGCCGGAGCACTAATAGGCA
CGGCATGGGGGCCTCACGCCATCGATTGTGTAATAGGCGTACGACGGTTACGACAGGAACGTGCCACAAAAGGAG
GGGTGGGAAAACGGATGACGGGAACAAGGAGGAAAACTGGCTCTTTAAGTTCCAACTTTGTTGCCAATAGCCAGT
CGCTGCTGTCTGTGTTTCTAGTTTCTACGGAGCATGAACCTGTGAGAACAAGCCACATCGGGGAGACGGGAAGAT
GGTGACACGGATGCGTTTGTGGAGGTGGGTAAGCTTTGCGCAACATGTGCCAGCCTTATCTTGATATTGGACGCG
GCGACGGCGAGATGGTTGGAAGGGTGTGTCTATGTGTACCGACAAACGCATGGCTGATGAGACGGTGAATAAAAC
TGCACCAAGAAAGAGATGCATGAGAGATGAATGACCAGTACCTAAGGTCTATGACATGTCGCTTTGCACTCGGTC
GGACTCATTCACATGTAGTAAATACTACATAACACCCACTTGCTCCAGTAATCATCACTTATAATAATACGGCGA
GAAGACAAGTTGACACAGGGCGAAACAGGGCGGAACAAGGGCGAAGCGAGGTGGAAAATGGTAAACGCAGAGAC
TCTTTCTATGTACTAGCCATCGATCAAAAGGAAGGACAGCTCAGTCTTCGCTGCATGCTAAAGCAGCGGCCGATG
GGATGGGGCTCCAAGGCAAGGTGTAATACCGAGTACATGCATATCAAAAAAGAAAAGACGAAACGTT

> SEQ ID NO:2132 215373FL 195472_300634_1c
GCTGCATTTTGGGGTCGCAAATCTACAGCAAAAATGGCCTCGACAACGACCAAGCAGACCCCGGCGTCCTTTGTC
GGGACCAGCAAGGTCGTCGAGACTGACTATCCGCTCATCGACAACGACCCTCACTTTAAGCGGGTTATCGGATAT
GCGAGAACGTCAGACTACGTAGCTGGTGCAACCTCTGCGGCCTTTGCACCGACTGCTCTCTATGCCCTCGAGAGG
CTCGCCCCGTCGCATGTTGGCCGGGGAGGCTTTGCCAAAGCCATGCGGTTAGCCGGATTCATTGGCTTGGCCGGC
GGTTTCCTCTACTTTTACCAGCGATCAGCCCTTCGATTCTACGGCGCCACTGAGAACTCAAGGGAAGTCGAGATG
GATATGCGAGAGATGGTTTCCAAGGTCAAGGCGGGACAGCCTCTGTATGGCGAGAGCAAGCTGAGCCCTCACCTG
CAGGGAGTTGCGGCCCGACAGAGCAGATACTCTGCGCTCTTTTTCAGCACAGTACCGTGGTTCAACTTTGTCAAC
CACAACCAGCACGGCGTGGACACGGCCAAGTACTATCAGCAGGCCGAGAGGGAACTGGAAGCAGAGCGGGCGGCG
GGCAAGAGCTAGACGGGACCAAATGTGTATATTTAGCGGGACTACCGCTTCTTGCGG

> SEQ ID NO:2133 215595FL 211010_300895_1c
TCAGCTCACACTCTCCAGGCTCACACAAAACTCACTACAATAAAAACACAATCTTCAATTCTTTGAACCTTTTTC
AAGTTTCGCCAACATGAAGTTCACCACTACTGCCGTTCTTGCCATTGCCGCATTCGTTGAATCGGCCACTGCTCT
GGGCAAGGCCCGTGTCGTCAACAAGTGCCCCTTCAGCGTCACCACCTGGTCCGTTGGCAGCGCCATCTCCAACCC
AACAACCCTTGCTCAAGGCGGTTCCTATGGCGAGACCTTCTCACGAGACCCCGTAACCGGCGGTCGTGCCATCAA
GGTCACCGTCCAGCCCGATGGCCTCTACACTGGCAAGCCCCAGACCAACTTCGCCATCAACCTTGAGGGCAACAC
CATCTGGTACGATCTTTCAGATGTCTTTGGCGATGCCTTCAACGGCCACAAGGTCGTTGTTTCCAGCGCCAACAC
TGCTTGCCCCCAGATTGTTTGGGGCAGCGGAATCCCTCCTGCCGGAAGCCAGGTCAAGAACTGCGGTGCGGATAA
GGATGTGACTTTGACTCTGTGTGCTTAGAGTTAAGGGAGGACGGAATCATGTCAAGGGAAAGGTTTAAATCAAGT
TTATGATAGAATTTCAAGTCCTAGCTATGTTTAAGACTTATGACAGTATGAATTGATGAGTTTACTGC

Figure 2 continued

> SEQ ID NO:2134 215669FL 195810_300638_1c
CAGATCATTACAATCAAACTCTTAATCTCTATTCTTAAATACATCTACCTCTCACAATGGATTTCGTCAACAAGG
CTATGGGCAAGGAGGAGCGCTCCACTCAGGGCACCGCTCCCGCTGCTCCCCAAGCAGGCGGCCAGGTCCAGAAGG
ACGATTACGTCGACAAGGCTTTCGCCATGGGTGCCAAAAAGAGCGGCCACAACATGGATCGCAACACACAGGAGA
AGATTACGGATGCAGGCCGTAACATGTACGAGAAGGTGACAGGAAACAAGGTCGACCCCAAGTGGTCTAATTAAT
GAACGGACGAGTTATGACTCACAACAAGACTGTACAATAGTAATAATAACATCTTATCAACGCTGTCTGTTCCT

> SEQ ID NO:2135 215670FL 210675_300891_1c
AAATTCGAGGTGTTTTAGACGCAAGCTTCTCTTTTACACACTGAAGCTGCTGCTGCAACCATCACCAACATACCA
CACGCAACAACACAACACCACCACGTAATAACGAGCAGAACACCCCTCGCTTGAACTTGTTGCAAAAAACACTCT
CGCCTCTATTTCATAAATCAAATTACACACGAACAAAACAATGAATCCAACAGTCAGAGGCTTCTCAACCGCCGC
AAGAGTGCACCCGCCCTTTTTGCCACATCTCCGCCCATCGCCGCGCCGAGCCCCGATCCGACGCTGGCTAAAAAC
TGCCGCCGTCATCACCGCCGTCGGATACGCCTCAAAGACCTACCTCGACGCCACCCGCGCCCAGCGCCGCGAAAC
CGCCCTCGCACTTGAACATGATTCCGCCGAGAGGCAGCGCATGATGGAGAATTTGTATGGTGGGAGGGAGAGCTT
GGAGGATTTGGAGAAGGGGGTTGCTGAGTATGGCAAGCGGTAATCACCGAAGGAAAAACAAAAAAAAACGACAAC
AGACGGAAAAAAAAACTTGAAGTAAATTCAAGGGGTATTATTACACCAAAAGCGGCGAGGCATTTGGGGGATTT
GCATCAGGGCTGATGGTGCCCTTGAGCGAAGCATACATGGGAG

> SEQ ID NO:2136 216062FL 103561_300363_1c
TGGTATCAACGCAGAGTGGCCATTACGGCCGGGGGTTACATAGGAATAAGTAATATATTTATTGTTTTCCCCTTC
GTCCAAACTATAGGCTCAAATACCTTATCCAAGCTCAGCAGATCTCCGTTTTCACCTAATTCAATCAATCGCCTC
GCATCTTCTAGGGCTTGGATTTGAAGGTATACGAGCTAATCTATGGCGTCGAAGCGTATATTGAAGGAGCTCAAG
GATTTGCAGAAGGATCCTCCGACATCATGCAGCGCTGGTCCAGTTGCTGAGGATATGTTCCACTGGCAAGCAACT
ATCATGGGTCCTACGGATAGCCCTTATGCAGGAGGCGTATTTTTGGTTTCGATTCATTTCCCTCCTGATTATCCT
TTCAAGCCTCCAAAGGTTGCATTTAGAACTAAGGTTTTCCACCCCAACATCAATAGCAATGGAAGTATATGTTTG
GATATTCTTAAAGAACAGTGGAGTCCAGCTTTGACCATATCCAAGGTCTTGTTGTCCATCTGTTCTCTGTTGACT
GATCCAAATCCAGACGATCCACTTGTACCAGAAATTGCTCATATGTACAAGACTGACAGGGCCAAGTACGAGGCC
ACTGCTCGTAGCTGGACACAGAAATATGCTATGGGATGATGCGGAAAGTGTCCTTGGACGTGCCTGAGACACTTT
TAATTGCAACAGTTTCATTGTGCTTTCACCCTTAAGTGCAATGTCTTTGTGCTTGGATGAAAGTAAAATATTG

> SEQ ID NO:2137 216062FL 104611_300369_1c
TACTGTCAAATCAGATCTCTTCAATTTGCTAGGGTTTTGGTTTCTTCTCCCTCTCTGATGGCTTCGAAACGGATA
TTGAAGGAGCTTAAGGATCTCCAGAAAGATCCTCCTACCTCTTGCAGTGCCGGCCCCGTTGGAGAGGACATGTTT
CACTGGCAAGCTACAATAATGGGCCCTCCAGATAGCCCCTACACCGGGGGTGTATTTTTAGTCACTATCCATTTT
CCTCCTGATTATCCATTTAAACCTCCTAAGGTTGCTTTTAGGACAAAAGTTTTGCATCCAAATATTAATAGCAAT
GGTAGTATATGCTTGGACATATTGAAGGAGCAATGGAGCCCTGCCTTGACTATTTCTAAGGTTTTGCTTTCAATA
TGCTCACTTTTGACGGATCCAAATCCTGATGACCCCTTGGTGCCTGAGATTGCTCATATGTACAAGACGGACAGG
GCAAAATACGAAACAACCGCCCGGAGTTGGACCCAGAAGTATGCCATGGGTTAAACCGTTACCTATGGCACTTGA
ATTTATGTAAAAGAAAGAATGCATCTGTCCTCTACTTTCCATACAAGAAGTATAGAATAGCATTGAAC

> SEQ ID NO:2138 216062FL 105318_300373_1c
CAGTTTAAGAGAGAAATATAGGACTTCTTCCAACGTACTGGGGTACTATTATTGGCCCAAAATCCTCTTCCAGCT
CTGCAATCTCCGTCTCCGTCAATTTTCAGTCAACCGAAATCCACCATCTTTCATTGTTCATCACCTTCAGGTTAG
GGTTTGGATTTGAAGGTACAAGGGGCTAATTGATGGCGTCGAAGAGGATATTGAAGGAGCTCAAGGATCTGCAGA
AGGATCCTCCTACATCATGCAGTGCTGGTCCAGTGGCAGAGGATATGTTCCATTGGCAAGCAACTATCATGGGGC
CTACAGATAGCCCTTATGCCGGAGGTGTATTTTTGGTTTCAATTCATTTCCCTCCGGATTATCCTTTCAAGCCTC
CAAAGGTTGCCTTTAGAACTAAGGTTTTCCACCCTAACATCAATAGCAATGGAAGTATTTGTCTGGATATTCTAA
AAGAGCAGTGGAGTCCAGCGTTAACCATATCTAAGGTCCTGCTCTCCATCTGCTCCCTATTGACTGACCCAAATC
CAGATGATCCACTTGTACCAGAAATTGCCCACATGTATAAGACTGAAAGGTCTAAATACGAGACCACTGCTCGTA
GCTGGACTCAGAAATATGCTATGGGATAATGGCAAAGGTGTCACCAGGCATGTCTGAGACTTTGTAACTGCAATG
TCTTATTGTGCTTGTAGTGAATGAATAAATTCGGCTAAAGAACTTAGTTTACTTCTTAATCTCCCTTAAAGTGGG
TTGTCAACAGACATTTCTTTTCAATTTGTGAATATCTATTTGGTGACTATTAGTAAGGGAGACACTTCAGTGTAA
TTTTACTTCGTTTGCCAGTTT

> SEQ ID NO:2139 216062FL 1106278_301498_1c
GTGTAGTCATGTCTTCGAAGCGGATTCTGAAGGAGCTGAAAGACTTGCAAAGGGATCCACCAACCTCATGCAGCG
CAGGACCTGTTGGGGAGGATCTTTTTCATTGGCAAGCAACAATCATAGGGCCTGATGATAGTCCTTATGTTGGTG
GGGTGTTCATGGTCACGGTTCATTTTCCCCAGGACTATCCCTTCAAGCCTCCCAAGGTTGCTTTCAGGACAAAAG

Figure 2 continued

TATTTCACCCAAATGTGAGCAGCAATGGGAGCATTTGCCTAGATATCTTAAAAGAGCAATGGAGTCCAGCTCTTA
CAATATCGAAGGTCTTGCTTTCGATTTCTTCACTTCTTACGGATCCGAACCCTGATGATCCCTTGGTTCCGGAGA
TTGCCCACATGTACAAGACCAACACGGCCAAGTATGAAGCCACGGCCAGGAGTTGGACACAAAAGTATGCCATGG
GGTGAGAGGCTTTTCCTTTGAAAGAGAAAATGGCCTTTATATATTGTTTATGTTTAAAACCTCCGTTCAAACCTT
GTATTTTTTTCTCAAAATGCTACTTTTT

> SEQ ID NO:2140 216062FL 1100623_301462_1c
GGGTGCCTTCCTTGCGTATCGGGAGGAGAACGGAAGAATGGCTTCGAAGCGGATCCTGAAGGAACTGAAGGATTT
GCAAAGGGATCCTCCCACTTCCTGCAGTGCAGGTCCTGTTGGGGAAGATATGTTTCATTGGCAGGCAACTATCAT
GGGGCCAACTGATAGTCCTTATGCCGGTGGCGTCTTCATGGTCACTATTCATTTCCCCCCGGACTACCCCTTCAA
GCCTCCCAAGGTTGCTTTCCGGACGAAAGTGTTCCACCCAAATATCAACAGCAATGGGAGCATCTGCCTTGATAT
ATTAAAAGAGCAATGGAGTCCAGCCCTTACAATATCGAAGGTCTTGCTTTCGATTTGTTCACTTCTCACTGATCC
GAATCCCGATGACCCCCTTGTGCCGGAGATTGCACACATGTATAAGACGGATCGAGCCAAATACGAAGGTACTGC
AAGGAGTTGGACACAGAAGTATGCAATGGGTTGAGTTGAGTCTTTCTTCACTCAATTGCTACTCGCTCTTAATAT
ATCCCCCCCCCTTGATGTAATAAATATATGTTGGCAGACAAGTTAAAATATCGGCATACAAAAAGCCGTGTTTCT
GAATGATCTTGTTTCAAAACTGAATGAATGCAAGCAATGTGTTTTTAT

> SEQ ID NO:2141 216062FL 1100320_301459_1c
GGTTAAAGCTTAGAGAGACATCTGCCCTTGCAAGTGAAGAGGATCAATCGATCGATCAGCCATGGCAGCGAGGGT
AAGACTATTCAAGGAATACAAGGAAGCAATGAAAGACAAGGCTGTTGACTCAGATATTGTACTTACTTGTGATGA
TACAAACATATACAGGTGGACAGGACACATCAAGGGTCCAGAAGATACACCATACCAAGAAGGTGTTTTTCAGCT
AGCCATAAATGTTCCAGATCAGTACCCTCTGGTGCCACCCCAAATACGGTTTGTGACCAAGATTTTTCACCCAAA
CGTTCACTTTAAGACAGGGGAGATATGCCTAGATATTTTGAAGGCGGCTTGGAGCCCAGCATGGACATTGCAATC
TGTTTGCCGTGCTATAATAGCCCTAATGGCTCATCCTGAGGCAGATAGTCCTTTAAATTGCGATTCCGGCAATCT
ACTAAGATCGGGTGATAACCGTGGATTTTATTCGATGGCTCGTATGTACACCCGATTGGCGGCGGCGCCAAAGCC
TTGATTCTCTTCACATCTTTTCAAAAAATATCAAGGATTTCTCATAGCTACTAAGATGCTTTCCATGTGAAGAAT
TATATATTCGGGCACAAATGATTTGGACACGTGGGTTTTAGAG

> SEQ ID NO:2142 216062FL 1099839_301451_1c
TAAGAGTATCTGCGTTGAATTGAAGCGAAAGGACTTTAAGGAATGGCATCCTCTGCTCAGCTTCGATTGATGTCC
GATCTGAAGGCCATTAGCCATGAGCCACCTGAGGGATGCAGTGCCAGCCCTTATAGCGATGCGGACCTTTTTGTT
TGGGACGCCACAATATTTGGTCCCGAAGATACTCCATGGGAATGTGGCATTTTCTGCCTCCGTTTGGTCTTTGGA
GAGCATTACCCTGCCAAACCACCTCGTGTCAGGTTTACTTCCAGATATTTCACCCCAATGTGTACAATGATGGC
ACCTTATGCATGGACATTATACAAGATGCTTGGTCTCCTTGCCACAACATCTGTACAATTCTAACATCTGTTCAG
TCATTGCTAACAGATCCGAATCCCGCAAGCCCAGCTAACTCGGAAGCTGCACATTTATATCAAACTGATATTCAA
GCATATAACAGGCGAGTTCGGCGTTGTGTGAGGAAGTCTTTGGAAAGCACATAGTATACT

> SEQ ID NO:2143 216062FL 1098140_301483_1c
TTCATATATATATATATAGAGGGAGGAAGGCTTCGTGTTGGACCTTCCTTTTTTGTTTTCCTTTTTGCCGCCATC
GCCGTCTTTCCTTCCTTCCTTCGATCGATCCATCCCTCCTCCTCTTCGCGATCAAGCTTCTCCTCCTCCCCCCCC
CCCCAATGGCCTCCAAACGGATCCTCAAAGAGCTCAAGGACCTACAGAAGGACCCCCCCACCTCGTGTAGCGCCG
GCCCTGTTGCGGAAGACATGTTCCATTGGCAGGCAACGATCATGGGACCTGTTGATAGCCCTTACGCCGGAGGTG
TGTTCATGTTGACAATCCACTTTCCCCCAGACTACCCTTTCAAACCTCCCAAGGTTGCTTTCAAGACAAAAGTAT
TTCATCCAAACATCAATAGCAATGGAGTATTTGCTTGGATATTTTGAAAGAGCAATGGAGCCCAGCTTTGACAA
TCTCCAAGGTTTTGCTTTCGATTTGTTCTCTTCTCACTGACCCAAACCCCGATGATCCTCTGGTTCCTGAGATAG
CACACATGTACAAGATAGACAGAGCCAAGTACGAATCTACTGCAAGGAATTGGGCACAGAAGTATGCTATGGGCT
AATAGTTATTATAATGGACATCCCATTGCAATGGTAGACAGGCCGAGGGATTGATTACACTTTCCTGTTCTTGTT
TTCAAACCATGGGGGGTTGGATGTATCTTGTG

> SEQ ID NO:2144 216062FL 107664_300380_1c
TGCGAACTCCAGGGGCACCTCCTCCAACACAAAGCAGGAGTTCAACGCAGAATCAAACCAAAACCCTAGCTCACC
GCCTTGTTTCCTCCGTATTGGTGGTTACAATGTCGACTCCGGCTAGAAAGAGGTTGATGAGAGATTTCAAGAGGT
TGCAGCAGGACCCTCCTGCTGGTATTAGTGGTGCACCTCAAGACAACAACATTATGCTTTGGAATGCCGTGATAT
TTGGTCCTGATGACACTCCTTGGGATGGTGGTACGTTCAAGCTGACTCTTCAATTCTCTGAGGATTACCCCAATA
AGCCACCAACAGTGCGGTTTGTTTCTCGCATGTTTCATCCTAACATTTATCAGATGGAAGTATATGTTTGGATA
TTCTTCAAAATCAGTGGAGTCCAATATATGATGTTGCAGCTATACTTACATCCATTCAGTCATTGCTGTGCGATC
CCAACCCCAATTCACCTGCAAATTCGGAAGCAGCTCGGATGTTCAGCGAGAATAAAAGGGATTACAACCGCAGAG
TTAGAGAAGTTGTGGAGCAGAGCTGGACTGCAGACTGATTCTAAGGAAGAAAGATGTCATTGCTGACCGCAATTC
GGGAGCACCAGGGTTCATCTATGTTACATTTACGGATTGAAACCTCTTCTTGGAAATTTTATTGGAACACATTTG

Figure 2 continued

TTTTGGCCCTAGTATTATGGCTTGGTGCTGTTTGCCTTACCGTTTGCTGCATTGCATTGACAAGCTCCTGTAATA
TATGAATG

> SEQ ID NO:2145 216062FL 107138_300263_1c
AAATCCCCCGTCACCCCCAACAAAATAAAAAGAGCCAAAAAGGTCAGGAAAAAATCATGTCTTCACCAAGCAAAC
GGAGAGAAATGGACTTGATGAAGCTGATGATGAGTGATTACAAGGTGGAAATGATCAATGACGGCATGCAAGAAT
TTTATGTGCATTTCCATGGACCTGCTGAAAGTCCTTATCATGGTGGAGTTTGGAAAATGAAAGTTGAACTTCCCG
ATGCCTACCCTTATAAATCTCCGTCAATTGGCTTTGTTAATAAAATCTATCATCCAAATGTTGATGAGATGTCAG
GCTCAGTTTGTTTAGATGTTATCAATCAGACTTGGAGTCCCATGTTTGATTTGACAAACGTGTTTGAAGTGTTTC
TTCCACAACTTCTCTTGTATCCTAACCCGTCGGACCCTTTGAATGGGGAAGCAGCTGCCTTGATGATGCGAGACC
GAACTGCGTATGAACAAAGAGTTAAAGAATATTGTCAAAAATATGCCAAACCAGAAGATGTTGGAGCTGCACCAG
AGGAGAAGTCAAGTGATGAGGAGTTAAGTGAAGCTGAATATGACTCGGATGATGAGGAAATGGCAGGCCCCGTTG
ATCCATAATAATTCCTTCTATTTCCATTACTATCTTTATATGTAAATGATGTTATTTATCCTGTTTAAAAT

> SEQ ID NO:2146 216062FL 104744_300367_1c
CCCACGCGTCCGCCCACGCGTCCGCCCACGCGTCCGCCCACGCGTCCGGCTCAGCATCTCTAGGCTTCAGCACTG
CAATCTTCGTCTTTCTGCAAACTCAATTAATCCCCTCTACCACTCTGCCACCTTCAGATTTGAGCTTGGGTTTGA
AGGTAAGGAAGTAACATATGGCGTCAAAGCGCATATTGAAGGAGCTGAAGGATCTGCAGAAGGACCCTCCCACGT
CATGCAGCGCTGGTCCTGTGGCTGAGGACATGTTCCATTGGCAAGCAACAATCATGGGCCCTACAGATAGCCCTT
ATGCAGGGGGTGTATTCTTGGTTTCTATTCATTTTCCTCCTGATTATCCGTTCAAGCCACCTAAGGTTGCATTTC
GAACTAAGGTTTTCCACCCTAACATCAATAGCAATGGAAGCATTTGTCTGGATATTCTTAAAGAGCAGTGGAGTC
CAGCATTGACCATATCTAAGGTCCTGTTGTCCATCTGCTCTCTATTGACAGACCCAAATCCAGACGATCCTCTTG
TACCAGAAATTGCTCATATGTACAAGACTGACAGGTCCAAATATGAGGCCACTGCTCGTAGCTGGACACAGAAAT
ATGCCATGGGATAATAGCAAAAGTGTCACCGGGCATGTCAGAGACTTTGTAGCTGCACCGTCTTAATTGTGCTTG
GGTG

> SEQ ID NO:2147 216062FL 57194_300378_1c
CCCACGCGTCCGATCTCTTCTATTCATAAGTTGTAAATTCTTATTATTGGGATTTTTTCCCTTTTTAATTCAATC
CAAGAATTGAGTAGGACTAATGGCATCCAGGAGAATTCACAAGGAACTAAGGGAGTTGCAAAGAGACCCTCCTAC
TTCATGCAGTGCAGGTCCGGTGGCACAGGATATGTTCCATTGGCAAGCAACCATTATAGGTCCAAATGACAGCCC
TTATGCAGGTGGTGTTTTCCAAGTGGCCATCCATTTTCCTCCTGATTACCCTTTCAAACCTCCCAAGGTGGCTTT
CAAGACCAAAGTTTTCCATCCAAATATAAATAATAATGGAAATATTTGTTTGGACATTCTTAAGGATCAATGGAG
TCCTGCCCTCACCATATCAAAGGTTTTGCTTTCCATATGTTCACTACTAACAGATCCAAATCCAGATGATCCACT
GGTTCCAGAGATTGCTCATATGTGCAAGAGTGATCGGAACAAGTATGAATCAATGGCTCGTAGTTGGACTCAAAA
GTATGCTATGAACTGAGTCTGAATACATTAAGAAAAAACTCTAGTTTGTGACAAATATGAATTTCTTGGTATCGA
GCAATATATAAAATGTTCAGGAAAACTGGCACTCTTATGAAAAATGAGATGAGTGACAGTTGGATGTATTTAAAT
CTCGGGATTTGTTTTAAATAAAAGGGTGATTTTACTGTCTTCTTATT

> SEQ ID NO:2148 216062FL 50942_300164_1c
CTTCTCTCTAATACGAGACAGAAAAAGGCGAAAACCTCGCCAATCCGATTACGCGAAAAATCAAAGGTTTTTGGA
TATGGCGTCGAAGCGGATCTTGAAGGAATTGAAGGATCTCCAGAAGGATCCACCTACATCATGTAGCGCAGGTCC
TGTTGCTGAAGACATGTTTCACTGGCAGGCAACGATAATGGGTCCTTCAGAGAGTCCTTATGCTGGAGGTGTTTT
CCTTGTAACCATCCATTTCCCTCCGGATTACCCATTCAAGCCTCCTAAGGTGGCCTTTAGGACCAAGGTGTTCCA
TCCCAACATTAACAGCAACGGTAGCATTTGCCTCGACATCTTG

> SEQ ID NO:2149 216062FL 39306_300198_1c
CCCACGCGTCCGAGCTCCCGGTATAAGTGCCTCTCCATCTGAGGATAATATGCGGTATTTCAACGTTATGATTCT
TGGTCCTACACAATCACCTTATGAAGGAGGAGTTTTCAAGTTGGAGCTCTTTTTGCCTGAAGAATACCCTATGGC
AGCTCCCAAGGTTAGGTTTCTCACAAAGATATACCATCCTAACATTGACAAGCTTGGAAGAATCTGTCTTGATAT
TCTCAAGGACAAATGGAGCCCTGCACTACAAATACGAACAGTGCTCTTAAGGTATATGAGCTGATTACATAAGAT
TATTTCCTGCTAAAAACTAT

> SEQ ID NO:2150 216062FL 38614_300097_1c
GGATAATAAAGAGGTGAAGTAATGTTTTTGTTTGAGATTAAAGAGGTTTCAAACAAAGAGATGATAAAACATAGG
AATCTAACTTATTTCATGGAAGATCCCTATGTGAAGAAGTCCTCTCTCTTTCTCTCTCTCTCTATTAAAACCG
AGTCTGTGAGGGATCAAAGGACACAAACTTTCATCCCATTGCATATTTCTGAGTCCAGCTTCTCGCAGTAGACTC
ATACTTTGCTCTATCGGTTTTGTACATGTGAGCAATCTCTGGAACCAATGGATCATCTGGGTTTGGGTCCGTTAA
CAATGAACATATCGAAAGCAAAACCTTCGATATGGTGAGTGCAGGACTCCATTGTTCTTTCAAAATGTCAAGGCA
AATGCTTCCATTGCTGTTGACATTAGGGTGGAACACTTTTGTCCTGAATGCAACCTTTGGTGGTTTGAAAGGATA

Figure 2 continued

ATCCGGAGGGAAGTGAATGGTTACGAGAAAGACACCGCCTGAATAAGGACTATCAAATGGACCCATTATTGG

> SEQ ID NO:2151 216062FL 37480_300389_1c
TTGAATGGAGATCAAATAATTTCTTACTGATCCTGTCTTCACAAATTTTATAAGACAGACAAGTCTATAAAAGAT
CATTACATAGAAATAAGAAGAGTTTAATTATTAGGGCTCTTCCTTAAGGACAGTATTTGTGTCAGCCCATGGCAT
ACTTTTGGGTCCAGGTCCGAGCAGTGGACTCGTACTTGTTCTTGTCTGTCTTGTACATGTGAGCTATCTCAGGGA
CCAAAGGATCATCTGGGTTTGGATCCGTTAACAAAGAACAGATCGATAGCAGCACCTTGGAAATTGTGAGAGCAG
GACTCCACTGCTCCTTCAAGATGTCGAGGCAGATGCTTCCATTGCTGTTAATGTTTGGATGGAACACCTTCGTCC
TAAAAGCCACCTTAGGAGGCTTAAATGGGTAATCTGGAGGGAAATGGATGGTTACAAGAAAAACTCCTCCAGAAT
AAGGGCTATCCGATGGACCCATTATAGTGGCCTGCCAATGAAACATGTCTTCCGCAACGGGTCCTGCGCTACATG
AAGTAGGAGGATCCTT

> SEQ ID NO:2152 216062FL 35521_300098_-1c
CCCGGGACGACCCACGGGGGCGGGATATTGAAAGAATTGACGGATTTGCTAAGAGACCCTCCTGTTGGGGGACCA
ATCAAACCAGACCACAAGATATGTGCCACTGGCAAGCTACTATAATGGGTCCGAATGAAAGTCCTTACTCCGGA
GGTGTCTTCCTTGTCAATATTCATTTCCCTGCTGATTATCCTTTTACACCTCCCAAGGTTGTATTCACAACCAGA
GTGTTTCACGCAAACATCAACATTCTTGGAAACATATGTTTGGACATTCTCAAAGACCAATGGAGCCCTGCCCTT
ACCATTTCTAAGGTTTGAAATTCTATATATGTATTTAGTTATTTGCATGTCGCCTGTTAAGGCTTCTTTGGACAG
AGCTCCAGGTTTGTCAATCTTGTCCCCAAGAACGAGAAGAGGGATACCATTAG

> SEQ ID NO:2153 216062FL 293034_200199_1c
ATGCTTATATTCAGGTCCGAGTTTTATTTGCAGTCTCGTTCCAACTCTTCTCTCTCCCACAAAGTGAAGTCGGTC
TGAGATTCGTAATGGCTTCAAAGAGGATTCAGAAGGAACTGAAGGACTTGCAGAAAGACCCCCCTGCTTCTTGCA
GTGCAGGTCCTGTTGGTGAGGATATGTTCCACTGGCAAGCTACAATTATGGGTCCATCTGACAGCCCATTTTCTG
GGGGTGTTTTCCTTGTGTCTATCCATTTCCCCCCTGATTATCCATTCAAGCCCCCAAAGGTTTCCTTTAAAACCA
AAGTATTCCATCCAAACATCAACAGTAATGGTAGTATTTGTCTGGACATCTTAAAAGAACAATGGAGCCCTGCCC
TTACTGTATCCAAGGTGCTGCTTTCCATTTGCTCCTTGCTTACTGATCCAAATCCAGATGATCCGTTAGTGCCAG
AGATTGCTCACATGTACAAGACTGATAGAGTGAAGTATGAGAGTACTGCTAGATCTTGGACCCAGAAATATGCCA
TGGGATGAAAACATTTGGCTTACTCCCATGAACATCGGGCCTTTATGCTATAGTAGTAAATAAAAATAGGCGCGG
AACACAATTTC

> SEQ ID NO:2154 216062FL 292918_200249_1c
AGAAATCGAGTAGGAGGATCTCTGAGGGATATGGCATCCAAGAGAATTCTGAAAGAGCTCAAGGATCTGCAGAAA
GATCCTCCCACCTCTTGTAGCGCTGGCCCAGTTGCTGAAGATATGTTTCACTGGCAAGCAACACTTATGGGTCCA
TCTGACAGTCCTTATGCTGGCGGAGTGTTTCTTGTTACCATTCATTTTCCACCTGATTATCCATTTAAGCCTCCA
AAGGTAGCTTTTAGGACAAAAGTTTTTCACCCAAACATCAACAGCAATGGTAGCATTTGCCTCGACATTTTGAAG
GAACAGTGGAGCCCGGCACTCACAATATCTAAGGTGTTGCTGTCCATCTGTTCTCTTCTAACAGACCCAAATCCT
GATGATCCTTTGGTGCCTGAGATTGCTCATATGTACAAGACTGATAAAAGCAAGTACGAAGCCACTGCTCGGAGC
TGGACTCAAAAATATGCCATGGGTTAGTTGCTGAAACACAAATATTTGGCTTTTATCTATGATGTATTAAGAAAT
TGTGTTATGCATAATTAACTCAAGGGAAAGGTTGAATTGTGGCCCTCTGTAAAACACTTAATTTTCCTCATGTTT
GTAAGATTAAATGGTTTTGAAATTCTG

> SEQ ID NO:2155 216062FL 285250_200180_1c
GAATTTCAATTCTCGCTAATCAGGCTAAGACTCAGATTTCTTCGATTGTTTGGTTTTTAATGGCTTCGAAACGAA
TATTGAAGGAGCTGAAGGATCTCCAAAAAGATCCTCCTACCTCATGCAGCGCCGGTCCTGTTGGAGAGGACATGT
TTCACTGGCAGGCTACAATAATGGGGCCCTCTGACAGCCCTTACGCTGGGGGTGTATTTTTAGTCACTATCCATT
TTCCTCCAGATTATCCATTCAAACCTCCTAAGGTTGCTTTTAGGACAAAAGTTTTCCATCCAAATATCAACAGTA
ATGGGAGCATATGCTTGGACATACTGAAGGAGCAGTGGAGCCCCGCCTTAACTATTTCCAAGGTTTTGCTTTCAA
TCTGCTCACTTTTGACGGATCCAAACCCTGATGACCCCCTTGTTCCTGAGATTGCTCACATGTACAAGACAGACA
AGGCCAAATATGAAGCAACCGCCAGGAGTTGGACCCAGAAGTACGCCATGGGCTAACTATTGCCTATGGCGGCTT
GAATTGATATAAAGAAAAACAAATTTCAATGTCTTTCTTCTCTGTTCTCTCCATTAACAAGTTGTACAATAGCAT
TAAGCATTGCCCTCTGCAGGAAGAATTATGATGCTTTAAATTTTGTTTATATGGATTCTAATATTTGATGTGGGG
AAGCATATATTTATCTG

> SEQ ID NO:2156 216062FL 274064_200147_1c
AAATTATTGGGGGTAGCTGAAAATACCTAGCAAAGATACATAACGGACCAACGGTATACTGTCACGACATATCTG
CTTATAAAAAAGGAGTCCTAATTTCACTGTAAACTTCTCGCTTTCTCCTCGGTCCCCTCCAGAATCTGAATTGCA
ACGTGTAGGAGGATCTCTGAAGGATTTGGTGAATCATGGCATCCAAACGGATTCTCAAAGAGCTCAAGGATCTCC
AGAAAGATCCTCCTACCTCTTGCAGCGCTGGTCCAGTTGCTGAAGACATGTTTCATTGGCAAGCAACAATTATGG

Figure 2 continued

GTCCGCCTGACAGCCCTTATGCTGGCGGAGTGTTTCTTGTTACCATTCATTTTCCACCTGACTATCCATTTAAGC
CACCGAAGGTAGCTTTCAGGACAAAGGTTTTCCACCCAAACATCAACAGCAATGGTAGCATTTGCCTCGACATTT
TGAAGGAACAATGGAGTCCGGCACTTACAATCTCCAAGGTATTGCTGTCAATCTGTTCTCTGTTGACAGACCCTA
ATCCTGATGATCCATTGGTGCCGGAGATTGCTCATATGTACAAGACTGATAAAAGCAAGTACGAAACAACTGCCC
GGAGCTGGACTCAAAAGTATGCCATGGGTTAGTTGCAGTGACCATCTCTGGAGGGGCTCCTTTTCTTCTGTGGTA
TTCTGTATATCTATTATGTATTAAGAAATGGTGTTCTTATGCATAATCAACTCAAGGGGAAATGTTGAACAGGCC
CCTGTAACAATTTG

> SEQ ID NO:2157 216062FL 271676_200036_1c
GGGGAGACGTTTGAATTGGGAATAGGAAGAGAGCAAAAATGGTGGACTTGGCGAGGGTACAAAAGGAGCTGCAAG
AGTGCAACAGAGATGTTGGGGTTTCAGGAATAAGTGTAACCCTTAAAGGTGACAGTCTCACTCACTTGATTGGTA
CAATCCCTGGTCCTCTTGGTACTCCTTATGAAGGTGGTTCTTTCAAGATCGATATCACTCTTACTGATGGCTACC
CATTCGAGCCTCCAAAAATGAGATTTGCCACAAAAGTTTGGCATCCCAATATAAGTAGCCAAAGTGGAGCAATAT
GCCTAGACATCCTGAAAGACCAGTCTAGCCCAGCGCTGACTCTCAAGACAGCTCTCCTTTCTATACAAGCATTAC
TCTTTGCTCCTGAACCTGATGATCCACAAGATGCAGTTGTTGCACAACAGTATCTCAGAGACCATCAGACCTTTG
TTGGCACAGCTCGTTACTGGACTG

> SEQ ID NO:2158 216062FL 265904_200082_1c
AATCTCCAGTGCCTTTTAAGCCGGCGACGAACATAAGGCCGCCGCCTATCATTTAACCTCCCGTCGACGTCTATC
ATTCAATTCTCGCCGCTTTTTGCTCGTAGGTCAACAATTCCGTATTTCTTATGCGGTGAGGATGTCGACACCGGC
GAGGAAGAGACTGATGAGGGATTTTAAGCGATTACAGCAGGATCCCCCGGCCGGCATCAGCGGAGCTCCGTGTGA
CAACAATATAATGCTATGGAATGCA

> SEQ ID NO:2159 216062FL 258580_301697_1c
GAAACCACCGTCCACCCTACCCACCCTCCGCAGACCTCTTCTCTTGCGCCGCGACCCAAAGAACAAGAGGATAGC
TGAAGAACCCGAAAAGAATGCAGATGGAAGCCCAGAATGCCGACCCCTTTGCTGAAAACCCCGCCAAGCTGCAAA
TGTCGGGATCCAACTCAAACGACGGCCACTCGGTCACCAAGCGCCTGCAAAACGAGCTGATGCAACTCATGATGT
CCGACACGCCCGGAATCTCGGCGTTCCCCGTGTCCGACGCAGATCTGCTCAACTGGACCGGCACCCTGACCGGCC
CGGAGGGAACGGTCTACGGACCTGACGTTCAAAATCTCGCTGGCCTTCCCCAAAACTACCCCTACACCGCAC
CCACAATCAAGTTCATCAGCCCCATGTGGCATCCCAACGTGGACATGTCCGGCAACATCTGCCTGGACATTCTCA
AGGAAAAGTGGTCTGCCGTGTACAACGTGCAGACAATTCTCTTGTCCCTGCAGTCGCTGTTTGGCGAGCCCAACA
ACAAGTCGCCTCTCAACGCCCAGGCCGCCCAGCTGTGGGACACGGACATGGATGAGTACAAGCGGCTGCTGATGC
AGCGGTACGAGGCCCCTGACGATGA

> SEQ ID NO:2160 216062FL 255882_301645_1c
ACGCGTCGGAGACCACCCCATTCTCTCTCTCTCTCTCTCTCTACCCTGTTTTCTCCCGCCCTGTGGTTTTAAC
ACCCCTCGAAGGCTGGTCTTTAGCCTGTGTGTGTGTGTGTGTGTCTCCCTCCTCTCCTTTTTCTGTTTTGCAGCG
AGTTCGAATTGAGGAGCAGCAAGTTCGAATTGCTTAGATGGCGTCCAAGCGGATCCTGAAGGAGCTCAAGGATCT
GCAGAGGGACCCCCCCACCTCTTGCAGCGCTGGACCTGTAGCAGAGGACATGTTCTACTGGCAGGCTACAATAAT
GGGCCCTGACGACAGCCCTTATGCTGGAGGTGTCTTCCTGGTGACCATTCATTTCCCCCCGGATTACCCATTCAA
ACCCCCAAAGGTTGCTTTTAGGACTAAAGGTTTTCCANCCCAAACGTCAACAGCAATGGAAGTATCTGCTTGGAC
ATCTTGAAAGAACAATGGAGTCCTGCATTAACCATTTCACAGGTTCTGCTCTCAATTCGCTCATTGTTGACCGAC
CCAAACCCAGATGACCCCCTAGTTCCAGAAATTGCTCACATGTATAAAGCGGAACAGGGCGAAATATGAAGCCAC
TGCAAGGAGCTGGACTCAAAAATATGCCATGGGCTAATGCTACCCCTTATATATATATAAGGCGATGGGTGGTGA
GTCTGTTTCCACATCTT

> SEQ ID NO:2161 216062FL 254087_301631_1c
ACGACCACCAATTCCAAGCACACATTCGGACACCCACACTCTCTATCTTGCGAACAGCCTGTCACGCGCGAAATC
ACTTCCCCAACATCATCCTGGACTACAGTCTCCATAACGACACCACTCGCGCCTCACATCCCACGCATCACTTTC
CAACATGTCCACAGCAGCGAGGAGACGCTTGATGCGCGACTTCAAGCGCATGCAGACCGACCCTCCAGCTGGCGT
CTCAGCCTCTCCGATCGCAGACAATGTGATGACATGGAACGCCGTGATCATCGGGCCCTCCGACACACCCTTCGA
GGATGGCACTTTCCGTCTTGTCATGCACTTCGAAGAACAGTACCCAACAAGCCACCGGGCGTCAAGTTCATCTC
ACAAATGTTCCACCCAAACGTCTATGCCACCGGAGAGCTGTGTCTTGACATCCTGCAGAACCGCTGGAGTCCGAC
ATACGACGTGGCGGCAATCTTGACCAGCGTGCAGAGCTTGCTCAACGACCCGAACACCAGCAGCCCTGCGAACGT
GGAAGCCAGCAATCTATACAAGGACAACCGCAAAGAGTACACTAAGAGGGTACGGGAGACGGTCGAGAAAAGCTG
GGATGACTGAGCAAAGCGCGCAACACGAAAGTGAGTTATGAGGCAATCACTATCGAATTCAGACTGGCTTGCATG
AGAC

> SEQ ID NO:2162 216062FL 252709_301604_1c

Figure 2 continued

ACTGTGTCTGTCTCCCTTCCGTCGAGATCTGTGGATCTTATAGCCTAGCCCTAAAGGGGAACAGCAAGCTTTGGA
CTTTCCATGGCCTCCAAACGGATCCTGAAGGAGCTCAAGGATCTGCAGAGGGATCCTCCCACATCATGCAGCGCA
GGACCTGTTGGGGAAGATATGTTTCACTGGCAGGCAACAATCATGGGACCGAATGATAGTCCATATGCTGGCGGT
GTGTTTATGGTGACCATTCATTTCCCACCGGATTACCCCTTCAAGCCGCCAAAGGTTGCTTTCAGGACTAAAGTT
TTTCACCCTAACATCAACAGCAATGGGAGCATTTGCTTGGATATATTAAAAGAGCAATGGAGTCCTGCTCTTACA
ATATCGAAGGTCCTGCTGTCAATTTGTTCGCTCCTGACGGATCCAAACCCCGATGATCCCCTTGTTCCTGAGATT
GCGCATATGTACAAGACAGACAGAGCCAAATATGAAGGCACTGCAAGGAGTTGGACGCAGAAGTATGCAATGGGC
TGAATCTCTGACCTCTCTCGCCCCTTTGTAATAATCAAAAGATA

> SEQ ID NO:2163 216062FL 248560_301584_1c
GGACAGTATGTCTACTCCATCCAGGAAGCGCTTGATGCGAGATTTCAAGCGCCTCCAGCATGATCCACCCGCCGG
GATCAGCGGCGCGCCGCAGGACAACAACATCATGCTGTGGAATGCGGTGATTTTCGGGTAAGAGAGGCCGCTTCT
AGGGTTTAGAGTTTCTAAAGGACTTTTTTCGTGGTTTGCTGCAGGCCTGACGATACTCCCTGGGATGGAGGGACA
TTCAAGCTGACATTGCAGTTTACGGAGGACTACCCCAACAAACCTCCCACTGTGAGATTTGTTTCAAAGATGTTC
CATCCCAATATTTATGCTGACGGAAGTATTTGCCTCGACATCCTGCAAAATCAATGGAGTCCAATCTACGATGTC
GCGGCCATTCTTACTTCCATACAGTCATTGCTTTGTGATCCTAACCCGAACTCGCCGGCCAACTCCGAGGCAGCT
CGGATGTACAGCGAAAACCGCCGAGAGTACAACAGGAGAGTTCGCGACATAGTCGAGCAGAGTTGGACGGCGGAG
TAGCTCCCCTTGGTTCAAGAGCTTGTAAGAGTGGCCATCACAGAGAGATGTGTGCTGCTCCGAGCACACATAAAG
AATCTTGTCAAAAAACAATCCGGAAAGCTGTCGCCTCTACAGACCAGCGTTGAAGGTCGACCATCGAACTCGTTT
GCTTCTGTTGGAACCAGGGCCAGTGTTCTGGTACTCACCATAGAACAGGGTGCTGAGAGCGAAGTCCCCGTTCCA
TTCCAACCATCCACGGGGTTGAATTATGTCACTGATGAACGACTTCATGAACACCGTCCGCGAGTAGAGCTTCCA
CGGCCTTCCGAGTTTATGAAAGACAGCCCCGTGTTCTGTCGCTTATCGACG

> SEQ ID NO:2164 216062FL 247566_301621_1c
GGGCGGACGCGTGGGGGGCGATTAGGGTATATTGGCTTTGTCGCGGCTATGGCGTCCAAGAGAATCCTCAAGGAA
TTAAAGGACTTGCAGAAGGATCCGCCCACTTCGTGTAGCGCAGGTCCTGTGGCCGAGGATATGTTTCATTGGCAA
GCGACGATAATGGGTCCTCCCGATAGCCCCTACGCAGGGGGTGTGTTTTGGTCACCATCCATTTCCCCCCGGAT
TATCCCTTTAAGCCCCCAAGGTCGCATTTAGAACGAAAGTTTTCCACCCAAACATCAACAGCAATGGCAGCATC
TGCCTCGACATTCTCAAGGAGCAGTGGAGCCCGGCCTTGACAATCTCCAAGGTGCTGCTATCAATCTGCTCGTTG
CTAACCGATCCAAACCCCGACGATCCACTGGTGCCCGAGATTGCTCACATGTACAAGACAGACAGGCCCAAGTAT
GAATCGACCGCCAGGAACTGGACGCAGAAGTACGCCATGGGGTAAGCCCGGGCTTGTGAGCGGCGGCGGCGGCGG
TGGCGGTGGCATGGCTCGCTATGATGTTTGTGATACCATTTGGTTGCCTATCTATAAGTTGAAAGCAGGGATTGT
CTTTGATTATGGAATTCTTTTGATTACTGTATATAGAATTTCTATCACGTC

> SEQ ID NO:2165 216062FL 246013_301574_1c
GATCGCATGCACACGGCAGGGAAGGGGAAGTGGAGGAAGGGTTGCGATCTCGCGGCTGGATCGTCCAGGATAGGG
CGCCGCATCGACTCGCCGCCTACGCCGCCGCTGCCGCCGCCGCCGCTATGGCCGTGACCCTGGGTTTGTAGGGAT
TTTCCATCCAGATTTCGAGGAGATCGCTGCGCGTTTCTCGTTCATGGCTGAGAACTTACCCCCAAAGGTGATTCG
AGCGCTTGCAAAGGAGCTCAAGAGCTTGGACGAGAGCCCTCCAGAGGACATTCGCGTTCATGTAAATGACGACAA
CTTCTCGAGCATTTTCGCGGACATTGAGGGACCACCCGGAACACCGTACGAAAGTGGCGTCTTCCGGATCAGGCT
TTTGCTTAGTCCCGATTTCCCGCAAACGCCACCGAAAGGTTATTTCGTCACCAAGATCTTCCATCCAAACATCGC
AAAGAATGGAGAGATTTGCGTGAACGTTTTGAAGAAGGATTGGAAGCCGACGCTCGGCCTGAGGCATGTTCTTCT
TGTCGTACGGTGCTTGCTCATAGAGCCGTTTCCAGAATCGGCACTTAACGAGGACGCTGGAAAGATGTTGATGGA
GGATTACGATGGATACGCAAAGCACGCCAGATTGATGACAAACATCCACGCGATGAAGCCAAAGCCAAAGACCAC
GAAAGTCGCCATAGCCGAGTCAACGGTGGTGAACAGCAACGCGGAGGAG

> SEQ ID NO:2166 216062FL 244825_301562_1c
CGCGATTGTAGATGCTATAGATCCAGGTCGCCTCGTCGTCGTCCCGTGGCGCCGCTGTAGATAGGGTTTGATTCA
TCGCGCAGCAGCGGCAGCGGCGATGTCTACGCCGGCGAGGAAGCGGCTGATGCGGGATTTCAAGCGGCTGCAGCA
CGATCCACCGGCGGGCATCAGCGGCGCTCCACAGGACAACAACATCATGCTGTGGAATGCGGTCATCTTTGGGCC
GGATGATACGCCATGGGATGGAGGAACATTCAAGCTCACCTTGCAGTTCACAGAGGATTATCCAAACAAGCCACC
AAATGTGCGGTTTGTTTCGAAGATGTTCCATCCCAATATTTATGCGGACGGAAGCATTTGCCTGGACATTCTCCA
AAACCAGTGGAGCCCGATCTACGATGTTGCTGCAATATTGACATCGATCCAGTCTCTACTATGCGATCCAAACCC
GAACTCTCCTGCTAATTCCGAAGCCGCACGGATGTACAACGAGAACAGGCGAGAGTACAACAAGAAAGTTCGCCA
AGTCGTGGAGCAGAGCTGGACAGCGAACGACTGAAACCGAGAGTTCTGCTCGGCTGCTCGACATGCTGGTACGCG
ATTTTCTGGCGATCACGGACGGAATTCTACTAACCAGCAGGAGCACTGTATATCCTCTGTACTCGGATTTTTTTT
CTTAGGTGATGTGGTTGCAACTAAGAAAGT

> SEQ ID NO:2167 216062FL 239823_301308_1c

Figure 2 continued

GGAAATATTTGCTACAGGGTAGATGCTTCCCCATTTTTAGGTCTAAAGCTTCTTTCTCCTCCCTCGATTCGATTC
GATCCATCGGCGGCGGCGGCGATGAACATGAACGGCGGCGTCGATGCGATCGCGCAGCAGCAAGCGACGAACAAT
CCGGCGGGTAGCAAGCAGAGCAAACCCAATTTGCAGCCGGTGGACAGCCATTCCGTCGCCCGGAGGTTGCAGTCG
GAGCTCATGGCCTTGATGACTTGCGGGGACCCGGGAATCTCAGCGTTCCCAGACGGCGACAACATCTTTACGTGG
ATTGGAACCATCAAAGGGAGCGACGCGACGGTGTACGAAGGTCTCTCCTTCAAGCTCTCGTTGCGCTTCCCGACC
GACTATCCATTCAAGCCGCCACTGGTCAAGTTTGAGACGTCGTGTTTCCATCCCAATGTCGATCAGCATGGCAAC
ATTTGCCTCGACATCTTGCAGGATAAATGGTCCTCGGCCTACGATGTTAGAACCGTGTTGCTGTCCATCCAAAGC
TTGCTAGGAGAACCAAACAACGATAGTCCTCTCAACAGCTATGCGGCAGCATTGTGGCCAAACCAAGAAGAGTAC
AAGAAAGTGATGAACAGGCAGTGCCGCGACGGATCTGGTCGATGAGAAAGGGTCGATCGACAAGAGAG

> SEQ ID NO:2168 216062FL 238009_301291_2c
ATCATAAGTGGGGCAAAAAAAGGGTTCATGGCGAAGGCGCACGAATCCACTGCGGCACTCCTCTTCTTGATCGAT
TAGGTCAGATCGAAGTAGGTCGATCGATTGATAGATAGATTGGAAAAGGATTGGCGAAGATGCTCGATGTGTCCC
GCGTCCAGAAGGAGCTGGTGGAGATCGAGCGCGACAAGAAGCTGTCGGGCGTGAGCATTCAAGTCTTCGACGATG
GGTTGAGTCGAATGCGAGGAACAATCACGGGCCTGTTGGCACCCCCTACGAGGGCGGAATCTTCACCATCGATA
TTCAGTTACCTTCTGCTTATCCTTTCGAACCACCAAAGATGCAATTCATGACTAAAGTCTGGCATCCAAACATCA
GCAGCCAAAACGGAGCTATCTGCCTGGACATTCTAAAGGATCAGTGGAGTCCAGCGCTGACGCTAAAGACTGCGC
TACTGTCGCTACAAGCGCTGCTTTCGACGCCGGAGCCGGGGGACCCTCAAGACGCGGTCGTCGCAAAGCAGTACC
TGAGTGAGTATCCGGTTTTCGAGAGCACTGCGAGATACTGGACCGAAACGTTTGCAAAGAGATCGTCCCTTGGCA
TGGAAGAAAAGGTAGCGAAGCTAGTCGAGATGGGATTTACGGATGAGGTTGCGACCGCTGCTCTAGAGTGCTGTG
GCGGCGACGAGAATG

> SEQ ID NO:2169 216062FL 237695_301289_1c
GGGAACGCGGGAAGGGGCGGCAACGGCGATGGCGCTGGCGTCGGCGGCGGCCTTGTGACAGTCAACCACAGCATG
CTCGTTGCGGCTGCCGCCACTGCCACTACAGCGTCGATCGAATTCTTGTATTCCTGCAAGCTAGGGTGGGGCGAG
AATGCTGTCGTCGGCCCAGTTGCGGCTCATGTCCGACCTCAAGGCGATTCAACAGGAGCCGCCAGAGGGATGTAG
TGCTAGTCCACAAGGCGAAGAGAATCTCTTTGTGTGGGGAGCCACTGTGTTTGGGCCGGATGAAACACCATGGGA
AGGGGCGATCTTGCCTCTTCGTCTCACCTTTGGCGAGCACTACCCGGCGAAGCCACCGCGCGTGAGATTCACGTC
CGAAGTGTTCCATCCAAATGTCTACAGTGACGGCGCACTGTGCATGGATATCATCCAGGATGCATGGTCTCCTTG
CCACAACGTCAGCACCATTCTCACCTCGATTCAGTCTCTCCTGACTGATCCAAATCCAGCGAGTCCAGCGAATCC
CGAAGCCGCGCATATGTATCAAAACGATCTCCAAGCATACAACAGGAGAGTGCGCCAGTGTGTGAGGAAGTCCCT
AGATATATAAAACTCCAAAGTTTTATTTATCTATCTATCATAGTGATTATCTA

> SEQ ID NO:2170 216062FL 233923_301095_1c
GCGAGAGAGAGCAGGAAGGCGATCGATCAGCTCCCGGCGGCGCTGTCGGAATCCGGATCTTGGAGCCGCTGCCAT
GGCCAGTACCATCGCCAACAGCAATCTCCCGCGGCGGATCATCAAGGAAACGCAGCGATTACTGACCGAGCCAGC
CGAAGGCATCAAAGCTTCGCCTGCCGAAGATAATTTGCGATACTTCAATGTGATGATCCTTGGCCCCGCACAGTC
ACCCTATGAAGGTGGTGCTTTTAAACTGGAGCTTTTTCTTCCGGAAGAATATCCAATGGCTGCTCCAAAGAACTG
CAATAGGTTCGCTTCTTGACGAAAATTTACCATCCAAACATCGACAAGCTGGGCCGGATTTGCTTAGACATTCTA
AAAGACAAATGGAGTCCTGCTCTCCAGATTCGAACAGTGCTTTTGAGTATTCAAGCTCTTTTGAGTGCTCCCAAT
CCTGAGGATCCCCTGGACGAGAACATCGCGAAGCACTGGAAGACAGACCAAGGAGGAGCCATCGCGACTGCAAGA
GAGTGGACTCAACTCTACGCGACCCATAATTAAATCAAAATGCGGACCATTCGTCATCTTGGTTCGTTTAGTTTT
TTCTGCTTTGGTCATATTTGT

> SEQ ID NO:2171 216062FL 230618_301070_1c
TACTCCATCCAGGAAGCGCTTGATGCGAGATTTCAAGCGCCTCCAGCATGATCCACCCGCCGGGATCAGCGGCGC
GCCGCAGGACAACAACATCATGCTGTGGAATGCGGTGATTTTCGGGCCTGACGATACTCCCTGGGATGGAGGGAC
GTTCAAGCTGACATTGCAGTTTACGGAGGACTACCCCAACAAACCTCCCACTGTGAGATTTGTTTCAAAGATGTT
CCACCCCAATATTTATGCTGACGGAAGTATTTGCCTTGACATCCTGCAAAATCAATGGAGTCCAATCTACGATGT
CGCGGCCATTCTTACTTCCATACAGTCATTGCTTTGTGATCCTAACCCGAACTCGCCGGCCAACTCCGAGGCAGC
TCGGATGTACAGCGAAAACCGCCGAGAGTACAACAGGAGAGTTCGCGACATAGTGGAGCAGAGTTGGACGGCGGA
GTAGCTCCCCTTGGATTTGTGGGTAAGACAGCATTTATGGGTGATCTTTTGCAATATATATGTTGCATTGGTTAG
ATCACAGCACTGGCTTCTTGAGTATGTATATG

> SEQ ID NO:2172 216062FL 226366_300996_1c
ACGACACCAATTTTAAAAAATGGCTTTGAAGCGAATCAACAAGGAACTCAGTGATCTTGGACGTGATCCCCCCTC
CTCTTGCTCTGCTGGTCCTGTTGGCCAGGATCTGTTCCACTGGCAGGCTACTATCATGGGACCCTCAGACTCTCC
TTACTCCGGAGGTGTTTTCTTTCTGTCTATCCACTTCCCCACTGACTACCCCTTCAAGCCACCAAAGGTGACCTT
CACTACCCGAATCTACCACCCCAACGTCAACACCAACGGATCCATCTGTCTGGATATTCTCAAGGAGAACTGGTC

Figure 2 continued

TCCCGCACTCACCATCTCCAAGGTGCTGCTGTCCATCTGCTCCATGCTCACAGACCCCAACCCTGACGATCCTCT
CGTGCCCGACATTGGCCACCTGTACAAGAACGACCGAGCACGATACGACGCCACTGCCAAGGAGTGGACCAAGAA
GTATGCCGTCTAGGATGTATATAGGGAGCAGGCATGAGCCTATGCAAGCGAATGGCTGTGACGATACAACTAGCC
AATGTTAGATTTATGGATGGTAAAACAATGTGTGTCGAGGAAAAA

> SEQ ID NO:2173  216062FL 216386_300868_1c
ATGAAGATATATTTTCAAGACCTGCGATAGGTTTTGATATCAAAACGGAAGCTTGCTATGGGGTACGAACATTAT
TATGGGAGGAGTTGAGAGATTATTCTTTTCTTCCATTTTCTTTGGCTTGGTTGCAAATATTTTAGAAGGCTCAAA
TTTGTTTCGAGATGAGCCGCAAGCGTTACTGTCCGCGCTTCTATGGTGTATGTCTTAGATAGTACAAGTGGTCTT
GCAGCAGATATACCACTGGCGCAATACATCATCACATTACACACAAAAAAAAAAAACCAA

> SEQ ID NO:2174  216062FL 215413_300881_1c
ACAGGACCGCCATCAGGGACTCTGCACCCCCGATCAGATAAAGCCTCTACCTAGCGCTCAGGACTTGCAGACGGT
CGCCTTGCATCGTCTCCAACGTCCGCCTAGGATCTTTTGATTCTTTCTTTGCCTCCTCGATCCGAGATCGATCTT
CCACCACCCTTTTAGATACCACATACCCTCATCACAATGGCCCTGAAGCGCATCAACAAGGAGCTCAAGGACCTC
GGCACTGACCCGCCATCATCCTGCTCCGCTGGTCCTGTTGGAGAAGATCTGTTTCACTGGCAAGCTACAATCATG
GGACCCGGTGATTCACCATACTCAGGAGGCGTCTTCTTCCTGAAGATCCAGTTCCCTACGGATTACCCCTTCAAG
CCCCCGAAAGTCAACTTCTCCACCAGAATCTACCACCCCAACATCAACAGCAACGGCAGCATCTGCCTCGATATT
CTTCGAGACCAGTGGAGCCCTGCTCTGACCATTTCCAAAGTTCTCCTTTCCATCTGCTCTATGCTGACAGACCCG
AACCCCGATGATCCCCTTGTGCCTGAGATTGCGCACGTGTACAAGACCGACCGGCCCCGGTACGAGGCGACTGCT
AGGGAATGGACCCGCAAGTACGCCGTCTAGGCAATACCAAACGGTTTCTTTTAAGGGGTTTTGATGGCGCTGGGT
GTTTGACGTCCTCTATCACGCAATGACGGTGCGGCATGTTGGCGAGCCTCTACGTTATAAGCGGGTGCGGGGAT
GATATTCGAAGGCGGACAGTGCAAGTTTTTTCTTTCTTCTCCTTGCTGTTCTCATCATCTCTTCGGGTGCACCGC
ATTTATGATGCTGGGGGTGAGACGACGCATGGCCGGCGGACAGGTGGCAGACTAGACAGAAATATCCGCTATTCA
AGGGCTTATGCGGCTGGACTTGACTTTGGGTTTGCATCAACAACGTGTACTCTGCATCCAACAACAGGCATCTGA
TTTAACGCGTCTATACG

> SEQ ID NO:2175  216062FL 211510_300900_1c
GCTTTTATCACTTTTGAGAACCACTCATTCATCCATCTCCGCAAGATCGTCTGTTTTTGTTTACAATGGATTATA
CCGAGGATAACCAGAATTCTGCTCCTGGCAGCGTCCAGGCTTCCAAGCTCAATGCCGCTCGCAAGGGTCCCGATT
CGCAGAGCGTCACTAAACGACTCCAGACCGAGCTGATGACTCTCATGACATCTCCAGCACCCGGTATCTCCGCAT
TCCCCTCTGCCGACGGCAACCTTATGTCGTGGACCGCCACCATCGAGGGCCCCGAGGATACACCTTATTCCGGAC
TCACGTTCAAGCTGAGCTTCGCGTTTCCTTCAAACTATCCTTATGCCGCGCCGACGGTCCTCTTCAAGACGCCCA
TCTACCACCCCAACGTCGACTTCTCTGGCCGCATCTGCCTTGACATTCTCAAGGACAAGTGGACAGCCGCCTACA
ACATTCAGACCGTTCTGCTGAGTCTGCAGAGCTTACTCGGCGAGCCCAATAACGCATCTCCATTAAACGGCGAGG
CAGCAGAGTTGTGGGACAAGGATATGGAAGAGTTCAAGAAGAAGGTGTTGGGACGCCATCGCGACATCGAGGAGG
AGTAATGGGATTCATAGCGTGCAGATTTTTATGATTTTACGTTTACGGGTATTTGGAGTCTTTGGGGCACGAATC
GGTCGTTTTTGAAAGGGTATTTGGGTGTATTTTGCATTTCCACAGCCAGAGCTGGGAAAGGAGGGCTACCTGCCC
CTTCCACAAGCGCA

> SEQ ID NO:2176  216062FL 210910_300894_1c
AAGCCTCTTCGACCACCCTCTGCCATCGTCAGCCTTCGACTCTCTTCACCAAACCTCAACAAGCGACAAATTATC
GCCAGGGTGCTCCAACGCTCGCTCCGCCATCGCCAGTATCCTTTGGACCCATACTTTCGCTCTACAACACACACA
ACCCCTCTTACGCCCACATAGCTTCGGCTACGTCAAGTTTCGGCATCATGTCTAGCAGAGATCGCCGTATAATGA
AGGAGCTGCAGGATCTGACCGAGGACAAGGACACTTCCGGCATTCATGCTGCCCTAGAACAAGAGGGCTCGCTGA
CCGCTCTCAAGGGCTGGTTCTTTGGCCCTGGAAATACGCCGTACGCTGGTGGCAAATTCGTGATTCACATTCAGC
TTCCCACCGACTACCCCTTCAAGCCACCCAAGATGAAGTTTGAGACCAGGATCTGGCATCCTAATGTCAGCAGTC
AGACGGGCGTCATTTGTCTCGACACCCTCAACAAGAACTGGTCGCCTGTCCAAACGATCAAGACGGCTCTCCTCT
CCGTCCGAATGCTTCTCGAAAACCCAAACCCCTCAGATCCACAGGACGGCGAAGTTGCACGGATGCTGCTCGACA
GTCCCGACTCGTTTGTCCAGATGGCTCACGAGTGGGCAGTCAGGCACGCCGGTGCGCCGCGACAGCGAAACCTCG
ACGTAACTATATTCAGAAGCCTGGCCAGACCAACAACTGCTGTCGATGCGAGCCGATACCATGGATACAAGCCAG
TC

> SEQ ID NO:2177  216062FL 207919_300830_1c
GCCAGTACGAACGAACATTCAGCCTTGTGCAGGGGAAGCAGAAGATCATATAGAGCATTTATCAAGCGAATAACA
GACCCTGAGACACTGAATCAGAGAAGCTTTAGAAGCTCTTCTTCTCTGTCTCCGCGCCTCTTATCGCAAACAG
CCCCTCTACTGCTGCTGCTGCCTTTGTCAGGCCTGTCTTTTCAGTGTCGCATGCCCCGCCTCATCTTTCTACCTT
GCACAACTCAGCCTTTGCGCTAATCAACGACATCTGCGATCTGTGTCGGCAGCAGAAGAGTCCCAGATCACTGGT
CTCTCTTTTATTCTCCTTCTTCTAAACAGATCTGTGTTGCCCCCAAAGCAAGCGAGAATACGTCAAGATGGCTCT

Figure 2 continued

TCCGAAACGCATCATCAAAGAAACCGAACGCCTTATGGCGGAACCAGTTCCCGGAATCAGCGCCGTGCCTCACGA
AGATAACCTGCGATACTTTGACGTCGAGATCCACGGCCCTGCATCGTCACCATACGAAGGCGGCATTTTCAAGCT
TGAGCTCTTCCTCCCAGATGACTATCCCATGACTCCGCCCAAAGATTCGATTCCTTACTAAGATTTTCCACCCAA
ACGTTGACAAGCTGGG

> SEQ ID NO:2178 216062FL 197269_300700_1c
CTCACCTGGCGCGCCGAAGCTTCTCTCCTCTCTCTCAACTCCGGCGAGAGGAGGAGGCGGCGGTGGGCGTTCGT
CGGGAGAGAGACCAGGGCCGGGGGGCTAGGGTTCGGCCGTTCAGAGAGGCGGCGGCTGAGGAGGAGGAGGAGGAG
GAGGAGGGGGTGAGGAGAGATGTCGACGCCGGCGAGGAAGCGGCTGATGCGGGACTTCAAGCGGCTGCAGCAGGA
CCCGCCCGCCGGAATCAGCGGCGCGCCGCACGACAACAACATCATGCTCTGGAACGCCGTCATATTCGGACCGGA
TGACACGCCGTGGGATGGAGGCACGTTCAAGCTGACACTACAATTTACAGAAGATTATCCCAACAAACCACCAGT
TGTTCGGTTTGTCTCAAGGATGTTTCACCCAAATATTTATGCAGATGGAAGTATCTGCTTGGATATCCTACAAAA
TCAATGGAGCCCTATATATGATGTTGCTGCGATATTGACCTCTATCCAGTCCCTGCTCTGTGATCCAAACCCAAA
CTCCCCTGCAAACTCCGAAGCAGCCAGACTGTTCAGCGAGAACAAGCG

> SEQ ID NO:2179 216062FL 190923_300737_1c
CCCAACTCCATTATTGATTCTTGCAAGGAGGAAGAGCAGCTAGAGGCGAGGCAAGAAAAGAAGTGAAATCTCTCC
GTTAGACAGGAAGAGGAAAAGCAAGGGGGAATTGGGGATGGCGTCAAAGAGGATACAGAAGGAGCTCAAGGATCT
GCAGAAGGATCCCCCTACATCATGCAGTGCAGGTCCTGTTGGTGAAGACATGTTCCACTGGCAGGCAACGATAAT
GGGTCCATCTGATAGCCCATATGCTGGTGGAGTTTTCCTAGTTACCATCCACTTCCCTCCTGATTATCCCTTCAA
ACCACCCAAGGTGGCGTTTCGCACCAAGGTTTTCCATCCAAACATCAACAGCAACGGGAGCATTTGCCTTGACAT
CCTTAAGGACCAATGGAGCCCAGCACTAACCATTTCCAAGGTGTTGCTGTCAATCTGTTCCCTGCTGACTGATCC
GAACCCTGATGATCCTCTGGTCCCTGAGATCGCCCACATGTACAAGACAGATAGGCACAAGTACGAGAACACAGC
AAGGACCTGGACTCAGAGGTACGCCATGTAGCACCTCAGATATCGATGGACATGTCGATGTTGTAACAACATTAT
CAACGGGTGTGTCTCCCTCTCGCCTTGTGTGGTGTAAGGATCAAAACCGGCTTTGCAGTGCACTCT

> SEQ ID NO:2180 216062FL 187287_300675_1c
CTCGTGTCCGCTGCGAAGAAAAGGGGCATATCATGGCATTGAAGCGGATCCTCAAGGAACTAAAGGACCTGCAGA
AAGATCCTCCAACATCATGCAGTGCAGGTCCTGCTGGTGAGGATATGTTCCATTGGCAGGCGACCATTATGGGTC
CTCCAGATAGTCCCTATGCTGGTGGAGTTTTCTTAGTGAATATTCATTTCCCCCCGGACTACCCCTTCAAGCCTC
CAAAGGTATCTTTTAAGACAAAGGTCTTCCATCCAAACATCAATAGCAATGGAAGCATATGCCTTGACATTCTTA
AGGAGCAATGGAGCCCTGCTTTGACCATTTCTAAGGTGTTGCTTTCGATCTGCTCGCTGCTCACTGACCCCAACC
CGGACGACCCTCTTGTCCCTGAGATTGCCCACATGTACAAGACGGATCGTCCAAAGTATGAGACGACAGCCCGCA
GCTGGACCCAGAAGTATGCCATGGGATGATGAAACCCACAAGCCCTGAATTCAAACCTGCTGCTTAAATGCAGAC
AGTCGTGGTAATTGTCCCATGAAAACT

> SEQ ID NO:2181 216062FL 182315_300660_1c
GAATTCAGCAGCTAACAACAATACCCCAATACCAAACCCTAACCCTTAATCTCCCGCAGCTGTATAAAACCCTAA
TCATTAGATCCTGAGAAGAATCGGAGTTTTTTCTCACAGCTTTTTCTTACGGCTGTGAGGATGTCGACCCCTTCG
AGGAAGAGGTTGATGAGAGATTTCAAGAGATTGCAACAGGATCCTCCAGCAGGCATCAGCGGTGCACCGCAGGAC
AATAACATAATGCTATGGAATGCTGTTATATTTGGCCCAGATGATACTCCCTGGGATGGAGGTACCTTTAAGTTG
TCTCTGCAGTTTTCGGAGGACTATCCAAATAAGCCACCAACAGTTCGGTTTGTTTCGCGGATGTTCCATCCAAAT
ATCTATGCAGATGGAAGTATTTGCTTGGATATCTTACAGAATCAGTGGAGTCCTATTTATGATGTAGCTGCTATT
CTAACTTCTATCCAGTCGTTGCTTTGCGACCCGAACCCAAATTCTCCTGCTAATTCTGAAGCTGCAAGAATGTTT
AGTGATAACAAGCGTGACTACAACAGAAAAGTACGCGAAGTCGTTGAGCAAAGCTGGACAGCAGATTAACTGCTC
ATCCCTAACATGTGGATGTCATTTGACTTATTCTGTAAAGTTTGAAGTCTACGTAAGTAAACATTTCCACTTGAA
AACAATTGTAATACAGACATAAGAGTTATATA

> SEQ ID NO:2182 216062FL 179640_300562_1c
TCGACCCACGCGTCCGAACAATCCCCAGCCTCACCAAAAAGGACACAAAATAACGACATTCACTCTCTCTCTCTC
TCTCTCTTCCTCTTTTCTCCATTCTCGCGGGTCATCCGCCCACCATGGCCCAATCCACCGCCCACCGCCGCC
TCCTTCAAGAATACCGCGCCCTCACAAACAACCCGCCGAAGGCATCACCGCCGGCCCCGTCTCCGAGGACGACC
TGCTGCACTGGGAATGCCTCATCCAGGGGCCTGAGGGAACTCCCTTTGAGGGCGGCGTCTTTCCCGCAGAGCTCA
AGTTTCCCAAGGACTATCCGCTGGCGCCGCCGACGATGAAGTTTCTCGCTGACATGTGGCATCCGAACGTCTACC
CCAGCGGCCTCGTCTGCATCTCCATCCTCCACCCTCCCGGCGACGACCCCAACCACTACGAGCACGCCTCCGAGC
GCTGGTCCCCATCCAGTCCGTCGAAAAGATCCTCATCTCTGTTATGAGCATGCTAGCTGAGCCCAACGACGAGA
GCCCCGCCAACGTCGAGGCCGCCAAGATGTGGCGCGAGCGTCGGGATGAGTACGAAAAGACGGTCCGCGACGGTG
TTCGGCGCATGTTGGGTTTGTAACAGCGCATGTTGGGTTTG

Figure 2 continued

> SEQ ID NO:2183 216062FL 167862_300551_1c
GAATTCAAAAAGACTATAAAATCCAATCAACCTCTCCAATTCCCGGAATCCTCCTTCCTCCTCCGGTTTCTTCCT
TTTTCAGAGCACCGAGTTCCTCTGGATCCTCTCTCCTGGTTTCTTCAAATACCCTTTGGTTTTTTTCCTTTACCC
CTCTTGTAAAATCTAGGGTTTCGAGAGAAAAAAATCTTCAGAGAGGATGGCCTCCAAACGGATCTTGAAAGAACT
CAAGGATCTTCAGAAAGATCCTCCTACTTCTTGCTCCGCAGGTCCTGTTGCCGAAGACATGTTTCACTGGCAAGC
AACAATAATGGGTCCCCCAGACAGTCCATACGCAGGAGGAGTCTTTCTAGTTACTATTCATTTCCCTCCAGATTA
TCCATTCAAGCCACCAAAGGTTGCCTTCAGGACAAAGGTATTCCACCCTAATATCAACAGCAATGGGAGCATCTG
TCTTGACATCTTGAAGGAGCAATGGAGCCCTGCCTTGACCATTTCCAAGGTGTTGCTATCCATTTGCTCATTGTT
GACGGACCCAAACCCAGACGATCCTTTGGTGCCAGAGATTGCTCACATGTACAAAACCGACAGGAGCAAGCATG

> SEQ ID NO:2184 216062FL 135317_300413_1c
GTCCTCGTCCTCGCGTAGGCGCGGCGGCCGAGGAACAAGTCCGTCACGCGAACCTTCCAGAACCCCCTCCTCACA
CGTCACGCAACCTCCTCCTCCTCCTCCTCCTCTTTATTACGACTACCCCCCCCCCCCGGCGCCCCCTCCTT
TTTTCAGATTCGGAGAGACCTACTCGTCGTTAGACCGCCATGGCGTCCAAGCGGATCCTCAAGGAGCTCAAGGAC
CTGCAGAAGGATCCCCCAACCTCCTGCAGCGCCGGCCCTGTGGCTGAAGATATGTTCCACTGGCAGGCAACACTG
ATGGGTCCATCAGATAGCCCTTATGCTGGAGGCGTGTTTTTGGTTACCATTCATTTTCCTCCAGATTATCCATTC
AAACCGCCTAAGGGGGCATTCAAGACAAAGGTGTTCCACCCAAACATTAATAGCAACGGAAGCATATGCCTTGAT
ATCTTGAAGGAGCAGTGGAGTCCTGCATTGACT

> SEQ ID NO:2185 216062FL 1186661_302132_1c
CTCTCTAGGAAGGCGGAATACTCCTTCTCTTCTCTTCTCTCTCTCATACCGAGGTATTAGGGTTCCACAGGCGGA
GAGAAGAGAGAGAGAGAGAGAGAGCGTCTTTCTTCCTCTACCGCTGCTACTACTACTGCTACGACCATGTCGGGGAT
CGCCAATGCTAACCTACCGCGGCGGATCATCAAGGAAACTCAACGGTTATTGAGCGAGCCAGCCCCTGGCATAAG
TGCATCACCTTCTGAGGATAACTTACGGTATTTCAATGTTATGATTCTTGGCCCAACTCAATCTCCCTATGAAGG
CGGGGTTTTCAAATTGGAATTGTTTCTACCCGAAGAATACCCAATGGCGGCTCCAAAGGTCCGATTCCTGACAAA
AATTTATCATCCGAATATTGACAAGCTGGGGCGCATCTGCCTCGACATTTTGAAAGACAAGTGGAGCCCTGCACT
CCAAATTCGGACAGTCCTTCTAAGTATTCAGGCCCTTTTGAGTGCACCGAATCCTGACGATCCACTTTCTGAGAA
CATTGCGAAGCATTGGAAGACTAACGAGGCAGAAGCTATGCAAACAGCAAAGGAGTGGACCAGGATGTATGCCTG
TGGGGCCTGAAAAC

> SEQ ID NO:2186 216062FL 116594_300078_1c
GCACGAAACTCAAAGCATCCCCGGCGCCGCAGCTCCCCGGAGGAGGAAGCCCCCGCGCCCCGCCCCGACCAGATC
CGATGGCCAACAGCAACCTCCCCCGGCGAATCATCAAGGAGACGCAGCGACTCCTCAGCGAGCCAGCGCCGGGAA
TCAGCGCGTCTCCGTCGGAGGAGAACATGCGCTACTTCAACGTCATGATCCTTGGCCCGGCACAGTCCCCCTATG
AAGGTGGAGTTTTTAAGCTTGAACTCTTTTTACCCGAGGAATATCCTATGGCTGCTCCAAAGGTTAGGTTCCTGA
CCAAAATATACCACCCCAACATTGACAAGCTTGGTAGGATATGCCTTGACATTCTCAAGGACAAATGGAGCCCAG
CCCTTCAGATTCGGACAGTTCTTTTGAGTATCCAGGCACTCCTAAGTGCACCAAACCCTGATGATCCTCTCTCTG
ATAACATTGCAAAGCACTGGAAAGCCAATGAAGCAGAAGCTGTTGAAACAGCAAAGGAGTGGACTCGCCTGTATG
CCAGCGGTGCATAAAACCCAATGCCTCTCGTGATGTAATAACCCGTCATGCTTTAGCCTTAATCAAATGCCATTT
GCTTGATAAGAACAAACTGGAGATATTGGCAGTGGAAGGGAGTTTAAATGACTACC

> SEQ ID NO:2187 216062FL 115025_300011_1c
CAAATTCTTAAAACTATCTCCACTATCTCTTTCTCTCTCTAGACAAATTAAGAACCCTTAGCGTAAACTCTGCGA
CCGAAGAACCCCACCCACCCAGGCAGCCTTCAATTCAATTCCAATGGCGAACAGCAATCTTCCTCGCCGAATTAT
CAAGGAAACTCAACGGCTTCTCAGCGAACCTGCACCAGGAATAAGTGCATCTCCATCGGAAGATAATATGCGATA
CTTTAATGTCATGATTCTTGGTCCTACACAGTCTCCTTATGAAGGAGGCGTCTTCAAGCTCGAACTCTTTTTGCC
TGAAGAGTACCCGATGGCTGCTCCTAAGGTTCGATTCCTCACCAAAATCTACCATCCGAACATTGATAAGCTTGG
AAGGATATGTCTTGATATTCTTAAAGACAAGTGGAGTCCTGCACTTCAGATCCGTACTGTACTTTTGAGCATTCA
AGCACTTTTGAGTGCTCCAAATCCGGATGATCCACTCTCTGAGAATATCGCAAAGCACTGGAAGTCAAATGAGGC
TGAAGCTGTTGAAACGGCTAAGGAGTGGACACGCCTATATGCAAGTGGTGCATGAAGGCATTAGCAACGAAATAT
TTAAAAATAACAAAAATTATGGACTGTATCCTATTGACTTGCTTATCAATATGGATGGCTGTTAATGCCTGGACT
CTTCCGATTGCCTCCCATAATTGCTTCCCTGTCCTTG

> SEQ ID NO:2188 216062FL 1119709_301900_1c
GGCCTTATAACCTTAGTTACCTATAGTCCATTGACGGTTCGCAATCAGAATGGCTACTTCTGCGCAGCTCCGCCT
CATGTCGGACCTCAAAGCCATCCTCAGCGAGCCTCCCGAGGTGGGATTTTTTCTCTTCGTTTGATATTCGGAGAT
CAATATCCTGAAAAGCCACCTCGTGTTAGATTTACTAGCGAGATTTTCCATCCAAATGTGTACAACGATGGAACC
TTATGCATGGATATAATTCAGGATGCTTGGTCTCCCTGCCACAACATCTGCACTATATTGACTTCAATACAGTCT
TTATTGACGGATCCAAATCCAGAGAGCCCTGCTAACCCAGAAGCTGCACACTTATATCGGACCGATATTCAAGCA

Figure 2 continued

TATAATAGGAGGATCAAGCAGTGCGTAAGAAAGTCTTTGGATAGTTAATGAGTATGGAATTTCGACTGAAAGTAA
ACATGACGTAATTTGGCTCTTGCTAGGCATTCACAGGTCTAAACTAAACTATGGTTAAAGAAGATTGAATAACTC
ACTA

> SEQ ID NO:2189 216062FL 1119652_301899_1c
GAGAAGAACTGTGGTGGGTGGGGGGCCATAATAATAAGAAGAGGTATTATTATTATTATTATTATTAGTATT
ATAATGAGCTTGCAGAGAGGAGGGCAGGAGGGTAGCTTGGCTATGGCGGATGGAAAGCACTCTGGTGCCCCCGTT
GATACACATTCCGTCGCTCGTAGATTGCAGTCGGAGCTCATGGCATTGATGACCTGTGGGGGGGACCCAGGTGTA
TCTGCTTTTCCTGACGGAGACAACATCTTCTCTTGGCTTGGAACCATCAAAGGAAGCACCGCAACTGTCTATGAG
GGTCTCTCGTTCAAGCTTTCTTTGCGCTTTCCAAATGAGTACCCTTTCAAGCCTCCCACTGTGAAATTCGATACC
CCTTGCTTCCACCCCAACGTTGATCAGTATGGCAACATTTGCCTTGACATCTTGCAGGATAAGTGGTCATCTGCT
TATGACGTCCGCACCATTCTCTTGTCTATTCAAAGTCTACTTGGAGAGCCCAATAATGCTAGTCCATTGAACAGT
TATGCGGCAACTCTATGGTGCAATCAAGAAGAGTTCAAGAAGGCGATGCAAAAACATCACAAAGATGCTACTGGA
CTTAC

> SEQ ID NO:2190 216062FL 1118391_301855_1c
AGAATGGCTACTTCTGCGCAGCTCCGCCTCATGTCGGACCTCAAAGCCATCCTCAGCGAGCCTCCCGAGGGATGC
AGCGCAAGCCCTTACAATGATGATAATCTCTTTGTGTGGAATGCTACTATCTTTGGCCCTGAGGACAGCCCTTGG
GAAGGTGGGATTTTTTCTCTTCGTTTGATATTCGGAGATCAATATCCTGAAAAGCCACCTCGTGTTAGATTTACT
AGCGAGATNTTCCATCCAAATGGTGTACACAATGGAAACTTATGCATGGATATAATTCAGGATGCTTGGTCTCCC
TGCCACAACATCTGCACTATATTGACTTCAATACAGTCTTTATTGACGGATCCAAATCCAG

> SEQ ID NO:2191 216062FL 1118324_301855_1c
TATAACGGCGGTGGCTATTTAAGAACTCCAAGTAGCAGAAGTTATAGTTGAAGAGGGATCTGGATCTGAATCTGA
ATCTGTGTCATGGCTAGCAAGAGGATTTTAAAGGAACTCAAGGATCTGCAAAGGGATCCCCCAACCTCATGTAGT
GCTGGTCCTATTGCAAATGATATGTTCCATTGGCAAGCCACTATCATGGGTCCCTTTGATAGTCCATATGCTGGA
GGAGTTTTTCTGGTTACCATTCATTTCCCCCCAGACTACCCATTTAAGCCTCCTAAGGTGTCCTTCAAAACCAAA
GTCTTCCATCCAAATGTCAATAGTAATGGAAGCATTTGCCTTGACATCTTGAAGGAACAATGGAGTCCTGCTCTA
ACAATAGCAAAGGTCCTACTCTCGATATGCTCTCTTTTGACTGATCCCAATCCTGATGACCCTCTCGTTCCAGAA
ATAGCCCACATGTATAAAACAGACAGGGCAAAGTACGAGACAACTGCAAGGAGTTGGACCTTGAAGTATGCTATG
CCCTAAATAAAGCTCACCTCTTGCCTTGCATATAGTTGAGGTATATATATTATATATATACACACGTTATTAC
ATATGCAACTACTATTGCATTGCTATAATCTTTGCTAGAATCTCCAATAAGATATGTAATATG

> SEQ ID NO:2192 216062FL 1117629_301848_1c
AGAAAAGGATTGAGATCGGCAAAAGACAGAAGGATTTCGCATTCCTGGGTTTGTTGTGTGACCGAAACTGGATGG
ATAAGCCTCTTTAACCCCAACAAGGGCAGCGTTTAATCACTTTCAACAAGTCCGGGGGGTTGGTTGCATACAATC
CAACATAAGCTTTCACTTTCTTCCAAAGGCGATCAATCTCTTGCCACAATGTCCACGCCGTCAAGGAAGCGTTTG
ATGCGTGATTTCAAGCGGCTTCAACATGACCCCCCTGCTGGTATTAGTGGTGCTCCGCAGGACAACAATATCATG
CTTTGGAATGCTGTCATATTTGGGCCGGACGACACACCTTGGGATGGAGGCACTTTCAAATTGACCTTGCAATTC
TCGGAAGACTACCCCAATAAACCTCCAACAGTTCGTTTTGTGTCAAGGATGTTCCATCCAAACATCTATGCAGAT
GGAAGTATCTGCTTGGACATTCTGCAAAATCAATGGAGCCCCATATATGACGTTGCAGCGATACTTACATCTATT
CAGTCTTTGCTTTGCGATCCGAACCCGAATTCTCCTGCGAATTCGGAGGCAG

> SEQ ID NO:2193 216062FL 1117116_301818_1c
TTCCCATCTCTCTCTTTCTCTCTCTCTAGGTATGGCGTCGAAACGGATACAGAAGGAGCTGCAGGACCTGCAGAA
GGACCCCCCGACGTCATGCAGTGCCGGGCCGGCTGGGGAGGACCTCTTCCACTGGCAGGCCACCATCATGGGCCC
CTCTGATAGCCCCTACGACGGCGGCGTCTTCTTCATCACCATTCACTTCCCCCCTGACTACCCCTTCAAGCCCCC
CAAAGTCAGCTTCCAGACCAAGGTTTATCATCCAAACATCAGCTCGAACGGGAGCATTTGCTTAGACATTCTAAA
GGAACAATGGAGTCCAGCGTTGACGATTTCAAAGGTGTTGTTATCCATCTGCTCTCTGCTTACGGATCCAAATCC
AGATGACCCTCTTGTCCCTGAGATCGCTCACATCTACAAAACCCAGAAGGCTCGCTACGAGGAGACCGCCCGAGC
ATGGACCCAGAAATATGCAATGAACTAGTTGAAAAATTTCCTTACATATCCTTGCCCACCCTTCAAACTATAATA
AGCATAAGGTATGCTTTCTATATATGGAGGCTAATCGTTATTGTTTCTCCGTTGTCTTTCTCTATCATCAATCAC
AGTTTCTTG

> SEQ ID NO:2194 216062FL 158243_200002_1c
TGTTTTTAGTGAGACAAAGAGTGTGAAACTCTCTTACAATTTCTACTTTCTCTCTCTAGAAAAAAAGAGACCCTT
AGCGTAAATTTTCTGCGATCAAAAAAAGAATTCGATTCAATTCAATGGCCAACAGCAATCTTCCTCGAAGAATTA
TTAAGGAAACTCAACGTCTTCTCAGTGAACCCGCGCCGGGAATAAGTGCGTCTCCTTCGGAAGAAAATATGCGAT
ACTTCAATGTCATGATTCTTGGTCCAACACAATCTCCTTATGAAGGAGGTGTTTTCAAACTGGAACTCTTTTTGC

Figure 2 continued

CTGAAGAGTACCCAATGGCTGCTCCGAAGGTTCGATTTCTCACCAAAATATACCATCCCAACATTGATAAGCTTG
GTAGGATATGCCTTGATATTCTCAAGGACAAGTGGAGTCCTGCTCTTCAGATTCGCACCGTTCTTTTGAGCATTC
AAGCACTTCTGAGTGCACCAAATCCAGATGATCCACTCTCAGAGAACATTGCGAAGCATTGGAAGTCGAATGAGG
CTGAAGCTGTTGAAACGGCTAAAGAATGGACACGCCTGTATGCAACCGGTGCCTGAAACGGCATGACTAAGTGAT
TTTGAAAAGAAAAAGAAAAAAGATGTGGAATGTAATTTATCCACTGTCTAATCAGGGGACATGGGAGGACTGAAA
GCTAAATTACCATCTATAATATTTTCCCTACCCTTGAAATTGTATAGTCAAATATTGCACCTTTTTATTCCAAGT
TGAAGAAACTT

> SEQ ID NO:2195 216062FL 156775_301369_1c
AAAATAAAACCCCCTTTTTCCCATTCCGATCAAATTGAATCAATTGATTTAAGGTTCTTCTGAGCTGTGAAGTGC
TTGTTCTGATTATAAAGGATTGAATAAGGATGCAGGCTTCAAGGGCAAGGCTTTTCAAAGAGTACAAAGAAGTAC
AGAGAGAGAAATCTGCTGATCCAGATATTCAATTAGTTTGTGATGATTCTAATATCTTTAAATGGACGGCTCTTA
TTAAAGGGCCATCTGAAACTCCTTATGATGGCGGAGTTTTCCAGCTTGCTTTCTCAGTTCCGGAGCAGTATCCTT
TGCAACCTCCTCAAGTGCGGTTCCTGACCAAAATATTTCACCCAAATGTTCATTTTAAGACTGGAGAGATTTGCC
TTGATATTTTGAAGAATGCATGGAGCCCAGCATGGCACACTCCAGTCTGTTTGTCGAGCTATAATTGCTTTGATGG
CTCACCCCGAAGCTGATAGTCCACTAAACTGTGACTCAGGCAATCTTCTTCGATCTGGTGATATCAGAGGATATC
AGTCAATGGCAAGGATGTACACTAGACTTGCAGCAATGCCCAAGAAAGGCTAAAACAATGAGCTACAACCTCGTT
CGCACAGCTTGTAATAATGGCATTAACAAAAGTTGAATTGTTGCATATCCGTGTTTAGTGTTTTCTAACAGCAGT
GCATGACCTATTGTTTATTAATCCTTTTGTTTTTTCGCATATTTCTGATACAGCTCATCTCATTTAGCAGGTTTC
TTGTGTGCCTTTAGCAAGTGGAATATGTATAAA

> SEQ ID NO:2196 216062FL 145271_301058_1
TACGAAACCAACAAGGAAGAGAATCAAATTCTTCTATTCCCAATAATTCTCTATTCAGATTCGATCTCGGTCTCT
GAGTGATGGCTTCGAAACGGATCTTGAAGGAGCTCAAGGATCTCCAGAAGGATCCCCCTACCTCTTGCAGCGCCG
GCCCCGTCGGAGAGGACATGTTCCATTGGCAGGCCACAATTATGGGTCCCCCAGACAGCCCTTATACCGGTGGTG
TATTCCTAGTTACTATACATTTTCCTCCTGATTATCCATTCAAACCTCCTAAGGTTGCTTTTAGAACAAAAGTTT
TCCATCCAAATATTAACAGTAATGGCAGTATATGCCTGGACATATTGAAGGAGCAGTGGAGCCCTGCATTAACTA
TTTCCAAGGTTTTGCTTTCAATTTGCTCTCTTTTGACGGACCCAAATCCCGATGACCCCCTGGTGCCGGAGATTG
CTCACATGTACAAGACAGACAGAGCTAAATACGAATCAACTGCCAGGAGTTGGACCCAGAAATATGCCATGGGTT
AGAACATTACCTATACGGGCCCGAGTCCATGTAAAAAGAATTCATGTGCCTGTTCTCTCTCCTCTCTCAACCAGC
AAAGTGTAGAATAGCATTAAATGTTGTCCTCTCCAAGAAAAAGAGATGCTTTGAATATTTTTATATGGATTCTAA
CATTTTAAGAAATCTGGGAACTGTTTATTTATCTGGTT

> SEQ ID NO:2197 216062FL 136820_300439_1c
GAACGGCTGCGCGTCTTCCCGTTCGTCCTCCTGTCCGGTCCGAGCCCCTCTGACGACGCGACTTTCCCCACGCCG
GGATCGAGCTCCGGGGAGGGGAGCTGCGAGCTGAAACACTTTGTCATATCAGTCAACAGTAGAGAGGAGACCAGA
TGCAGGCATCTAGAGCTAGGCTCTTTAAGGAGTATAAGGAGGTGCAGCGAGAAAAGTCAGCTGATCCAGATATCC
AGTTAATCTGCGATGATTCAAACATATTCAAGTGGACTGCTCTTATCAAGGGCCCTTCGGAGACACCTTTTGAAG
GTGGTGTATTTCAACTTGCATTCTCTATTCCTGAGCAATACCCTCTCCTTCCTCCGCAAGTTCGCTTCTTGACCA
AAATTTTCCACCCGAATGTGCATTTCAAGACAGGTGAGATTTGCCTGGATATCTTGAAGAATGCGTGGAGCCCAG
CATGGACACTACAATCCGTTTGTAGAGCCATAATTGCATTGATGGCCCATCCTGAACCAGACAGTCCACTTAACT
GTGACTCAGGCAACCTCCTGCGCTCAGGCGACATCAGAGGCTATCAATCCATGGCAAGAATGTATACTAGGTTGG
CTGCCATGCCAA

> SEQ ID NO:2198 216062FL 126473_300463_1c
GCCATTACGGCCGGGAATCAAAATCTATCTCAACCCTTCTGTCTTCTTCTTCCCCTTCAGTTTCTCAAAAATTCT
CAAGAAGAAGAAGAAAGAAAGAAAAAAATCGTCTCCTTTTCTGTTCAAAAAAAATATATCTTGAAATTAAAAATT
CAGATGGCTACAATGAACAGTGGAAACAACAGCAATACTCAAGCAACTGCTCAGGTTATGCCTTCACCTAAACAG
AGTTTGCCTACTGCAAAAACTGTTGATACCCAGTCTGTTCTTAAAAGGTTGCAGTCTGAATTGATGGCTCTAATG
ATGAGCGGTGATTCTGGGATATCTGCATTTCCTGAAGAAGACAACATATTTGTTTGGAAAGGGACAATAACTGGT
AGCAAAGATACTGTTTTTGAAGGAACAGAATACAAGCTCTCTCTTTCATTTCCTGCTGATTACCCTTTCAAACCA
CCAAAGGTTAAATTTGAGACTGGTTGCTTTCATCCCAATGTTGATGTCTATGGCAACATATGCTTAGACATTCTT
CAGGATAAGTGGTCATCTGCTTATGATGTGAGGACTATACTGATTTCCATTCAGAGTCTGCTTGGAGAGCCAAAC
ATAAGCTCACCTCTAAACACTCAAGCTGCTGCTCTTTGGTGCAATCAAGAAGAATACAGAAAGATG

> SEQ ID NO:2199 216062FL 125232_300629_1c
GGCGTCGATTCTCTTTGACACTCGTGCCGCTTCATCACTCAGGCGGTCAGGGATGTCGACGCCAGCGAGGAAAAG
ATTGATGAGGGATTTTAAGAGGTTACAGCAGGATCCTCCTGCCGGCATCAGTGGTGCTCCGTATGACAACAATAT
TATGCTCTGGAATGCCGTTATATTCGGTCCTGATGACACACCTTGGGATGGAGGTACGTTCAAGCTCACCCTTCA

Figure 2 continued

GTTTACGGAGGACTACCCCAACAAGCCTCCAACTGTGCGGTTTATTTCCAGGATGTTCCATCCAAATATTTACGC
CGATGGAAGTATATGCTTGGACATACTGCAAAATCAGTGGAGTCCTATATATGACGTAGCTGCTATACTTACTTC
AATCCAGTCTTTGCTCTGTGATCCAAACCCAAACTCGCCAGCAAATTCAGAAGCAGCACGCATGTTTAGTGAGAA
TAAGCGCGAGTACAACAGGAAGGTGCGTGAGATTGTTGAGCAGAGCTGGACAGCAGACTAACATCTCTCAGGCTG
AATCTGTTTTGGGAGATTTTCCTGGTACCGCCTGTGTCGAGCTGAAAACTTTTCAGTGCCGTTGCTACATTAAAA
ACAAATGTAGCAGGAAATTGTACTTTTATGTGTTGTAGGAAACTCTGATTGCCTTTATCTTCATGTTCTGCTACT
CGACTATGAGACGTTGTACATATGATGATCTCTTGT

> SEQ ID NO:2200 216062FL 124562_300423_1c
AGAAATCAAATCGACCCCTTACTCCTCTAAATCCCCACACCCATCTCTCTCTCTCTCTCTCCTCAATCGAAGG
ATCCGACAATAAAAGTTGATTGTCTTCAACATCTGTCTACCAGCAAAAACTACTTGCGTGCAGTCGCCAACTGAT
CCTAGGATTATACTTACATTTGGCTATGGCAACTAATGAAAATCTCCCACCCAAACGTGATAAAACAATTGGCAAA
GGAATTGAAAAATCTTGATGAAACTCCTCCTGAAGGCATCAAAGTAGGTGTCAACGATGATGATTTTTCAACCAT
ATATGCTGATATCGAGGGGCCAGCTGGGACTCCTTACGAGAATGGGGTTTTCCGCATGAAGTTGATTTTGACGCA
TGATTTCCCTCATTCCCCACCCAAAGGTTATTTTCTGACCAAGATTTTTCATCCCAACATCGCTTCCATTGGCGA
AATTTGTGTCAATGCTCTGAAAAAAGATTGGAATCCTAGTTTGGGCCTACGACATGTTCTCATGGTGGTAAGGTG
TTTGCTGATCGAGCCATTTCCAGAATCTGCGTTAAATGAGCAAGCTGGTAAATGCTGCTTGATAATTATGATGA
GTATGCTAGACATGCAAGGCTTTATACCAGTATTCATGCTAAACCAAAGACTAAGTTAAAAACA

> SEQ ID NO:2201 216062FL 121412_300357_1c
ATTTGATCGGAGGGTGAATATGTCGACGCCAGCAAGGAAGAGGTTGATGAGGGATTTCAAACGACTGATGCAGGA
TCCTCCAGCTGGCATAAGTGGGGCCCCACAGGACAACAATATAATGCTTTGGAATGCTGTAATTTTTGGCCCTGA
TGATACTCCTTGGGATGGAGGTACGTTCAAGCTGACACTTCAGTTTACTGAAGATTATCCTAACAAGCCACCTAC
AGTGCGATTTGTTTCTCGGATGTTTCATCCTAACATTTATGCTGATGGGAGCATATGCTTAGATATACTACAAAA
CCAGTGGAGCCCCATATATGATGTAGCTGCTATACTCACATCCATCCAGTCGCTGCTTTGCGATCCAAACCCAAA
TTCACCTGCCAACTCTGAAGCTGCCCGCCTATTCAGTGAGAACAAGCGGGAATACAACCGAAAAGTTCGTGAGAT
AGTGGAGCAGAGCTGGACCGCGGACTGATCCACTCCATCTAACCATATGATGCCTGATACTTAAAACGCTCATCT
TTTCAGTGTGTCGTGTACCAAACTGCTTGTAATTAAAATGCTAAAACAGTAAAACGTGC

> SEQ ID NO:2202 216062FL 120926_300518_1c
CGGACGCGTGGGCGCAAACGGCGAAGCAGAAGGGGGAAGAGAGAGAGAGAGAGAGAGAGAGAGGGGACTCA
GCGAGCGGTGGGCGAGAGGGGGAGATCGAAACCCTAGCTAGGGTTTGCGCGCGGCGGCGGCGGGGATGTCGACGC
CGGCGAGGAAGCGGCTGATGCGGGACTTCAAGCGGCTGCAGCAGGACCCGCCCGCGGGGATCAGCGGCGCGCCGC
ACGACAACAACATCATGCTCTGGAACGCCGTCATCTTCGGGCCGGATGATACGCCGTGGGACGGAGGCACGTTCA
AGCTTACCTTGCAGTTTACAGAAGATTATCCCAACAAGCCGCCGACTGTTCGGTTTGTTTCTAGGATGTTCCACC
CAAATATTTATGCAGATGGAAGCATCTGCTTGGATATTCTACAGAACCAGTGGAGCCCTATATATGATGTTGCTG
CCATATTGACTTCAATTCAGTCTTTGCTGTGTGATCCAAACCCCAACTCTCCAGCAAACTCAGAAGCTGCCAGAC
TGTTTAGTGAGAACAAGCGAGAGTACAACCGCAAGGTTCGTGAGATCGTGGAGCAGAGCTGGACAGCTGACTAGG
GCATGCAGCAGGGCAACGGGTGGTATCCACCATGCC

> SEQ ID NO:2203 216062FL 1197049_302200_1c
ATGGCTTCCAAAAGGATTCAGAAGGAGCTGAAAGACTTGCAGAAGGACCCCCCCCACATCATGCAGTGCAGGTCCT
GTTGCGGAAGATATGTTTCACTGGCAGGCAACAATTATGGGACCAGATGACAGTCCTTATAGTGGTGGTGTGTTT
TTGGTGACGATTCATTTCCCCCCAGATTATCCCTTCAAGCCCCCCAAGGTTGCTTTTAGGACCAAGGTTTTCCAC
CCAAACATCAACAGCAATGGGAGCATTTGCCTGGATATATTAAAAGAGCAATGGAGTCCAGCTCTGACAATATCT
AAGGTCTTGCTTTCAATCTGCTCACTTCTCACTGATCCAAACCCCGATGATCCTCTGGTACCTGAGATTGCACAC
ATGTACAAGATAGACAGAGCAAAATATGAAGGTATTGCAAGGAGTTGGACACAGAAGTATGCAATGGGTTGAGCC
TTTTTTTTCGGCAAAAGATAACAACTTTTATCAGTCTATCTCATATCTAAAAAGAATCGGTTTACAACTTTCTGT
TTCTGCATCTTGTTGGTCCAAAGCTCAAATCACACGTGTATCTTTACTTTCATAGCCAAGGAGTTGATATAGAAG
TAGTGCAAGGAACAGGTAC

> SEQ ID NO:2204 216062FL 1190701_302176_1c
TCCGCTCACTCACTTACTCACTCACTGCTTACAGATTTAGGGATTCCAGAAAGCAAGCTGTGCGAGCGGTCCTTC
ATGGCTCTGCTGATCTAGTTGAAGATTACCTGACCTGACTTCGTTCCTCCATGGCAACAAATGAAAATTTACCAC
CTAAAGTCATAAGGGAGCTGGCTCGGGAGCTAAAGGCATGGATGAGAGCCCTCCGGCGGATATCAGAGTGCTAG
TTAATGAGGACAATTTGTCCATCATATATGCAGATATTGAAGGACCATCTGGCACACCATATGAGGGAGGCGTCT
TCCGCTTGAAGTTGGTCTTAAGTCAAGATTTTCCGAATACACCTCCCAAGGGATATTTCATCACAAAGATTTTTC
ATCCAAATGTAGCCAACAATGGGGAAATATGTGTGAATGTCCTAAAAAAGGATTGGAAGCCTGTGTTGGGGTTGC
GACACATTCTTTTGGTAATCAGATGTTTACTCATCGAGCCATTCCCTGAATCTGCCTTGAATGAGGAAGCGGGGA

Figure 2 continued

AAATGCTTATGGAAGATTATGAGGGCTATGCGAAACATGCCAGGCTAATGACGAGTATCCATGCAAACAAATTGA
GGGCAAAGACTAGCAATAGCATGAATGCGGGTGGTCCAGGTCCAACTGAACTGGTAAGCTCTATGACTACTAACA
ATAGCATTTTAACTCCAAGCTCAGATGCGGGT

> SEQ ID NO:2205 216062FL 143665_200045_1c
CGGTAGTAGTAGTGGAGGAAGAACATGGCCGTCGACGACGTCGGTGTCTAGTTCCGGTAAGAGAATACAGAAGGA
AATGGCTGAACTAAGCATAGAGGCGCCACCAGATTGTGCAGCTGGGCCTAAAGGCGATAATCTTTACCATTGGGT
TGCCACCCTCTTCGGCCCACCTGGAACACCTTATGAGGGTGGAATATATTTTGTCGATATAACCTTCCCTTCTGA
TTATCCATTTAAACCTCCAAAGGTTGTATTCAAAACTCGCATATATCATTGCAATGTCGAGCCTTCTGGAAATGT
TAGCTTGGACATCCTAACAGATAACTGGAGTCCAGCATTAACAATCTCGAAAGTACTACTTGCTCTGAGATCAAT
GTTCACCACTCCAGAAACCTATAAGCCAGTTGTTCCTGGTATTGCACACTTATACTTTGAAGATAAAGCCAAACA
TGATGAAATAGCTACACAATGGACACTGCGATTTGCAAGGTGAAAAAAATGAATTCAATGTGGAATTTTCTTAAC
CAAGTTCTGGTCAGCCCCCTG

> SEQ ID NO:2206 216062FL 1116844_301815_1c
CCCACGCGTCCGTTCAGTTTGGGGTGAGTTTGAGGGGTCAGTAGTAGTAGCAGTAGCAGGGGAAAGGGGAAGGGA
GAGCGGTATGGCTTCCAAGCGGATCCTGAAGGAGCTCAAGGACCTCCAGAAGGACCCCCCCACCTCTTGCAGCGC
AGGTCCTGTAGCCGAGGATATGTTTTATTGGCAAGCAACAATAATGGGTCCACCTGATAGTCCATATTCTGGGGG
GGTGTTTTTGGTCACCATTCATTTCCCTCCTGATTATCCCTTCAAGCCTCCAAAGGTTGCTTTCAAAACTAAAGT
CTTCCACCCGAATGTCAATAGCAATGGGAGTATCTGCTTGGATATACTGAAGGAACAGTGGAGTCCGGCTCTTAC
CATCTCCAAGGTTCTTCTGTCAATATCCTCTTTGCTTACCGACCCCAATCCAGACGATCCCCTCGTTCCGGAGAT
TGCACACATGTACAAAACGGACAGGATGAAGTATGAAACAACTGCAAGAAATTGGACCAGGAAGTATGCCATGGG
ATAAAAGACAGGATCTCGTTTCTTCTCATAC

> SEQ ID NO:2207 216062FL 1116092_301809_1c
TCTGTTTTTCTGTGAATCCCTCGCAGAGAGTATCTCCACTACTAGCGCGCCAGAGATTTTCTGCCATCCTGTCGT
TGCGGGAATTGTTATTATAAAGAAAATGAGCTTGAACAGAGCCTCAGGCGTGGTGATGAACGGGGTGATGGGTGA
CCCTGCTGCCCCTGTCCCTGCTGCAGCTGCTGGAAAGCAGTCTGCCCCTGCCTCCCATCCCGTCGAAACTCACTC
CGTCTCTCGCAGATTGCAGTCGGAGCTCATGGCATTAATGACAAGCGGAGACCCAGGCGTGTCGGCCTTCCCGGA
CGGAGACAATATTTTCTCATGGATGGGAACCATCAAGGGGGGAACCGGAACTGTCTACGAGGGAATGTCTTTCAA
GCTCTCTTTACGCTTCCCCAACGAGTACCCATTCAAGCCTCCCACTGTGAAGTTCGACGGTGCATGCTTCCACCC
GAATGTCGACCAGTTTGGCAACATCTGGCTCGACATCCTCCAAGACAAGTGGTCATCTGCTTACGATGTGCGTAC
AGTCCTTCTCTCCATTCAAAGTC

> SEQ ID NO:2208 216062FL 1111370_301534_1c
GAGCGCATCTCAAAAGCCCCAAGCCTAGGGCCTGTCTTCCCCTTGGAACAAAAGCACCCCCCACCCATAGCCATT
AGCCATTAGCCATTATGTCAGAAACTCAGGCTAGCCTTCTCCTTGGCAAACAACTTAGAGAGCTTTTAAAATCTC
CAGTGGAAGGTTTCTCAGCAGGGCTGGTGGATGATTCTAACCTCTTTGAATGGAATGTGACCATTATTGGTCCTC
CTGATACATTATATGAAGGTGGTTTCTTCAATGCCATTATGAGCTTTCCCAAAAATTATCCAAATAGTCCTCCAA
CAGTCAGGTTCACCTCTGAGATGTGGCACCCAAATGTGTATCCGGATGGCCGTGTTTGTATTTCCATTCTTCATG
CCCCGGGGGATGATCCAAATGGATACGAACATGCTAGCGAGCGGTGGTCACCAGTGCACACGGTGGAAACCATTC
TATTGAGCATCATTGCAATGCTTTCCAGTCCGAACGACGAGTCTCCGGCAAATATAGATGCAGCAAAGGAATGGA
GAGAGAACAGGGCGGAGTTTAAGAAGAAAGTGCGTCGCATTGTACGGCGATCTCAAGAGTGTCTCTGAATTTGGC
AATATACCAGGGTATGTATCCTCATTGAGAAACCCTTGAAACTTCTCTGAATTGATAGAAAAAAGGAAGGGACAT
ACATATATATCAGA

> SEQ ID NO:2209 216062FL 1110673_301541_1c
TGCTTACAGGCGTTAGAAGAGAAGACGGAGAGAGAGAGAGAGAAGGGAAGTCCAGGCGTCTCTATCTTTCTTACT
CTGCCCTTCTCAGCATTCCCACTGCCATGTCCACCCCTGCACGGAAGCGCTTGATGCGCGACTTCAAGCGGCTTC
ACCATGATCCCCCTGCTGGCATAAGTGGTGCTCCTCAGGACAACAACATTATGCTTTGGAATGCTGTCATCTTTG
GGCCGGATGACACACCATGGGATGGAGGTACGTTCAAGCTGACATTACAATTTTCTGAGGACTATCCAAATAAGC
CTCCGACGGTCCGTTTTGTGTCGAGGATGTTCCACCCAAACATTTATGCCGATGGAAGTATCTGCCTGGATATTC
TGCAGAACCAATGGAGCCCAATCTATGATGTCGCAGCAATACTTACATCCATTCAGTCTTTGCTCTGCGATCCAA
ACCCGAACTCTCCGGCAAATTCCGAAGCAGCACGAATGTATAGCGAAAACCGGCGAGACTACAACCGGAAAGTGC
GCGAAATAGTGGAGCAAAGCTGGACGGCTGAATGATGGATGAACTGTCTACCTCTAGTGATATACAAGTGTGTCG
AAACAGTTGCATGAGGTTGAACTAATTCTCTCCTTTTACAAGTTTGGCACTTTCGTAAAAATTCT

> SEQ ID NO:2210 216062FL 110920_300048_1c
CCCACGCGTCCGGTCGTTGCTTAATTACTGTTCATTCACAGGAGGATCCTAATCTCTTTCAGGAGTCGCTATGGC

Figure 2 continued

TTCAAAGCGGATCTTGAAGGAGCTCAAAGATCTTCAAAAGGATCCTCCTACTTCGTGTAGTGCTGGACCTGTTGC
TGAGGACATGTTTCATTGGCAAGCAACGATAATGGGTCCTCCAGATAGTCCTTTTTCTGGTGGTGTTTTTCTGGT
GACGATTCATTTTCCTCCAGATTATCCATTCAAGCCACCTAAGGTTGCTTTCAGGACAAAAGTTTTCCACCCAAA
CATAAACAGCAATGGGAGCATATGCCTTGACATTTTAAAGGAACAGTGGAGCCCTGCCCTAACGATTTCCAAGGT
GTTGCTTTCAATATGTTCTCTTTTGACGGACGCCAATCCTGATGATCCTTTGGTCCCAGAGATTGCACACATGTA
CAAGCAGACAGGAACAAGTATGAGACAACTGCAAGGAGCTGGACCCAGAAGTATGCCATGGGCTAAACGTACCT
TTGTATCATGGGGTCAAGGGCATTTTACTTTCAGATACTTCACTATTTACATTCAATGTACTAATCTGTTCTTTG
AGTTGTAACATGGAGTCCATGTCTTAAGAGGAAAGGAAAATCATGGACGCTGCTCCTAAAAGTTTGTATGTGCAA
ATTGATCTTTGAAAGAAACCAATTAATTAGACTTTTCTTTC

> SEQ ID NO:2211 216130FL 210976_300894_1c
AAACAACCATGCCTCACAAACACAAGTCAAAAAGGGCGAATTTGAAGCAGAGTTCGTTTGTGAGCGTACCATGA
GTAGATTTCACTGACTAATCTTGGAGCTAGATTCGATCTCGCCCCTACAGAGAAAGCGCGATCTCTTCCAGTAAA
CAAACGAAAAGCGGCATCAAGTTCTGGAGAGCAAGTCACAAAGAAGCGTGCCAGAAGCTCATTAAGAGGCAATGA
CACTCCGCGAGCATTCAAGAGAATCATGGCTGTGGCAGGGGGGAAGAAAATTAGATCAGGCTTGGATGATGGTCA
ACTCGACAAAACGACTACGAAGGCTACCGATGTAACGAGCGAGAAACTTCAAATTCGTCCCGGTGAAAATTTAGG
GGCCTTTGCCAGCCGGGTTGATGCGGCTCTACCAGTATCAGGGCTTGCGAAGAAACCAGCACGAATGCAGAGGG
CAAAGACGCATTAGGATTGAAAGTGTATCGCACTCGCAAAGAGCGCAAAATGCACAAACTCTACGATCAGTGGAG
GGCAGAGGAATCCAAGATACGAGAAAAGAGGGAGGAGGAGCTAGAGCGCATAGCAGAACGCGACTTGGAAGACGA
TGCTGCCGGCATTCTTACTTCAGCTGCCTTCGAAAACGACAATAGCCACACGAAAAAGAGGAAGGGGGGCAAGAG
GAAGAGAATAGTAGAGGAAGA

> SEQ ID NO:2212 216131FL 195983_300639_1c
GCGCTGAGAAGCCTGCATCGCCCGCCATGGCCATTACGCCGACCCAATTCGCCAAGAAGACGGCGCAGTCGACCA
GCTGGTCGGATGCGAAGCGTCGAGTCCTTTCTTCGTACCGCGAATGGATCCGAGCTGCGCCTGAGATCCAGACCA
TGTACAATGTCCCTCTCCCCATTTCTACCCTCCGAACACGGATGCGACAAGAGTTCGAGCGACACCGATACACGA
ACCAGCTGTCCATAGTTGACGTGCTTCTCTTCAAGTCCCATGCAGAGTACCAGGAAACAATGAACTTCTGGAAGC
AGCAGACTCACATCTTGTCTTATTTCGGCGAAAACTTTAGAGGTGACAAGAGGCTTCCGTCCAGCTTCATGGCTG
GTTTCCTTGAGGGTCGAAATTAGAAAGACAATGCAAGAAAGTTTGTTTTGTAAATATCTCTGTATAAAGATTTTG
TGCCGAAACCCTCCAATAAAAAAAAACACAACAACAC

> SEQ ID NO:2213 216268FL 103453_300026_1c
TGGTATCAACGCAGAGTGCCATTACGCCGGGGACTCACAACAGAAATAGCTACTAAACAAACAGCAAAAGATAAC
CAGAAAAGATGGCGACTTTCCCTGTTGTTGATTTGGGGTTGCTTCAAACTGGGAAAAGGGCTGAAACATTGGATA
AAATCAAAGATGCATGTGAAAACTGGGGTTTCTTTGAGCTTGTGAATCATGGGATTTCCCATGAAGTGTTGGACA
CAGTTGAGAAGCTTACTAAGGAGCATTACAAGAAATGCATGGAGCAAAGGTTCAAGGAAATGGTGGAAAGTAAAG
GTCTTGAGGCTGTCCAAACTGAGATTGATGATCTGGATTGGGAAAGCACTTTTTACTTGAAACACCTCCCTGTTT
CCACTGTGTATGAAGTTCCAGACTTAGAGGATAAATACAGAAATGTTATGAAAGACTTCGCGTTGAGTCTAGAGA
AACTAGCTGAAGATCTTCTTGATTTGCTGTGTGAAAATCTCGGGCTCGAGCAAGGTTATTTGAAGAAAGCATTTT
ATGGTTCAAAGGGTCCAACTTTTGGTACCAAAGTTAGCAACTATCCTCCTTGCCCCAAACCAGAACTGATCAAAG
GCCTACGTGCTCACACTGATGCTGGTGGCCTAATCCTGCTTTTCCAAGATGACAAAGTCAGTGGTCTTCAGTTAC
TGAAAGACGGTAATTGGATTGATGTCCCACCTATGAAACACTCGATTGTTATCAACCTTGGCGACCAGCTGGAGG
TCATAACAAATGGAAAGTACAAGAGTATTGAGCACAGAGTTATTGCACAACAAGATGGCACTAGAATGTCAATTG
CTTCATTTTATAATCCAGGAAGTGATGCTGTGATATTTCCAGCACCAGAATTGGTTGAAAAGGCAGAAGAAGAGA
ACAAGTTGAAGTATCCCAAATTTGTGTTTGAAGATTACATGAAGCTGTATGCAGGT

> SEQ ID NO:2214 216268FL 1110522_301790_1c
GTATATTGCCGAGGAGGGCGCTGTCAGAGATTGGAGGGACTACCTTTACCTCCACCTTGACCCTCCCTCCACTAG
AGATTATAACCATTGGCCTGTGGATGCAAGTTTTAGGGAGACCGTTGACAAATATAGCAAGGAGACCCTAAAGGT
TGGGAAAAGTTGTTAAGCCTCTTATCTGAAAATTTGGGTCTTCATCCATCTTGTTTTGAGGAGCATCTAGTAAA
AATTCACCAAAAGATGCTCATTAACTACTACCCTCCATGCCCAGAGCCTGAGTTGACCGCAGGATTTCACAAACA
TTCCGATTTTGGAGCCATAACATTAGTGATGCAAGAAGTTGGTGTAGTTGGCTTGCAAGTCCACAAAGATGGAGA
GTGGATTCCAATCATCCCAGAAAAGGTGCTTATGTGGTGAATATTGCAGATCAAGTGGAGATTTTAAGCAATGG
ACGATACAAGAGTATAGAGCATCGTGTAGTCACAAATCCCTACAAGTCTCGAATATCTGTACCTGTTTTCCATGA
TGCAGCTCTTGATGCTGTTATTTCTCCTATTAACAATATCTTGAAAAATGAAAATGATTGCCAATACAAGAAATG
CAGATTTGAGGACCATGAGATAACATTCTATTCCTATGGAGCAAAT

> SEQ ID NO:2215 216268FL 1108731_301520_1c
AATTGTTGGAGATCCTCTGCAAAGAACTGGGATTGGACGAAAACTACATAACTCAACACTTGGACAATGGAAGCA

Figure 2 continued

ACTCGGTGTTTCGCTTCAATTTCTACCCCCCTTGCCCAAAGCCTTCCATGATGATGGGATTGGGAGCCCATTCTG
ACCCTCACATTCTGACAATCCTACATCAAGATCAAATTGGCGGGCTCCAGGTCTTTAAAGACTCTAAATGGATCG
GGGTGCGACCTCAGGCCAACTCGTTAATCATTAATGTTGGCGACGCTCTCCAAGTGTGGAGCAACGGAATCTACA
AGAGCATCGAACATCGAGTCGTGTGTAACAATATGAGTGGCCGGTTGTCTATGGCTTTTTTTCTCAATCCAGGGG
AGGACACACAGATAACACCTGCCCCGAAACTATTTAACAGTGACTATGAGCACTGTAGCAAATACAAGAGCTTTA
CATGGAAAGAATATCGCCAATCCATGTACGCTTACAGACTGAAGGGGAAAAGCAACCTCCAACGCTTCACCCTCC
ATTAGCATTATTAATAGGCTAAAAAAATGCAAGGCTCTTCTACCTTGCTTGGGAAACTCTCAATGTCCTTAGTTG
GCATTAGAAAATTTGATGTAGTTACAAAATAAACT

> SEQ ID NO:2216 216268FL 56232_300126_1c
AACAAAAGTTCAATGACATGCTCAAGTCCAAAGGTTTGGATAATCTTGAGACAGAAGTCGAAGATGTGGATTGGG
AAAGCACTTTCTACGTTCGTCACCTCCCTCAATCCAATCTCAATGACATTTCAGATGTGTCTGATGAATACAGGA
CGGCCATGAAAGACTTTGGTAAGAGACTGGAGAATCTTGCTGAGGATTTGTTGGATCTACTGTGTGAGAATCTAG
GGTTAGAGAAAGGGTATTTGAAGAAA

> SEQ ID NO:2217 216268FL 43403_300149_1c
CCCACGCGTCCGCTTCATATCTTCTTATTCATACACTAAATAAAAGCACATTTCTTCAATTCATTCTGCAAGAAA
GATGGAGAATTTCCCAATTATCAACTTGGAAAAATTAAATGGTTCTGAAAAAGCTGCCACCATGGAAATGATTAA
GGATGCTTGTGAAAACTGGGGCTTCTTTGAGTTGGTGAACCATGGAATCCCACATGAAGTAATGGACACAGTTGA
GAAATTAACAAAAGGGCATTACAAGAAATGCATGGAACAGAGGTTTAAGGAATTGGTGGCCAGTAAAGGTCTTGA
AGGTGTACAAGCTGAGGTTACTGATATGGATTGGGAAAGCACTTTCTTCTTGCGCCATCTTCCTGTTTCTAACAT
CTCTGAAGTCCCTGATCTTGATGATCAATACAGGGAGGTTATGAGAGATTTTGCTAAAAGATTAGAGAATTTAGC
AGAGGAGCTCTTGGATTTGCTCTGTGAAAATCTTGGTCTAGAAAAGGGATACTTGAAAAAGGTATTTTATGGATC
AAAGGGTCCAAATTTTGGGACTAAAGTTAGCAACTATCCACCATGCCCAAAACCAGATTTGATTAAAGGACTGCG
CGCCCATACGGACGCTGGTGGCATAATCCTTCTCTTCCAAGATGACAAAGTAAGC

> SEQ ID NO:2218 216268FL 269688_200209_1c
GTAATATTCGCTATTCTATTAATTTATTGTATCACATTTTTCACACACTCAAAAATTAAACACATATTTTACCAA
GAAAGCTATGGAGAACTTCCCAATTATCAACTTGGAAAAGCTCAATGGTTCTGAGAGAGCTGACACCATGGAAAT
GATTAAAGATGCTTGTGAGAACTGGGGCTTCTTTGAGTTAGTGAACCATGGTATTCCACATGAAGTAATGGATAC
AGTGGAGAAAATGACAAAGGGACATTACAAGAAGTACATGGAACAGAGATTTAAAGAATTGGTGGCTAGCAAAGG
TCTTGAAGCTGTGCAAGCTGAGGTTACTGATCTTGATTGGGAAAGCACTTTCTTCTTGCGCCATCTTCCTAATTC
TAACATTTCTGCAGTACCTGATCTTGATGATCAATACAGGGAAGTAATGAGAGATTTTGCTAAAAGGTTAGAAAA
TTTGGCAGAGGAGTTACTGGAGTTGCTATGTGAAAATCTTGGCCTTGAAAAAGGCTACCTGAAAAAGGTGTTTTA
TGGGACAAAAGGTCCCAATTTTGGAACTAAGGTTAGCAACTATCCTCCATGCCCAAAACCAGATTTGATAAAGGG
ACTGCGCGCCCACACAGATGCAGGTGGTATAATCCTTCTCTTCCAAGATGACAAAGTAAGTGGCCTTCAACTCCT
C

> SEQ ID NO:2219 216268FL 267836_200119_1c
GTCCGGGAGATTCCGGTGATTGACTTAGTAAGCTTGACGGCGAGGAGAGAAGTGCAACCATGGCACTTCTCCATA
CGCTTGTGAGAAATGGGGCTTCTTTATGATAGAGAACCATGGAATTGACACTAACCTGATGGACAATGTGAAGCA
GCTCGTGATTCAGCACTATGAAGCCAATATGAAGAAACGGTTCTATGAATCAGAGCTACCTATGAGCTTAGAGAA
GAAAGAAAAACTCAGCAACACAGACTGGGAAAGCACCTTCTTTCTTTGGCATCGTCCAAGTTCTAACATCTATGA
GATTGAAGGTCTCTCAAAGGATCTTTGCAACGCAGTAGATGGATACATTGATCAGCTGATTAATCTTGCTGAAAA
TCTTTCAGAACTAATGTGTGAGAACCTTGGCCTAGAGAAGAGTTACATTAAGGAAGCATTTTCAGGAAGCAAGGG
TCCTTCTGTTGGAACAAAAGTGGCAATATATCCTCAATGTACGCGCCCTGAATTAGTCAGGGGATTGCGTGAGCA
CACAGATGCTGGTGGTATCATTCTCTTACTCCAAGATGAACAAGTTCCTGGTCTGGAATTCTTTAAAGATGGACA
TTGGGTGAAAATTCCACCTTCCAAGAACAACAGAATTTTTGTAAACACTGGTGATCAAATCGAAATTTTAAGCAA
TGGGAT

> SEQ ID NO:2220 216268FL 243488_301339_1c
GCGTCCGGAACAATGCCGACTCAGGGAGTGAAGGAGCTAGTGGAGAATTCTCAAGATCATATACCAGATAAGTAT
ATCAAGCCCGAGCGTGCCCGTGTTAGATACAACAGTTCCACAGCAGGGATTCCCCTCATTGACCTCGCTGAAATC
CATGGACAAGGAAGAAGTGATGTTCTTCGTGCCATAAGAGATGCGGAGGAGAGTGGGGATTCTTCCAGGTGATC
AATCACAGCGTTCCACCAGCTTTGATGGAGGCTATGATGAAGGCTGCTCGTGAGTTCTTCGACCTGCCTCTAGAG
GAAAAAATGGCATATTTTTCTGAAGATTTTGAGGAGAGAATTCGTTTCTGCACCAGCTTTGTTCCTTCAACGGAA
GAACGCTGGGACTGGCAAGACAACCTCTCGCATACTTTTCCACCTTACGGAGACGATCACCCCTGGCCAAAGAAG
CCACACTTGTACGAGGAAGTTGCGAAGGAGTATCTCCACCAGGTTTTGGAGCTGGGGAACGCAATCGCAGGTGCA
ATCTCTGAAAGCTTGGGCTTAGAAAAAGACTTTCTCCTAAAGGCGTTCGGAGAGGGCAGGCACAACATGCGTCTA

Figure 2 continued

AACTATTATGCACCTTGTCCAAGACCCGATCTTGCAGTGGGCTTCAGTCCTCACTCCGACTTCGGAGGTTTTACC
ATCCTGATGCAAGACCAAGTAGGAGGGCTTCAGGTGAAAAAGGACGAGGACTGGTACTTTGTCAAACCAGTCAAG
CACTCCTTCGTGGTCAATATCAGTGATCAACTCGAGATATTTAGCAACGGTAGGCTCCGGAGTGCCGAACACCGA
GCTACGGTGAACTCAAGCTCCGAAAGGATTTCAATTGGCTACTTGCTTTGAGCCTTCT

> SEQ ID NO:2221 216268FL 209068_300811_1c
GACACACAGACGCACTCACACACTCAGCTGAAGCGAGCGAGCGAGTGAACGAGAGAGAGAGACAGAGATGGCGAG
TGTTGCCTCCTTCCCGGTGATCAACATGGAGAACCTGGAGACCGAGGAGAGGGGCGCAGCAATGGAGGTCATCCG
CGACGCCTGCGAGAACTGGGGCTTCTTCGAGATGCTGAACCATGGCATCGCGCACGAGCTGATGGACGAGGTGGA
GCGGGTGAGCAAGGCGCACTACGCCAACTGCCGGGAGGAGAAGTTCAAGGAGTTCGCGCGGCGGATGCTGGAGGC
CGGCGAGAAGGGCGCCGACGTGAAGGGCATCGACTGGGAGGAGCACCTTCTTCGTCCGCCACCGCCCCGTCTCCAA
CCTCGCCGACCTCCCCGACGTCGACGACCACTACAGGCAGGTGATGAATCAATTTGCGTCGGAGATCGAGAAGCT
CTCGGAGAGGGTGCTGGACCTGCTGTGCGAGAATCTGGGCCTGGAGAAGGGTTACCT

> SEQ ID NO:2222 216268FL 187871_300681_1c
CACAACCCAGCTGGTGAAAGAGAGGAACTTGAGAGTTAGCTAGCATGGCGGCAGCATTGTCGTTCCCGATCATCG
ACATGAGTCTGCTCGACGGGGCAGAGAGGCCCGCGGCGATGGGGCTGCTCCGCGACGCATGCGAGAGCTGGGGCT
TCTTTGAGATCCTGAACCACGGCATCTCGACGGAGCTGATGGACGAGGTGGAGAAAATGACCAAGGACCACTACA
AGCGTGTGCGCGAGCAGAGGTTCCTCGAGTTCGCGAGCAAGACGCTCAAGGAAGGCTGCGACGACGTGAATAAGG
CGGAGAAGCTGGACTGGGAGAGCACCTTCTTCGTCCGCCACCTCCCGGAGTCCAACATCGCCGACATACCCGACC
TCGACGACGACTACAGGCGCCTCATGAAGCGCTTCGCGGCGGAGCTGGAGACGCTGGCGGAGCGGCTACTGGACC
TGCTCTGCGAGAACCTCGGCCTCGAGAAGGGCTACCTCACCAAGGCCTTCCGTGGCCCCGCGGGCGCACCCACCT
TCGGCACCAAGGTCAGCAGCTACCCGCCGTGCCCGCGCCCCGACCTCGTC

> SEQ ID NO:2223 216268FL 141827_300429_1c
CCCGACTAGATTCTTAATACACAACCCAGCTGGTGAAAGAGAGGAACTTGAGAGTTAGCTAGCATGGCGGCAGCA
TTGTCGTTCCCGATCATCGACATGAGTCTGCTCGACGGGGCAGAGAGGCCCGCGGCGATGGGGCTGCTCCGCGAC
GCATGCGAGAGCTGGGGCTTCTTTGAGATCCTGAACCACGGCATCTCGACGGAGCTGATGGACGAGGTGGAGAAG
ATGACCAAGGACCACTACAAGCGTGTGCGCGAGCAGAGGTTCCTCGAGTTCGCGAGCAAGACGCTCAAGGAAGGC
TGCGACGACGTGAATAAGGCGGAGAAGCTGGACTGGGAGAGCACCTTCTTCGTCCGCCACCTCCCGGAGTCCAAC
ATCGCCGACATACCCGACCTCGACGACGACTACAGGCGCCTCATGAAGCGCTTCGCGGCGGAGCTGGAGACGCTG
GCGGAGCGGCTACTGGACCTGCTCTGCGAGAACCTCGGCCTCGAGAAGGGCTACCTCACCAAGGCCTTCCGTGGC
CCCGCGGGCGCACCCACCTTCGGCACCAAGGTCAGCAGCTACCCGCCGTGCCCGCGCCCCGACCTCGTCAAGGGC
CTCCGCGCCCACACCGACGCCGGCGGCATCATCCTGCTCTTC

> SEQ ID NO:2224 216268FL 132569_300447_1c
AAAAAGATAGGATCTGTCTGCTATTATTATCTAAGTCTGTTTAGGTTTTGTGTTTTTTATTACTACAACAACATA
ATGACTATTCCGGTGATTGATTTCTCAAAGCTTGATGGAGAGGAAAGAGCCCAAACTTTGGTTCAGATTTCCAAA
GGTTGTGAAGAATGGGGATTTTTTCAGTTGGTGAATCATGGGATACCAGTGGAGCTGCTTGAGAGGGTGAAGAAA
GTGTGTGCAGAATGCTTTAAGCTGGAAAGAGAAGAGGCTTTCAAGAATTCAACACCAGTCAAGTTGCTTAATGAG
CTAGCGGAGAGCAAGAAGAGTGGCAATTATAAGGTTGAAAATGTGGATTGGGAAGATGTCTTCCTTCTCACTGAT
GACAATCAATGGCCCTCCAACACTCCTCAATTCAAGGAGACAATGAAAGAATATAGATCAGAACTGAAGAAGCTA
GCAGAGTGTGATGGAAGTAATGGATGAAAACTTAGGCTTACAAAAAGGGTCAATCAAGAAAGCCTTCAATGAA
GGAGAAGGTGACAATAATGCTTTTTTTGGAACAAAAGTGAGTCACTACCCACCTTGCCCTCATCCAGAAATGGTG
AATGGCCTAAGAGCTCACACTGATGCTGGAGGTGTGATTCTACTCTTCCAAGATGATCAAGTTGATGGCCTTCAA
ATCCTC

> SEQ ID NO:2225 216268FL 128550_300476_1c
AAAATACATAGAAAGATGGAGAGTTTCCCAGTGGTTAACATGGAGTTGCTTAACACTGAACAAAGGGCTGCAACA
ATGGAGAAAATTAAGGATGCTTGTGAGAACTGGGGCTTCTTTGAGGTGGTAAATCATGGGATCTGTCATGAGCTT
CTGGACACAGTGGAGAAGTTGACAAAGGGACACTACAAGAAGTGTATGGAACAAAGGTTTAAGGAAATGGTTGCA
AGTAAAGGGCTTGAAGCTGTTGAGACTGAAATAAAGGATTTGGATTGGGAAAGTACTTTCTTCTTGAAACACCTT
CCTGTTTCAAATATCTCAGAAGTTCCTGATCTTGAAGATGAATACAGGAATGTAGGGAAAATCATGAAGGAGTTT
GCTGAAAAGCTAGAGAAATTAGCTGAGCAACTTTTGGACTTGCTCTGTGAAAATCTAGGACTGGAGCAAGGTTAC
CTGAAGAAAGCCTTTTATGGTTCAAATGGTCCTACTTTTGGCACCAAAGTTAGCAACTATCCACCATGTCCCAAG
CCTGATTTGATTAAAGGCCTTAGGGCTCACACTGATGCTGGTGGAATCATCCTTCTATTCCAAGATGACAAAGTC
AGTGGTCTCCAACTACTCAAAGACGACAAATGGATCGACGTTCCACCAATGCGCCACTCCATCGTCATTAACCTC
GGAGACCAACTCGAGGTGATTACTAATGGAAAGTACAAGAGTGTGGAGCATAGGGTGATTGCTCAGCCTGATGGA
AACAGAATGTCCCTAGCTTCATTCTATAACCCGGGGAGTGATGCTGTCATCTATCCAGCACCAGAATTGTTGGAG

Figure 2 continued

```
AAAGAGAACAAAGTCATTTATCCTAAGTTTGTATTTGAGGACTATATGAAATTATATGCAGGTCTTAAGTTCCAG
GCTAAAGAGCCAAGGTTTGAAGCAATGAAGGCTGTGGAAACTACTGTCAACTCTGCCCCAATAGCTACTGTTTGA
GACTTTGATGGAGTATTAATTAGAAAACTGATTAATGAGAAGAAAATGGCTTAGTATTAAGATTATGATGATGTA
TTGATGATTTGTTTATATTGATTAGTTGGGGTGTTTTCCTTGTTTTATGCCACTTGGGTTTTTCATGTACTGTTG
TCTGGTAGTCTAAGAGGAATTTATTGTTATGTTCTCAAAAGAAGTTCCTTTTAACTTGAAAAAAAG
```

> SEQ ID NO:2226 216268FL 120181_300359_1c
```
AAGAAAGCCTTTTATGGTTCAAAGGGTCCTACTTTTGGCACCAAAGTTAGCAACTATCCACCATGTCCCAAGCCT
GATTTGATTAAAGGCCTCAGGGCTCACACCGATGCTGGTGGAATCATCCTTCTATTCCAAGATGACAAAGTCAGT
GGCCTCCAACTGCTCAAAGACGACAAATGGATCGACGTTCCACCAATGCGCCACTCCATTGTCATCAAACTCGGT
GACCAACTTGAGGTGATTACTAATGGAAAGTACAAGAGTGTGGAGCATAGGGTGATTGCTCAGCCTGATGGAAAC
AGAATGTCCCTAGCTTCGTTCTATAACCCGGGGAGTGATGCTGTCATCTATCCAGCACCAGAATTGTTGGAGAAA
GAGAACAAAGTCATTTATCCTAAGTTTGTTTTTGAGGACTATATGAAATTATATGCAGGTCTTAAATTCCAGGCT
AAGGAGCCAAGGTTCGAGGCAATGAAGGCTGTGGAAAATACTGTCAACGCTGCCCCAATAGCTACTGTTTGAGAC
TTTTCATGGAGTATTAATTAGAAAACTGATTAATGAGAATAAAATGGCATAGTATTAAGATTATGATGATGTAAT
AATGATTTGTTTATGTTGATTAGTGGGGGGTGTTTTCTTGTTTTGTGCCACTTTGGGTTTTTCATGTACTGTT
TTCTGGTAGTCTA
```

> SEQ ID NO:2227 216268FL 1174142_302095_1c
```
GAAATCATACTAGAGGCTATGTCAATAACACTTGGGCTCAACCCAGGAACGTTAAAAGAAGCATTTGGAGGCGAT
AAAAATTGCAGCTTAAGTCAACGTATTAATTTCTACCCTTCTTGCCCTCAACCTGACCTCACCTTAGGGTTATCT
CCTCACTCGGACCCCGGGGGTCTAACTGTCCTTCTTCAAGATGACCAAGTCAGTGGCTTGCAAGTGCACTACGAG
GGGGAATGGGTTGATGTCAAACCCATTCCTGGTGCATTTGTCGTAAATCTCGCTGATCAAATCCAAATAATGACC
AATGGGAGGTACAAGAGCGTGGAGCACAGAGTGGCAGTCAATTGCGATCAAAGCAGGCTATCCATAGCTACCTTT
TGCAATCCTAGCAATGAACTTCTGATAAGCCCTTTGAAAGAGTTGGTGGGTGAATCTAGTGAGCTTCAGTACAAC
CCCATGACCTTTAGAGAGTACAGGTCCTTCATAAGGAGGATAGGAACAAAAGGCAAATATTTCCTTAACTATGTG
CAATCACCTAAACACTCTGTATTGCCATCCCCATAGCACATCTTCTTCTAATTATCATCTCCTCTACCTTGTAAA
ACAACCCATTTTGTTAAAAAACGTAGAATGTGTGTGTGTGTGTGTACATATA
```

> SEQ ID NO:2228 216463FL 211675_300901_2c
```
GGCCAATATGTGGCCTGCATGCTGTTTCTGATACAAATCCTCGTAATGCACAGACGTGAATAGTGCTGGCACAAG
TCACATTGCTGCTGCCTTGAAGGGTTCCATTTACATTTTGGTGCAGCTCTACCAACCG
```

> SEQ ID NO:2229 219090FL 206542_300823_1c
```
GTCCAATTAGGCATTGACAGCAAACCAATTCCCTCCATAACTGGGCCTCTTCACACCCGTACTCAGAATGACCGA
CAGAATATTCCGCATCTTTAACCCGGGAGAACCAAAGGGTGATCCCGTTGAGAAGAGGCGCGCTCAGCTGCGACG
TGCCCAACAATCTTATCGAGATCGCAAGGACAAGTACACCAAGGCGCTCGAGGCTGAACTAGCACGGTCTCGGAA
GAGCGAGGCGGGCTTGACGTTCCAGATCGAGCAGCTTCGTGTCAAAGTTCAGAAACTGGCCAGTCTCTTGTCCCA
AAATGGCATCTCACTTCCTCCAGATTTTGACAATGAGGAACAACTTCATGATGATGTACCGCGTATAGATTCATC
TCCGCTCACAACGCGTGGACAACCACAAACCGCTGAAGGCTTCCTATCAAGTACAGATTCAACCTCTCCTGAGTC
GGTGACGGACCAAGGAGCTATCTTAAATAGTGGAAACCGCACTCTACGGCAGTACAGTTCGA
```

> SEQ ID NO:2230 213894FL 219319_300944_1d
```
GGTACGTTATTGTTTTTTGTTGGCCTTTTCACTTTGGTTTGTTTTTAATTTCTTCGTTTTTGTTTTCTGTTGCA
GAGGAGAAGCGTGAAGATAGGAGAGAATAGAGATAGAGAGGCAATTGCACGGAATGTTTAGCCAACAAGTTGCTC
GTGGCGGGCGCCGCATCGGCCAGATGGCTCGAGGCGGCCAATATCCGTCACTCGCTGCGCTCAGAGGAGCTGCTC
AACGACGATGTTATGCTGAGGCTGCACAGGCAGCCCCCAAGGGACGTATCGGTCGAGGCCTCGGGCTGCTCCTGT
ATGGCGTTGCATTTAGCGGCCTCGGAGCAGCAGCAACATTCTATTCGATGGTACAAAAGGGTTTCGCCTCGTTCA
CCGACGCCGAGTCAGCCAAACTGTTTGTCCCAGATAGCGACGAGCTGCAACAAATCGAAGAGACAATCAACAAAC
ACCCGCTCGTCCAAGAGCTTCGATCACGACCAGAGTTCAAGGAGTCACGACCACACCTAAAGATGTCAAGCGAAG
TCCGCAGCCGCACCCTCACCGGCGGCGCTCTACAAGGCGACGGCATGATCATGGTCCCCCCGTCGCCTTCATCG
AGGACGGCGGCAAGTCCATCGTCAGCGTCACGTACATTGGCGACAAACTATGCGGCCACCCAGGCCTCGTGCACG
GGGGCCTGCTGGCGACGATGCTGGACGAGGGGCTGGCGAGGGGCTGCTTCGACGCGCTGCCGCACAAGATTGCCG
TGACGGCGAGCCTGGAGATCAACTACCGCAAGCCGAC
```

> SEQ ID NO:2231 213967FL 220892_300939_1d
```
ACACAATTCCTCGCTGCGTGTGACTCGTGTCTCCAGCAAATACCGCAAAGATGTCTGACGACGGGCTCTCAATAT
ACGATGAGATCGAAATCGAAGATATGACCTTCGACGAGGTTCTTCAAACATACTTCTACCCGTGTCCCTGCGGCG
ATCGTTTCCAGATCGCTATCGATGACCTGCGCGACGAGCAGGATATTGCTGTGTGCCCCAGCTGTAGCTTGATGA
```

Figure 2 continued

TTAGAGTTATTTTCGACCTTGACG

> SEQ ID NO:2232 214087FL 221036_300941_1d
ACAACAAACAACGAAACAACCGCCCAATCGCCAATCGCCGCCTCGACATGGTGCTCGGCGACTACGAGGAAGCAC
AATAGGCGGGACGCGAAGCAAACAAGCGCTGGGCGTCTGAGAAGTAGCCCGAGAGTCACAGCTACAGCTACAGCT
ACAGTGAACACGCGATAGAGTGATTCAGGACATCCAGAGACGAGACGAGGCGCCTGAACGAGATACGAAGCAAAC
AGACACGGGAAAGCAGATGCAATGTCGGCAAACGTAACAAAGCCGGCGCCCAATCGGCCGCAGCGGCGCGTAACG
GCCGGCCAGATCCTGTCGATGCCGCCGAAATGGCTCGGCATGTACGACGAATTCATCACCAAGAACGCCGGCCAG
GTGTCGCAGATTGAGAGCGCGCTGAGGAGCTTGACGTATATCATTCCAGGCCGCTTTCGCGATGCTGAAATCGCC
TCCGAGTCGATTCACTCGGGCGTCCAGCTGCTGTCGCTCTACCACGACGGCATCCTCTCGCAGGCAGTGTCCAAG
CTGCCCACGCCGCCTGTCCGGTCGGCTCATGCGCGCTACACGCGATACTGGACGCAGAAGAGCAAAACGTACCGC
AGGATAGCCATGGTGCTGCAGATGGTCGTCTACACGGAGCTGCTGTGCGAAATGAGCGCC

> SEQ ID NO:2233 214259FL 200377_300816_1d
AAGATCAGGACAAGACAATTCGAGAGTGCCAAAAACAGCAAAAGGGCAGAGAGACGTCATCATGGCTCAGGCCAA
GTTCGCCGTTTATCCCAGCCTCGTCGACCGCACCGTCGTCATCACAGGTGGTGCGCAGGGTATCGCCGCCGACAT
GGTCGAGCAGTTTTCCCTGCCAGGGTTCTCAAGTCATATTTTTCGACGTCGAGGACGAGCTTGCCGCTGATTTAGT
CCGAAAAGTGTCTGATCAGGGCGTCAAACACAAGCCCATATACTACCACTGCGATGTCATCAAGATCGACGAGGA
GCTCAAACCCACAGCGGCCAAGATCCTGAAAGACCATCCCAAGATCGACGGACTCATAAACAGTGCCGCGAGGGC
AATGGTGAAGCCCTCGCAGGATATCACGACTGAGTGGTGGGATGAGAGCGTCGCCGTGAACCTGCGGCATCAGTT
CTTCCTGACCCAGGCCTTGCTGCCGGGGCTTCTCCTTGCTGCTGGAAACGCTTCGGTGATTAACATGGGGAGCAT
CAACTGGCTCGTCTCTGCGACGGGTCAGGCGCCTTACACGACGAGCAAGGCCGCCGTTGTGGGACTGACGAGGAC
GCTGGCACATGAGTTTGGACCGCA

> SEQ ID NO:2234 214421FL 220363_300954_1d
GGCCAGAACCGCGCGAGTATACATCTATCTGCAACATCTCTTACCTCCATCTTCGCAATGGCTTCTGATAAGATG
GACCGCGGCCTCGACGAAATCATTGCAGACAAGCGCAGCAATGGATCTCGAACCCGACGCGGTGGCGACCGCCGT
CGTGACCGTCAAGACTATCCCCGTGATGGGGTGAAAAAGTCTCTCCGCAACGAACCTCGAAACTTGGATAGCGAA
TGGGTACATGATCGATACGAAGAGAACACGTATCGCAATAGAGGCCCTGCACCGCGTCGCAGGCGCGAGTCTCCC
AGCGGGGGAGATGCCCGCGGCGCACGACTCCGAGTCGAAAATATCCACTACGATCTCACCGAGGAGGATCTCGAT
GAACTTTTCCGAAGAATTGGCCCCATCACAAAATTGCAACTGCGTTATGATCGGTCTGGACGGTCCGAAGGTGTA
GCTTTCGTAACGTATGAGAGCAAAGACGATGCCGCAGAGGCTGTGAGACAATTCGATGGTGCCAATGCGAACGGC
CAGCCAATTCGTTTGTCCGTCATGTCAAGTGGGCCTTCTCGAAACCCGTTTGATACTGCTGTGATGCCAGGCAAG
CCTTTGTCCGAACGCATTTCTGCTCCTGGTGGCAGATCTCGATCACTCTCCCCTCGCCGATACGATGAAGAAGAT
GCCGCTCGCAGAGGCATTGATCGATATGTTCCAGGCGGAAGTCGCT

> SEQ ID NO:2235 214443FL 199653_300751_1d
CAAAAAGGCTCCAGGCATCGTCTTTGACAAGGAGGACTACACTGCTCGCTACAACTGGTCAATTCCGCTACGTTC
ATACGCGGAAGAAAAAGAACATGTCGCTAACAGCAATCGCAACAACAATGCAGACGGCTCTGCAACGAGCAGAAA
CGATGGATCCCGCCTCTCTAAGCCTTCTCCAGAAAGGCTCTTCCCACAATTCCTCTCCCAACTATGGAGCCTCCG
GAACGGTGACAAGAGGGATATTGCAAGACTATCAGGCGGTACCGACCAGCGATGAAAGCGATGCCACCCGTCCGA
GAAAGGTTTCATACAGCGATGCGGCGAAGAAGGCCGGGAACCATGCGAAGAGCCAGAGCTCTCTGCGGCAACGAA
ACGGAGTCTCCGGCTCGGAGGATACAAGATCGCCAACAAAAGCAAAGTCATCATGGACGAAGGAAACATTTCGAA
AATTTCAGTCCCTTCAGTTGGAAAACAAGGGAAGCGTGGCTAGAGATCACCTGGCTCTCGAACGCACATTTCTAG
CATGGCTTCGAACCTCTCTCGCTTTTGCATCGATTGGCGTCGCCGTGACGCAGCTATTCCGCCTCAACACTGATA
ACGCTTCCGCCTCCGATTTCGACCACACAAGGCTACAAAAGAT

> SEQ ID NO:2236 214443FL 200546_300853_1d
GGCGCAATGCTTCAACAGCGTCTCTCGCCACAGTCTGGATCTGCCCGTGCCGCCACTCTGAACTACAATCACGCA
ACCAAACCTTAGTTTAAATGCGCCGCTCTGCGCCCCACAAGAGCTTGTGCGCATGTGCTGTGGCACTCAGTTCA
AAGTGGTACTGCCGAGTCAAGTGAGACGTGCACCCTGGTCGAGGCCGTGACCATGGCTTCTCACCCTCAGACCAA
CGAGCTTGACGCATCTGCCTCTGCAGTGGCATTGCCGAAGAAGACGCTATCGAGGGCTGACCTGCATCGTCGTCA
GTCGGCAGACGAGCGGATTAACAACATTCTCGAGACGGCTCTGCAACGAGCAGAAACGATGGATCCCGCCTCTCT
AAGCCTTCTCCAGAAAGGCTCTTCCCACAATTCCTCTCCCAACTATGGAGCCTCCGGAACGGTGACAAGAGGGAT
ATTGCAAGACTATCAGGCGGTACCGACCAGCGATGAAAGCGATGCCACCCGTCCGAGAAAGGTTTCATACAGCGA
TGCGGCGAAGAAGGCCGGGAACCATGCGAAGAGCCAGAGCTCTCTGCGGCAACGAAACGGAGTCTCCGGCTCGGA
GGATACAAGATCGCCAACAAAAGCAAAGTCATCATGGACGAAGGAAACATTTCGAAAATTTCAGTCCCTTCAGTT
GGAAAACAAGGGAAGCGTGGCTAGAGATCACCTGGCTCTCGGTATGTCGCATGCGTATACAGCAGCTGAGCTGCA
TGTCTCAAGAGAACCAATTGGCTGACCATTTCATTTCCCCCCCCTTCCAGAACGCACATTTCTAGCATGGCTTCG

Figure 2 continued

AACCTCTCTCGCTTTTGCATCGATTGGCGTCGCCGTGACGCAGCTATTCCGCCTCAACACTGATAACGCTTCCGC
CTCCGATTTCGACCACACAAGGCTACAAAAGATGGGCCGCCCGTTGGGTGCGACATTCCTCGCCATTAGTATTGT
GACCTTGCTCCTCGGTTGCAGACGATATTTCCATGCCCAGGAATGGATCCTTCAGGGCAAGTTCCCGGCAAGCCG
AGGGACCATCATTATCATGTCACTGGTGGCATTGGCCCTCATGATTTT

> SEQ ID NO:2237 214460FL 219439_300945_1d
GCCCACGCTGTCGCCCACGCGTCCGATTTCACTCTTCTGCAGACGAGGACGGACCCGATTGACCATGTTGCGACA
ATCCTTCAGAGCCTTTGCCCGCACGGCTGTTGCGAGACCGGCCGCGGCGAGAAGCTACGCTACCTTCAACTGGGA
GGATCCCCTCAATGCGAACAACCTCTTTACCGAGGAAGAGCAGGCCATTGCAGAAACCGCAGAGCGATACTGCCA
GGAACGACTACAGCCTAGGGTCTTGCAGGCCTACCGAGACGAACACTATGACCCCAAGATCCTCGAAGAGATGGG
CGAGCTGGGCCTGCTTGGCTCCAGCATCAAGGGCTACGGATGCGCTGGCGTTTCTTCGGTGGCCGGCGGCCTGAT
TACACGAGCGGTCGAGCGAGTC

> SEQ ID NO:2238 214471FL 214490_300858_1d
TCATGCGCCTCAAAGAATGGAAGAAAACACAGGCGAATGACGTGAAACGAAAGATAAAAAGACAGGCGCCTTCAT
GCGAGGGTTTCGCCAGTCGCCTCTAGCGTGTTTCGAAGCGCAGGGTTGAAACGCGGCTGCATGATGCCCGGCCGC
CCATCTGAGGCATGGCGGCTACCGGAACAGGACGACATCCGAAGACTTGAGGAGGCTCCGTGTTTGTTCGTTTCG
TTTCGTCTTTCGAGTGAAGGGTTGGTTCTTGTTTTCGGCTGTTGTGTGTTTTGGTTGACTTGTGTTTACGGGTTG
GGGGTGAGTTGAATTGAGTGCGAGACTTGATGCTTCTGTCAACAAGCCAGCCACTTACACTGCGGCTTCACCCTT
TCGTCTCTTTTACCATGTTACGCAACATGGCGAATTTCCTTCTATAGGATCCATATTGCCCAAATTCAGATCCAG
CCCGCAAGGGAGAATTTTATCCGCCT

> SEQ ID NO:2239 214548FL 216980_300903_1d
CGAATATCATGCTATCAGCCGCTTCCTTCGTTCCTGGAAATGGTCCATGCTGACCTACCTACCCCTCGCCTTGGC
CCTTCAACTACGCAACCCCAGGCGCATCAACCTCGTCAAGGCCATCACCGGCTCTACCCGATCATCCACTTTTCT
TGCTACCTTTATAACCCTCTTTTACTACGGGGTGTGTCTGGCCCGCACTCGCCTCGGCCCCCGCGTCCTCGGCAA
AGAAATACCGAACCGCCAGCGAATCGACGAGGGCATCTGTGTCGGTACCGGATGCTGCCTTTGCGGATGGAGCGT
CTTCATCGAGACGGCAGGTAGAAGGAAAGACATGGCCTTGTTTGTGGCGCCGCGGGCACTGGCAACGTTGGTCCC
TCGGCGGTATCCCCTGGAGAAGCAGTGGCGAGAGAAGTTGATATTCGCAGCGAGCACGGCAGTCGTGTTTACTTG
CGCCCTTGAGAATCCAAAGAGAGTTAGAGGCGTACTAGGGGGGATTTTGGGCATGGTGTTGAAGAAATAAACCGG
GCATATGGGCAAATATGATCTCTTTTAGGGAGTTCTGAGACGTGACATGACTAATTTCTTCTTCTTCTTTGGATG
TCTTTGGAATAAGCTACGGTTTTTAGATGATATACACAAACAACCCTGATGCTATAATTGGTAATAAATACATAA
TATTAATTGTTTATCCAAACAAAAAAAAAAA

> SEQ ID NO:2240 214633FL 167306_301607_1d
ATTAGGAAATATTCAATAGAATATATCTGAACCAACATCATTCCATAAGATTCTTAAAAACAACAACCCTTCTTC
TTCAGTTACACAGAAGAGAAACGAAACTAGAGCACCTAACATTTTAAAAGATCCCCACGACTATCTATATCTACC
AGACACATGGGAACAAATAAAAAACGAAACACTCATATATGAAATTTTCTTTTTTTTTCCTATGAATAACCAAAG
TGTGCAAGGAAATGAGGTCTAATTCTCACCTCCAATGCAATTCAGTCGAATCAAAGCCTTTGATTATTCATTCAG
ACCGAGCAGCAAACCTTTCAACCTTACGGGCATTAAGGTTAATTCCAACCATAGCTTCACCCAAACCAGAGCTAA
CATCAGCAAGAATGTCAGGATCGCTATAATGAGTCACAGCTTGCACAATCGCCCTAGCACGTTTAGCAGGATCAC
CACTCTTAAAAACACCGGAACCAACGAAAACACCATCACAACCCAATTGGATCATCAGAGCAGCATCAGCAGGAG
TAGCAACACCACCAGCAGCAAATTGAACAAACCATGGGATTGTAGTCCACCACTTCATCCCACACAAAGTAATCG
CTTATGTCGT

> SEQ ID NO:2241 214633FL 223816_300976_1d
ACAACACACACACAACACAATGTCTACCGTCGAGAAGTCTTTTGAGGAGCAGTTCAAGCTGCAGGCCGGTCTGGC
CCAGATGCTCAAGGGTGGCGTCATCATGGACGTTGTCAACGCCGAGCAGGCCAAGATTGCCCAGGAGGCCGGAGC
CGTGGCCGTTATGGCCCTTGAGAAGATCCCCGCCGACATTCGAGCCGACGGAGGAGTCGCCCGAATGTCCGACCC
CGCTATGATCAAGGAGATCATGGCTGCCGTGTCCATCCCCGTTATGGCCAAGTGCCGAATCGGTCACTTTGTCGA
GGCCCAGATCATTGAGGAGATTGGTGTCGACTACATTGACGAGTCTGAGGTTCTGACCCCGCTGACCAGTTCCA
CCACATCAACAAGCGAGACTTCAAGGTCCCCTTCGTTTGCGGTGCCAAGAACCTGGGTGAGGCTCTCCGACGAAT
CCACGAGGGAGCTGCCTTCATCCGAACCAAGGGTGAGGCCGGTACTGGTGATGTCACCGAGGCCGTCAAGCACAT
GCGAACCATCCAGTCCGAGATCAACAAGACCCGACACATGTCTGAGATTGAGCTCTACACCTACGCCAAGGAGAT
TGGTG

> SEQ ID NO:2242 214633FL 182915_300664_1d
TGTACTAACAGTATATGGAAATGGAGCAATAACAGAGGCAAAAACCTCACCATTCTCTGTTAAAGTACGATTACC
ACAGATGCTTAGAGGAGGAGTAATCATGGATGTTGTTAATGCAGAACAAGCCAGAATCGCTGAAGAATCAGGTGC

Figure 2 continued

TTGTGCTGTCATGGCATTAGAACGTGTACCAGCAGATATTCGTGCTCAAGGTGGTGTTGCTCGTATGAGTGATCC
ACAGATGATTAAAGAAATCAAACAGGCTGTTACTATTCCTGTCATGGCTAAAGCTCGGATTGGTCATTTTGTTGA
AGCTCAGATTCTCGAAGCAATTGGTGTTGATTATATCGATGAGAGTGAGGTTTTGACCCTTGCTGATGAAGAACA
TCATATTAACAAGCATAATTTCAGGATTCCATTTGTTTGTGGTTGTCGTAATCTTGGTGAAGCCCTAAGGAGGAT
TCGGGAAGGTGCGGCTATGATTCGAACAAAGGGTGAAGCTGGAACTGGTAATGTTGTTGAAGCTGTTAGGCATGT
GAGGTCTGTCATGGGTGATATGAGGCTTGTGCGTAATATGGATGATGATGAGGTGTGTTCATAT

> SEQ ID NO:2243 214672FL 1114826_301805_1d
GCGGGATTAGGAGTTGGAGAAGAGGTGATACGAGATGTCGTACGATGACGTGGAGATAGAGGACATGGAGTGGAA
CGCGGAGCTCGAAGCGTACACCTATCCATGCCCTTGCGGAGACCTCTTCCAAATCTCTCTGCCTGACCTTCGCTT
GGGAGAGGAGATAGCCAGATGCCCTAGCTGCTCCCTCTACATCACCGTCGTCTACAACCTCGAAGACTTCCAAGA
CCCTCGGCCCCCGCCTCGCCCCCAACAGCCGATCGCCGTCGCCTGATCTTTCCAGTTGCTTCGTTCAGTAAACTC
GACATCTACATTCTATCCTAAATTGATAGTCACCAAATGTCTGGTGCACTTGAGACTGTTTATCTGACAAGATTT
CATGTATCTTGGAGTTTTGCTTAAATCAGCATGTAGAATGATAACTGTTGGCTTCTTGATGTTTCAAAGGTTAGA
TATTGTCATATCTCGTGTGAGTTTTTTAAATTTTTGGTCATGCTAGATACCATGATAATATATTATGCAAGGACT
ATATG

> SEQ ID NO:2244 214724FL 210440_300889_1d
GTCGGATTCAGGCCTCAGCGCTCGGATCGGCCTCTTTTCCTCTCTTCCCTCTCTGCTTTCCATCTGCCCAGCAGA
CCGAGTTTGGCAGCGCAATGTTGCCTCTATCGGTGCGGCGCGCGGTGGCCGCTGCTCCTCAGGGGGCAAGTGGGC
TGACTTCTCTCGCCGCGTCGGCTCCAAAGATCACAGCCTCGAGCTTCATCCTGAATCGTCCTCAGCGGCGCTACT
CCTCGTCGAAACCCTCAAGATCCGATGAGCCCAACGATATTGCTGCCGGCCAGTCGGTGCCGGCATCTACCTCGC
GCGGAGAGAGCAAAGGCAGCAGGAAACGAAAGAGCAAGGATTCAGCCGACCGAAATGCGGCTTTCAAGAAACTGC
CCAGTGTCCCTAGCACTCACCACATGTCTCAAGAGGCCCTGAGCTTATCGAGCTTCTTCTCACTCCACCGTCCCA
TTTCCATCACCCAGACCATGCCCAGGACTGTTACCGACGAGCACTTTGCATCCATATTTGCGCCTCGATCAAAAT
CGAACAGGATACGAGACACTGTCTCTACAATTTCTGACACCATTGAGCAGCTGGAAGGCCCCATGGCTCAGGTGA
CAATAGGATCTCAGGACCAAGGGGCTGGCGATGGTATGCACAGAGTTGATGTCAAGAACCCTGACGGAACCGAGT
CGAGCATCTATCTCCAGGTTGACACCATGTCTGGAGACTTCTTGCCTTTCCGCCCCCCTCCGCTGCCCGAGGCGC
AGCAAGGCATTGAGGCTGAAGGAGTTGCGGCTGAGGCTGAAGCTCTGGAAGAGGCAGCTCACCACCGAGTTTACA
AGGCCATGTTCACCATTGAGGAGTCCACAGAGTCAGACGGCCAAATCAGGATCATCGCCCACAGCCCTCGAATTA
TCCAGGACGAGCAGCCCCGGAGCTTCTTGGAGCGTCTGGCAGTCCGCCAACTGCGG

> SEQ ID NO:2245 216036FL 206402_300822_1d
ACGCGCATCATTATGCCGGCATGGGCCCGGGGTCTGACCCTCACCATTTCCGAGACCAGAGCGTGCCGCATTTCG
ACAAGGCGGGCCATACGCGGACGCACGAGCGGGAGGATCACCGGCGGTGGCAGCGGCAGAGAAGGGCTGTGGGGG
ATGATGGCATAGAGTTTGAGCCGCAGACGAGCCTGGCCGGGCACTTTTTGATTGTGGCGGGGATATTGGCGGCGA
CGCTGTTTGTGCCGGCGGTGTATTTGCAGTTTATGCGCCTGGGGAGGCAGAAGAAGGAGAAGGAGTCGTGAGGCG
GGTATGGCGTCTGGAGTGTGATAGGGAAGGCTGTACAAAGAATAGAGCAGACTTATATAGAAATAGGCAATGGGG
GGGCATGAGCGAACAATGCCGATTTTAACGTTACG

> SEQ ID NO:2246 216187FL 208071_300831_1d
ATTTATCGAGTTTCACAGGGCTTACAACTCCTGTCCGGGGGGATTGGCAGATCTTGACAACTGAGGAGGACCGGA
TGCCGTGACGTGTAGCTGCTAGGATGAATCTTGGATTGGAGATTTGCCAGTCGATTTGGATGGTGCCTTTCGGGA
TGGAGGGGTGGAGGGTGGAGAGATATGACTAGTGTGGAGGTATCACAGCGTCGGGGGGCTGTGGAGAGTTCAGGG
TAAGCCATTTGCGGCTTTCACGCTCAGTAACACTCGGGGGTTTAAAACTGACTGATGGCCCATCTATACCTTGCA
GAACGAATTTAGGTCCTCGCAAGACTCTCCCTAGAGCCGCGTCCCGTCACTACTGCTGCTTTGGCATCAAATAGT
GCTCAATGGCTAGGCCGAGGGATTTGAAGACGATAGCAATGTAACCCATACGATCTGACTGAACGAAAAAAAACA
ACAACC

> SEQ ID NO:2247 216259FL 175122_300530_1d
CCCACGCGTCCGCCACCGCGACACTCCCCTTCCCTTCCTTCTCCGGTCTCCTCCCTCTCTCGTCGTCGTCGTCGT
CGCCGTCGCCGGCTCGCCGCGTTCTCCTCCGCCGCCGCTGCTGAGCCGGGATGGCCGCGCGTAGCCCCTACTTCG
TCCCCGAGAGCGAGGGGATCCGGGCCGGGGAGTCGCCGGCCGCGGCGCTCCGCAGGATCCTCGCGTCGCCGGGGG
CGCACCAGGCCCCTGCTGCTTCGACGCGCTCGGCGCCCGCCTCATCCAGCGCGCGGGGTTCCCGATCTGCTTCA
TGGGCGGTTTCTGTGTTTCTGCCGCACGACTTGGATTGCCAGATGCTGGTCTCATCTCATATGGAGAAATGGTAG
ATCAAGGGCGTCTGATCACTGAAGCTGTATCACTCCCAGTTATCGGCGATGGTGATAATGGCTATGGAAATGCTA
TGAGCATTAAGAGAACCGTAAAAGGGTATATTAATGCTGGTTTTGCTGGAATCATGCTCGAAGATCAGGTGGCAC
CAAAAGCATGTGGACATACTGAAGGAAGGAAAGTTATCTCAAGGGAGGATGCTATCATGCACATAAA

Figure 2 continued

> SEQ ID NO:2248 216259FL 226961_301006_1d
ACTCCCCTTCCCTTCCTTCTCCGGTCTCCTCCCTCTCTCGTCGTCGTCGTCGCCGTCGGCGGCTCGCCGCGT
TCTCCTCCGCCGCCGCTGCTGAGCCGGGATGGCCGCGCGTAGCCCCTACTTCGTCCCCGAGAGCGAGGGGATCCG
GGCCGGGGAGTCGCCGGCCGCGGCGCTCCGCAGGATCCTCGCGTCGCCGGGGGCGCACCAGGCCCCCTGCTGCTT
CGACGCGCTCGGCGCCCGCCTCATCCAGCGCGCGGGGTTCCCGATCTGCTTCATGGGCGGTTTCTGTGTTTCTGC
CGCACGACTTGGATTGCCAGATGCTGGTCTCATCTCATATGGAGAAATGGTAGATCAAGGGCGTCTGATCACTGA
AGCTGTATCACTCCCAGTTATCGGCGATGGTGATAATGGCTATGGAAATGCTATGAGCATTAAGAGAACCGTAAA
AGGGTATATTAATGCTGGTTTTGCTGGAATCATGCTCGAAGATCAGGTGGCACCAAAAGCATGTGGACATACTGA
AGGAAGGAAAGTTATCTCAAGGGAGGATGCTATCATGCACATAAAAGCTGCCGTAGATGCTAGGAAAGAGAGTG

> SEQ ID NO:2249 216259FL 217553_300909_1d
GGTTAATTTCGGATTGCCACAGAATAGGAGACTTGCCACTCCGGTGGTTATTCTCGGCATATATGCGACGTTAGA
ATAACCTGTTTAATCGTATATAGTCACTGTGAAGGAATCCATGAGGGCAATGTTGATGAATGTTGTCAGTGAAGT
TGGAAGTATAGAACTTAGCCGGCTACAAACTTAAAGAGCGTTGCCCAAAATGAAGCCCTATCCATTCCAATTCAA
CAGCACATCCTCGT

> SEQ ID NO:2250 216259FL 208958_300810_1d
ATACTCGGACCCAAGCAAGATTCTCGCTACATGCTGCTCTGACGATGGACTAGGATCACGTCTGGTGGAAGAAGC
TAGGTTCCCGTACATATGTTTGGGTGGATTCATGGTCGCGTCTAGCTTGGGATTACCAGACACTGGATACATTGC
CTTC

> SEQ ID NO:2251 216262FL 218530_300967_1d
AGGGACTGCTGCTGGCGGCCATCCGAAGCAATGACCCCTGCATCTTCATGGAGCCCAAGATCCTGTACCGAGCCG
CCGTGGAGGAGGTCCCCGTGGCGCCGTATGAGTTGCCTCTGTCCAAGGCGGAAGTCATCAAGGAGGGCAAGAACG
TCACAATTGTTTCATATGGTCAGCCGTTGTACAACTGCATGGCGGCCATCAAGCAGGCAGAGGAGGATTTGGGCA
TCTCCGTCGAGCTGATTGACCTGCCACAATCTATCCCTGGGACAAGAAGACTGTGTTTGAAAGCGTTCAGAAGA
CTGGAAGAGTCCTGGTCGTCCATGAGTCTATGGTGAACGCTGGTGTTGGTGCCGAGGTGGCTGCCGCCATTCAAG
AGAACGCAGATACCTTCAACAGGCTCGAGGCTCCCGTGTCTCGTGTTGCTGGATGGAGTATCCACAACGCTCTGA
TATTCGAAAAGTTTCACGTCCCAGATGTTGCAAGAATTTACGACAGTATTAAAAAGACGGTTCAGTACTAAGAAT
GTGGGGAGCGAGTAACGTGTGACTTTATCTTTGAATTTCTAGAGCTTCTTCCTAGCATAAGTGTAAATAATAGAG
AATAAAGCTTTCTGTAACACAC

> SEQ ID NO:2252 216329FL 214955_300876_1d
TTGACCGAAAGCCGTCTTTAACCCTCCCCCCAGCTGCACGAAAGCGGAGGATAGGCAGCCGGAACGGAGATCTCT
TCCCAAAGCTGGACCAAAGGGCAGGGCGCGCCAAGTACGGAGCTTGTGCACTGCCGTCCCAAGTACCTGGCAGCC
TGGCAGTACCTCGGACGCACGCTGCCTGCCCCTCACCACGCGGAGTATCCAGGTACCTCGGTGTGCAGGTGCAGG
CAGCTCTCCCTGTCCTGCAGGAAAATGCAGGATAGAGGAAAGACCCGGAGACAAGTCTGGTGATTCTGGTGATTC
CATCCTGCCGGGGGTCAGGTTTTTACATAAGGCACTCTCGACTTCCATCTTATTTCCCCACTCGATCCCGATCTC
TCTCTCTCTTGCACCAGCAGGGAAGGAGTGGGCGACCCCGAAAAAAAAAACAATTAGAAAAAAAAAAAGAAAAAA
AGAGGCGAACGAAGGAACGAGCGAACGAGCGTCGTCGAGAAGGCGCGAACAAGGAGAACGGAGCCTGCGGGGTAC
CTTGGTGGACTTCCTGAC

> SEQ ID NO:2253 216338FL 205090_300795_1d
AATTGACGACCACCAGCGCCGCCAGAATGTTCGCCGCACGATCAAGGGCAGTCTGCGCCGCCCGCCAGCTGCAGC
GGACAACCCGAACCTACGCCTCCGAGTCCCACGGCCACCACTCGCCCGCTCCGGTCAACGAGTCCTTTGGGGCCG
GATCTGTTATTGCCCTGGGCGCTTTCCTGGGCACCGTCCTAGTCTACCAGTTCCGCCCCACGGAGAGCGACAACT
GGACGCCCTCTGCCCTGCTCAACAAGTATCGATCAAAGGCCGAGGACTGGGAGGCCGTCAACACTCTGCACACAA
AGGCCATGGAGCAGGCCGGCTATGACAGGAATCTGTTCGAGAACGGCTCCAACAAGCACCGATTTGTCGACGTCG
CATACCCCGAAGCTCTCCAATCCCACGCCGCGCGAAACATCCAGGCCGGCCACCTTGCCAACATTGACCATGCTG
TGGAACACTACCGACAGCAGCACCTGAAGATGGAGGAGAAGAAGGCGGCCAAGCTGGCGGCTGCCAAGGCAGAGT
AGTTGCAGTTGCTACAGTATATCCAATTTATAGAACAAAGTTTGCAACACATTGGGGCCAATTCAATGCGTGATA
ATGATTCCAGTTGCCGGATGTACCT

> SEQ ID NO:2254 216461FL 212130_300874_1d
CCCACGCGTCCGCGGACGGGGGGGCGGACGCTTGGGTTCGACAGAAGCCGAGTTAAGCGGCGATAGAAGCAACAA
AGGTGAAGTTGTGCCGGTCTGGTGGTTTATTGGAAAGAAACGAAGAGAAGAATGTTCCGGTCAAGGGAAGCGGCC
TTTGGTCAGTAGCCAAAGGGCAGATCAAGCGCCGCCTTGGAGGATTAAAAGGGCGGCTGCAGGGGTCCCAAGGCT
GGTCGCGCCTCATGGAATTGTATCGAAGAAAGTCGATGGTGTGGCGGTGCCCGATAACGCAAAAAGCTGGCAACCT
TTGTGCTGCCATGCGGGCTAGCAGCGGGTACCGCCGAGTATTTGTTTGTCACTGTACAGAGGCGAGACGTGAGGC

Figure 2 continued
CGAGATTCGCATTGGTTCGGAGTCTGGAGTAGGGAGGACAATATGGTAGCACGATTGTCATTGTGATTGCTTTGT
TTATTAGTACTTAAAAAAAAAAT > SEQ ID NO:2255 216471FL 211746_300870_1d
GAACAATGCAGCTGGTGACAGGTTTGTCAAGTGGCAGGGGAGAATCGTATTCGTGTGGCGATGGTGATGTCGAAT
TTCGAATGAGGGAGCCTTGGCGCGAAGAAAAAAGAAGAGAGAGAGAGAGCGGAGAGGAGAGGAGAGGAGAGTGAA
ACAAGGAGAAGTACAGAGGAGAGAGGAGAGAGACGCTGTGGTGCTAAGCAACCACGAGAGAGGAACATGAATGCG
GTTTACAAGGTTGACATTGGCGAACGAGCTTGGACCGCTTTGACAATGTGATGTGATGCAGGCTGGGTACTCCAA
ATGTTTCCAATTGAACGAATATCCAATCAGACAAGTAGAGA

Figure 3

BLASTX Results

This figure contains results of BLASTX queries against the non-redundant protein database using assembled contigs or singletons of seqences identified as hits in functional screening as queries. Only results with Pz values <1.00E-4 are considered, and only the highest homology hit is shown.

| SEQ ID NO | Query Contig ID (length, bp) | Pz Score | Result |
|---|---|---|---|
| 1 | 103532_300363_1 (653 letters) | 3.00E-36 | >gb\|AAF98579.1\|AC013427_22 (AC013427) Contains similarity to PIR7A protein from Oryza sativa gb\|Z34271 and contains an alpha/beta hydrolase foldPF\|00561. [Arabidopsis thaliana] |
| 2 | 103578_300363_1 (802 letters) | 1.00E-40 | >gb\|AAF65769.1\|AF242311_1 (AF242311) histone H2A [Euphorbia esula] |
| 3 | 104218_300060_1 (414 letters) | 3.00E-08 | >pir\|\|T03933 SAR8.2m protein, TMV-inducible - common tobacco gb\|AAB49767.1\| (U89604) SAR8.2m gene product [Nicotiana tabacum] dbj\|BAB13709.1\| (AB040408) elicitor inducible protein [Nicotiana tabacum] |
| 4 | 104251_300060_1 (562 letters) | 1.00E-92 | >pir\|\|B36094 pyrophosphate--fructose-6-phosphate 1-phosphotransferase (EC 2.7.1.90) beta chain - potato (cv. Kennebec) gb\|AAA63452.1\| (M55191) pyrophosphate-fructose 6-phosphate 1-phosphotransferase beta-subunit [Solanum tuberosum] |
| 5 | 104421_300364_1 (593 letters) | 3.00E-15 | >gb\|AAD39661.1\|AC007591_26 (AC007591) ESTs gb\|H37032, gb\|R6425, gb\|Z34651, gb\|N37268, gb\|AA713172 and gb\|Z34241 come from this gene. [Arabidopsis thaliana] |
| 6 | 104423_300364_1 (632 letters) | 8.00E-96 | >dbj\|BAA25394.1\| (AB012639) light harvesting chlorophyll a/b-binding protein [Nicotiana sylvestris] |
| 8 | 104874_300366_1 (681 letters) | 5.00E-26 | >pir\|\|T07393 myb-related transcription factor - tomato emb\|CAA67600.1\| (X99210) myb-related transcription factor [Lycopersicon esculentum] |
| 9 | 105059_300046_1 (636 letters) | 2.00E-35 | >pir\|\|T07780 remorin - potato gb\|AAB49425.1\| (U72489) remorin [Solanum tuberosum] |
| 10 | 107031_300262_1 (343 letters) | 3.00E-34 | >pir\|\|T15058 photosystem I protein psaH precursor - wood tobacco dbj\|BAA04634.1\| (D21055) PSI-H precursor [Nicotiana sylvestris] |
| 11 | 107690_300380_1 (624 letters) | 1.00E-47 | >sp\|P12301\|PSBQ_SPIOL OXYGEN-EVOLVING ENHANCER PROTEIN 3, CHLOROPLAST PRECURSOR (OEE3) (16 KDA SUBUNIT OF OXYGEN EVOLVING SYSTEM OF PHOTOSYSTEM II) (OEC 16 KDA SUBUNIT) pir\|\|S00008 photosystem II oxygen-evolving complex protein 3 precursor - spinach emb\|CAA29056.1\| (X05512) 16 kDa protein of the photosynthetic oxygen- evolving protein (OEC) [Spinacia oleracea] prf\|\|1307179B luminal protein 16kD [Spinacia oleracea] |

Figure 3 continued

| SEQ ID NO | Query Contig ID (length, bp) | Pz Score | Result |
|---|---|---|---|
| 12 | 109076_300042_1 (604 letters) | 1.00E-68 | >sp\|P34091\|RL6_MESCR 60S RIBOSOMAL PROTEIN L6 (YL16-LIKE) pir\|\|S28586 ribosomal protein ML16, cytosolic - common ice plant emb\|CAA49175.1\| (X69378) ribosomal protein YL16 [Mesembryanthemum crystallinum] |
| 13 | 109576_300051_1 (664 letters) | 5.00E-81 | >sp\|P26573\|RBS8_NICPL RIBULOSE BISPHOSPHATE CARBOXYLASE SMALL CHAIN 8B PRECURSOR (RUBISCO SMALL SUBUNIT 8B) pir\|\|RKNTSV ribulose-bisphosphate carboxylase (EC 4.1.1.39) small chain precursor - curled-leaved tobacco emb\|CAA31994.1\| (X13711) ribulose bisphosphate carboxylase [Nicotiana plumbaginifolia] gb\|AAA34110.1\| (M36685) ribulose bisphosphate carboxylase [Nicotiana plumbaginifolia] |
| 14 | 113128_300022_1 (529 letters) | 5.00E-29 | >gb\|AAK15087.1\|AF240004_1 (AF240004) 11S globulin [Sesamum indicum] |
| 15 | 113145_300022_1 (594 letters) | 5.00E-45 | >emb\|CAB56580.1\| (AJ011628) squamosa promoter binding protein-like 1 [Arabidopsis thaliana] |
| 16 | 113718_300005_1 (529 letters) | 1.00E-63 | >emb\|CAA98178.1\| (Z73950) RAB11B [Lotus japonicus] |
| 17 | 114987_300010_1 (623 letters) | 4.00E-40 | >dbj\|BAA19111.1\| (AB000452) PEThy;ZPT2-6 [Petunia x hybrida] |
| 19 | 116525_300078_1 (583 letters) | 2.00E-67 | >sp\|P36213\|PSAD_HORVU PHOTOSYSTEM I REACTION CENTRE SUBUNIT II PRECURSOR (PHOTOSYSTEM I 20 KD SUBUNIT) (PSI-D) pir\|\|JQ2247 photosystem I chain D precursor - barley gb\|AAA18567.1\| (M98254) PSI-D subunit [Hordeum vulgare] |
| 20 | 120380_300384_1 (664 letters) | 5.00E-82 | >emb\|CAB90634.1\| (AJ277744) protein phosphatase 2C (PP2C) [Fagus sylvatica] |
| 21 | 120445_300385_1 (613 letters) | 5.00E-13 | >pir\|\|S51478 drought-induced protein Di19 - Arabidopsis thaliana emb\|CAA55321.1\| (X78584) Di19 [Arabidopsis thaliana] |
| 22 | 120677_300428_1 (577 letters) | 6.00E-98 | >sp\|P51135\|UCR5_TOBAC UBIQUINOL-CYTOCHROME C REDUCTASE IRON-SULFUR SUBUNIT 5, MITOCHONDRIAL PRECURSOR (RIESKE IRON-SULFUR PROTEIN 5) (RISP5) pir\|\|T02023 ubiquinol--cytochrome-c reductase (EC 1.10.2.2) Rieske iron-sulfur protein - common tobacco gb\|AAA20834.1\| (L16813) Rieske iron-sulfur protein [Nicotiana tabacum] |
| 23 | 120979_300518_1 (585 letters) | 3.00E-26 | >pir\|\|S53012 root-specific protein RCc3 - rice gb\|AAA65513.1\| (L27208) RCc3 [Oryza sativa] |
| 25 | 122157_300016_1 (545 letters) | 3.00E-36 | >pir\|\|T01391 WD-repeat protein T4I9.10 - Arabidopsis thaliana gb\|AAC79104.1\| (AF069442) putative WD-repeat protein [Arabidopsis thaliana] emb\|CAB77787.1\| (AL161495) putative WD-repeat protein [Arabidopsis thaliana] |
| 24 | 122157_301608_1 (542 letters) | 1.00E-24 | >gb\|AAK09221.1\|AC084320_8 (AC084320) putative phytochrome interacting factor [Oryza sativa] |
| 27 | 127573_300470_1 (673 letters) | 8.00E-93 | >pir\|\|S57471 GTP-binding protein GTP6 - garden pea emb\|CAA90080.1\| (Z49900) small GTP-binding protein [Pisum sativum] |

Figure 3 continued

| SEQ ID NO | Query Contig ID (length, bp) | Pz Score | Result |
|---|---|---|---|
| 29 | 130630_300489_1 (606 letters) | 9.00E-36 | >gb\|AAF79618.1\|AC027665_19 (AC027665) F5M15.26 [Arabidopsis thaliana] |
| 30 | 130744_300490_1 (730 letters) | 1.00E-109 | >gb\|AAK43846.1\|AF370469_1 (AF370469) Unknown protein [Arabidopsis thaliana] |
| 31 | 131003_300510_1 (619 letters) | 9.00E-68 | >gb\|AAG61120.1\| (AF329934) ribulose-1,5-bisphosphate carboxylase/oxygenase activase 1 [Gossypium hirsutum] |
| 32 | 131272_300512_1 (438 letters) | 6.00E-67 | >gb\|AAD43167.1\|AC007504_22 (AC007504) Putative RAB7 GTP-binding Protein [Arabidopsis thaliana] |
| 33 | 135281_300412_1 (590 letters) | 3.00E-44 | >sp\|P09229\|CYT1_ORYSA CYSTEINE PROTEINASE INHIBITOR-I (ORYZACYSTATIN-I) pir\|\|A28464 oryzacystatin - rice pdb\|1EQK\|A Chain A, Solution Structure Of Oryzacystatin-I, A Cysteine Proteinase Inhibitor Of The Rice, Oryza Sativa L. Japonica gb\|AAA33903.1\| (J03469) oryzacystatin [Oryza sativa] gb\|AAA33912.1\| (M29259) oryzastatin [Oryza sativa] gb\|AAB24010.1\| (S49967) oryzacystatin=cysteine protease inhibitor [Oryza=rice, Peptide, 102 aa] gb\|AAB66355.1\| (U54702) oryzacystatin [Oryza sativa] |
| 34 | 135357_300413_1 (507 letters) | 5.00E-52 | >pir\|\|T00809 hypothetical protein T32G6.5 - Arabidopsis thaliana gb\|AAB84335.1\| (AC002510) putative esterase D [Arabidopsis thaliana] gb\|AAK55678.1\|AF378875_1 (AF378875) At2g41530/T32G6.5 [Arabidopsis thaliana] |
| 35 | 136729_300438_1 (628 letters) | 3.00E-86 | >sp\|P28756\|SOD1_ORYSA SUPEROXIDE DISMUTASE [CU-ZN] 1 pir\|\|S22508 superoxide dismutase (EC 1.15.1.1) (Cu-Zn) sodA - rice dbj\|BAA00799.1\| (D00999) copper/zinc-superoxide dismutase [Oryza sativa] gb\|AAC14464.1\| (L19435) cytosolic copper/zinc-superoxide dismutase [Oryza sativa] prf\|\|2111424A Cu/Zn superoxide dismutase [Oryza sativa] |
| 36 | 137131_300502_1 (612 letters) | 2.00E-34 | >gb\|AAD35089.1\|AF148877_1 (AF148877) putative aldehyde dehydrogenase OS-ALDH [Oryza sativa subsp. indica] |
| 38 | 167904_300552_1 (611 letters) | 3.00E-58 | >gb\|AAD03441.1\| (AF118223) contains similarity to Guillardia theta ABC transporter (GB:AF041468) [Arabidopsis thaliana] emb\|CAB80842.1\| (AL161501) putative ABC transporter [Arabidopsis thaliana] |
| 39 | 168371_300555_1 (705 letters) | 2.00E-74 | >dbj\|BAB18760.1\| (AB027000) beta-cyanoalanine synthase [Solanum tuberosum] |
| 40 | 171278_300535_1 (655 letters) | 5.00E-82 | >dbj\|BAA92972.1\| (AP001551) ESTs AU056183(S20356),AU056881(S20950) correspond to a region of the predicted gene.-Similar to Arabidopsis thaliana chromosome 4 BAC clone F6I18 ; putative protein kinase. (AL022198) [Oryza sativa] |

Figure 3 continued

| SEQ ID NO | Query Contig ID (length, bp) | Pz Score | Result |
|---|---|---|---|
| 41 | 174874_300527_1 (583 letters) | 2.00E-52 | >sp\|P43284\|TRP2_MAIZE TRYPTOPHAN SYNTHASE BETA CHAIN 2 PRECURSOR (ORANGE PERICARP 2) pir\|\|PQ0450 tryptophan synthase (EC 4.2.1.20) beta-2 chain precursor - maize (fragment) gb\|AAA33491.1\| (M76685) tryptophan synthase beta-subunit [Zea mays] |
| 42 | 175126_300530_1 (681 letters) | 3.00E-80 | >gb\|AAF60317.1\|AF236109_1 (AF236109) putative purple acid phosphatase precursor [Phaseolus vulgaris] |
| 43 | 175159_300530_1 (381 letters) | 2.00E-12 | >gb\|AAK37831.1\|AF182309_1 (AF182309) alpha-tubulin [Euglena gracilis] gb\|AAK37832.1\|AF182556_1 (AF182556) alpha-tubulin [Euglena gracilis] gb\|AAK37833.1\|AF182557_1 (AF182557) alpha-tubulin [Euglena gracilis] gb\|AAK37835.1\|AF182553_1 (AF182553) alpha-tubulin [Euglena gracilis] |
| 44 | 175378_300541_1 (466 letters) | 5.00E-74 | >gb\|AAC78103.1\| (AF093631) Rieske Fe-S precursor protein [Oryza sativa] |
| 45 | 175535_300545_1 (666 letters) | 2.00E-75 | >gb\|AAB97122.1\| (AC003674) unknown protein [Arabidopsis thaliana] |
| 46 | 175706_300544_1 (616 letters) | 5.00E-66 | >emb\|CAA40474.1\| (X57187) chitinase [Phaseolus vulgaris] |
| 47 | 175904_300523_1 (598 letters) | 7.00E-57 | >gb\|AAC61829.1\| (AC004667) glycine decarboxylase complex H-protein [Arabidopsis thaliana] |
| 48 | 176385_300521_1 (559 letters) | 4.00E-80 | >pir\|\|T05091 probable methyltransferase F28M20.20 - Arabidopsis thaliana emb\|CAA19744.1\| (AL031004) methyltransferase like protein [Arabidopsis thaliana] emb\|CAB79897.1\| (AL161579) methyltransferase-like protein [Arabidopsis thaliana] gb\|AAK32892.1\|AF367305_1 (AF367305) AT4g31790/F28M20_20 [Arabidopsis thaliana] |
| 49 | 180809_300625_1 (465 letters) | 3.00E-34 | >sp\|Q42961\|PGKH_TOBAC PHOSPHOGLYCERATE KINASE, CHLOROPLAST PRECURSOR pir\|\|T03660 phosphoglycerate kinase (EC 2.7.2.3) precursor, chloroplast - common tobacco emb\|CAA88841.1\| (Z48977) phosphoglycerate kinase [Nicotiana tabacum] |
| 50 | 183214_300592_1 (637 letters) | 4.00E-83 | >dbj\|BAA84791.1\| (AP000559) ESTs AU030008(E50477),AU078239(E50477) correspond to a region of the predicted gene.; Similar to peptidyl-prolyl cis-trans isomerase 10 &CELB0252_4 (P52017) [Oryza sativa] |
| 51 | 183295_300592_1 (643 letters) | 7.00E-98 | >sp\|Q9SLY8\|CRTC_ORYSA CALRETICULIN PRECURSOR dbj\|BAA88900.1\| (AB021259) calcium-binding protein [Oryza sativa] |

Figure 3 continued

| SEQ ID NO | Query Contig ID (length, bp) | Pz Score | Result |
|---|---|---|---|
| 52 | 183350_300593_1 (674 letters) | 1.00E-90 | >sp\|P93407\|SODP_ORYSA SUPEROXIDE DISMUTASE [CU-ZN], CHLOROPLAST PRECURSOR pir\|\|T03685 probable superoxide dismutase (EC 1.15.1.1) (Cu-Zn) precursor, chloroplast - rice dbj\|BAA12745.1\| (D85239) superoxide dismutase precusor [Oryza sativa] dbj\|BAB21760.1\| (AB026724) copper/zinc superoxide dismutase [Oryza sativa] |
| 53 | 188835_300610_1 (606 letters) | 1.00E-108 | >dbj\|BAA36695.1\| (AB016501) glutelin [Oryza sativa] |
| 54 | 188836_300610_1 (565 letters) | 3.00E-37 | >pir\|\|S52392 prolamin - rice emb\|CAA59142.1\| (X84649) prolamin [Oryza sativa] |
| 55 | 188877_300610_1 (658 letters) | 1.00E-113 | >gb\|AAF72990.1\|AF261277_1 (AF261277) beta-expansin [Oryza sativa] gb\|AAK43515.1\|AC020666_25 (AC020666) beta-expansin [Oryza sativa] |
| 56 | 188877_301703_1 (575 letters) | 3.00E-64 | >gb\|AAD30573.1\|AC007260_4 (AC007260) 50S Ribosomal protein L13 [Arabidopsis thaliana] emb\|CAA60775.1\| (X87333) ribosomal protein L13 [Arabidopsis thaliana] gb\|AAK44133.1\|AF370318_1 (AF370318) putative 50S Ribosomal protein L13 [Arabidopsis thaliana] |
| 57 | 188877_301704_1 (391 letters) | 4.00E-20 | >gb\|AAD30573.1\|AC007260_4 (AC007260) 50S Ribosomal protein L13 [Arabidopsis thaliana] emb\|CAA60775.1\| (X87333) ribosomal protein L13 [Arabidopsis thaliana] gb\|AAK44133.1\|AF370318_1 (AF370318) putative 50S Ribosomal protein L13 [Arabidopsis thaliana] |
| 58 | 188959_300611_1 (628 letters) | 5.00E-69 | >gb\|AAC62137.1\| (AC005169) putative clathrin assembly protein [Arabidopsis thaliana] gb\|AAK44000.1\|AF370185_1 (AF370185) putative clathrin assembly protein [Arabidopsis thaliana] |
| 59 | 189013_300612_1 (564 letters) | 1.00E-20 | >pir\|\|T02663 abscisic acid- and stress-induced protein - rice gb\|AAB96681.1\| (AF039573) abscisic acid- and stress-inducible protein [Oryza sativa] |
| 60 | 189037_300612_1 (519 letters) | 5.00E-35 | >dbj\|BAA36699.1\| (AB016505) prolamin [Oryza sativa] |
| 61 | 200614_300746_1 (631 letters) | 1.00E-113 | >ref\|NP_009592.1\| contains 9 or 10 putative membrane spanning regions; putative Ca2+ binding protein (homology to EF-hand Ca2+ binding site); Csg2p [Saccharomyces cerevisiae] pir\|\|S45894 regulatory protein CSG2 precursor - yeast (Saccharomyces cerevisiae) emb\|CAA84978.1\| (Z35905) ORF YBR036c [Saccharomyces cerevisiae] dbj\|BAA05666.1\| (D28120) Cls2p (Ca2+-regulatory membrane protein) [Saccharomyces cerevisiae] |

Figure 3 continued

| SEQ ID NO | Query Contig ID (length, bp) | Pz Score | Result |
|---|---|---|---|
| 62 | 200629_300746_1 (600 letters) | 1.00E-102 | >ref\|NP_010698.1\| farnesyl cysteine-carboxyl methyltransferase; Ste14p [Saccharomyces cerevisiae] sp\|P32584\|ST14_YEAST PROTEIN-S ISOPRENYLCYSTEINE O-METHYLTRANSFERASE (ISOPRENYLCYSTEINE CARBOXYLMETHYLTRANSFERASE) pir\|\|S37604 farnesyl cysteine carboxyl-methyltransferase - yeast (Saccharomyces cerevisiae) gb\|AAA16520.1\| (L07952) farnesyl cysteine carboxyl-methyltransferase [Saccharomyces cerevisiae] gb\|AAA16840.1\| (L15442) isoprenylcysteine carboxyl methyltransferase [Saccharomyces cerevisiae] gb\|AAB64880.1\| (U33007) Ste14p: farnesyl cysteine carboxyl-methyltransferase; YDR410C; CAI: 0.12 [Saccharomyces cerevisiae] |
| 63 | 200665_300746_1 (875 letters) | 1.00E-159 | >ref\|NP_012868.1\| 3-oxoacyl-[acyl-carrier-protein] reductase; Oar1p [Saccharomyces cerevisiae] sp\|P35731\|YKF5_YEAST HYPOTHETICAL OXIDOREDUCTASE IN NUP120-CSE4 INTERGENIC REGION pir\|\|S37877 hypothetical protein YKL055c - yeast (Saccharomyces cerevisiae) emb\|CAA53417.1\| (X75781) 3-oxoacyl-[acyl-carrier-protein] reductase homologue [Saccharomyces cerevisiae] emb\|CAA81892.1\| (Z28055) ORF YKL055c [Saccharomyces cerevisiae] prf\|\|2206495M ORF [Saccharomyces cerevisiae] |
| 64 | 200671_300746_1 (631 letters) | 1.00E-118 | >ref\|NP_010583.1\| Syringomycin response protein 2; Sur2p [Saccharomyces cerevisiae] sp\|P38992\|SUR2_YEAST SUR2 PROTEIN (SYRINGOMYCIN RESPONSE PROTEIN 2) pir\|\|S48533 SUR2 protein - yeast (Saccharomyces cerevisiae) gb\|AAA16608.1\| (U07171) Sur2p [Saccharomyces cerevisiae] gb\|AAB64733.1\| (U28374) Sur2p: syringomycin response protein 2 [Saccharomyces cerevisiae] gb\|AAB41115.1\| (U10427) Syr2p [Saccharomyces cerevisiae] |
| 66 | 212363_300848_1 (373 letters) | 2.00E-13 | >emb\|CAC28576.1\| (AL513410) conserved hypothetical protein [Neurospora crassa] |
| 71 | 212511_300850_1 (301 letters) | 8.00E-07 | >gb\|AAK48714.1\|AF325533_1 (AF325533) 4-hydroxyphenylpyruvate dioxygenase [Magnaporthe grisea] |
| 74 | 212785_300843_1 (483 letters) | 1.00E-19 | >sp\|O74471\|COXE_SCHPO PROBABLE CYTOCHROME C OXIDASE POLYPEPTIDE VIA PRECURSOR pir\|\|T41117 probable Cytochrome C oxidase subunit via - fission yeast (Schizosaccharomyces pombe) emb\|CAA20783.1\| (AL031540) putative Cytochrome C oxidase subunit via [Schizosaccharomyces pombe] |
| 77 | 212959_300845_1 (568 letters) | 4.00E-08 | >pir\|\|H83195 conserved hypothetical protein PA3598 [imported] - Pseudomonas aeruginosa (strain PAO1) gb\|AAG06986.1\|AE004780_5 (AE004780) conserved hypothetical protein [Pseudomonas aeruginosa] |

Figure 3 continued

| SEQ ID NO | Query Contig ID (length, bp) | Pz Score | Result |
|---|---|---|---|
| 78 | 213011_300846_1 (588 letters) | 2.00E-16 | >pir||T26079 hypothetical protein W02A2.5 - Caenorhabditis elegans emb|CAB05308.1| (Z82286) predicted using Genefinder-contains similarity to Pfam domain: PF01679 (Uncharacterized protein family), Score=79.5, E-value=2.2e-20, N=1 [Caenorhabditis elegans] |
| 82 | 213364_300852_1 (491 letters) | 8.00E-54 | >sp|P52809|RL44_PICJA 60S RIBOSOMAL PROTEIN L44 (L41) dbj|BAA11057.1| (D67040) ribosomal protein L41 [Pichia jadinii] |
| 89 | 213830_300861_1 (486 letters) | 4.00E-20 | >dbj|BAB08952.1| (AB006700) lysine decarboxylase-like protein [Arabidopsis thaliana] |
| 90 | 213835_300861_1 (619 letters) | 4.00E-11 | >sp|O13689|YDYA_SCHPO HYPOTHETICAL 21.5 KD PROTEIN C11E3.10 IN CHROMOSOME I |
| 105 | 213946_300862_1 (535 letters) | 7.00E-22 | >pir||T51040 hypothetical protein B15I20.100 [imported] - Neurospora crassa emb|CAB97464.1| (AL389900) conserved hypothetical protein [Neurospora crassa] |
| 106 | 213956_300862_1 (407 letters) | 4.00E-12 | >pir||D81339 acetate kinase (EC 2.7.2.1) Cj0689 [imported] - Campylobacter jejuni (strain NCTC 11168) emb|CAB72963.1| (AL139076) acetate kinase [Campylobacter jejuni] |
| 109 | 213991_300862_1 (620 letters) | 3.00E-24 | >dbj|BAB05165.1| (AP001512) nucleoside transporter [Bacillus halodurans] |
| 111 | 214019_300854_1 (407 letters) | 2.00E-16 | >sp|P22151|GRG1_NEUCR GLUCOSE-REPRESSIBLE GENE PROTEIN pir||T50483 glucose-repressible protein 1 [imported] - Neurospora crassa emb|CAA32907.1| (X14801) grg1 [Neurospora crassa] emb|CAC28672.1| (AL513443) glucose-repressible protein grg-1 [Neurospora crassa] |
| 113 | 214084_300854_1 (635 letters) | 6.00E-24 | >sp|P42327|ADH2_BACST ALCOHOL DEHYDROGENASE (ADH) pir||S47643 alcohol dehydrogenase (EC 1.1.1.1) - Bacillus stearothermophilus (strain DSM 2334) emb|CAA80989.1| (Z25544) alcohol dehydrogenase [Bacillus stearothermophilus] |
| 114 | 214086_300854_1 (644 letters) | 1.00E-26 | >gb|AAF50468.1| (AE003556) CG7375 gene product [Drosophila melanogaster] |
| 115 | 214087_300854_1 (512 letters) | 2.00E-13 | >sp|P78980|PEXG_YARLI PEROXISOMAL MEMBRANE PROTEIN PEX16 (PEROXIN-16) gb|AAB41724.1| (U75433) Pex16p [Yarrowia lipolytica] |
| 118 | 214111_300855_1 (538 letters) | 5.00E-37 | >sp|O74893|RS20_SCHPO 40S RIBOSOMAL PROTEIN S20 pir||T41419 40s ribosomal protein s20 - fission yeast (Schizosaccharomyces pombe) emb|CAA21188.1| (AL031798) 40s ribosomal protein s20 [Schizosaccharomyces pombe] gb|AAG00495.1|AF282863_1 (AF282863) 40S robosomal protein S20 [Schizosaccharomyces pombe] |
| 133 | 214244_300856_1 (593 letters) | 5.00E-36 | >pir||B82434 probable NADH oxidase VCA0644 [imported] - Vibrio cholerae (group O1 strain N16961) gb|AAF96545.1| (AE004394) NADH oxidase, putative [Vibrio cholerae] |

Figure 3 continued

| SEQ ID NO | Query Contig ID (length, bp) | Pz Score | Result |
|---|---|---|---|
| 135 | 214259_300856_1 (531 letters) | 6.00E-19 | >ref\|NP_107561.1\| putative oxidoreductase [Mesorhizobium loti] dbj\|BAB53347.1\| (AP003011) putative oxidoreductase [Mesorhizobium loti] |
| 138 | 214278_300856_1 (580 letters) | 1.00E-13 | >sp\|P79009\|RS25_SCHPO 40S RIBOSOMAL PROTEIN S25 (S31) dbj\|BAA19096.1\| (AB000398) ribosomal protein S31 [Schizosaccharomyces pombe] |
| 140 | 214286_300856_1 (592 letters) | 2.00E-36 | >pir\|\|T49717 related to BCS1 protein precursor [imported] - Neurospora crassa emb\|CAB91698.1\| (AL356172) related to BCS1 protein precursor [Neurospora crassa] |
| 145 | 214318_300857_1 (546 letters) | 9.00E-07 | >ref\|NP_013294.1\| Ylr193cp [Saccharomyces cerevisiae] pir\|\|S48546 hypothetical protein YLR193c - yeast (Saccharomyces cerevisiae) gb\|AAB67434.1\| (U14913) Ylr193cp [Saccharomyces cerevisiae] |
| 146 | 214319_300857_1 (596 letters) | 2.00E-15 | >ref\|NP_065141.1\| CGI-203 protein [Homo sapiens] ref\|XP_004159.2\| CGI-203 protein [Homo sapiens] gb\|AAG01155.1\|AF285118_1 (AF285118) CGI-203 [Homo sapiens] |
| 152 | 214340_300857_1 (531 letters) | 1.00E-10 | >pir\|\|T38695 conserved hypothetical protein SPAC3C7.09 - fission yeast (Schizosaccharomyces pombe) emb\|CAB16739.1\| (Z99568) conserved hypothetical protein. [Schizosaccharomyces pombe] |
| 166 | 214421_300858_1 (668 letters) | 4.00E-14 | >ref\|NP_062357.1\| RNA and export factor binding protein 2; RNA and export factor binding protein 2-I [Mus musculus] emb\|CAB76384.1\| (AJ252141) RNA and export factor binding protein 2-I [Mus musculus] |
| 167 | 214433_300858_1 (589 letters) | 2.00E-06 | >ref\|NP_011356.1\| Ygl159wp [Saccharomyces cerevisiae] sp\|P53110\|YGP9_YEAST HYPOTHETICAL 41.6 KD PROTEIN IN SUT1-RCK1 INTERGENIC REGION pir\|\|S60427 probable membrane protein YGL159w - yeast (Saccharomyces cerevisiae) emb\|CAA96871.1\| (Z72681) ORF YGL159w [Saccharomyces cerevisiae] |
| 168 | 214437_300858_1 (639 letters) | 2.00E-57 | >ref\|NP_010738.1\| Ribosomal protein S18A; Rps18ap [Saccharomyces cerevisiae] ref\|NP_013686.1\| Ribosomal protein S18B; Rps18bp [Saccharomyces cerevisiae] sp\|P35271\|RS18_YEAST 40S RIBOSOMAL PROTEIN S18 pir\|\|S50886 ribosomal protein S18.e, cytosolic - yeast (Saccharomyces cerevisiae) emb\|CAA86629.1\| (Z46659) 40S ribosomal protein gene, len: 146, CAI: 0.74 [Saccharomyces cerevisiae] gb\|AAB64891.1\| (U33007) Ydr450wp [Saccharomyces cerevisiae] |
| 174 | 214445_300858_1 (668 letters) | 1.00E-05 | >pir\|\|T50198 probable transcription activator protein [imported] - fission yeast (Schizosaccharomyces pombe) emb\|CAB61777.1\| (AL133225) putative transcriptional activator protein [Schizosaccharomyces pombe] |

Figure 3 continued

| SEQ ID NO | Query Contig ID (length, bp) | Pz Score | Result |
|---|---|---|---|
| 178 | 214452_300858_1 (439 letters) | 2.00E-23 | >dbj\|BAA94531.1\| (AP001800) EST AU057948(S21932) corresponds to a region of the predicted gene.-hypothetical protein [Oryza sativa] |
| 179 | 214456_300858_1 (659 letters) | 2.00E-07 | >pir\|\|T26079 hypothetical protein W02A2.5 - Caenorhabditis elegans emb\|CAB05308.1\| (Z82286) predicted using Genefinder-contains similarity to Pfam domain: PF01679 (Uncharacterized protein family), Score=79.5, E-value=2.2e-20, N=1 [Caenorhabditis elegans] |
| 182 | 214460_300858_1 (650 letters) | 2.00E-51 | >gb\|AAF52395.1\| (AE003613) CG9547 gene product [Drosophila melanogaster] |
| 183 | 214461_300858_1 (620 letters) | 2.00E-08 | >pir\|\|F69905 probable alcohol dehydrogenase (EC 1.1.1.-) yogA - Bacillus subtilis emb\|CAB13726.1\| (Z99113) similar to alcohol dehydrogenase [Bacillus subtilis] emb\|CAB13736.1\| (Z99114) similar to alcohol dehydrogenase [Bacillus subtilis] |
| 185 | 214468_300858_1 (644 letters) | 5.00E-15 | >gb\|AAD30438.1\|AF119672_1 (AF119672) integral membrane protein [Magnaporthe grisea] |
| 191 | 214485_300858_1 (515 letters) | 1.00E-41 | >pir\|\|T40381 hypothetical protein SPBC3E7.07c fission yeast (Schizosaccharomyces pombe) emb\|CAA19020.1\| (AL023534) hypothetical protein [Schizosaccharomyces pombe] |
| 193 | 214493_300858_1 (444 letters) | 1.00E-09 | >ref\|NP_015506.1\| Similar to ubiquitin activating proteins; Aos1p [Saccharomyces cerevisiae] sp\|Q06624\|RH31_YEAST DNA DAMAGE TOLERANCE PROTEIN RHC31 (RAD31 HOMOLOG) pir\|\|S59837 probable membrane protein YPR180w - yeast (Saccharomyces cerevisiae) gb\|AAB68113.1\| (U25842) Similar in N-terminus to E. coli ThiF protein (Swiss Prot. accession number P30138) [Saccharomyces cerevisiae] |
| 197 | 214504_300859_1 (511 letters) | 1.00E-19 | >gb\|AAF51238.1\| (AE003582) CG3214 gene product [Drosophila melanogaster] |
| 199 | 214506_300859_1 (548 letters) | 4.00E-08 | >ref\|NP_010216.1\| Subunit VIIa of cytochrome c oxidase; Cox9p [Saccharomyces cerevisiae] |
| 200 | 214511_300859_1 (631 letters) | 2.00E-18 | >pir\|\|T51293 stress activated MAP kinase interacting protein - fission yeast (Schizosaccharomyces pombe) gb\|AAD37449.1\|AF155208_1 (AF155208) stress activated MAP kinase interacting protein [Schizosaccharomyces pombe] |
| 202 | 214515_300859_1 (480 letters) | 9.00E-16 | >pir\|\|T40363 40s ribosomal protein s25 - fission yeast (Schizosaccharomyces pombe) pir\|\|T43379 40s ribosomal protein S31 homolog - fission yeast (Schizosaccharomyces pombe) dbj\|BAA31553.1\| (AB016006) ribosomal protein S31 homolog [Schizosaccharomyces pombe] emb\|CAB09129.2\| (Z95620) 40s ribosomal protein s25 [Schizosaccharomyces pombe] |

Figure 3 continued

| SEQ ID NO | Query Contig ID (length, bp) | Pz Score | Result |
|---|---|---|---|
| 206 | 214534_300859_1 (629 letters) | 2.00E-12 | >pir\|\|T51079 related to chitinase 3 precursor protein [imported] - Neurospora crassa emb\|CAB98243.1\| (AL390092) related to chitinase 3 precursor protein [Neurospora crassa] |
| 208 | 214545_300859_1 (575 letters) | 5.00E-10 | >emb\|CAA80973.1\| (Z25485) ACR1-protein [Saccharomyces cerevisiae] |
| 215 | 214578_300859_1 (600 letters) | 7.00E-21 | >ref\|NP_014702.1\| Yor059cp [Saccharomyces cerevisiae] pir\|\|S66942 probable membrane protein YOR059c - yeast (Saccharomyces cerevisiae) emb\|CAA99252.1\| (Z74967) ORF YOR059c [Saccharomyces cerevisiae] emb\|CAA94544.1\| (Z70678) YOR29-10 [Saccharomyces cerevisiae] |
| 217 | 214583_300859_1 (538 letters) | 6.00E-06 | >ref\|NP_075208.1\| Ydl085c-ap [Saccharomyces cerevisiae] pir\|\|S78710 protein YDL085c-a - yeast (Saccharomyces cerevisiae) |
| 218 | 214584_300859_1 (634 letters) | 2.00E-62 | >sp\|Q55905\|PPSA_SYNY3 PHOSPHOENOLPYRUVATE SYNTHASE (PYRUVATE,WATER DIKINASE) (PEP SYNTHASE) pir\|\|S76976 pyruvate,water dikinase (EC 2.7.9.2) - Synechocystis sp. (strain PCC 6803) dbj\|BAA10668.1\| (D64005) phosphoenolpyruvate synthase [Synechocystis sp.] |
| 221 | 214595_300859_1 (543 letters) | 2.00E-51 | >sp\|Q10082\|YAO3_SCHPO HYPOTHETICAL 34.1 KD PROTEIN C11D3.03C IN CHROMOSOME I pir\|\|T37514 hypothetical protein SPAC11D3.03c - fission yeast (Schizosaccharomyces pombe) emb\|CAA92304.1\| (Z68166) hypothetical protein. [Schizosaccharomyces pombe] |
| 223 | 214601_300863_1 (470 letters) | 2.00E-33 | >ref\|NP_012317.1\| Yjl218wp [Saccharomyces cerevisiae] sp\|P40892\|YJV8_YEAST PUTATIVE ACETYLTRANSFERASE IN HXT11-HXT8 INTERGENIC REGION pir\|\|S50709 probable O-acetyltransferase (EC 2.3.1.-) YJL218w - yeast (Saccharomyces cerevisiae) emb\|CAA83992.1\| (Z34098) ORF [Saccharomyces cerevisiae] emb\|CAA89515.1\| (Z49493) ORF YJL218w [Saccharomyces cerevisiae] |
| 225 | 214603_300863_1 (595 letters) | 1.00E-80 | >emb\|CAC18315.1\| (AL451022) probable IMP4 protein [Neurospora crassa] |
| 227 | 214606_300863_1 (672 letters) | 7.00E-07 | >ref\|NP_054762.1\| DKFZP564O123 protein [Homo sapiens] pir\|\|T12468 hypothetical protein DKFZp564O123.1 - human emb\|CAB45721.1\| (AL080122) hypothetical protein [Homo sapiens] |
| 228 | 214607_300863_1 (651 letters) | 9.00E-32 | >pir\|\|T08877 Modin - Podospora anserina gb\|AAC25496.1\| (AF025289) Modin [Podospora anserina] |
| 233 | 214613_300863_1 (659 letters) | 2.00E-44 | >pdb\|1GGW\|A Chain A, Cdc4p From Schizosaccharomyces Pombe |

Figure 3 continued

| SEQ ID NO | Query Contig ID (length, bp) | Pz Score | Result |
|---|---|---|---|
| 236 | 214626_300863_1 (649 letters) | 9.00E-85 | >sp\|P23704\|ATPB_NEUCR ATP SYNTHASE BETA CHAIN, MITOCHONDRIAL PRECURSOR pir\|\|JC1112 H+-transporting ATP synthase (EC 3.6.1.34) beta chain [similarity] - Neurospora crassa emb\|CAA37756.1\| (X53720) F(1)-ATPase beta-subunit precursor (519 AA) [Neurospora crassa] gb\|AAA33562.1\| (M84192) mitochondrial ATPase beta-subunit [Neurospora crassa] emb\|CAB91479.1\| (AL355933) H+-transporting ATP synthase (EC 3.6.1.34) beta chain [Neurospora crassa] |
| 239 | 214633_300863_1 (520 letters) | 5.00E-49 | >pir\|\|T46646 pyridoxine biosynthesis protein pdx1 [imported] - Cercospora nicotianae gb\|AAD13386.1\| (AF035619) pyridoxine biosynthesis protein [Cercospora nicotianae] |
| 240 | 214634_300863_1 (561 letters) | 4.00E-94 | >dbj\|BAB40590.1\| (AB041752) endochitinase-HAR2 [Trichoderma harzianum] |
| 242 | 214639_300863_1 (477 letters) | 1.00E-18 | >pir\|\|T49825 hypothetical protein B24H17.110 [imported] - Neurospora crassa emb\|CAB92633.1\| (AL356815) putative protein [Neurospora crassa] |
| 250 | 214672_300863_1 (661 letters) | 1.00E-18 | >ref\|NP_075207.1\| Ybl071w-ap [Saccharomyces cerevisiae] |
| 252 | 214680_300863_1 (603 letters) | 2.00E-19 | >ref\|NP_012223.1\| Yil041wp [Saccharomyces cerevisiae] sp\|P40531\|YIE1_YEAST 36.7 KD PROTEIN IN CBR5-NOT3 INTERGENIC REGION pir\|\|S49937 hypothetical protein YIL041w - yeast (Saccharomyces cerevisiae) emb\|CAA86910.1\| (Z46861) unknown [Saccharomyces cerevisiae] |
| 256 | 214695_300863_1 (472 letters) | 3.00E-07 | >emb\|CAC38828.1\| (AJ303089) OTT-MAL [Homo sapiens] |
| 260 | 214708_300864_1 (616 letters) | 4.00E-06 | >gb\|AAG40148.1\|AF213669_1 (AF213669) bHLHZip transcription factor BIGMAX [Drosophila melanogaster] |
| 261 | 214710_300864_1 (211 letters) | 5.00E-10 | >pir\|\|T39206 hypothetical protein SPAC926.08c - fission yeast (Schizosaccharomyces pombe) emb\|CAB54156.1\| (AL110469) hypothetical protein [Schizosaccharomyces pombe] |
| 268 | 214756_300864_1 (670 letters) | 2.00E-39 | >gb\|AAA77678.1\| (U18061) CAP20 [Glomerella cingulata] |
| 271 | 215167_300878_1 (548 letters) | 1.00E-28 | >pir\|\|T51222 hypothetical protein B24M22.180 [imported] - Neurospora crassa emb\|CAB99386.1\| (AL390354) conserved hypothetical protein [Neurospora crassa] |
| 272 | 215174_300878_1 (588 letters) | 9.00E-44 | >emb\|CAB76570.1\| (AJ245552) cytochrome c oxidase subunit V [Podospora anserina] |
| 273 | 215181_300878_1 (367 letters) | 3.00E-25 | >sp\|P32192\|EF1D_ARTSA ELONGATION FACTOR 1-DELTA (EF-1-DELTA) pir\|\|S47630 translation elongation factor eEF-1 delta chain - brine shrimp |
| 274 | 215183_300878_1 (552 letters) | 3.00E-19 | >pir\|\|T48811 hypothetical protein 15E6.190 [imported] - Neurospora crassa emb\|CAB88650.1\| (AL353822) conserved hypothetical protein [Neurospora crassa] |

Figure 3 continued

| SEQ ID NO | Query Contig ID (length, bp) | Pz Score | Result |
|---|---|---|---|
| 276 | 215213_300879_1 (545 letters) | 7.00E-60 | >emb\|CAC18626.1\| (AL451109) probable homoserine kinase [Neurospora crassa] |
| 277 | 215221_300879_1 (588 letters) | 1.00E-20 | >emb\|CAC28690.1\| (AL513444) probable ribosomal protein L38 [Neurospora crassa] |
| 278 | 215255_300879_1 (568 letters) | 1.00E-85 | >sp\|Q09127\|RL10_SCHPO 60S RIBOSOMAL PROTEIN L10 (QM PROTEIN HOMOLOG) (SPQM) pir\|\|T39755 60s ribosomal protein l10 - fission yeast (Schizosaccharomyces pombe) emb\|CAA22664.1\| (AL035077) 60s ribosomal protein l10 [Schizosaccharomyces pombe] |
| 279 | 215267_300879_1 (473 letters) | 3.00E-56 | >sp\|P40910\|RS3A_CANAL 40S RIBOSOMAL PROTEIN S3AE (S1) pir\|\|S49366 ribosomal protein S0.e.B, cytosolic - yeast (Candida albicans) emb\|CAA57542.1\| (X82017) ribosomal protein 10 [Candida albicans] |
| 280 | 215280_300879_1 (647 letters) | 3.00E-99 | >emb\|CAA11267.1\| (AJ223328) polyubiquitin [Nicotiana tabacum] emb\|CAA07773.1\| (AJ007936) polyubiquitin [Gibberella pulicaris] |
| 282 | 215308_300880_1 (415 letters) | 1.00E-09 | >emb\|CAC34571.1\| (AJ409217) putative ARM-1 protein [Gallus gallus] |
| 284 | 215338_300880_1 (566 letters) | 4.00E-39 | >sp\|P23750\|H41_EMENI HISTONE H4.1 pir\|\|S11939 histone H4.1 - Emericella nidulans emb\|CAA39155.1\| (X55549) H4.1 [Aspergillus nidulans] gb\|AAA20820.1\| (U12630) histone H4.1 [Aspergillus nidulans] dbj\|BAB12238.1\| (AB033943) histone H4 [Aspergillus oryzae] prf\|\|1707275C histone H4.1 [Emericella nidulans] |
| 285 | 215343_300880_1 (548 letters) | 1.00E-11 | >pir\|\|T51215 hypothetical protein B24M22.110 [imported] - Neurospora crassa emb\|CAB99379.1\| (AL390354) conserved hypothetical protein [Neurospora crassa] |
| 288 | 215373_300880_1 (575 letters) | 4.00E-57 | >sp\|Q02854\|NUXM_NEUCR NADH-UBIQUINONE OXIDOREDUCTASE 21 KD SUBUNIT (COMPLEX I-21KD) (CI-21KD) pir\|\|S27171 NADH dehydrogenase (ubiquinone) (EC 1.6.5.3) 20.9K chain - Neurospora crassa emb\|CAA43221.1\| (X60829) NADH dehydrogenase, 21 kDa subunit [Neurospora crassa] |
| 289 | 215379_300880_1 (512 letters) | 2.00E-59 | >pir\|\|T49800 probable ribosomal protein Rps8bp [imported] - Neurospora crassa emb\|CAB92705.1\| (AL356834) probable ribosomal protein Rps8bp [Neurospora crassa] |

Figure 3 continued

| SEQ ID NO | Query Contig ID (length, bp) | Pz Score | Result |
|---|---|---|---|
| 290 | 215382_300880_1 (613 letters) | 5.00E-27 | >ref|NP_014332.1| Ribosomal protein L9B (L8B) (rp24) (YL11); Rpl9bp [Saccharomyces cerevisiae] sp|P51401|RL9B_YEAST 60S RIBOSOMAL PROTEIN L9-B (L8) (YL11) (RP25) pir||S53915 ribosomal protein L9.e.B, cytosolic - yeast (Saccharomyces cerevisiae) emb|CAA60195.1| (X86470) putative second copy of ribosomal protein gene YL9A, SWISS_PROT:RL9_YEAST [Saccharomyces cerevisiae] gb|AAA99644.1| (U12141) ribosomal protein YL9 [Saccharomyces cerevisiae] emb|CAA95940.1| (Z71343) ORF YNL067w [Saccharomyces cerevisiae] |
| 291 | 215383_300880_1 (452 letters) | 3.00E-27 | >sp|P48503|UCRQ_NEUCR UBIQUINOL-CYTOCHROME C REDUCTASE COMPLEX UBIQUINONE-BINDING PROTEIN QP-C PRECURSOR (UBIQUINOL-CYTOCHROME C REDUCTASE COMPLEX 11 KDA PROTEIN) (COMPLEX III SUBUNIT VII) pir||T46746 ubiquinol--cytochrome-c reductase (EC 1.10.2.2) chain VIII [imported] - Neurospora crassa gb|AAC49654.1| (U20790) ubiquinol-cytochrome c oxidoreductase subunit VIII [Neurospora crassa] |
| 292 | 215409_300881_1 (508 letters) | 1.00E-07 | >ref|NP_011157.1| Yfl030wp [Saccharomyces cerevisiae] sp|P43567|YFD0_YEAST HYPOTHETICAL 41.9 KD PROTEIN IN HAC1-CAK1 INTERGENIC REGION pir||S56224 hypothetical protein YFL030w - yeast (Saccharomyces cerevisiae) dbj|BAA09208.1| (D50617) YFL030W [Saccharomyces cerevisiae] |
| 293 | 215410_300881_1 (619 letters) | 1.00E-20 | >pir||T50270 hypothetical protein SPAC922.05c [imported] - fission yeast (Schizosaccharomyces pombe) emb|CAB63552.1| (AL133522) hypothetical protein [Schizosaccharomyces pombe] |
| 294 | 215420_300881_1 (615 letters) | 4.00E-29 | >pdb|1BEK| Effect Of Unnatural Heme Substitution On Kinetics Of Electron Transfer In Cytochrome C Peroxidase |
| 295 | 215429_300881_1 (668 letters) | 1.00E-71 | >sp|P34737|RS15_PODAN 40S RIBOSOMAL PROTEIN S15 (S12) pir||A53793 ribosomal protein S12, cytosolic - Podospora anserina emb|CAA80805.1| (Z23267) cytoplasmic ribosomal protein S12 [Podospora anserina] |
| 296 | 215431_300881_1 (674 letters) | 2.00E-68 | >sp|Q10157|RL11_SCHPO 60S RIBOSOMAL PROTEIN L11 pir||T38395 ribosomal protein L11 - fission yeast (Schizosaccharomyces pombe) pir||T39733 60s ribosomal protein L11 - fission yeast (Schizosaccharomyces pombe) emb|CAA93230.1| (Z69240) 60s ribosomal protein L11 [Schizosaccharomyces pombe] dbj|BAA31552.1| (AB016005) ribosomal protein L11 homolog [Schizosaccharomyces pombe] emb|CAB52808.1| (AL109846) 60s ribosomal protein L11 [Schizosaccharomyces pombe] |

Figure 3 continued

| SEQ ID NO | Query Contig ID (length, bp) | Pz Score | Result |
|---|---|---|---|
| 297 | 215432_300881_1 (555 letters) | 3.00E-39 | >sp\|P00842\|ATP9_NEUCR ATP SYNTHASE PROTEIN 9, MITOCHONDRIAL PRECURSOR (LIPID-BINDING PROTEIN) pir\|\|LWNCA H+-transporting ATP synthase (EC 3.6.1.34) lipid-binding protein precursor - Neurospora crassa |
| 298 | 215461_300881_1 (559 letters) | 8.00E-21 | >pir\|\|T40973 cytochrome c oxidase polypeptide vib - fission yeast (Schizosaccharomyces pombe) emb\|CAA21442.1\| (AL031966) cytochrome c oxidase polypeptide vib [Schizosaccharomyces pombe] |
| 301 | 215523_300882_1 (441 letters) | 3.00E-12 | >emb\|CAC28576.1\| (AL513410) conserved hypothetical protein [Neurospora crassa] |
| 304 | 215552_300882_1 (530 letters) | 2.00E-36 | >pdb\|1YAA\|A Chain A, Aspartate Aminotransferase From Saccharomyces Cerevisiae Cytoplasm pdb\|1YAA\|B Chain B, Aspartate Aminotransferase From Saccharomyces Cerevisiae Cytoplasm pdb\|1YAA\|C Chain C, Aspartate Aminotransferase From Saccharomyces Cerevisiae Cytoplasm pdb\|1YAA\|D Chain D, Aspartate Aminotransferase From Saccharomyces Cerevisiae Cytoplasm |
| 305 | 215553_300882_1 (572 letters) | 2.00E-35 | >sp\|O59931\|RL13_CANAL 60S RIBOSOMAL PROTEIN L13 gb\|AAD09956.1\| (AF050672) ribosomal protein L13E [Candida albicans] emb\|CAA21966.1\| (AL033497) ribosomal protein L13e [Candida albicans] gb\|AAD09226.1\| (U80854) ribosomal protein L13 [Candida albicans] |
| 306 | 215579_300882_1 (338 letters) | 2.00E-25 | >gb\|AAD47296.1\| (AF017140) dihydrolipoamide succinyltransferase [Aspergillus fumigatus] |
| 307 | 215586_300882_1 (382 letters) | 8.00E-06 | >ref\|NP_107120.1\| dehydrogenase [Mesorhizobium loti] dbj\|BAB52906.1\| (AP003009) dehydrogenase [Mesorhizobium loti] |
| 311 | 215611_300883_1 (593 letters) | 2.00E-38 | >gb\|AAG28787.1\|AF308443_1 (AF308443) 60S ribosomal protein [Trichoderma hamatum] |
| 312 | 215615_300883_1 (441 letters) | 1.00E-23 | >sp\|O00087\|DLDH_SCHPO DIHYDROLIPOAMIDE DEHYDROGENASE, MITOCHONDRIAL PRECURSOR (DLDH) emb\|CAB65609.1\| (AL136078) dihydrolipoamide dehydrogenase, mitochondrial precursor (EC 1.8.1.4) [Schizosaccharomyces pombe] |
| 314 | 215637_300883_1 (541 letters) | 4.00E-23 | >pir\|\|T47216 probable V-ATPase, 20K chain [imported] - Neurospora crassa gb\|AAB61278.1\| (AF001033) Woronin body major protein [Neurospora crassa] |
| 315 | 215638_300883_1 (473 letters) | 8.00E-13 | >emb\|CAC28576.1\| (AL513410) conserved hypothetical protein [Neurospora crassa] |
| 316 | 215639_300883_1 (455 letters) | 4.00E-29 | >pir\|\|T37806 probable flavoprotein subunit - fission yeast (Schizosaccharomyces pombe) emb\|CAB16560.1\| (Z99292) putative flavoprotein subunit [Schizosaccharomyces pombe] |
| 317 | 215661_300883_1 (381 letters) | 2.00E-24 | >gb\|AAK55436.1\| (AF378567) cytochrome-c oxidase chain VIIc-like protein [Ophiostoma ulmi] |

Figure 3 continued

| SEQ ID NO | Query Contig ID (length, bp) | Pz Score | Result |
|---|---|---|---|
| 320 | 215672_300883_1 (515 letters) | 1.00E-43 | >sp\|P21772\|RS26_NEUCR 40S RIBOSOMAL PROTEIN S26E (CRP5) (13.6 KD RIBOSOMAL PROTEIN) pir\|\|R4NC26 ribosomal protein S26.e - Neurospora crassa emb\|CAA39162.1\| (X55637) ribosomal protein [Neurospora crassa] |
| 321 | 215678_300883_1 (558 letters) | 2.00E-04 | >emb\|CAC28735.1\| (AL513462) putative protein [Neurospora crassa] |
| 322 | 215685_300883_1 (495 letters) | 2.00E-11 | >gb\|AAD28474.1\|AF133671_1 (AF133671) coproporphyrinogen III oxidase precursor [Chlamydomonas reinhardtii] gb\|AAD28475.1\|AF133672_1 (AF133672) coproporphyrinogen III oxidase precursor [Chlamydomonas reinhardtii] |
| 327 | 215882_300885_1 (552 letters) | 4.00E-08 | >sp\|P78768\|VTI1_SCHPO VESICLE TRANSPORT V-SNARE PROTEIN VTI1 HOMOLOG pir\|\|T40349 vesicle transport v-snare protein - fission yeast (Schizosaccharomyces pombe) emb\|CAA17790.1\| (AL022070) vesicle transport v-snare protein [Schizosaccharomyces pombe] |
| 329 | 215907_300886_1 (423 letters) | 4.00E-11 | >sp\|P42281\|ACBP_DROME ACYL-COA-BINDING PROTEIN HOMOLOG (ACBP) (DIAZEPAM BINDING INHIBITOR HOMOLOG) (DBI) pir\|\|A56041 endozepine - fruit fly (Drosophila melanogaster) gb\|AAA21649.1\| (U04822) diazepam binding inhibitor [Drosophila melanogaster] gb\|AAA21650.1\| (U04823) diazepam binding inhibitor [Drosophila melanogaster] gb\|AAF50607.1\| (AE003560) Dbi gene product [Drosophila melanogaster] |
| 331 | 215917_300886_1 (199 letters) | 7.00E-14 | >emb\|CAC28788.1\| (AL513464) probable SEC23 [Neurospora crassa] |
| 332 | 215918_300886_1 (617 letters) | 5.00E-74 | >emb\|CAC28704.1\| (AL513444) probable ubiquitin-conjugating enzyme ubcP3 [Neurospora crassa] |
| 333 | 215926_300886_1 (691 letters) | 7.00E-48 | >ref\|NP_014840.1\| Yor197wp [Saccharomyces cerevisiae] pir\|\|S67089 hypothetical protein YOR197w - yeast (Saccharomyces cerevisiae) emb\|CAA99410.1\| (Z75105) ORF YOR197w [Saccharomyces cerevisiae] |
| 334 | 215930_300886_1 (683 letters) | 1.00E-85 | >ref\|NP_011223.1\| Ribosomal protein L2A (L5A) (rp8) (YL6); Rpl2ap [Saccharomyces cerevisiae] ref\|NP_012246.1\| Ribosomal protein L2B (L5B) (rp8) (YL6); Rpl2bp [Saccharomyces cerevisiae] sp\|P05736\|RL6_YEAST 60S RIBOSOMAL PROTEIN L2 (YL6) (L5) (RP8) pir\|\|S50243 ribosomal protein L8.e, cytosolic - yeast (Saccharomyces cerevisiae) gb\|AAA92283.1\| (U17359) ribosomal protein YL6 (L5) [Saccharomyces cerevisiae] emb\|CAA86974.1\| (Z46881) putative 60S ribosomal protein [Saccharomyces cerevisiae] |
| 335 | 215937_300886_1 (617 letters) | 2.00E-76 | >gb\|AAD10497.1\| (U91983) phosphatidylserine synthase [Triticum aestivum] |

Figure 3 continued

| SEQ ID NO | Query Contig ID (length, bp) | Pz Score | Result |
|---|---|---|---|
| 338 | 215957_300886_1 (575 letters) | 5.00E-65 | >ref|NP_009604.1| Ribosomal protein S11B (S18B) (rp41B) (YS12); Rps11bp [Saccharomyces cerevisiae] ref|NP_010308.1| Ribosomal protein S11A (S18A) (rp41A) (YS12); Rps11ap [Saccharomyces cerevisiae] sp|P26781|RS11_YEAST 40S RIBOSOMAL PROTEIN S11 (S18) (YS12) (RP41) pir||S41784 ribosomal protein S11.e, cytosolic - yeast (Saccharomyces cerevisiae) gb|AAC37411.1| (L15408) ribosomal protein S18 [Saccharomyces cerevisiae] gb|AAC37410.1| (L17004) ribosomal protein S18 [Saccharomyces cerevisiae] emb|CAA84990.1| (Z35917) ORF YBR048w [Saccharomyces cerevisiae] emb|CAA87804.1| (Z47814) Rps18ap [Saccharomyces cerevisiae] emb|CAA65218.1| (X95966) 40S ribosomal protein [Saccharomyces cerevisiae] emb|CAA98846.1| (Z74321) ORF YDR025w [Saccharomyces cerevisiae] |
| 339 | 215962_300886_1 (623 letters) | 6.00E-24 | >emb|CAB91184.2| (AL355921) putative ubiquitin conjugating enzyme, e2 [Schizosaccharomyces pombe] |
| 340 | 215968_300886_1 (626 letters) | 1.00E-04 | >emb|CAC35000.1| (AL391034) hypothetical protein [Schizosaccharomyces pombe] |
| 341 | 215973_300886_1 (345 letters) | 6.00E-17 | >sp|Q01294|CARP_NEUCR VACUOLAR PROTEASE A PRECURSOR pir||T47207 aspartic proteinase (EC 3.4.23.-) [imported] - Neurospora crassa gb|AAA79878.1| (U36471) vacuolar protease A [Neurospora crassa] |
| 342 | 215986_300886_1 (633 letters) | 2.00E-29 | >sp|Q10113|MAL3_SCHPO MAL3 PROTEIN pir||T37928 probable chromosome segregation protein - fission yeast (Schizosaccharomyces pombe) pir||T43413 probable chromosome segregation protein - fission yeast (Schizosaccharomyces pombe) emb|CAA92392.1| (Z68198) putative chromosome segregation protein [Schizosaccharomyces pombe] emb|CAA70707.1| (Y09518) MAL3 protein [Schizosaccharomyces pombe] |
| 350 | 216047_300887_1 (379 letters) | 2.00E-04 | >pir||I55214 salivary proline-rich glycoprotein precursor - rat gb|AAA75405.1| (L08134) glycoprotein [Rattus norvegicus] prf||2107200A glycoprotein [Rattus norvegicus] |
| 351 | 216059_300887_1 (426 letters) | 3.00E-07 | >dbj|BAB22088.1| (AK002421) putative [Mus musculus] dbj|BAB32314.1| (AK021173) putative [Mus musculus] dbj|BAB40856.1| (AB049651) mitochondrial ribosomal protein L33 (L33mt) [Mus musculus] |
| 355 | 216071_300887_1 (570 letters) | 9.00E-82 | >emb|CAC36929.1| (AL590605) 40c ribosomal protein S6 [Schizosaccharomyces pombe] |

Figure 3 continued

| SEQ ID NO | Query Contig ID (length, bp) | Pz Score | Result |
|---|---|---|---|
| 357 | 216093_300887_1 (481 letters) | 1.00E-25 | >ref|NP_015362.1| Erv2p [Saccharomyces cerevisiae] sp|Q12284|ERV2_YEAST ERV2 PROTEIN, MITOCHONDRIAL PRECURSOR pir||S61060 probable membrane protein YPR037c - yeast (Saccharomyces cerevisiae) emb|CAA92143.1| (Z68111) unknown [Saccharomyces cerevisiae] emb|CAA94987.1| (Z71255) unknown [Saccharomyces cerevisiae] |
| 358 | 216113_300866_1 (564 letters) | 2.00E-16 | >gb|AAB97513.1| (AF017783) alpha NAC [Drosophila melanogaster] gb|AAF58457.1| (AE003821) Nacalpha gene product [Drosophila melanogaster] |
| 360 | 216131_300866_1 (459 letters) | 7.00E-45 | >sp|P42114|NB4M_NEUCR NADH-UBIQUINONE OXIDOREDUCTASE 14.8 KD SUBUNIT (COMPLEX I-14.8KD) (CI-14.8KD) pir||S43840 NADH dehydrogenase (ubiquinone) (EC 1.6.5.3) - Neurospora crassa emb|CAA53963.1| (X76344) NADH dehydrogenase (ubiquinone) [Neurospora crassa] |
| 361 | 216157_300866_1 (557 letters) | 2.00E-61 | >sp|O94363|RHEB_SCHPO GTP-BINDING PROTEIN RHEB HOMOLOG pir||T40468 probable ras-related GTP-binding protein - fission yeast (Schizosaccharomyces pombe) emb|CAA22291.1| (AL034382) putative ras-related GTP-binding protein [Schizosaccharomyces pombe] |
| 363 | 216189_300866_1 (503 letters) | 4.00E-12 | >sp|P33953|RS22_KLUMA 40S RIBOSOMAL PROTEIN S22 (S15A) (YS24) pir||S30003 ribosomal protein S15a.e - yeast (Kluyveromyces marxianus) gb|AAB24900.1| (S53434) S24-1 [Kluyveromyces marxianus] |
| 364 | 216191_300866_1 (601 letters) | 6.00E-11 | >ref|NP_104990.1| acetyltransferase [Mesorhizobium loti] dbj|BAB50776.1| (AP003003) acetyltransferase [Mesorhizobium loti] |
| 365 | 216193_300866_1 (592 letters) | 1.00E-34 | >pir||T38622 ribulose-phosphate 3-epimerase - fission yeast (Schizosaccharomyces pombe) emb|CAB11689.1| (Z98979) putative ribulose phosphate 3-epimerase [Schizosaccharomyces pombe] |
| 366 | 216228_300867_1 (599 letters) | 2.00E-43 | >gb|AAF79727.1|AC005106_8 (AC005106) T25N20.16 [Arabidopsis thaliana] |
| 370 | 216262_300867_1 (249 letters) | 1.00E-07 | >pir||T49708 probable 3-methyl-2-oxobutanoate dehydrogenase (lipoamide)E1 beta chain precursor [imported] - Neurospora crassa emb|CAB91689.1| (AL356172) probable 3-methyl-2-oxobutanoate dehydrogenase (lipoamide)E1 beta chain precursor [Neurospora crassa] |
| 371 | 216268_300867_1 (596 letters) | 2.00E-98 | >pir||T02754 probable 1-aminocyclopropane-1-carboxylate oxidase (EC 1.4.3.-) - rice gb|AAC05507.1| (AF049889) 1-aminocyclopropane-1-carboxylate oxidase [Oryza sativa] |
| 372 | 216270_300867_1 (537 letters) | 9.00E-11 | >gb|AAK18812.1|AF321883_1 (AF321883) TOM7 [Neurospora crassa] |
| 375 | 216319_300868_1 (637 letters) | 8.00E-16 | >gb|AAF53953.1| (AE003669) CG9265 gene product [Drosophila melanogaster] |

Figure 3 continued

| SEQ ID NO | Query Contig ID (length, bp) | Pz Score | Result |
|---|---|---|---|
| 378 | 216338_300868_1 (577 letters) | 2.00E-10 | >sp\|P42116\|NURM_NEUCR NADH-UBIQUINONE OXIDOREDUCTASE 17.8 KD SUBUNIT PRECURSOR (COMPLEX I-17.8KD) (CI-17.8KD) pir\|\|S35057 NADH dehydrogenase (EC 1.6.99.3) 17.8K chain - Neurospora crassa emb\|CAA50537.1\| (X71414) NADH dehydrogenase [Neurospora crassa] |
| 379 | 216345_300868_1 (594 letters) | 6.00E-30 | >emb\|CAC28857.1\| (AL513467) conserved hypothetical protein [Neurospora crassa] |
| 382 | 216355_300868_1 (603 letters) | 2.00E-08 | >gb\|AAF50425.1\| (AE003555) CG7163 gene product [Drosophila melanogaster] |
| 383 | 216377_300868_1 (628 letters) | 4.00E-05 | >ref\|NP_014815.1\| Yor172wp [Saccharomyces cerevisiae] pir\|\|S67060 probable membrane protein YOR172w - yeast (Saccharomyces cerevisiae) gb\|AAB47417.1\| (U55021) O3620p [Saccharomyces cerevisiae] emb\|CAA99380.1\| (Z75080) ORF YOR172w [Saccharomyces cerevisiae] |
| 384 | 216408_300869_1 (585 letters) | 1.00E-39 | >sp\|P52808\|RL30_SCHPO 60S RIBOSOMAL PROTEIN L30 (L32) pir\|\|T39226 60s ribosomal protein L30 - fission yeast (Schizosaccharomyces pombe) gb\|AAB17132.1\| (U52080) ribosomal protein Rpl32p [Schizosaccharomyces pombe] emb\|CAB11499.1\| (Z98763) 60s ribosomal protein L30/L30A [Schizosaccharomyces pombe] |
| 387 | 216464_300869_1 (626 letters) | 2.00E-22 | >gb\|AAH03864.1\|AAH03864 (BC003864) nuclear receptor binding factor 1 [Mus musculus] |
| 394 | 219090_300927_1 (615 letters) | 7.00E-06 | >sp\|Q01663\|AP1_SCHPO AP-1-LIKE TRANSCRIPTION FACTOR pir\|\|S15664 transcription factor pap1 - fission yeast (Schizosaccharomyces pombe) emb\|CAA40363.1\| (X57078) AP-1-like transcription factor [Schizosaccharomyces pombe] |
| 395 | 219159_300928_1 (838 letters) | 2.00E-71 | >ref\|NP_005580.1\| methylmalonate-semialdehyde dehydrogenase [Homo sapiens] ref\|XP_012348.2\| methylmalonate-semialdehyde dehydrogenase [Homo sapiens] sp\|Q02252\|MMSA_HUMAN METHYLMALONATE-SEMIALDEHYDE DEHYDROGENASE [ACYLATING], MITOCHONDRIAL PRECURSOR (MMSDH) gb\|AAF04489.1\|AF148505_1 (AF148505) methylmalonate-semialdehyde dehydrogenase [Homo sapiens] emb\|CAB76468.1\| (AJ249994) methylmalonate semialdehyde dehydrogenase [Homo sapiens] gb\|AAF80380.1\|AF159889_1 (AF159889) methylmalonate semialdehyde dehydrogenase [Homo sapiens] gb\|AAG29581.1\|AF148855_1 (AF148855) methylmalonate-semialdehyde dehydrogenase [Homo sapiens] gb\|AAH04909.1\|AAH04909 (BC004909) methylmalonate-semialdehyde dehydrogenase [Homo sapiens] |

Figure 3 continued

| SEQ ID NO | Query Contig ID (length, bp) | Pz Score | Result |
|---|---|---|---|
| 399 | 219218_300929_1 (345 letters) | 2.00E-17 | >sp\|Q12726\|HOSM_YARLI HOMOCITRATE SYNTHASE, MITOCHONDRIAL PRECURSOR emb\|CAA88928.1\| (Z49114) homocitrate synthase (acetyl-coenzyme A:2-Ketoglutarate C-acetyltransferase) [Yarrowia lipolytica] |
| 403 | 48435_300119_1 (623 letters) | 5.00E-97 | >gb\|AAD32922.1\|AC007167_4 (AC007167) putative heat shock protein [Arabidopsis thaliana] |
| 407 | 57821_300037_1 (562 letters) | 1.00E-30 | >gb\|AAF80217.1\|AC025290_6 (AC025290) Contains similarity to an unknown protein T16B12.5 gi\|3746062 from Arabidopsis thaliana gb\|AC005311. EST gb\|AI996597 comes from this gene |
| | 200671FL Saccharomyces cereviseae (1097 letters) | 0.0 | >ref\|NP_010583.1\| (NC_001136) Suppressor of rvs161 and rvs167 mutations; Sur2p [Saccharomyces cerevisiae] sp\|P38992\|SUR2_YEAST SUR2 PROTEIN (SYRINGOMYCIN RESPONSE PROTEIN 2) pir\|\|S48533 SUR2 protein - yeast (Saccharomyces cerevisiae) gb\|AAA16608.1\| (U07171) Sur2p [Saccharomyces cerevisiae] gb\|AAB64733.1\| (U28374) Sur2p: syringomycin response protein 2 [Saccharomyces cerevisiae] gb\|AAB41115.1\| (U10427) Syr2p [Saccharomyces cerevisiae] |
| | 216131FL Trichoderma harzianum (492 letters) | 1e-44 | >sp\|P42114\|NB4M_NEUCR NADH-ubiquinone oxidoreductase 14.8 kDa subunit (Complex I-14.8KD) (CI-14.8KD) pir\|\|S43840 NADH dehydrogenase (ubiquinone) (EC 1.6.5.3) - Neurospora crassa emb\|CAA53963.1\| (X76344) NADH dehydrogenase (ubiquinone) [Neurospora crassa] |
| | 216268FL Trichoderma harzianum (900 letters) | e-148 | >pir\|\|T02754 probable 1-aminocyclopropane-1-carboxylate oxidase (EC 1.4.3.-) - rice gb\|AAC05507.1\| (AF049889) 1-aminocyclopropane-1-carboxylate oxidase [Oryza sativa] |
| | 219090FL Trichoderma harzianum (1314 letters) | 3e-05 | >pir\|\|S15664 transcription factor pap1 - fission yeast (Schizosaccharomyces pombe) emb\|CAA40363.1\| (X57078) AP-1-like transcription factor [Schizosaccharomyces pombe] |
| | 216062FL Trichoderma harzianum (1154 letters) | 5e-62 | >gb\|AAD42941.1\|AF091621_1 (AF091621) ubiquitin-conjugating enzyme E2 [Catharanthus roseus] |
| | 215373FL Trichoderma harzianum (689 letters) | 1e-54 | >sp\|Q02854\|NUXM_NEUCR NADH-ubiquinone oxidoreductase 21 kDa subunit (Complex I-21KD) (CI-21KD) pir\|\|S27171 NADH dehydrogenase (ubiquinone) (EC 1.6.5.3) 20.9K chain - Neurospora crassa emb\|CAA43221.1\| (X60829) NADH dehydrogenase, 21 kDa subunit [Neurospora crassa] |

Figure 3 continued

| SEQ ID NO | Query Contig ID (length, bp) | Pz Score | Result |
|---|---|---|---|
| | 214639FL Trichoderma harzianum (906 letters) | 2e-24 | >emb|CAB92633.2| (AL356815) putative protein [Neurospora crassa] |
| | 215595FL Trichoderma harzianum (654 letters) | 1e-09 | >gb|AAF86474.1| (AF277080) blastomyces yeast phase-specific protein 1 [Ajellomyces dermatitidis] |
| | 214613FL Trichoderma harzianum (773 letters) | 2e-44 | >pdb|1GGW|A Chain A, Cdc4p From Schizosaccharomyces Pombe |
| | 212363FL Trichoderma harzianum (558 letters) | 6e-13 | >emb|CAC28576.1| (AL513410) conserved hypothetical protein [Neurospora crassa] |
| | 212454FL Trichoderma harzianum (241 letters) | 2e-12 | >sp|Q01373|FOX2_NEUCR Peroxisomal hydratase-dehydrogenase-epimerase (HDE) (Multifunctional beta-oxidation protein) (MFP) [Includes: 2-enoyl-CoA hydratase ; D-3-hydroxyacyl CoA dehydrogenase ] pir||S54786 multifunctional beta-oxidation protein - Neurospora crassa emb|CAA56355.1| (X80052) multifunctional beta-oxidation protein [Neurospora crassa] |
| | 213894FL Trichoderma harzianum (1190 letters) | 7e-18 | >ref|NP_593892.1| (NC_003424) hypothetical protein [Schizosaccharomyces pombe] emb|CAC21472.1| (AL512549) hypothetical protein [Schizosaccharomyces pombe] 213967FL Trichoderma harzianum (772 letters) 2e-18 >ref|NP_660100.1| (NC_001134) Similar to Hemiascomycetous yeast protein (FEBS Lett. 487(1): 31-36 (2000)).; Kti11p [Saccharomyces cerevisiae] |
| | 214087FL Trichoderma harzianum (1521 letters) | 5e-56 | >sp|P78980|PEXG_YARLI Peroxisomal membrane protein PEX16 (Peroxin-16) gb|AAB41724.1| (U75433) Pex16p [Yarrowia lipolytica] |
| | 214421FL Trichoderma harzianum (1226 letters) | 1e-12 | 1e-12 >ref|NP_062357.1| (NM_019484) RNA and export factor binding protein 2; RNA and export factor binding protein 2-I [Mus musculus] emb|CAB76384.1| (AJ252141) RNA and export factor binding protein 2-I [Mus musculus] |
| | 214672FL Trichoderma harzianum (817 letters) | 2e-18 | >ref|NP_660100.1| (NC_001134) Similar to Hemiascomycetous yeast protein (FEBS Lett. 487(1): 31-36 (2000)).; Kti11p [Saccharomyces cerevisiae] |
| | 214259FL Trichoderma harzianum (947 letters) | 3e-46 | >ref|NP_107561.1| (NC_002678) putative oxidoreductase [Mesorhizobium loti] dbj|BAB53347.1| (AP003011) putative oxidoreductase [Mesorhizobium loti] |

Figure 3 continued

| SEQ ID NO | Query Contig ID (length, bp) | Pz Score | Result |
|---|---|---|---|
| | 214443FL Trichoderma harzianum (1028 letters) | 5e-11 | >gb|AAM34385.1| (AC117082) hypothetical protein [Dictyostelium discoideum] |
| | 214460FL Trichoderma harzianum (1365 letters) | e-115 | >ref|NP_609040.1| (NM_135196) CG9547 gene product [Drosophila melanogaster] gb|AAF52395.1| (AE003613) CG9547 gene product [Drosophila melanogaster] gb|AAL13534.1| (AY058305) GH06693p [Drosophila melanogaster] |
| | 214633FL Trichoderma harzianum (1378 letters) | e-123 | >pir||T46646 pyridoxine biosynthesis protein pdx1 [imported] - Cercospora nicotianae gb|AAD13386.1| (AF035619) pyridoxine biosynthesis protein [Cercospora nicotianae] |
| | 216338FL Trichoderma harzianum (603 letters) | 4e-10 | >sp|P42116|NURM_NEUCR NADH-ubiquinone oxidoreductase 17.8 kDa subunit, mitochondrial precursor (Complex I-17.8KD) (CI-17.8KD) pir||S35057 NADH dehydrogenase (EC 1.6.99.3) 17.8K chain - Neurospora crassa emb|CAA50537.1| (X71414) NADH dehydrogenase [Neurospora crassa] |
| | 216259FL Trichoderma harzianum (1065 letters) | 7e-40 | >emb|CAA48139.1| (X67953) carboxyphosphonoenolpyruvate mutase [Streptomyces hygroscopicus] |
| | 216262FL Trichoderma harzianum (271 letters) | 2e-11 | >emb|CAB91689.2| (AL356172) probable 3-methyl-2-oxobutanoate dehydrogenase (lipoamide)E1 beta chain precursor [Neurospora crassa] |

Figure 4

Derwent Amino Acid db Search

This file describes the results of querying the Derwent AA db with claimed sequences (contigs) identified in functional screening using tBLASTX. Only results with Pz values <1.00E-4 are considered, and only the highest homology hit is shown.

| SEQ ID NO | Query Contig ID (length, bp) | Pz score | Result |
|---|---|---|---|
| 1 | 103532_300363_1 (653 letters) | 6.00E-12 | >gnl\|Derwent\|AAG52896 110 AA.Arabidopsis thaliana protein fragment SEQ ID NO: 67289.EP1033405-A2. |
| 2 | 103578_300363_1 (802 letters) | 1.00E-40 | >gb\|AAF65769.1\|AF242311_1 (AF242311) histone H2A [Euphorbia esula] |
| 3 | 104218_300060_1 (414 letters) | 3.00E-08 | >pir\|\|T03933 SAR8.2m protein, TMV-inducible - common tobacco gb\|AAB49767.1\| (U89604) SAR8.2m gene product [Nicotiana tabacum] dbj\|BAB13709.1\| (AB040408) elicitor inducible protein [Nicotiana tabacum] |
| 4 | 104251_300060_1 (562 letters) | 1.00E-92 | >pir\|\|B36094 pyrophosphate--fructose-6-phosphate 1-phosphotransferase (EC 2.7.1.90) beta chain - potato (cv. Kennebec) gb\|AAA63452.1\| (M55191) pyrophosphate-fructose 6-phosphate 1-phosphotransferase beta-subunit [Solanum tuberosum] |
| 5 | 104421_300364_1 (593 letters) | 3.00E-15 | >gb\|AAD39661.1\|AC007591_26 (AC007591) ESTs gb\|H37032, gb\|R6425, gb\|Z34651, gb\|N37268, gb\|AA713172 and gb\|Z34241 come from this gene. [Arabidopsis thaliana] |
| 6 | 104423_300364_1 (632 letters) | 8.00E-96 | >dbj\|BAA25394.1\| (AB012639) light harvesting chlorophyll a/b-binding protein [Nicotiana sylvestris] |
| 8 | 104874_300366_1 (681 letters) | 5.00E-26 | >pir\|\|T07393 myb-related transcription factor - tomato emb\|CAA67600.1\| (X99210) myb-related transcription factor [Lycopersicon esculentum] |
| 9 | 105059_300046_1 (636 letters) | 2.00E-35 | >pir\|\|T07780 remorin - potato gb\|AAB49425.1\| (U72489) remorin [Solanum tuberosum] |
| 10 | 107031_300262_1 (343 letters) | 3.00E-34 | >pir\|\|T15058 photosystem I protein psaH precursor - wood tobacco dbj\|BAA04634.1\| (D21055) PSI-H precursor [Nicotiana sylvestris] |
| 11 | 107690_300380_1 (624 letters) | 1.00E-47 | >sp\|P12301\|PSBQ_SPIOL OXYGEN-EVOLVING ENHANCER PROTEIN 3, CHLOROPLAST PRECURSOR (OEE3) (16 KDA SUBUNIT OF OXYGEN EVOLVING SYSTEM OF PHOTOSYSTEM II) (OEC 16 KDA SUBUNIT) pir\|\|S00008 photosystem II oxygen-evolving complex protein 3 precursor - spinach emb\|CAA29056.1\| (X05512) 16 kDa protein of the photosynthetic oxygen- evolving protein (OEC) [Spinacia oleracea] prf\|\|1307179B luminal protein 16kD [Spinacia oleracea] |
| 12 | 109076_300042_1 (604 letters) | 1.00E-68 | >sp\|P34091\|RL6_MESCR 60S RIBOSOMAL PROTEIN L6 (YL16-LIKE) pir\|\|S28586 ribosomal protein ML16, cytosolic - common ice plant emb\|CAA49175.1\| (X69378) ribosomal protein YL16 [Mesembryanthemum crystallinum] |

Figure 4 continued

| SEQ ID NO | Query Contig ID (length, bp) | Pz score | Result |
|---|---|---|---|
| 13 | 109576_300051_1 (664 letters) | 5.00E-81 | >sp\|P26573\|RBS8_NICPL RIBULOSE BISPHOSPHATE CARBOXYLASE SMALL CHAIN 8B PRECURSOR (RUBISCO SMALL SUBUNIT 8B) pir\|\|RKNTSV ribulose-bisphosphate carboxylase (EC 4.1.1.39) small chain precursor - curled-leaved tobacco emb\|CAA31994.1\| (X13711) ribulose bisphosphate carboxylase [Nicotiana plumbaginifolia] gb\|AAA34110.1\| (M36685) ribulose bisphosphate carboxylase [Nicotiana plumbaginifolia] |
| 14 | 113128_300022_1 (529 letters) | 5.00E-29 | >gb\|AAK15087.1\|AF240004_1 (AF240004) 11S globulin [Sesamum indicum] |
| 15 | 113145_300022_1 (594 letters) | 5.00E-45 | >emb\|CAB56580.1\| (AJ011628) squamosa promoter binding protein-like 1 [Arabidopsis thaliana] |
| 16 | 113718_300005_1 (529 letters) | 1.00E-63 | >emb\|CAA98178.1\| (Z73950) RAB11B [Lotus japonicus] |
| 17 | 114987_300010_1 (623 letters) | 4.00E-40 | >dbj\|BAA19111.1\| (AB000452) PEThy;ZPT2-6 [Petunia x hybrida] |
| 19 | 116525_300078_1 (583 letters) | 2.00E-67 | >sp\|P36213\|PSAD_HORVU PHOTOSYSTEM I REACTION CENTRE SUBUNIT II PRECURSOR (PHOTOSYSTEM I 20 KD SUBUNIT) (PSI-D) pir\|\|JQ2247 photosystem I chain D precursor - barley gb\|AAA18567.1\| (M98254) PSI-D subunit [Hordeum vulgare] |
| 20 | 120380_300384_1 (664 letters) | 5.00E-82 | >emb\|CAB90634.1\| (AJ277744) protein phosphatase 2C (PP2C) [Fagus sylvatica] |
| 21 | 120445_300385_1 (613 letters) | 5.00E-13 | >pir\|\|S51478 drought-induced protein Di19 - Arabidopsis thaliana emb\|CAA55321.1\| (X78584) Di19 [Arabidopsis thaliana] |
| 22 | 120677_300428_1 (577 letters) | 6.00E-98 | >sp\|P51135\|UCR5_TOBAC UBIQUINOL-CYTOCHROME C REDUCTASE IRON-SULFUR SUBUNIT 5, MITOCHONDRIAL PRECURSOR (RIESKE IRON-SULFUR PROTEIN 5) (RISP5) pir\|\|T02023 ubiquinol--cytochrome-c reductase (EC 1.10.2.2) Rieske iron-sulfur protein - common tobacco gb\|AAA20834.1\| (L16813) Rieske iron-sulfur protein [Nicotiana tabacum] |
| 23 | 120979_300518_1 (585 letters) | 3.00E-26 | >pir\|\|S53012 root-specific protein RCc3 - rice gb\|AAA65513.1\| (L27208) RCc3 [Oryza sativa] |
| 25 | 122157_300016_1 (545 letters) | 3.00E-36 | >pir\|\|T01391 WD-repeat protein T4I9.10 - Arabidopsis thaliana gb\|AAC79104.1\| (AF069442) putative WD-repeat protein [Arabidopsis thaliana] emb\|CAB77787.1\| (AL161495) putative WD-repeat protein [Arabidopsis thaliana] |
| 24 | 122157_301608_1 (542 letters) | 1.00E-24 | >gb\|AAK09221.1\|AC084320_8 (AC084320) putative phytochrome interacting factor [Oryza sativa] |
| 27 | 127573_300470_1 (673 letters) | 8.00E-93 | >pir\|\|S57471 GTP-binding protein GTP6 - garden pea emb\|CAA90080.1\| (Z49900) small GTP-binding protein [Pisum sativum] |
| 29 | 130630_300489_1 (606 letters) | 9.00E-36 | >gb\|AAF79618.1\|AC027665_19 (AC027665) F5M15.26 [Arabidopsis thaliana] |
| 30 | 130744_300490_1 (730 letters) | 1.00E-109 | >gb\|AAK43846.1\|AF370469_1 (AF370469) Unknown protein [Arabidopsis thaliana] |
| 31 | 131003_300510_1 (619 letters) | 9.00E-68 | >gb\|AAG61120.1\| (AF329934) ribulose-1,5-bisphosphate carboxylase/oxygenase activase 1 [Gossypium hirsutum] |

Figure 4 continued

| SEQ ID NO | Query Contig ID (length, bp) | Pz score | Result |
|---|---|---|---|
| 32 | 131272_300512_1 (438 letters) | 6.00E-67 | >gb\|AAD43167.1\|AC007504_22 (AC007504) Putative RAB7 GTP-binding Protein [Arabidopsis thaliana] |
| 33 | 135281_300412_1 (590 letters) | 3.00E-44 | >sp\|P09229\|CYT1_ORYSA CYSTEINE PROTEINASE INHIBITOR-I (ORYZACYSTATIN-I) pir\|\|A28464 oryzacystatin - rice pdb\|1EQK\|A Chain A, Solution Structure Of Oryzacystatin-I, A Cysteine Proteinase Inhibitor Of The Rice, Oryza Sativa L. Japonica gb\|AAA33903.1\| (J03469) oryzacystatin [Oryza sativa] gb\|AAA33912.1\| (M29259) oryzastatin [Oryza sativa] gb\|AAB24010.1\| (S49967) oryzacystatin=cysteine protease inhibitor [Oryza=rice, Peptide, 102 aa] gb\|AAB66355.1\| (U54702) oryzacystatin [Oryza sativa] |
| 34 | 135357_300413_1 (507 letters) | 5.00E-52 | >pir\|\|T00809 hypothetical protein T32G6.5 - Arabidopsis thaliana gb\|AAB84335.1\| (AC002510) putative esterase D [Arabidopsis thaliana] gb\|AAK55678.1\|AF378875_1 (AF378875) At2g41530/T32G6.5 [Arabidopsis thaliana] |
| 35 | 136729_300438_1 (628 letters) | 3.00E-86 | >sp\|P28756\|SOD1_ORYSA SUPEROXIDE DISMUTASE [CU-ZN] 1 pir\|\|S22508 superoxide dismutase (EC 1.15.1.1) (Cu-Zn) sodA - rice dbj\|BAA00799.1\| (D00999) copper/zinc-superoxide dismutase [Oryza sativa] gb\|AAC14464.1\| (L19435) cytosolic copper/zinc-superoxide dismutase [Oryza sativa] prf\|\|2111424A Cu/Zn superoxide dismutase [Oryza sativa] |
| 36 | 137131_300502_1 (612 letters) | 2.00E-34 | >gb\|AAD35089.1\|AF148877_1 (AF148877) putative aldehyde dehydrogenase OS-ALDH [Oryza sativa subsp. indica] |
| 38 | 167904_300552_1 (611 letters) | 3.00E-58 | >gb\|AAD03441.1\| (AF118223) contains similarity to Guillardia theta ABC transporter (GB:AF041468) [Arabidopsis thaliana] emb\|CAB80842.1\| (AL161501) putative ABC transporter [Arabidopsis thaliana] |
| 39 | 168371_300555_1 (705 letters) | 2.00E-74 | >dbj\|BAB18760.1\| (AB027000) beta-cyanoalanine synthase [Solanum tuberosum] |
| 40 | 171278_300535_1 (655 letters) | 5.00E-82 | >dbj\|BAA92972.1\| (AP001551) ESTs AU056183(S20356),AU056881(S20950) correspond to a region of the predicted gene.-Similar to Arabidopsis thaliana chromosome 4 BAC clone F6I18 ; putative protein kinase. (AL022198) [Oryza sativa] |
| 41 | 174874_300527_1 (583 letters) | 2.00E-52 | >sp\|P43284\|TRP2_MAIZE TRYPTOPHAN SYNTHASE BETA CHAIN 2 PRECURSOR (ORANGE PERICARP 2) pir\|\|PQ0450 tryptophan synthase (EC 4.2.1.20) beta-2 chain precursor - maize (fragment) gb\|AAA33491.1\| (M76685) tryptophan synthase beta-subunit [Zea mays] |
| 42 | 175126_300530_1 (681 letters) | 3.00E-80 | >gb\|AAF60317.1\|AF236109_1 (AF236109) putative purple acid phosphatase precursor [Phaseolus vulgaris] |

Figure 4 continued

| SEQ ID NO | Query Contig ID (length, bp) | Pz score | Result |
|---|---|---|---|
| 43 | 175159_300530_1 (381 letters) | 2.00E-12 | >gb\|AAK37831.1\|AF182309_1 (AF182309) alpha-tubulin [Euglena gracilis] gb\|AAK37832.1\|AF182556_1 (AF182556) alpha-tubulin [Euglena gracilis] gb\|AAK37833.1\|AF182557_1 (AF182557) alpha-tubulin [Euglena gracilis] gb\|AAK37835.1\|AF182553_1 (AF182553) alpha-tubulin [Euglena gracilis] |
| 44 | 175378_300541_1 (466 letters) | 5.00E-74 | >gb\|AAC78103.1\| (AF093631) Rieske Fe-S precursor protein [Oryza sativa] |
| 45 | 175535_300545_1 (666 letters) | 2.00E-75 | >gb\|AAB97122.1\| (AC003674) unknown protein [Arabidopsis thaliana] |
| 46 | 175706_300544_1 (616 letters) | 5.00E-66 | >emb\|CAA40474.1\| (X57187) chitinase [Phaseolus vulgaris] |
| 47 | 175904_300523_1 (598 letters) | 7.00E-57 | >gb\|AAC61829.1\| (AC004667) glycine decarboxylase complex H-protein [Arabidopsis thaliana] |
| 48 | 176385_300521_1 (559 letters) | 4.00E-80 | >pir\|\|T05091 probable methyltransferase F28M20.20 - Arabidopsis thaliana emb\|CAA19744.1\| (AL031004) methyltransferase - like protein [Arabidopsis thaliana] emb\|CAB79897.1\| (AL161579) methyltransferase-like protein [Arabidopsis thaliana] gb\|AAK32892.1\|AF367305_1 (AF367305) AT4g31790/F28M20_20 [Arabidopsis thaliana] |
| 49 | 180809_300625_1 (465 letters) | 3.00E-34 | >sp\|Q42961\|PGKH_TOBAC PHOSPHOGLYCERATE KINASE, CHLOROPLAST PRECURSOR pir\|\|T03660 phosphoglycerate kinase (EC 2.7.2.3) precursor, chloroplast - common tobacco emb\|CAA88841.1\| (Z48977) phosphoglycerate kinase [Nicotiana tabacum] |
| 50 | 183214_300592_1 (637 letters) | 4.00E-83 | >dbj\|BAA84791.1\| (AP000559) ESTs AU030008(E50477),AU078239(E50477) correspond to a region of the predicted gene.; Similar to peptidyl-prolyl cis-trans isomerase 10 &CELB0252_4 (P52017) [Oryza sativa] |
| 51 | 183295_300592_1 (643 letters) | 7.00E-98 | >sp\|Q9SLY8\|CRTC_ORYSA CALRETICULIN PRECURSOR dbj\|BAA88900.1\| (AB021259) calcium-binding protein [Oryza sativa] |
| 52 | 183350_300593_1 (674 letters) | 1.00E-90 | >sp\|P93407\|SODP_ORYSA SUPEROXIDE DISMUTASE [CU-ZN], CHLOROPLAST PRECURSOR pir\|\|T03685 probable superoxide dismutase (EC 1.15.1.1) (Cu-Zn) precursor, chloroplast - rice dbj\|BAA12745.1\| (D85239) superoxide dismutase precusor [Oryza sativa] dbj\|BAB21760.1\| (AB026724) copper/zinc superoxide dismutase [Oryza sativa] |
| 53 | 188835_300610_1 (606 letters) | 1.00E-108 | >dbj\|BAA36695.1\| (AB016501) glutelin [Oryza sativa] |
| 54 | 188836_300610_1 (565 letters) | 3.00E-37 | >pir\|\|S52392 prolamin - rice emb\|CAA59142.1\| (X84649) prolamin [Oryza sativa] |
| 55 | 188877_300610_1 (658 letters) | 1.00E-113 | >gb\|AAF72990.1\|AF261277_1 (AF261277) beta-expansin [Oryza sativa] gb\|AAK43515.1\|AC020666_25 (AC020666) beta-expansin [Oryza sativa] |

Figure 4 continued

| SEQ ID NO | Query Contig ID (length, bp) | Pz score | Result |
|---|---|---|---|
| 56 | 188877_301703_1 (575 letters) | 3.00E-64 | >gb\|AAD30573.1\|AC007260_4 (AC007260) 50S Ribosomal protein L13 [Arabidopsis thaliana] emb\|CAA60775.1\| (X87333) ribosomal protein L13 [Arabidopsis thaliana] gb\|AAK44133.1\|AF370318_1 (AF370318) putative 50S Ribosomal protein L13 [Arabidopsis thaliana] |
| 57 | 188877_301704_1 (391 letters) | 4.00E-20 | >gb\|AAD30573.1\|AC007260_4 (AC007260) 50S Ribosomal protein L13 [Arabidopsis thaliana] emb\|CAA60775.1\| (X87333) ribosomal protein L13 [Arabidopsis thaliana] gb\|AAK44133.1\|AF370318_1 (AF370318) putative 50S Ribosomal protein L13 [Arabidopsis thaliana] |
| 58 | 188959_300611_1 (628 letters) | 5.00E-69 | >gb\|AAC62137.1\| (AC005169) putative clathrin assembly protein [Arabidopsis thaliana] gb\|AAK44000.1\|AF370185_1 (AF370185) putative clathrin assembly protein [Arabidopsis thaliana] |
| 59 | 189013_300612_1 (564 letters) | 1.00E-20 | >pir\|\|T02663 abscisic acid- and stress-induced protein - rice gb\|AAB96681.1\| (AF039573) abscisic acid- and stress-inducible protein [Oryza sativa] |
| 60 | 189037_300612_1 (519 letters) | 5.00E-35 | >dbj\|BAA36699.1\| (AB016505) prolamin [Oryza sativa] |
| 61 | 200614_300746_1 (631 letters) | 1.00E-113 | >ref\|NP_009592.1\| contains 9 or 10 putative membrane spanning regions; putative Ca2+ binding protein (homology to EF-hand Ca2+ binding site); Csg2p [Saccharomyces cerevisiae] pir\|\|S45894 regulatory protein CSG2 precursor - yeast (Saccharomyces cerevisiae) emb\|CAA84978.1\| (Z35905) ORF YBR036c [Saccharomyces cerevisiae] dbj\|BAA05666.1\| (D28120) Cls2p (Ca2+-regulatory membrane protein) [Saccharomyces cerevisiae] |
| 62 | 200629_300746_1 (600 letters) | 1.00E-102 | >ref\|NP_010698.1\| farnesyl cysteine-carboxyl methyltransferase; Ste14p [Saccharomyces cerevisiae] sp\|P32584\|ST14_YEAST PROTEIN-S ISOPRENYLCYSTEINE O-METHYLTRANSFERASE (ISOPRENYLCYSTEINE CARBOXYLMETHYLTRANSFERASE) pir\|\|S37604 farnesyl cysteine carboxyl-methyltransferase - yeast (Saccharomyces cerevisiae) gb\|AAA16520.1\| (L07952) farnesyl cysteine carboxyl-methyltransferase [Saccharomyces cerevisiae] gb\|AAA16840.1\| (L15442) isoprenylcysteine carboxyl methyltransferase [Saccharomyces cerevisiae] gb\|AAB64880.1\| (U33007) Ste14p: farnesyl cysteine carboxyl-methyltransferase; YDR410C; CAI: 0.12 [Saccharomyces cerevisiae] |

Figure 4 continued

| SEQ ID NO | Query Contig ID (length, bp) | Pz score | Result |
|---|---|---|---|
| 63 | 200665_300746_1 (875 letters) | 1.00E-159 | >ref|NP_012868.1| 3-oxoacyl-[acyl-carrier-protein] reductase; Oar1p [Saccharomyces cerevisiae] sp|P35731|YKF5_YEAST HYPOTHETICAL OXIDOREDUCTASE IN NUP120-CSE4 INTERGENIC REGION pir||S37877 hypothetical protein YKL055c - yeast (Saccharomyces cerevisiae) emb|CAA53417.1| (X75781) 3-oxoacyl-[acyl-carrier-protein] reductase homologue [Saccharomyces cerevisiae] emb|CAA81892.1| (Z28055) ORF YKL055c [Saccharomyces cerevisiae] prf||2206495M ORF [Saccharomyces cerevisiae] |
| 64 | 200671_300746_1 (631 letters) | 1.00E-118 | >ref|NP_010583.1| Syringomycin response protein 2; Sur2p [Saccharomyces cerevisiae] sp|P38992|SUR2_YEAST SUR2 PROTEIN (SYRINGOMYCIN RESPONSE PROTEIN 2) pir||S48533 SUR2 protein - yeast (Saccharomyces cerevisiae) gb|AAA16608.1| (U07171) Sur2p [Saccharomyces cerevisiae] gb|AAB64733.1| (U28374) Sur2p: syringomycin response protein 2 [Saccharomyces cerevisiae] gb|AAB41115.1| (U10427) Syr2p [Saccharomyces cerevisiae] |
| 66 | 212363_300848_1 (441 letters) | 9.00E-13 | >emb|CAC28576.1| (AL513410) conserved hypothetical protein [Neurospora crassa] |
| 71 | 212511_300850_1 (301 letters) | 8.00E-07 | >gb|AAK48714.1|AF325533_1 (AF325533) 4-hydroxyphenylpyruvate dioxygenase [Magnaporthe grisea] |
| 74 | 212785_300843_1 (483 letters) | 1.00E-19 | >sp|O74471|COXE_SCHPO PROBABLE CYTOCHROME C OXIDASE POLYPEPTIDE VIA PRECURSOR pir||T41117 probable Cytochrome C oxidase subunit via fission yeast (Schizosaccharomyces pombe) emb|CAA20783.1| (AL031540) putative Cytochrome C oxidase subunit via [Schizosaccharomyces pombe] |
| 77 | 212959_300845_1 (568 letters) | 4.00E-08 | >pir||H83195 conserved hypothetical protein PA3598 [imported] - Pseudomonas aeruginosa (strain PAO1) gb|AAG06986.1|AE004780_5 (AE004780) conserved hypothetical protein [Pseudomonas aeruginosa] |
| 78 | 213011_300846_1 (588 letters) | 2.00E-16 | >pir||T26079 hypothetical protein W02A2.5 - Caenorhabditis elegans emb|CAB05308.1| (Z82286) predicted using Genefinder-contains similarity to Pfam domain: PF01679 (Uncharacterized protein family), Score=79.5, E-value=2.2e-20, N=1 [Caenorhabditis elegans] |
| 82 | 213364_300852_1 (491 letters) | 8.00E-54 | >sp|P52809|RL44_PICJA 60S RIBOSOMAL PROTEIN L44 (L41) dbj|BAA11057.1| (D67040) ribosomal protein L41 [Pichia jadinii] |
| 89 | 213830_300861_1 (486 letters) | 4.00E-20 | >dbj|BAB08952.1| (AB006700) lysine decarboxylase-like protein [Arabidopsis thaliana] |
| 90 | 213835_300861_1 (619 letters) | 4.00E-11 | >sp|O13689|YDYA_SCHPO HYPOTHETICAL 21.5 KD PROTEIN C11E3.10 IN CHROMOSOME I |
| 105 | 213946_300862_1 (535 letters) | 7.00E-22 | >pir||T51040 hypothetical protein B15I20.100 [imported] - Neurospora crassa emb|CAB97464.1| (AL389900) conserved hypothetical protein [Neurospora crassa] |

Figure 4 continued

| SEQ ID NO | Query Contig ID (length, bp) | Pz score | Result |
|---|---|---|---|
| 106 | 213956_300862_1 (407 letters) | 4.00E-12 | >pir\|\|D81339 acetate kinase (EC 2.7.2.1) Cj0689 [imported] - Campylobacter jejuni (strain NCTC 11168) emb\|CAB72963.1\| (AL139076) acetate kinase [Campylobacter jejuni] |
| 109 | 213991_300862_1 (620 letters) | 3.00E-24 | >dbj\|BAB05165.1\| (AP001512) nucleoside transporter [Bacillus halodurans] |
| 111 | 214019_300854_1 (407 letters) | 2.00E-16 | >sp\|P22151\|GRG1_NEUCR GLUCOSE-REPRESSIBLE GENE PROTEIN pir\|\|T50483 glucose-repressible protein 1 [imported] - Neurospora crassa emb\|CAA32907.1\| (X14801) grg1 [Neurospora crassa] emb\|CAC28672.1\| (AL513443) glucose-repressible protein grg-1 [Neurospora crassa] |
| 113 | 214084_300854_1 (635 letters) | 6.00E-24 | >sp\|P42327\|ADH2_BACST ALCOHOL DEHYDROGENASE (ADH) pir\|\|S47643 alcohol dehydrogenase (EC 1.1.1.1) - Bacillus stearothermophilus (strain DSM 2334) emb\|CAA80989.1\| (Z25544) alcohol dehydrogenase [Bacillus stearothermophilus] |
| 114 | 214086_300854_1 (644 letters) | 1.00E-26 | >gb\|AAF50468.1\| (AE003556) CG7375 gene product [Drosophila melanogaster] |
| 115 | 214087_300854_1 (512 letters) | 2.00E-13 | >sp\|P78980\|PEXG_YARLI PEROXISOMAL MEMBRANE PROTEIN PEX16 (PEROXIN-16) gb\|AAB41724.1\| (U75433) Pex16p [Yarrowia lipolytica] |
| 118 | 214111_300855_1 (538 letters) | 5.00E-37 | >sp\|O74893\|RS20_SCHPO 40S RIBOSOMAL PROTEIN S20 pir\|\|T41419 40s ribosomal protein s20 - fission yeast (Schizosaccharomyces pombe) emb\|CAA21188.1\| (AL031798) 40s ribosomal protein s20 [Schizosaccharomyces pombe] gb\|AAG00495.1\|AF282863_1 (AF282863) 40S robosomal protein S20 [Schizosaccharomyces pombe] |
| 133 | 214244_300856_1 (593 letters) | 5.00E-36 | >pir\|\|B82434 probable NADH oxidase VCA0644 [imported] - Vibrio cholerae (group O1 strain N16961) gb\|AAF96545.1\| (AE004394) NADH oxidase, putative [Vibrio cholerae] |
| 135 | 214259_300856_1 (531 letters) | 6.00E-19 | >ref\|NP_107561.1\| putative oxidoreductase [Mesorhizobium loti] dbj\|BAB53347.1\| (AP003011) putative oxidoreductase [Mesorhizobium loti] |
| 138 | 214278_300856_1 (580 letters) | 1.00E-13 | >sp\|P79009\|RS25_SCHPO 40S RIBOSOMAL PROTEIN S25 (S31) dbj\|BAA19096.1\| (AB000398) ribosomal protein S31 [Schizosaccharomyces pombe] |
| 140 | 214286_300856_1 (592 letters) | 2.00E-36 | >pir\|\|T49717 related to BCS1 protein precursor [imported] - Neurospora crassa emb\|CAB91698.1\| (AL356172) related to BCS1 protein precursor [Neurospora crassa] |
| 145 | 214318_300857_1 (546 letters) | 9.00E-07 | >ref\|NP_013294.1\| Ylr193cp [Saccharomyces cerevisiae] pir\|\|S48546 hypothetical protein YLR193c - yeast (Saccharomyces cerevisiae) gb\|AAB67434.1\| (U14913) Ylr193cp [Saccharomyces cerevisiae] |
| 146 | 214319_300857_1 (596 letters) | 2.00E-15 | >ref\|NP_065141.1\| CGI-203 protein [Homo sapiens] ref\|XP_004159.2\| CGI-203 protein [Homo sapiens] gb\|AAG01155.1\|AF285118_1 (AF285118) CGI-203 [Homo sapiens] |

Figure 4 continued

| SEQ ID NO | Query Contig ID (length, bp) | Pz score | Result |
|---|---|---|---|
| 152 | 214340_300857_1 (531 letters) | 1.00E-10 | >pir\|\|T38695 conserved hypothetical protein SPAC3C7.09 - fission yeast (Schizosaccharomyces pombe) emb\|CAB16739.1\| (Z99568) conserved hypothetical protein. [Schizosaccharomyces pombe] |
| 166 | 214421_300858_1 (668 letters) | 4.00E-14 | >ref\|NP_062357.1\| RNA and export factor binding protein 2; RNA and export factor binding protein 2-I [Mus musculus] emb\|CAB76384.1\| (AJ252141) RNA and export factor binding protein 2-I [Mus musculus] |
| 167 | 214433_300858_1 (589 letters) | 2.00E-06 | >ref\|NP_011356.1\| Ygl159wp [Saccharomyces cerevisiae] sp\|P53110\|YGP9_YEAST HYPOTHETICAL 41.6 KD PROTEIN IN SUT1-RCK1 INTERGENIC REGION pir\|\|S60427 probable membrane protein YGL159w - yeast (Saccharomyces cerevisiae) emb\|CAA96871.1\| (Z72681) ORF YGL159w [Saccharomyces cerevisiae] |
| 168 | 214437_300858_1 (639 letters) | 2.00E-57 | >ref\|NP_010738.1\| Ribosomal protein S18A; Rps18ap [Saccharomyces cerevisiae] ref\|NP_013686.1\| Ribosomal protein S18B; Rps18bp [Saccharomyces cerevisiae] sp\|P35271\|RS18_YEAST 40S RIBOSOMAL PROTEIN S18 pir\|\|S50886 ribosomal protein S18.e, cytosolic - yeast (Saccharomyces cerevisiae) emb\|CAA86629.1\| (Z46659) 40S ribosomal protein gene, len: 146, CAI: 0.74 [Saccharomyces cerevisiae] gb\|AAB64891.1\| (U33007) Ydr450wp [Saccharomyces cerevisiae] |
| 174 | 214445_300858_1 (668 letters) | 1.00E-05 | >pir\|\|T50198 probable transcription activator protein [imported] - fission yeast (Schizosaccharomyces pombe) emb\|CAB61777.1\| (AL133225) putative transcriptional activator protein [Schizosaccharomyces pombe] |
| 178 | 214452_300858_1 (439 letters) | 2.00E-23 | >dbj\|BAA94531.1\| (AP001800) EST AU057948(S21932) corresponds to a region of the predicted gene.~hypothetical protein [Oryza sativa] |
| 179 | 214456_300858_1 (659 letters) | 2.00E-07 | >pir\|\|T26079 hypothetical protein W02A2.5 - Caenorhabditis elegans emb\|CAB05308.1\| (Z82286) predicted using Genefinder~contains similarity to Pfam domain: PF01679 (Uncharacterized protein family), Score=79.5, E-value=2.2e-20, N=1 [Caenorhabditis elegans] |
| 182 | 214460_300858_1 (650 letters) | 2.00E-51 | >gb\|AAF52395.1\| (AE003613) CG9547 gene product [Drosophila melanogaster] |
| 183 | 214461_300858_1 (620 letters) | 2.00E-08 | >pir\|\|F69905 probable alcohol dehydrogenase (EC 1.1.1.-) yogA - Bacillus subtilis emb\|CAB13726.1\| (Z99113) similar to alcohol dehydrogenase [Bacillus subtilis] emb\|CAB13736.1\| (Z99114) similar to alcohol dehydrogenase [Bacillus subtilis] |
| 185 | 214468_300858_1 (644 letters) | 5.00E-15 | >gb\|AAD30438.1\|AF119672_1 (AF119672) integral membrane protein [Magnaporthe grisea] |
| 191 | 214485_300858_1 (515 letters) | 1.00E-41 | >pir\|\|T40381 hypothetical protein SPBC3E7.07c - fission yeast (Schizosaccharomyces pombe) emb\|CAA19020.1\| (AL023534) hypothetical protein [Schizosaccharomyces pombe] |

Figure 4 continued

| SEQ ID NO | Query Contig ID (length, bp) | Pz score | Result |
|---|---|---|---|
| 193 | 214493_300858_1 (444 letters) | 1.00E-09 | >ref\|NP_015506.1\| Similar to ubiquitin activating proteins; Aos1p [Saccharomyces cerevisiae] sp\|Q06624\|RH31_YEAST DNA DAMAGE TOLERANCE PROTEIN RHC31 (RAD31 HOMOLOG) pir\|\|S59837 probable membrane protein YPR180w - yeast (Saccharomyces cerevisiae) gb\|AAB68113.1\| (U25842) Similar in N-terminus to E. coli ThiF protein (Swiss Prot. accession number P30138) [Saccharomyces cerevisiae] |
| 197 | 214504_300859_1 (511 letters) | 1.00E-19 | >gb\|AAF51238.1\| (AE003582) CG3214 gene product [Drosophila melanogaster] |
| 200 | 214511_300859_1 (631 letters) | 2.00E-18 | >pir\|\|T51293 stress activated MAP kinase interacting protein - fission yeast (Schizosaccharomyces pombe) gb\|AAD37449.1\|AF155208_1 (AF155208) stress activated MAP kinase interacting protein [Schizosaccharomyces pombe] |
| 202 | 214515_300859_1 (480 letters) | 9.00E-16 | >pir\|\|T40363 40s ribosomal protein s25 - fission yeast (Schizosaccharomyces pombe) pir\|\|T43379 40s ribosomal protein S31 homolog fission yeast (Schizosaccharomyces pombe) dbj\|BAA31553.1\| (AB016006) ribosomal protein S31 homolog [Schizosaccharomyces pombe] emb\|CAB09129.2\| (Z95620) 40s ribosomal protein s25 [Schizosaccharomyces pombe] |
| 206 | 214534_300859_1 (629 letters) | 2.00E-12 | >pir\|\|T51079 related to chitinase 3 precursor protein [imported] - Neurospora crassa emb\|CAB98243.1\| (AL390092) related to chitinase 3 precursor protein [Neurospora crassa] |
| 208 | 214545_300859_1 (575 letters) | 5.00E-10 | >emb\|CAA80973.1\| (Z25485) ACR1-protein [Saccharomyces cerevisiae] |
| 215 | 214578_300859_1 (600 letters) | 7.00E-21 | >ref\|NP_014702.1\| Yor059cp [Saccharomyces cerevisiae] pir\|\|S66942 probable membrane protein YOR059c - yeast (Saccharomyces cerevisiae) emb\|CAA99252.1\| (Z74967) ORF YOR059c [Saccharomyces cerevisiae] emb\|CAA94544.1\| (Z70678) YOR29-10 [Saccharomyces cerevisiae] |
| 217 | 214583_300859_1 (538 letters) | 6.00E-06 | >ref\|NP_075208.1\| Ydl085c-ap [Saccharomyces cerevisiae] pir\|\|S78710 protein YDL085c-a - yeast (Saccharomyces cerevisiae) |
| 218 | 214584_300859_1 (634 letters) | 2.00E-62 | >sp\|Q55905\|PPSA_SYNY3 PHOSPHOENOLPYRUVATE SYNTHASE (PYRUVATE,WATER DIKINASE) (PEP SYNTHASE) pir\|\|S76976 pyruvate,water dikinase (EC 2.7.9.2) - Synechocystis sp. (strain PCC 6803) dbj\|BAA10668.1\| (D64005) phosphoenolpyruvate synthase [Synechocystis sp.] |
| 221 | 214595_300859_1 (543 letters) | 2.00E-51 | >sp\|Q10082\|YAO3_SCHPO HYPOTHETICAL 34.1 KD PROTEIN C11D3.03C IN CHROMOSOME I pir\|\|T37514 hypothetical protein SPAC11D3.03c - fission yeast (Schizosaccharomyces pombe) emb\|CAA92304.1\| (Z68166) hypothetical protein. [Schizosaccharomyces pombe] |

Figure 4 continued

| SEQ ID NO | Query Contig ID (length, bp) | Pz score | Result |
|---|---|---|---|
| 223 | 214601_300863_1 (470 letters) | 2.00E-33 | >ref\|NP_012317.1\| Yjl218wp [Saccharomyces cerevisiae] sp\|P40892\|YJV8_YEAST PUTATIVE ACETYLTRANSFERASE IN HXT11-HXT8 INTERGENIC REGION pir\|\|S50709 probable O-acetyltransferase (EC 2.3.1.-) YJL218w - yeast (Saccharomyces cerevisiae) emb\|CAA83992.1\| (Z34098) ORF [Saccharomyces cerevisiae] emb\|CAA89515.1\| (Z49493) ORF YJL218w [Saccharomyces cerevisiae] |
| 225 | 214603_300863_1 (595 letters) | 1.00E-80 | >emb\|CAC18315.1\| (AL451022) probable IMP4 protein [Neurospora crassa] |
| 227 | 214606_300863_1 (672 letters) | 7.00E-07 | >ref\|NP_054762.1\| DKFZP5640123 protein [Homo sapiens] pir\|\|T12468 hypothetical protein DKFZp5640123.1 - human emb\|CAB45721.1\| (AL080122) hypothetical protein [Homo sapiens] |
| 228 | 214607_300863_1 (651 letters) | 9.00E-32 | >pir\|\|T08877 Modin - Podospora anserina gb\|AAC25496.1\| (AF025289) Modin [Podospora anserina] |
| 233 | 214613_300863_1 (659 letters) | 2.00E-44 | >pdb\|1GGW\|A Chain A, Cdc4p From Schizosaccharomyces Pombe |
| 236 | 214626_300863_1 (649 letters) | 9.00E-85 | >sp\|P23704\|ATPB_NEUCR ATP SYNTHASE BETA CHAIN, MITOCHONDRIAL PRECURSOR pir\|\|JC1112 H+-transporting ATP synthase (EC 3.6.1.34) beta chain [similarity] - Neurospora crassa emb\|CAA37756.1\| (X53720) F(1)-ATPase beta-subunit precursor (519 AA) [Neurospora crassa] gb\|AAA33562.1\| (M84192) mitochondrial ATPase beta-subunit [Neurospora crassa] emb\|CAB91479.1\| (AL355933) H+-transporting ATP synthase (EC 3.6.1.34) beta chain [Neurospora crassa] |
| 239 | 214633_300863_1 (520 letters) | 5.00E-49 | >pir\|\|T46646 pyridoxine biosynthesis protein pdx1 [imported] - Cercospora nicotianae gb\|AAD13386.1\| (AF035619) pyridoxine biosynthesis protein [Cercospora nicotianae] |
| 240 | 214634_300863_1 (561 letters) | 4.00E-94 | >dbj\|BAB40590.1\| (AB041752) endochitinase-HAR2 [Trichoderma harzianum] |
| 242 | 214639_300863_1 (477 letters) | 1.00E-18 | >pir\|\|T49825 hypothetical protein B24H17.110 [imported] - Neurospora crassa emb\|CAB92633.1\| (AL356815) putative protein [Neurospora crassa] |
| 250 | 214672_300863_1 (661 letters) | 1.00E-18 | >ref\|NP_075207.1\| Ybl071w-ap [Saccharomyces cerevisiae] |
| 252 | 214680_300863_1 (603 letters) | 2.00E-19 | >ref\|NP_012223.1\| Yil041wp [Saccharomyces cerevisiae] sp\|P40531\|YIE1_YEAST 36.7 KD PROTEIN IN CBR5-NOT3 INTERGENIC REGION pir\|\|S49937 hypothetical protein YIL041w - yeast (Saccharomyces cerevisiae) emb\|CAA86910.1\| (Z46861) unknown [Saccharomyces cerevisiae] |
| 256 | 214695_300863_1 (472 letters) | 3.00E-07 | >emb\|CAC38828.1\| (AJ303089) OTT-MAL [Homo sapiens] |
| 260 | 214708_300864_1 (616 letters) | 4.00E-06 | >gb\|AAG40148.1\|AF213669_1 (AF213669) bHLHZip transcription factor BIGMAX [Drosophila melanogaster] |
| 261 | 214710_300864_1 (211 letters) | 5.00E-10 | >pir\|\|T39206 hypothetical protein SPAC926.08c - fission yeast (Schizosaccharomyces pombe) emb\|CAB54156.1\| (AL110469) hypothetical protein [Schizosaccharomyces pombe] |

Figure 4 continued

| SEQ ID NO | Query Contig ID (length, bp) | Pz score | Result |
|---|---|---|---|
| 268 | 214756_300864_1 (670 letters) | 2.00E-39 | >gb\|AAA77678.1\| (U18061) CAP20 [Glomerella cingulata] |
| 271 | 215167_300878_1 (548 letters) | 1.00E-28 | >pir\|\|T51222 hypothetical protein B24M22.180 [imported] - Neurospora crassa emb\|CAB99386.1\| (AL390354) conserved hypothetical protein [Neurospora crassa] |
| 272 | 215174_300878_1 (588 letters) | 9.00E-44 | >emb\|CAB76570.1\| (AJ245552) cytochrome c oxidase subunit V [Podospora anserina] |
| 273 | 215181_300878_1 (367 letters) | 3.00E-25 | >sp\|P32192\|EF1D_ARTSA ELONGATION FACTOR 1-DELTA (EF-1-DELTA) pir\|\|S47630 translation elongation factor eEF-1 delta chain - brine shrimp |
| 274 | 215183_300878_1 (552 letters) | 3.00E-19 | >pir\|\|T48811 hypothetical protein 15E6.190 [imported] - Neurospora crassa emb\|CAB88650.1\| (AL353822) conserved hypothetical protein [Neurospora crassa] |
| 276 | 215213_300879_1 (545 letters) | 7.00E-60 | >emb\|CAC18626.1\| (AL451109) probable homoserine kinase [Neurospora crassa] |
| 277 | 215221_300879_1 (588 letters) | 1.00E-20 | >emb\|CAC28690.1\| (AL513444) probable ribosomal protein L38 [Neurospora crassa] |
| 278 | 215255_300879_1 (568 letters) | 1.00E-85 | >sp\|Q09127\|RL10_SCHPO 60S RIBOSOMAL PROTEIN L10 (QM PROTEIN HOMOLOG) (SPQM) pir\|\|T39755 60s ribosomal protein l10 - fission yeast (Schizosaccharomyces pombe) emb\|CAA22664.1\| (AL035077) 60s ribosomal protein l10 [Schizosaccharomyces pombe] |
| 279 | 215267_300879_1 (473 letters) | 3.00E-56 | >sp\|P40910\|RS3A_CANAL 40S RIBOSOMAL PROTEIN S3AE (S1) pir\|\|S49366 ribosomal protein S0.e.B, cytosolic - yeast (Candida albicans) emb\|CAA57542.1\| (X82017) ribosomal protein 10 [Candida albicans] |
| 280 | 215280_300879_1 (647 letters) | 3.00E-99 | >emb\|CAA11267.1\| (AJ223328) polyubiquitin [Nicotiana tabacum] emb\|CAA07773.1\| (AJ007936) polyubiquitin [Gibberella pulicaris] |
| 282 | 215308_300880_1 (415 letters) | 1.00E-09 | >emb\|CAC34571.1\| (AJ409217) putative ARM-1 protein [Gallus gallus] |
| 284 | 215338_300880_1 (566 letters) | 4.00E-39 | >sp\|P23750\|H41_EMENI HISTONE H4.1 pir\|\|S11939 histone H4.1 - Emericella nidulans emb\|CAA39155.1\| (X55549) H4.1 [Aspergillus nidulans] gb\|AAA20820.1\| (U12630) histone H4.1 [Aspergillus nidulans] dbj\|BAB12238.1\| (AB033943) histone H4 [Aspergillus oryzae] prf\|\|1707275C histone H4.1 [Emericella nidulans] |
| 285 | 215343_300880_1 (548 letters) | 1.00E-11 | >pir\|\|T51215 hypothetical protein B24M22.110 [imported] - Neurospora crassa emb\|CAB99379.1\| (AL390354) conserved hypothetical protein [Neurospora crassa] |
| 288 | 215373_300880_1 (575 letters) | 4.00E-57 | >sp\|Q02854\|NUXM_NEUCR NADH-UBIQUINONE OXIDOREDUCTASE 21 KD SUBUNIT (COMPLEX I-21KD) (CI-21KD) pir\|\|S27171 NADH dehydrogenase (ubiquinone) (EC 1.6.5.3) 20.9K chain - Neurospora crassa emb\|CAA43221.1\| (X60829) NADH dehydrogenase, 21 kDa subunit [Neurospora crassa] |

Figure 4 continued

| SEQ ID NO | Query Contig ID (length, bp) | Pz score | Result |
|---|---|---|---|
| 289 | 215379_300880_1 (512 letters) | 2.00E-59 | >pir\|\|T49800 probable ribosomal protein Rps8bp [imported] - Neurospora crassa emb\|CAB92705.1\| (AL356834) probable ribosomal protein Rps8bp [Neurospora crassa] |
| 290 | 215382_300880_1 (613 letters) | 5.00E-27 | >ref\|NP_014332.1\| Ribosomal protein L9B (L8B) (rp24) (YL11); Rpl9bp [Saccharomyces cerevisiae] sp\|P51401\|RL9B_YEAST 60S RIBOSOMAL PROTEIN L9-B (L8) (YL11) (RP25) pir\|\|S53915 ribosomal protein L9.e.B, cytosolic - yeast (Saccharomyces cerevisiae) emb\|CAA60195.1\| (X86470) putative second copy of ribosomal protein gene YL9A, SWISS_PROT:RL9_YEAST [Saccharomyces cerevisiae] gb\|AAA99644.1\| (U12141) ribosomal protein YL9 [Saccharomyces cerevisiae] emb\|CAA95940.1\| (Z71343) ORF YNL067w [Saccharomyces cerevisiae] |
| 291 | 215383_300880_1 (452 letters) | 3.00E-27 | >sp\|P48503\|UCRQ_NEUCR UBIQUINOL-CYTOCHROME C REDUCTASE COMPLEX UBIQUINONE-BINDING PROTEIN QP-C PRECURSOR (UBIQUINOL-CYTOCHROME C REDUCTASE COMPLEX 11 KDA PROTEIN) (COMPLEX III SUBUNIT VII) pir\|\|T46746 ubiquinol--cytochrome-c reductase (EC 1.10.2.2) chain VIII [imported] Neurospora crassa gb\|AAC49654.1\| (U20790) ubiquinol-cytochrome c oxidoreductase subunit VIII [Neurospora crassa] |
| 292 | 215409_300881_1 (508 letters) | 1.00E-07 | >ref\|NP_011157.1\| Yfl030wp [Saccharomyces cerevisiae] sp\|P43567\|YFD0_YEAST HYPOTHETICAL 41.9 KD PROTEIN IN HAC1-CAK1 INTERGENIC REGION pir\|\|S56224 hypothetical protein YFL030w - yeast (Saccharomyces cerevisiae) dbj\|BAA09208.1\| (D50617) YFL030W [Saccharomyces cerevisiae] |
| 293 | 215410_300881_1 (619 letters) | 1.00E-20 | >pir\|\|T50270 hypothetical protein SPAC922.05c [imported] - fission yeast (Schizosaccharomyces pombe) emb\|CAB63552.1\| (AL133522) hypothetical protein [Schizosaccharomyces pombe] |
| 294 | 215420_300881_1 (615 letters) | 4.00E-29 | >pdb\|1BEK\| Effect Of Unnatural Heme Substitution On Kinetics Of Electron Transfer In Cytochrome C Peroxidase |
| 295 | 215429_300881_1 (668 letters) | 1.00E-71 | >sp\|P34737\|RS15_PODAN 40S RIBOSOMAL PROTEIN S15 (S12) pir\|\|A53793 ribosomal protein S12, cytosolic - Podospora anserina emb\|CAA80805.1\| (Z23267) cytoplasmic ribosomal protein S12 [Podospora anserina] |
| 296 | 215431_300881_1 (674 letters) | 2.00E-68 | >sp\|Q10157\|RL11_SCHPO 60S RIBOSOMAL PROTEIN L11 pir\|\|T38395 ribosomal protein L11 - fission yeast (Schizosaccharomyces pombe) pir\|\|T39733 60s ribosomal protein L11 - fission yeast (Schizosaccharomyces pombe) emb\|CAA93230.1\| (Z69240) 60s ribosomal protein L11 [Schizosaccharomyces pombe] dbj\|BAA31552.1\| (AB016005) ribosomal protein L11 homolog [Schizosaccharomyces pombe] emb\|CAB52808.1\| (AL109846) 60s ribosomal protein L11 [Schizosaccharomyces pombe] |

Figure 4 continued

| SEQ ID NO | Query Contig ID (length, bp) | Pz score | Result |
|---|---|---|---|
| 297 | 215432_300881_1 (555 letters) | 3.00E-39 | >sp\|P00842\|ATP9_NEUCR ATP SYNTHASE PROTEIN 9, MITOCHONDRIAL PRECURSOR (LIPID-BINDING PROTEIN) pir\|\|LWNCA H+-transporting ATP synthase (EC 3.6.1.34) lipid-binding protein precursor - Neurospora crassa |
| 298 | 215461_300881_1 (559 letters) | 8.00E-21 | >pir\|\|T40973 cytochrome c oxidase polypeptide vib - fission yeast (Schizosaccharomyces pombe) emb\|CAA21442.1\| (AL031966) cytochrome c oxidase polypeptide vib [Schizosaccharomyces pombe] |
| 304 | 215552_300882_1 (530 letters) | 2.00E-36 | >pdb\|1YAA\|A Chain A, Aspartate Aminotransferase From Saccharomyces Cerevisiae Cytoplasm pdb\|1YAA\|B Chain B, Aspartate Aminotransferase From Saccharomyces Cerevisiae Cytoplasm pdb\|1YAA\|C Chain C, Aspartate Aminotransferase From Saccharomyces Cerevisiae Cytoplasm pdb\|1YAA\|D Chain D, Aspartate Aminotransferase From Saccharomyces Cerevisiae Cytoplasm |
| 305 | 215553_300882_1 (572 letters) | 2.00E-35 | >sp\|O59931\|RL13_CANAL 60S RIBOSOMAL PROTEIN L13 gb\|AAD09956.1\| (AF050672) ribosomal protein L13E [Candida albicans] emb\|CAA21966.1\| (AL033497) ribosomal protein L13e [Candida albicans] gb\|AAD09226.1\| (U80854) ribosomal protein L13 [Candida albicans] |
| 306 | 215579_300882_1 (338 letters) | 2.00E-25 | >gb\|AAD47296.1\| (AF017140) dihydrolipoamide succinyltransferase [Aspergillus fumigatus] |
| 307 | 215586_300882_1 (382 letters) | 8.00E-06 | >ref\|NP_107120.1\| dehydrogenase [Mesorhizobium loti] dbj\|BAB52906.1\| (AP003009) dehydrogenase [Mesorhizobium loti] |
| 311 | 215611_300883_1 (593 letters) | 2.00E-38 | >gb\|AAG28787.1\|AF308443_1 (AF308443) 60S ribosomal protein [Trichoderma hamatum] |
| 312 | 215615_300883_1 (441 letters) | 1.00E-23 | >sp\|O00087\|DLDH_SCHPO DIHYDROLIPOAMIDE DEHYDROGENASE, MITOCHONDRIAL PRECURSOR (DLDH) emb\|CAB65609.1\| (AL136078) dihydrolipoamide dehydrogenase, mitochondrial precursor (EC 1.8.1.4) [Schizosaccharomyces pombe] |
| 314 | 215637_300883_1 (541 letters) | 4.00E-23 | >pir\|\|T47216 probable V-ATPase, 20K chain [imported] - Neurospora crassa gb\|AAB61278.1\| (AF001033) Woronin body major protein [Neurospora crassa] |
| 315 | 215638_300883_1 (473 letters) | 8.00E-13 | >emb\|CAC28576.1\| (AL513410) conserved hypothetical protein [Neurospora crassa] |
| 316 | 215639_300883_1 (455 letters) | 4.00E-29 | >pir\|\|T37806 probable flavoprotein subunit - fission yeast (Schizosaccharomyces pombe) emb\|CAB16560.1\| (Z99292) putative flavoprotein subunit [Schizosaccharomyces pombe] |
| 317 | 215661_300883_1 (381 letters) | 2.00E-24 | >gb\|AAK55436.1\| (AF378567) cytochrome-c oxidase chain VIIc-like protein [Ophiostoma ulmi] |
| 320 | 215672_300883_1 (515 letters) | 1.00E-43 | >sp\|P21772\|RS26_NEUCR 40S RIBOSOMAL PROTEIN S26E (CRP5) (13.6 KD RIBOSOMAL PROTEIN) pir\|\|R4NC26 ribosomal protein S26.e - Neurospora crassa emb\|CAA39162.1\| (X55637) ribosomal protein [Neurospora crassa] |
| 321 | 215678_300883_1 (558 letters) | 2.00E-04 | >emb\|CAC28735.1\| (AL513462) putative protein [Neurospora crassa] |

Figure 4 continued

| SEQ ID NO | Query Contig ID (length, bp) | Pz score | Result |
|---|---|---|---|
| 322 | 215685_300883_1 (495 letters) | 2.00E-11 | >gb\|AAD28474.1\|AF133671_1 (AF133671) coproporphyrinogen III oxidase precursor [Chlamydomonas reinhardtii] gb\|AAD28475.1\|AF133672_1 (AF133672) coproporphyrinogen III oxidase precursor [Chlamydomonas reinhardtii] |
| 327 | 215882_300885_1 (552 letters) | 4.00E-08 | >sp\|P78768\|VTI1_SCHPO VESICLE TRANSPORT V-SNARE PROTEIN VTI1 HOMOLOG pir\|\|T40349 vesicle transport v-snare protein - fission yeast (Schizosaccharomyces pombe) emb\|CAA17790.1\| (AL022070) vesicle transport v-snare protein [Schizosaccharomyces pombe] |
| 329 | 215907_300886_1 (423 letters) | 4.00E-11 | >sp\|P42281\|ACBP_DROME ACYL-COA-BINDING PROTEIN HOMOLOG (ACBP) (DIAZEPAM BINDING INHIBITOR HOMOLOG) (DBI) pir\|\|A56041 endozepine - fruit fly (Drosophila melanogaster) gb\|AAA21649.1\| (U04822) diazepam binding inhibitor [Drosophila melanogaster] gb\|AAA21650.1\| (U04823) diazepam binding inhibitor [Drosophila melanogaster] gb\|AAF50607.1\| (AE003560) Dbi gene product [Drosophila melanogaster] |
| 331 | 215917_300886_1 (199 letters) | 7.00E-14 | >emb\|CAC28788.1\| (AL513464) probable SEC23 [Neurospora crassa] |
| 332 | 215918_300886_1 (617 letters) | 5.00E-74 | >emb\|CAC28704.1\| (AL513444) probable ubiquitin-conjugating enzyme ubcP3 [Neurospora crassa] |
| 333 | 215926_300886_1 (691 letters) | 7.00E-48 | >ref\|NP_014840.1\| Yor197wp [Saccharomyces cerevisiae] pir\|\|S67089 hypothetical protein YOR197w - yeast (Saccharomyces cerevisiae) emb\|CAA99410.1\| (Z75105) ORF YOR197w [Saccharomyces cerevisiae] |
| 334 | 215930_300886_1 (683 letters) | 1.00E-85 | >ref\|NP_011223.1\| Ribosomal protein L2A (L5A) (rp8) (YL6); Rpl2ap [Saccharomyces cerevisiae] ref\|NP_012246.1\| Ribosomal protein L2B (L5B) (rp8) (YL6); Rpl2bp [Saccharomyces cerevisiae] sp\|P05736\|RL6_YEAST 60S RIBOSOMAL PROTEIN L2 (YL6) (L5) (RP8) pir\|\|S50243 ribosomal protein L8.e, cytosolic - yeast (Saccharomyces cerevisiae) gb\|AAA92283.1\| (U17359) ribosomal protein YL6 (L5) [Saccharomyces cerevisiae] emb\|CAA86974.1\| (Z46881) putative 60S ribosomal protein [Saccharomyces cerevisiae] |
| 335 | 215937_300886_1 (617 letters) | 2.00E-76 | >gb\|AAD10497.1\| (U91983) phosphatidylserine synthase [Triticum aestivum] |

Figure 4 continued

| SEQ ID NO | Query Contig ID (length, bp) | Pz score | Result |
|---|---|---|---|
| 338 | 215957_300886_1 (575 letters) | 5.00E-65 | >ref|NP_009604.1| Ribosomal protein S11B (S18B) (rp41B) (YS12); Rps11bp [Saccharomyces cerevisiae] ref|NP_010308.1| Ribosomal protein S11A (S18A) (rp41A) (YS12); Rps11ap [Saccharomyces cerevisiae] sp|P26781|RS11_YEAST 40S RIBOSOMAL PROTEIN S11 (S18) (YS12) (RP41) pir||S41784 ribosomal protein S11.e, cytosolic yeast (Saccharomyces cerevisiae) gb|AAC37411.1| (L15408) ribosomal protein S18 [Saccharomyces cerevisiae] gb|AAC37410.1| (L17004) ribosomal protein S18 [Saccharomyces cerevisiae] emb|CAA84990.1| (Z35917) ORF YBR048w [Saccharomyces cerevisiae] emb|CAA87804.1| (Z47814) Rps18ap [Saccharomyces cerevisiae] emb|CAA65218.1| (X95966) 40S ribosomal protein [Saccharomyces cerevisiae] emb|CAA98846.1| (Z74321) ORF YDR025w [Saccharomyces cerevisiae] |
| 339 | 215962_300886_1 (623 letters) | 6.00E-24 | >emb|CAB91184.2| (AL355921) putative ubiquitin conjugating enzyme, e2 [Schizosaccharomyces pombe] |
| 340 | 215968_300886_1 (626 letters) | 1.00E-04 | >emb|CAC35000.1| (AL391034) hypothetical protein [Schizosaccharomyces pombe] |
| 341 | 215973_300886_1 (345 letters) | 6.00E-17 | >sp|Q01294|CARP_NEUCR VACUOLAR PROTEASE A PRECURSOR pir||T47207 aspartic proteinase (EC 3.4.23.-) [imported] - Neurospora crassa gb|AAA79878.1| (U36471) vacuolar protease A [Neurospora crassa] |
| 342 | 215986_300886_1 (633 letters) | 2.00E-29 | >sp|Q10113|MAL3_SCHPO MAL3 PROTEIN pir||T37928 probable chromosome segregation protein - fission yeast (Schizosaccharomyces pombe) pir||T43413 probable chromosome segregation protein - fission yeast (Schizosaccharomyces pombe) emb|CAA92392.1| (Z68198) putative chromosome segregation protein [Schizosaccharomyces pombe] emb|CAA70707.1| (Y09518) MAL3 protein [Schizosaccharomyces pombe] |
| 350 | 216047_300887_1 (379 letters) | 2.00E-04 | >pir||I55214 salivary proline-rich glycoprotein precursor - rat gb|AAA75405.1| (L08134) glycoprotein [Rattus norvegicus] prf||2107200A glycoprotein [Rattus norvegicus] |
| 351 | 216059_300887_1 (426 letters) | 3.00E-07 | >dbj|BAB22088.1| (AK002421) putative [Mus musculus] dbj|BAB32314.1| (AK021173) putative [Mus musculus] dbj|BAB40856.1| (AB049651) mitochondrial ribosomal protein L33 (L33mt) [Mus musculus] |
| 355 | 216071_300887_1 (570 letters) | 9.00E-82 | >emb|CAC36929.1| (AL590605) 40c ribosomal protein S6 [Schizosaccharomyces pombe] |
| 357 | 216093_300887_1 (481 letters) | 1.00E-25 | >ref|NP_015362.1| Erv2p [Saccharomyces cerevisiae] sp|Q12284|ERV2_YEAST ERV2 PROTEIN, MITOCHONDRIAL PRECURSOR pir||S61060 probable membrane protein YPR037c - yeast (Saccharomyces cerevisiae) emb|CAA92143.1| (Z68111) unknown [Saccharomyces cerevisiae] emb|CAA94987.1| (Z71255) unknown [Saccharomyces cerevisiae] |

Figure 4 continued

| SEQ ID NO | Query Contig ID (length, bp) | Pz score | Result |
|---|---|---|---|
| 358 | 216113_300866_1 (564 letters) | 2.00E-16 | >gb\|AAB97513.1\| (AF017783) alpha NAC [Drosophila melanogaster] gb\|AAF58457.1\| (AE003821) Nacalpha gene product [Drosophila melanogaster] |
| 360 | 216131_300866_1 (459 letters) | 7.00E-45 | >sp\|P42114\|NB4M_NEUCR NADH-UBIQUINONE OXIDOREDUCTASE 14.8 KD SUBUNIT (COMPLEX I-14.8KD) (CI-14.8KD) pir\|\|S43840 NADH dehydrogenase (ubiquinone) (EC 1.6.5.3) - Neurospora crassa emb\|CAA53963.1\| (X76344) NADH dehydrogenase (ubiquinone) [Neurospora crassa] |
| 361 | 216157_300866_1 (557 letters) | 2.00E-61 | >sp\|O94363\|RHEB_SCHPO GTP-BINDING PROTEIN RHEB HOMOLOG pir\|\|T40468 probable ras-related GTP-binding protein - fission yeast (Schizosaccharomyces pombe) emb\|CAA22291.1\| (AL034382) putative ras-related GTP-binding protein [Schizosaccharomyces pombe] |
| 363 | 216189_300866_1 (503 letters) | 4.00E-12 | >sp\|P33953\|RS22_KLUMA 40S RIBOSOMAL PROTEIN S22 (S15A) (YS24) pir\|\|S30003 ribosomal protein S15a.e - yeast (Kluyveromyces marxianus) gb\|AAB24900.1\| (S53434) S24-1 [Kluyveromyces marxianus] |
| 364 | 216191_300866_1 (601 letters) | 6.00E-11 | >ref\|NP_104990.1\| acetyltransferase [Mesorhizobium loti] dbj\|BAB50776.1\| (AP003003) acetyltransferase [Mesorhizobium loti] |
| 365 | 216193_300866_1 (592 letters) | 1.00E-34 | >pir\|\|T38622 ribulose-phosphate 3-epimerase - fission yeast (Schizosaccharomyces pombe) emb\|CAB11689.1\| (Z98979) putative ribulose phosphate 3-epimerase [Schizosaccharomyces pombe] |
| 366 | 216228_300867_1 (599 letters) | 2.00E-43 | >gb\|AAF79727.1\|AC005106_8 (AC005106) T25N20.16 [Arabidopsis thaliana] |
| 370 | 216262_300867_1 (249 letters) | 1.00E-07 | >pir\|\|T49708 probable 3-methyl-2-oxobutanoate dehydrogenase (lipoamide)E1 beta chain precursor [imported] - Neurospora crassa emb\|CAB91689.1\| (AL356172) probable 3-methyl-2-oxobutanoate dehydrogenase (lipoamide)E1 beta chain precursor [Neurospora crassa] |
| 371 | 216268_300867_1 (596 letters) | 2.00E-98 | >pir\|\|T02754 probable 1-aminocyclopropane-1-carboxylate oxidase (EC 1.4.3.-) - rice gb\|AAC05507.1\| (AF049889) 1-aminocyclopropane-1-carboxylate oxidase [Oryza sativa] |
| 372 | 216270_300867_1 (537 letters) | 9.00E-11 | >gb\|AAK18812.1\|AF321883_1 (AF321883) TOM7 [Neurospora crassa] |
| 375 | 216319_300868_1 (637 letters) | 8.00E-16 | >gb\|AAF53953.1\| (AE003669) CG9265 gene product [Drosophila melanogaster] |
| 376 | 216320_300868_1 (564 letters) | 3.60E-02 | >emb\|CAB81647.1\| (AL078621) bA395L14.13 (novel protein similar to acrosin (ACR)) [Homo sapiens] |
| 378 | 216338_300868_1 (577 letters) | 2.00E-10 | >sp\|P42116\|NURM_NEUCR NADH-UBIQUINONE OXIDOREDUCTASE 17.8 KD SUBUNIT PRECURSOR (COMPLEX I-17.8KD) (CI-17.8KD) pir\|\|S35057 NADH dehydrogenase (EC 1.6.99.3) 17.8K chain - Neurospora crassa emb\|CAA50537.1\| (X71414) NADH dehydrogenase [Neurospora crassa] |
| 379 | 216345_300868_1 (594 letters) | 6.00E-30 | >emb\|CAC28857.1\| (AL513467) conserved hypothetical protein [Neurospora crassa] |

Figure 4 continued

| SEQ ID NO | Query Contig ID (length, bp) | Pz score | Result |
|---|---|---|---|
| 382 | 216355_300868_1 (603 letters) | 2.00E-08 | >gb\|AAF50425.1\| (AE003555) CG7163 gene product [Drosophila melanogaster] |
| 383 | 216377_300868_1 (628 letters) | 4.00E-05 | >ref\|NP_014815.1\| Yor172wp [Saccharomyces cerevisiae] pir\|\|S67060 probable membrane protein YOR172w - yeast (Saccharomyces cerevisiae) gb\|AAB47417.1\| (U55021) O3620p [Saccharomyces cerevisiae] emb\|CAA99380.1\| (Z75080) ORF YOR172w [Saccharomyces cerevisiae] |
| 384 | 216408_300869_1 (585 letters) | 1.00E-39 | >sp\|P52808\|RL30_SCHPO 60S RIBOSOMAL PROTEIN L30 (L32) pir\|\|T39226 60s ribosomal protein L30 - fission yeast (Schizosaccharomyces pombe) gb\|AAB17132.1\| (U52080) ribosomal protein Rpl32p [Schizosaccharomyces pombe] emb\|CAB11499.1\| (Z98763) 60s ribosomal protein L30/L30A [Schizosaccharomyces pombe] |
| 387 | 216464_300869_1 (626 letters) | 2.00E-22 | >gb\|AAH03864.1\|AAH03864 (BC003864) nuclear receptor binding factor 1 [Mus musculus] |
| 394 | 219090_300927_1 (615 letters) | 7.00E-06 | >sp\|Q01663\|AP1_SCHPO AP-1-LIKE TRANSCRIPTION FACTOR pir\|\|S15664 transcription factor pap1 - fission yeast (Schizosaccharomyces pombe) emb\|CAA40363.1\| (X57078) AP-1-like transcription factor [Schizosaccharomyces pombe] |
| 395 | 219159_300928_1 (838 letters) | 2.00E-71 | >ref\|NP_005580.1\| methylmalonate-semialdehyde dehydrogenase [Homo sapiens] ref\|XP_012348.2\| methylmalonate-semialdehyde dehydrogenase [Homo sapiens] sp\|Q02252\|MMSA_HUMAN METHYLMALONATE-SEMIALDEHYDE DEHYDROGENASE [ACYLATING], MITOCHONDRIAL PRECURSOR (MMSDH) gb\|AAF04489.1\|AF148505_1 (AF148505) methylmalonate-semialdehyde dehydrogenase [Homo sapiens] emb\|CAB76468.1\| (AJ249994) methylmalonate semialdehyde dehydrogenase [Homo sapiens] gb\|AAF80380.1\|AF159889_1 (AF159889) methylmalonate semialdehyde dehydrogenase [Homo sapiens] gb\|AAG29581.1\|AF148855_1 (AF148855) methylmalonate-semialdehyde dehydrogenase [Homo sapiens] gb\|AAH04909.1\|AAH04909 (BC004909) methylmalonate-semialdehyde dehydrogenase [Homo sapiens] |
| 399 | 219218_300929_1 (345 letters) | 2.00E-17 | >sp\|Q12726\|HOSM_YARLI HOMOCITRATE SYNTHASE, MITOCHONDRIAL PRECURSOR emb\|CAA88928.1\| (Z49114) homocitrate synthase (acetyl-coenzyme A:2-Ketoglutarate C-acetyltransferase) [Yarrowia lipolytica] |
| 403 | 48435_300119_1 (623 letters) | 5.00E-97 | >gb\|AAD32922.1\|AC007167_4 (AC007167) putative heat shock protein [Arabidopsis thaliana] |
| 407 | 57821_300037_1 (562 letters) | 1.00E-30 | >gb\|AAF80217.1\|AC025290_6 (AC025290) Contains similarity to an unknown protein T16B12.5 gi\|3746062 from Arabidopsis thaliana gb\|AC005311. EST gb\|AI996597 comes from this gene |

Figure 5

Derwent NUC (nucleotide) db Search

This figure describes the results of querying the Derwent nucleotide db with claimed sequences (contigs) identified as hits in functional screening using BLASTN. Sheet 1 shows results for the highest scoring hit. Only hits with Pz < 1.00E-04 are considered. Sheet 2 summarizes the contents of patents identified in this search. Highlighted lines indicate results requiring analysis by legal team.

| SEQ ID NO | Query Contig ID (length, bp) | Pz Score | Result |
|---|---|---|---|
| 1 | 103532_300363_1 (653 letters) | 4.00E-05 | >gnl\|Derwent\|AAA32018 253 BP.Plant microsatellite marker #979.WO9967421-A1. |
| 2 | 103578_300363_1 (802 letters) | 4.00E-24 | >gnl\|Derwent\|AAV33887 1788 BP.H.tuberosus CYCD1;1 gene.WO9842851-A1. |
| 3 | 104218_300060_1 (414 letters) | 1.00E-38 | >gnl\|Derwent\|AAV81604 529 BP.SARB.2a protein encoding cDNA sequence.US5847258-A. |
| 4 | 104251_300060_1 (562 letters) | 1.00E-35 | >gnl\|Derwent\|AAC45996 1701 BP.Arabidopsis thaliana DNA fragment SEQ ID NO: 48532.EP1033405-A2. |
| 6 | 104423_300364_1 (632 letters) | 1.00E-101 | >gnl\|Derwent\|AAZ46858 1166 BP.Pea type I LhcIIb Cab protein encoding DNA.US6011198-A. |
| 8 | 104874_300366_1 (681 letters) | 2.00E-19 | >gnl\|Derwent\|AAC41644 849 BP.Arabidopsis thaliana DNA fragment SEQ ID NO: 32616.EP1033405-A2. |
| 9 | 105059_300046_1 (636 letters) | 1.00E-26 | >gnl\|Derwent\|AAC48420 918 BP.Arabidopsis thaliana DNA fragment SEQ ID NO: 57415.EP1033405-A2. |
| 10 | 107031_300262_1 (343 letters) | 1.00E-31 | >gnl\|Derwent\|AAC35249 653 BP.Arabidopsis thaliana DNA fragment SEQ ID NO: 9511.EP1033405-A2. |
| 11 | 107690_300380_1 (624 letters) | 7.00E-13 | >gnl\|Derwent\|AAZ33693 254 BP.Tobacco plant resistance-associated cDNA fragment 18.DE19813048-A1. |
| 12 | 109076_300042_1 (604 letters) | 4.00E-11 | >gnl\|Derwent\|AAC40709 892 BP.Arabidopsis thaliana DNA fragment SEQ ID NO: 29277.EP1033405-A2. |
| 13 | 109576_300051_1 (664 letters) | 2.00E-68 | >gnl\|Derwent\|AAQ92327 1442 BP.Chloroplast transit peptide, tyrosinase activator protein andtyrosinase gene fusion.WO9513386-A. |
| 16 | 113718_300005_1 (529 letters) | 1.00E-29 | >gnl\|Derwent\|AAA97382 3441 BP.Pea light-repressible GTP-binding protein pra2 cDNA.WO200055313-A1. |
| 17 | 114987_300010_1 (623 letters) | 4.00E-08 | >gnl\|Derwent\|AAC87522 2991 BP.Petunia hybrida ZPT2-11 gene, SEQ ID NO:3.WO200071704-A1. |
| 19 | 116525_300078_1 (583 letters) | 1.00E-17 | >gnl\|Derwent\|AAQ80918 326 BP.Spruce tree psaD cDNA, (damage-associated).DE4225561-A. |
| 20 | 120380_300384_1 (664 letters) | 6.00E-35 | >gnl\|Derwent\|AAF74203 1806 BP.DNA encoding evironmental stress tolerant protein SEQ ID 33.WO200106006-A1. |
| 23 | 120979_300518_1 (585 letters) | 2.00E-04 | >gnl\|Derwent\|AAV28676 785 BP.Ripening banana pulp cDNA clone U-U70 SEQ ID NO:34.WO9811228-A2. |

Figure 5 continued

| SEQ ID NO | Query Contig ID (length, bp) | Pz Score | Result |
|---|---|---|---|
| 27 | 127573_300470_1 (673 letters) | 2.00E-96 | >gnl\|Derwent\|AAC51491 1023 BP.Arabidopsis thaliana DNA fragment SEQ ID NO: 68724.EP1033405-A2. |
| 30 | 130744_300490_1 (730 letters) | 4.00E-98 | >gnl\|Derwent\|AAC50440 1007 BP.Arabidopsis thaliana DNA fragment SEQ ID NO: 64853.EP1033405-A2. |
| 31 | 131003_300510_1 (619 letters) | 5.00E-54 | >gnl\|Derwent\|AAC48698 1785 BP.Arabidopsis thaliana DNA fragment SEQ ID NO: 58432.EP1033405-A2. |
| 32 | 131272_300512_1 (438 letters) | 9.00E-58 | >gnl\|Derwent\|AAC46227 1025 BP.Arabidopsis thaliana DNA fragment SEQ ID NO: 49369.EP1033405-A2. |
| 33 | 135281_300412_1 (590 letters) | 0 | >gnl\|Derwent\|AAT33226 596 BP.Oryzacystatin-I del-D86 protease-inhibitor DNA.WO9616173-A2. |
| 34 | 135357_300413_1 (507 letters) | 3.00E-08 | >gnl\|Derwent\|AAC48681 1052 BP.Arabidopsis thaliana DNA fragment SEQ ID NO: 58370.EP1033405-A2. |
| 35 | 136729_300438_1 (628 letters) | 0 | >gnl\|Derwent\|AAA60881 768 BP.Rice superoxide dismutase nucleotide sequence.TW370564-A. |
| 37 | 139377_300409_1 (461 letters) | 8.00E-06 | >gnl\|Derwent\|AAT35133 296 BP.Diminished expression senescence clone, SED2 fragment.WO9507993-A1. |
| 38 | 167904_300552_1 (611 letters) | 3.00E-27 | >gnl\|Derwent\|AAC42679 1868 BP.Arabidopsis thaliana DNA fragment SEQ ID NO: 36451.EP1033405-A2. |
| 41 | 174874_300527_1 (583 letters) | 1.00E-04 | >gnl\|Derwent\|AAV52324 10357 BP.Streptococcus pneumoniae genome fragment SEQ ID NO:191.WO9818931-A2. |
| 42 | 175126_300530_1 (681 letters) | 3.00E-06 | >gnl\|Derwent\|AAC51844 2232 BP.Arabidopsis thaliana DNA fragment SEQ ID NO: 69866.EP1033405-A2. |
| 43 | 175159_300530_1 (381 letters) | 7.00E-49 | >gnl\|Derwent\|AAQ53404 1593 BP.Eleusine indica alpha-1-tubulin DNA (modified).WO9324637-A. |
| 45 | 175535_300545_1 (666 letters) | 3.00E-15 | >gnl\|Derwent\|AAC42426 1332 BP.Arabidopsis thaliana DNA fragment SEQ ID NO: 35512.EP1033405-A2. |
| 46 | 175706_300544_1 (616 letters) | 1.00E-146 | >gnl\|Derwent\|AAA96232 1048 BP.cDNA encoding a maize chitinase polypeptide designated ZmCh16.WO200056908-A2. |
| 47 | 175904_300523_1 (598 letters) | 4.00E-05 | >gnl\|Derwent\|AAC42233 566 BP.Arabidopsis thaliana DNA fragment SEQ ID NO: 34781.EP1033405-A2. |
| 49 | 180809_300625_1 (465 letters) | 1.00E-07 | >gnl\|Derwent\|AAC50150 1639 BP.Arabidopsis thaliana DNA fragment SEQ ID NO: 63772.EP1033405-A2. |
| 50 | 183214_300592_1 (637 letters) | 1.00E-174 | >gnl\|Derwent\|AAC43646 744 BP.Zea mays DNA fragment SEQ ID NO: 39981.EP1033405-A2. |
| 51 | 183295_300592_1 (643 letters) | 1.00E-120 | >gnl\|Derwent\|AAC46669 470 BP.Zea mays DNA fragment SEQ ID NO: 50974.EP1033405-A2. |
| 52 | 183350_300593_1 (674 letters) | 1.00E-42 | >gnl\|Derwent\|AAC49832 934 BP.Arabidopsis thaliana DNA fragment SEQ ID NO: 62601.EP1033405-A2. |
| 55 | 188877_300610_1 (658 letters) | 1.00E-14 | >gnl\|Derwent\|AAQ43056 759 BP.Cyn dI clone CD1.WO9310236-A. |

Figure 5 continued

| SEQ ID NO | Query Contig ID (length, bp) | Pz Score | Result |
|---|---|---|---|
| 56 | 188877_301703_1 (575 letters) | 8.00E-31 | >gnl\|Derwent\|AAC47471 897 BP.Arabidopsis thaliana DNA fragment SEQ ID NO: 53942.EP1033405-A2. |
| 58 | 188959_300611_1 (628 letters) | 2.00E-41 | >gnl\|Derwent\|AAC46799 629 BP.Arabidopsis thaliana DNA fragment SEQ ID NO: 51447.EP1033405-A2. |
| 59 | 189013_300612_1 (564 letters) | 9.00E-06 | >gnl\|Derwent\|AAT32863 730 BP.Tomato P119 gene.WO9619103-A1. |
| 66 | 212363_300848_1 (373 letters) | 6.00E-06 | >gnl\|Derwent\|AAC84314 560 BP.Human EXCS encoding cDNA (clone ID 1440015CB1).WO200070049-A2. |
| 78 | 213011_300846_1 (588 letters) | 7.00E-56 | >gnl\|Derwent\|AAF15052 444 BP.Trichoderma reesei EST SEQ ID NO:7575.WO200056762-A2. |
| 82 | 213364_300852_1 (491 letters) | 3.00E-98 | >gnl\|Derwent\|AAF07944 495 BP.Fusarium venenatum EST SEQ ID NO:467.WO200056762-A2. |
| 98 | 213892_300861_1 (79 letters) | 1.00E-18 | >gnl\|Derwent\|AAF44199 4104 BP.Human PRO1309 (UNQ675) nucleotide sequence SEQ ID NO:277.WO200073454-A1. |
| 109 | 213991_300862_1 (620 letters) | 8.00E-19 | >gnl\|Derwent\|AAF08348 994 BP.Fusarium venenatum EST SEQ ID NO:871.WO200056762-A2. |
| 111 | 214019_300854_1 (407 letters) | 2.00E-12 | >gnl\|Derwent\|AAF08659 510 BP.Fusarium venenatum EST SEQ ID NO:1182.WO200056762-A2. |
| 114 | 214086_300854_1 (644 letters) | 7.00E-04 | >gnl\|Derwent\|AAF07809 1027 BP.Fusarium venenatum EST SEQ ID NO:332.WO200056762-A2. |
| 115 | 214087_300854_1 (512 letters) | 1.00E-13 | >gnl\|Derwent\|AAF08641 579 BP.Fusarium venenatum EST SEQ ID NO:1164.WO200056762-A2. |
| 118 | 214111_300855_1 (538 letters) | 1.00E-35 | >gnl\|Derwent\|AAF11389 616 BP.Aspergillus niger EST SEQ ID NO:3912.WO200056762-A2. |
| 138 | 214278_300856_1 (580 letters) | 2.00E-59 | >gnl\|Derwent\|AAF08475 516 BP.Fusarium venenatum EST SEQ ID NO:998.WO200056762-A2. |
| 171 | 214441_300858_1 (293 letters) | 8.00E-14 | >gnl\|Derwent\|AAF08113 468 BP.Fusarium venenatum EST SEQ ID NO:636.WO200056762-A2. |
| 175 | 214447_300858_1 (640 letters) | 3.00E-06 | >gnl\|Derwent\|AAC77958 1645 BP.Human cancer associated gene sequence SEQ ID NO:352.WO200055350-A1. |
| 179 | 214456_300858_1 (659 letters) | 7.00E-04 | >gnl\|Derwent\|AAC41801 842 BP.Arabidopsis thaliana DNA fragment SEQ ID NO: 33186.EP1033405-A2. |
| 191 | 214485_300858_1 (515 letters) | 1.00E-174 | >gnl\|Derwent\|AAF14972 600 BP.Trichoderma reesei EST SEQ ID NO:7495.WO200056762-A2. |
| 199 | 214506_300859_1 (548 letters) | 2.00E-10 | >gnl\|Derwent\|AAF08939 416 BP.Fusarium venenatum EST SEQ ID NO:1462.WO200056762-A2. |
| 202 | 214515_300859_1 (480 letters) | 2.00E-59 | >gnl\|Derwent\|AAF08475 516 BP.Fusarium venenatum EST SEQ ID NO:998.WO200056762-A2. |
| 227 | 214606_300863_1 (672 letters) | 3.00E-74 | >gnl\|Derwent\|AAF09326 689 BP.Fusarium venenatum EST SEQ ID NO:1849.WO200056762-A2. |
| 239 | 214633_300863_1 (520 letters) | 2.00E-22 | >gnl\|Derwent\|AAA57150 924 BP.Alternaria alternata sor1 homologue cDNA.US6063987-A. |
| 240 | 214634_300863_1 (561 letters) | 1.00E-121 | >gnl\|Derwent\|AAZ88577 1554 BP.T. harzianum strain P1 endochitinase cDNA.US6020540-A. |
| 251 | 214678_300863_1 (424 letters) | 7.00E-06 | >gnl\|Derwent\|AAF76848 1350 BP.Human secreted protein cDNA #6.WO200112776-A2. |
| 252 | 214680_300863_1 (603 letters) | 9.00E-34 | >gnl\|Derwent\|AAF08467 737 BP.Fusarium venenatum EST SEQ ID NO:990.WO200056762-A2. |

Figure 5 continued

| SEQ ID NO | Query Contig ID (length, bp) | Pz Score | Result |
|---|---|---|---|
| 256 | 214695_300863_1 (472 letters) | 1.00E-19 | >gnl\|Derwent\|AAF09038 763 BP.Fusarium venenatum EST SEQ ID NO:1561.WO200056762-A2. |
| 260 | 214708_300864_1 (616 letters) | 1.00E-11 | >gnl\|Derwent\|AAF09193 459 BP.Fusarium venenatum EST SEQ ID NO:1716.WO200056762-A2. |
| 271 | 215167_300878_1 (548 letters) | 6.00E-10 | >gnl\|Derwent\|AAF08628 641 BP.Fusarium venenatum EST SEQ ID NO:1151.WO200056762-A2. |
| 272 | 215174_300878_1 (588 letters) | 2.00E-40 | >gnl\|Derwent\|AAF08005 611 BP.Fusarium venenatum EST SEQ ID NO:528.WO200056762-A2. |
| 273 | 215181_300878_1 (367 letters) | 2.00E-12 | >gnl\|Derwent\|AAF12057 874 BP.Aspergillus oryzae EST SEQ ID NO:4580.WO200056762-A2. |
| 275 | 215185_300878_1 (363 letters) | 2.00E-12 | >gnl\|Derwent\|AAF15214 612 BP.Trichoderma reesei EST SEQ ID NO:7737.WO200056762-A2. |
| 277 | 215221_300879_1 (588 letters) | 5.00E-63 | >gnl\|Derwent\|AAF08612 454 BP.Fusarium venenatum EST SEQ ID NO:1135.WO200056762-A2. |
| 279 | 215267_300879_1 (473 letters) | 1.00E-154 | >gnl\|Derwent\|AAF14921 821 BP.Trichoderma reesei EST SEQ ID NO:7444.WO200056762-A2. |
| 280 | 215280_300879_1 (647 letters) | 1.00E-118 | >gnl\|Derwent\|AAZ28437 5174 BP.Sugar cane ubiquitin 9 (ubi9) gene.WO9946976-A1. |
| 282 | 215308_300880_1 (415 letters) | 5.00E-13 | >gnl\|Derwent\|AAF09017 589 BP.Fusarium venenatum EST SEQ ID NO:1540.WO200056762-A2. |
| 283 | 215316_300880_1 (513 letters) | 3.00E-05 | >gnl\|Derwent\|AAF07831 1941 BP.Fusarium venenatum EST SEQ ID NO:354.WO200056762-A2. |
| 284 | 215338_300880_1 (566 letters) | 1.00E-121 | >gnl\|Derwent\|AAF07884 602 BP.Fusarium venenatum EST SEQ ID NO:407.WO200056762-A2. |
| 288 | 215373_300880_1 (575 letters) | 7.00E-22 | >gnl\|Derwent\|AAF15146 135 BP.Trichoderma reesei EST SEQ ID NO:7669.WO200056762-A2. |
| 289 | 215379_300880_1 (512 letters) | 1.00E-154 | >gnl\|Derwent\|AAF07731 906 BP.Fusarium venenatum EST SEQ ID NO:254.WO200056762-A2. |
| 290 | 215382_300880_1 (613 letters) | 6.00E-35 | >gnl\|Derwent\|AAF07852 794 BP.Fusarium venenatum EST SEQ ID NO:375.WO200056762-A2. |
| 291 | 215383_300880_1 (452 letters) | 1.00E-22 | >gnl\|Derwent\|AAF08710 486 BP.Fusarium venenatum EST SEQ ID NO:1233.WO200056762-A2. |
| 292 | 215409_300881_1 (508 letters) | 8.00E-06 | >gnl\|Derwent\|AAF08440 511 BP.Fusarium venenatum EST SEQ ID NO:963.WO200056762-A2. |
| 294 | 215420_300881_1 (615 letters) | 1.00E-32 | >gnl\|Derwent\|AAF07750 801 BP.Fusarium venenatum EST SEQ ID NO:273.WO200056762-A2. |
| 295 | 215429_300881_1 (668 letters) | 1.00E-177 | >gnl\|Derwent\|AAF07667 663 BP.Fusarium venenatum EST SEQ ID NO:190.WO200056762-A2. |
| 296 | 215431_300881_1 (674 letters) | 0 | >gnl\|Derwent\|AAF07657 865 BP.Fusarium venenatum EST SEQ ID NO:180.WO200056762-A2. |
| 297 | 215432_300881_1 (555 letters) | 1.00E-82 | >gnl\|Derwent\|AAF08029 1074 BP.Fusarium venenatum EST SEQ ID NO:552.WO200056762-A2. |
| 298 | 215461_300881_1 (559 letters) | 9.00E-37 | >gnl\|Derwent\|AAF08298 494 BP.Fusarium venenatum EST SEQ ID NO:821.WO200056762-A2. |
| 300 | 215516_300882_1 (517 letters) | 1.00E-116 | >gnl\|Derwent\|AAF15233 849 BP.Trichoderma reesei EST SEQ ID NO:7756.WO200056762-A2. |
| 304 | 215552_300882_1 (530 letters) | 4.00E-17 | >gnl\|Derwent\|AAF07622 988 BP.Fusarium venenatum EST SEQ ID NO:145.WO200056762-A2. |
| 305 | 215553_300882_1 (572 letters) | 1.00E-153 | >gnl\|Derwent\|AAF14999 413 BP.Trichoderma reesei EST SEQ ID NO:7522.WO200056762-A2. |
| 306 | 215579_300882_1 (338 letters) | 1.00E-96 | >gnl\|Derwent\|AAF15035 391 BP.Trichoderma reesei EST SEQ ID NO:7558.WO200056762-A2. |
| 308 | 215593_300882_1 (535 letters) | 1.00E-63 | >gnl\|Derwent\|AAF15121 741 BP.Trichoderma reesei EST SEQ ID NO:7644.WO200056762-A2. |

Figure 5 continued

| SEQ ID NO | Query Contig ID (length, bp) | Pz Score | Result |
|---|---|---|---|
| 310 | 215606_300883_1 (517 letters) | 1.00E-10 | >gnl\|Derwent\|AAF09932 569 BP.Fusarium venenatum EST SEQ ID NO:2455.WO200056762-A2. |
| 311 | 215611_300883_1 (593 letters) | 8.00E-68 | >gnl\|Derwent\|AAF08280 500 BP.Fusarium venenatum EST SEQ ID NO:803.WO200056762-A2. |
| 312 | 215615_300883_1 (441 letters) | 1.00E-25 | >gnl\|Derwent\|AAF07594 957 BP.Fusarium venenatum EST SEQ ID NO:117.WO200056762-A2. |
| 313 | 215630_300883_1 (537 letters) | 2.00E-31 | >gnl\|Derwent\|AAQ58008 2175 BP.Sequence of plasmid pEA12 showing the promoter and coding region ofthe clone cDNA13.WO9404673-A. |
| 314 | 215637_300883_1 (541 letters) | 3.00E-58 | >gnl\|Derwent\|AAA75946 4047 BP.DNA encoding a vacuolar associated protein subunit called Quinn.WO200056900-A2. |
| 315 | 215638_300883_1 (473 letters) | 5.00E-84 | >gnl\|Derwent\|AAF15079 953 BP.Trichoderma reesei EST SEQ ID NO:7602.WO200056762-A2. |
| 316 | 215639_300883_1 (455 letters) | 1.00E-115 | >gnl\|Derwent\|AAF07602 1700 BP.Fusarium venenatum EST SEQ ID NO:125.WO200056762-A2. |
| 317 | 215661_300883_1 (381 letters) | 1.00E-47 | >gnl\|Derwent\|AAF09134 397 BP.Fusarium venenatum EST SEQ ID NO:1657.WO200056762-A2. |
| 318 | 215669_300883_1 (347 letters) | 9.00E-05 | >gnl\|Derwent\|AAF09527 645 BP.Fusarium venenatum EST SEQ ID NO:2050.WO200056762-A2. |
| 320 | 215672_300883_1 (515 letters) | 1.00E-109 | >gnl\|Derwent\|AAF07779 926 BP.Fusarium venenatum EST SEQ ID NO:302.WO200056762-A2. |
| 321 | 215678_300883_1 (558 letters) | 2.00E-12 | >gnl\|Derwent\|AAQ58006 1636 BP.Sequence of plasmid pTHN3 showing the promoter and coding region ofthe clone cDNA 1.WO9404673-A. |
| 330 | 215915_300886_1 (543 letters) | 1.00E-10 | >gnl\|Derwent\|AAF08939 416 BP.Fusarium venenatum EST SEQ ID NO:1462.WO200056762-A2. |
| 334 | 215930_300886_1 (683 letters) | 1.00E-116 | >gnl\|Derwent\|AAF07549 905 BP.Fusarium venenatum EST SEQ ID NO:72.WO200056762-A2. |
| 338 | 215957_300886_1 (575 letters) | 1.00E-164 | >gnl\|Derwent\|AAF07748 740 BP.Fusarium venenatum EST SEQ ID NO:271.WO200056762-A2. |
| 339 | 215962_300886_1 (623 letters) | 3.00E-06 | >gnl\|Derwent\|AAF08373 617 BP.Fusarium venenatum EST SEQ ID NO:896.WO200056762-A2. |
| 341 | 215973_300886_1 (345 letters) | 4.00E-10 | >gnl\|Derwent\|AAF07638 925 BP.Fusarium venenatum EST SEQ ID NO:161.WO200056762-A2. |
| 342 | 215986_300886_1 (633 letters) | 8.00E-25 | >gnl\|Derwent\|AAF08071 575 BP.Fusarium venenatum EST SEQ ID NO:594.WO200056762-A2. |
| 349 | 216046_300887_1 (138 letters) | 2.00E-49 | >gnl\|Derwent\|AAX13606 1587 BP.Enterococcus faecalis genome contig SEQ ID NO:669.WO9850555-A2. |
| 351 | 216059_300887_1 (426 letters) | 2.00E-06 | >gnl\|Derwent\|AAF11539 622 BP.Aspergillus niger EST SEQ ID NO:4062.WO200056762-A2. |
| 355 | 216071_300887_1 (570 letters) | 1.00E-166 | >gnl\|Derwent\|AAF07582 998 BP.Fusarium venenatum EST SEQ ID NO:105.WO200056762-A2. |
| 358 | 216113_300866_1 (564 letters) | 1.00E-38 | >gnl\|Derwent\|AAF08468 867 BP.Fusarium venenatum EST SEQ ID NO:991.WO200056762-A2. |
| 363 | 216189_300866_1 (503 letters) | 4.00E-63 | >gnl\|Derwent\|AAF14961 873 BP.Trichoderma reesei EST SEQ ID NO:7484.WO200056762-A2. |
| 371 | 216268_300867_1 (596 letters) | 2.00E-07 | >gnl\|Derwent\|AAV69440 809 BP.Banana fruit ripening-related clone U-7 cDNA.WO9853085-A1. |
| 378 | 216338_300868_1 (577 letters) | 2.00E-13 | >gnl\|Derwent\|AAF08808 586 BP.Fusarium venenatum EST SEQ ID NO:1331.WO200056762-A2. |

Figure 5 continued

| SEQ ID NO | Query Contig ID (length, bp) | Pz Score | Result |
|---|---|---|---|
| 384 | 216408_300869_1 (585 letters) | 3.00E-49 | >gnl\|Derwent\|AAF11377 500 BP.Aspergillus niger EST SEQ ID NO:3900.WO200056762-A2. |
| 395 | 219159_300928_1 (838 letters) | 2.00E-23 | >gnl\|Derwent\|AAF13368 1323 BP.Aspergillus oryzae EST SEQ ID NO:5891.WO200056762-A2. |
| 396 | 219178_300928_1 (75 letters) | 4.00E-09 | >gnl\|Derwent\|AAV84063 2000 BP.cDNA encoding a hexosaminidase enzyme.WO9850512-A1. |
| 399 | 219218_300929_1 (345 letters) | 9.00E-08 | >gnl\|Derwent\|AAF14471 664 BP.Aspergillus oryzae EST SEQ ID NO:6994.WO200056762-A2. |
| 236 | 214626_300863_1 (649 letters) | 1.00E-150 | >gnl\|Derwent\|AAV29575 375 BP.Trichoderma reesei F1 exhibiting ATPase activity encoding DNA.WO9810089-A1. |
| 403 | 48435_300119_1 (623 letters) | 1.00E-23 | >gnl\|Derwent\|AAC42718 2465 BP.Arabidopsis thaliana DNA fragment SEQ ID NO: 36597.EP1033405-A2. |
| 404 | 48443_300376_1 (349 letters) | 2.00E-14 | >gnl\|Derwent\|AAC55177 811 BP.Arabidopsis thaliana DNA fragment SEQ ID NO: 80252.EP1033405-A2. |
| 407 | 57821_300037_1 (562 letters) | 6.00E-04 | >gnl\|Derwent\|AAC42375 777 BP.Arabidopsis thaliana DNA fragment SEQ ID NO: 35315.EP1033405-A2. |

Figure 6

Disease Resistance Hits: Screening Assay Data

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 405 | N.benthamiana | GBSG0000048445 | ASPEFL | DR1547E01-601969X | | 41.73% | 0.95 | 0.5536 |
| | | | ASPEFL | DR1547E01-601972X | | 55.75% | 0.95 | 0.4204 |
| 11 | N.benthamiana | GBSG0000107690 | SCLESC | DR1557D03-603621X | | 55.15% | 0.815 | 0.3655 |
| | | | SCLESC | DR1557D03-603623X | | 61.55% | 0.815 | 0.3134 |
| 7 | N.benthamiana | GBSG0000104431 | USTIMA | DR1558H02-603763X | 75 | | | |
| | | | USTIMA | DR1558H02-603764X | 50 | | | |
| | | | USTIMA | DR1558H02-603765X | 50 | | | |
| | | | USTIMA | DR1558H02-603766X | 75 | | | |
| 3 | N.benthamiana | GBSG0000104218 | USTIMA | DR1558B08-603895X | 100 | | | |
| | | | USTIMA | DR1558B08-603896X | 50 | | | |
| | | | USTIMA | DR1558B08-603898X | 75 | | | |
| 9 | N.benthamiana | GBSG0000105059 | USTIMA | DR1558A07-603855X | 75 | | | |
| | | | USTIMA | DR1558A07-603856X | 75 | | | |
| | | | USTIMA | DR1558A07-603858X | 50 | | | |
| 10 | N.benthamiana | GBSG0000107031 | USTIMA | DR1558F04-603823X | 75 | | | |
| | | | USTIMA | DR1558F04-603825X | 50 | | | |
| | | | USTIMA | DR1558F04-603826X | 75 | | | |
| 13 | N.benthamiana | GBSG0000109576 | USTIMA | DR1558A08-603889X | 50 | | | |
| | | | USTIMA | DR1558A08-603887X | 75 | | | |
| | | | USTIMA | DR1558A08-603888X | 50 | | | |
| 14 | N.benthamiana | GBSG0000113128 | USTIMA | DR1558D08-603912X | 75 | | | |
| | | | USTIMA | DR1558D08-603913X | 50 | | | |
| | | | USTIMA | DR1558D08-603914X | 75 | | | |
| 22 | N.benthamiana | GBSG0000120677 | USTIMA | DR1558C09-603907X | 75 | | | |
| | | | USTIMA | DR1558C09-603908X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 403 | N.benthamiana | GBSG000048435 | USTIMA | DR1558C09-603909X | 50 | | | |
| | | | USTIMA | DR1558F03-603745X | 75 | | | |
| | | | USTIMA | DR1558F03-603746X | 75 | | | |
| | | | USTIMA | DR1558F03-603747X | 75 | | | |
| 404 | N.benthamiana | GBSG000048443 | USTIMA | DR1558H03-603768X | 75 | | | |
| | | | USTIMA | DR1558H03-603769X | 50 | | | |
| | | | USTIMA | DR1558H03-603770X | 50 | | | |
| 407 | N.benthamiana | GBSG000057821 | USTIMA | DR1558E06-603819X | 50 | | | |
| | | | USTIMA | DR1558E06-603821X | 50 | | | |
| | | | USTIMA | DR1558E06-603822X | 75 | | | |
| 1 | N.benthamiana | GBSG000103532 | USTIMA | DR1558C01-603708X | 50 | | | |
| | | | USTIMA | DR1558C01-603710X | 50 | | | |
| 2 | N.benthamiana | GBSG000103578 | USTIMA | DR1558E01-603727X | 75 | | | |
| | | | USTIMA | DR1558E01-603728X | 50 | | | |
| 4 | N.benthamiana | GBSG000104251 | USTIMA | DR1558C08-603903X | 75 | | | |
| | | | USTIMA | DR1558C08-603906X | 50 | | | |
| 5 | N.benthamiana | GBSG000104421 | USTIMA | DR1558E02-603731X | 75 | | | |
| | | | USTIMA | DR1558E02-603732X | 50 | | | |
| 6 | N.benthamiana | GBSG000104423 | USTIMA | DR1558G02-603751X | 75 | | | |
| | | | USTIMA | DR1558G02-603752X | 75 | | | |
| 12 | N.benthamiana | GBSG000109076 | USTIMA | DR1558G06-603841X | 75 | | | |
| | | | USTIMA | DR1558G06-603842X | 75 | | | |
| 15 | N.benthamiana | GBSG000113145 | USTIMA | DR1558B08-603915X | 75 | | | |
| | | | USTIMA | DR1558B08-603916X | 75 | | | |
| 20 | N.benthamiana | GBSG000120380 | USTIMA | DR1558G08-603919X | 50 | | | |
| | | | USTIMA | DR1558G08-603918X | 50 | | | |
| 402 | N.benthamiana | GBSG000048411 | USTIMA | DR1558E03-603733X | 75 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP OD 595 |
|---|---|---|---|---|---|---|---|---|
| 406 | N.benthamiana | GBSG0000048469 | USTIMA | DR1558E03-603734X | 50 | | | |
| | | | USTIMA | DR1558D04-603799X | 75 | 57.78% | 1.414625 | 0.5972 |
| | | | USTIMA | DR1558D04-603800X | 75 | 58.51% | 1.414625 | 0.5869 |
| 26 | N.benthamiana | GBSG0000127296 | DIAPHE | DR2471C05-746652X | 25 | 55.47% | 1.584617 | 0.7057 |
| | | | DIAPHE | DR2471C05-746653X | 25 | 46.82% | 1.63 | 0.8668 |
| 30 | Papaver rhoeas | GBSG0000130744 | COCHHE | DR2494F01-762865X | 75 | | | |
| | | | COCHHE | DR2495F01-762958X | 50 | | | |
| 38 | Papaver rhoeas | GBSG0000167904 | USTIMA | DR2500A07-747921X | 25 | | | |
| | | | USTIMA | DR2500A07-747922X | 25 | 55.51% | 1.648422 | 0.7334 |
| 37 | Oryzae sativa | GBSG0000139377 | COCHHE | DR2496G01-763065X | 50 | 58.52% | 1.648422 | 0.6837 |
| | | | COCHHE | DR2496G01-763066X | 50 | 40.55% | 1.2814 | 0.7618 |
| 35 | Oryzae sativa | GBSG0000136729 | DIAPHE | DR2473G01-746777X | 25 | 40.78% | 1.2814 | 0.7589 |
| | | | DIAPHE | DR2473G01-746778X | 25 | 48.35% | 1.140714 | 0.5892 |
| 43 | Oryzae sativa | GBSG0000175159 | DIAPHE | DR2472A06-746757X | 25 | 43.79% | 1.2814 | 0.7203 |
| | | | DIAPHE | DR2473A06-746839X | 25 | | | |
| 65 | Trichoderma harzianum | GBSG0000212333 | PYTHUL | DR1906C01-629966X | 100 | | | |
| | | | PYTHUL | DR1907C01-630038X | 100 | | | |
| 66 | Trichoderma harzianum | GBSG0000212363 | PYTHUL | DR1907F01-630040X | 100 | | | |
| | | | PYTHUL | DR1907F01-630116X | 100 | | | |
| 67 | Trichoderma harzianum | GBSG0000212375 | PYTHUL | DR1906H01-629886X | 25 | | | |
| | | | PYTHUL | DR1906H01-629988X | 100 | | | |
| | | | PYTHUL | DR1907H01-630120X | 100 | | | |
| 68 | Trichoderma harzianum | GBSG0000212426 | PYTHUL | DR1906D02-629888X | 100 | | | |
| | | | PYTHUL | DR1906D02-629969X | 100 | | | |
| | | | PYTHUL | DR1907D02-630119X | 100 | | | |
| 69 | Trichoderma harzianum | GBSG0000212454 | PYTHUL | DR1906E02-629970X | 100 | | | |
| | | | PYTHUL | DR1907E02-630045X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 70 | Trichoderma harzianum | GBSG0000212492 | PYTHUL | DR1906B03-629972X | 100 | | | |
| | | | PYTHUL | DR1907B03-630047X | 100 | | | |
| 71 | Trichoderma harzianum | GBSG0000212511 | PYTHUL | DR1906D03-629895X | 100 | | | |
| | | | PYTHUL | DR1907D03-630049X | 100 | | | |
| | | | PYTHUL | DR1907D03-630123X | 100 | | | |
| 72 | Trichoderma harzianum | GBSG0000212639 | PYTHUL | DR1906D04-629980X | 100 | | | |
| | | | PYTHUL | DR1907D04-630054X | 100 | | | |
| 73 | Trichoderma harzianum | GBSG0000212708 | PYTHUL | DR1906G04-629981X | 100 | | | |
| | | | PYTHUL | DR1907G04-630055X | 25 | | | |
| | | | PYTHUL | DR1907G04-630129X | 25 | | | |
| 74 | Trichoderma harzianum | GBSG0000212785 | PYTHUL | DR1906G05-629909X | 100 | | | |
| | | | PYTHUL | DR1907G05-630062X | 100 | | | |
| 75 | Trichoderma harzianum | GBSG0000212945 | PYTHUL | DR1906G07-629923X | 100 | | | |
| | | | PYTHUL | DR1907G07-630073X | 100 | | | |
| 76 | Trichoderma harzianum | GBSG0000212954 | PYTHUL | DR1906B08-630002X | 100 | | | |
| | | | PYTHUL | DR1907B08-630075X | 100 | | | |
| 77 | Trichoderma harzianum | GBSG0000212959 | PYTHUL | DR1906D08-630005X | 100 | | | |
| | | | PYTHUL | DR1907D08-630150X | 100 | | | |
| 78 | Trichoderma harzianum | GBSG0000213011 | PYTHUL | DR1906C09-629935X | 100 | | | |
| | | | PYTHUL | DR1907C09-630084X | 100 | | | |
| 79 | Trichoderma harzianum | GBSG0000213059 | PYTHUL | DR1906A10-629941X | 100 | | | |
| | | | PYTHUL | DR1906A10-630018X | 25 | | | |
| | | | PYTHUL | DR1907A10-630162X | 100 | | | |
| 80 | Trichoderma harzianum | GBSG0000213072 | PYTHUL | DR1906B10-629942X | 100 | | | |
| | | | PYTHUL | DR1906B10-630019X | 25 | | | |
| | | | PYTHUL | DR1907B10-630163X | 75 | | | |
| 81 | Trichoderma harzianum | GBSG0000213120 | PYTHUL | DR1906B12-629958X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1907B12-630106X | 100 | | | |
| 82, 83 | Trichoderma harzianum | GBSG0000213364 | COCHHE | DR1766G01-620996X | 25 | | | |
| | | | COCHHE | DR1766G01-620997X | 25 | | | |
| 84 | Trichoderma harzianum | GBSG0000213718 | PYRIOR | DR1767A04-621178X | 50 | | | |
| | | | PYRIOR | DR1767A04-621179X | 25 | | | |
| 85 | Trichoderma harzianum | GBSG0000213733 | GIBBZE | DR1766A05-621041X | 25 | | | |
| | | | GIBBZE | DR1766A05-621042X | 25 | | | |
| | | | LEPTMA | DR1766A05-621041X | 25 | | | |
| | | | LEPTMA | DR1766A05-621042X | 75 | | | |
| 86 | Trichoderma harzianum | GBSG0000213792 | LEPTMA | DR1711C10-620257X | 25 | | | |
| | | | LEPTMA | DR1711C10-620258X | 25 | | | |
| 87 | Trichoderma harzianum | GBSG0000213793 | COCHHE | DR1766F09-621099X | 25 | | | |
| | | | COCHHE | DR1767F09-621257X | 50 | | | |
| | | | GIBBZE | DR1711D10-620259X | 100 | | | |
| | | | GIBBZE | DR1767F09-621257X | 75 | | | |
| | | | C-SCLESC | DR1711D10-620260X | 25 | | | |
| | | | C-SCLESC | DR1767F09-621257X | 50 | | | |
| 88 | Trichoderma harzianum | GBSG0000213827 | PYRIOR | DR1712G01-620293X | 25 | | | |
| | | | PYRIOR | DR1712G01-620294X | 25 | | | |
| 89 | Trichoderma harzianum | GBSG0000213830 | PYTHUL | DR1768E01-621310X | 25 | | | |
| | | | PYTHUL | DR1769E01-621448X | 100 | | | |
| 90 | Trichoderma harzianum | GBSG0000213835 | PYRIOR | DR1769H01-621452X | 25 | | | |
| | | | PYRIOR | DR1769H01-621453X | 25 | | | |
| | | | PYTHUL | DR1768H01-621314X | 50 | | | |
| | | | PYTHUL | DR1769H01-621453X | 25 | | | |
| 91 | Trichoderma harzianum | GBSG0000213836 | PYTHUL | DR1712E02-620302X | 100 | | | |
| | | | PYTHUL | DR1713E02-620453X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 92 | Trichoderma harzianum | GBSG0000213837 | PYTHUL | DR1712G02-620306X | 100 | | | |
| | | | PYTHUL | DR1768B02-621316X | 50 | | | |
| 93 | Trichoderma harzianum | GBSG0000213849 | LEPTMA | DR1769G02-621465X | 25 | | | |
| | | | LEPTMA | DR1769G02-621466X | 25 | | | |
| | | | PYRIOR | DR1769G02-621465X | 25 | | | |
| | | | PYRIOR | DR1769G02-621466X | 25 | | | |
| 94 | Trichoderma harzianum | GBSG0000213850 | PYTHUL | DR1768H02-621326X | 50 | | | |
| | | | PYTHUL | DR1768H02-621327X | 50 | | | |
| 95 | Trichoderma harzianum | GBSG0000213862 | GIBBFU | DR1769E03-621476X | 50 | | | |
| | | | GIBBFU | DR1769E03-621477X | 50 | | | |
| | | | PYRIOR | DR1769E03-621476X | 75 | | | |
| | | | PYRIOR | DR1769E03-621477X | 25 | | | |
| 96 | Trichoderma harzianum | GBSG0000213865 | PYTHUL | DR1768G03-621338X | 50 | | | |
| | | | PYTHUL | DR1769G03-621481X | 25 | | | |
| 97 | Trichoderma harzianum | GBSG0000213882 | LEPTMA | DR1713D05-620494X | 25 | | | |
| | | | LEPTMA | DR1769C05-621500X | 25 | | | |
| 98 | Trichoderma harzianum | GBSG0000213892 | GIBBZE | DR1712A06-620352X | 100 | | | |
| | | | GIBBZE | DR1712A06-620353X | 100 | | | |
| | | | PYTHUL | DR1712A06-620352X | 100 | | | |
| | | | PYTHUL | DR1713A06-620502X | 100 | | | |
| 99 | Trichoderma harzianum | GBSG0000213894 | PYTHUL | DR1712B06-620355X | 100 | | | |
| | | | PYTHUL | DR1713B06-620505X | 100 | | | |
| 100 | Trichoderma harzianum | GBSG0000213908 | PYTHUL | DR1712G06-620365X | 100 | | | |
| | | | PYTHUL | DR1768G06-621375X | 100 | | | |
| 101 | Trichoderma harzianum | GBSG0000213911 | PYTHUL | DR1768A07-621380X | 100 | | | |
| | | | PYTHUL | DR1769A07-621526X | 100 | | | |
| 102 | Trichoderma harzianum | GBSG0000213923 | GIBBZE | DR1712H07-620376X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 103 | Trichoderma harzianum | GBSG0000213929 | GIBBZE | DR1712H07-620377X | 75 | | | |
| | | | PYTHUL | DR1712C08-620383X | 100 | | | |
| | | | PYTHUL | DR1769C08-621539X | 25 | | | |
| 104 | Trichoderma harzianum | GBSG0000213937 | PYTHUL | DR1713H08-620537X | 75 | | | |
| | | | PYTHUL | DR1769A09-621548X | 100 | | | |
| 105 | Trichoderma harzianum | GBSG0000213946 | PYTHUL | DR1712E09-620396X | 100 | | | |
| | | | PYTHUL | DR1713E09-620546X | 100 | | | |
| 106 | Trichoderma harzianum | GBSG0000213956 | PYRIOR | DR1712H09-620402X | 25 | | | |
| | | | PYRIOR | DR1769C10-621566X | 25 | | | |
| 107 | Trichoderma harzianum | GBSG0000213967 | PYTHUL | DR1712D10-620409X | 100 | | | |
| | | | PYTHUL | DR1713D10-620557X | 100 | | | |
| 108 | Trichoderma harzianum | GBSG0000213980 | PYTHUL | DR1712A12-620417X | 10 | | | |
| | | | PYTHUL | DR1768F12-621435X | 75 | | | |
| 109 | Trichoderma harzianum | GBSG0000213991 | LEPTMA | DR1713F12-620578X | 50 | | | |
| | | | LEPTMA | DR1770D01-621596X | 24 | | | |
| 110 | Trichoderma harzianum | GBSG0000214011 | LEPTMA | DR1770E02-621610X | 25 | | | |
| | | | LEPTMA | DR1770E02-621611X | 25 | | | |
| 111 | Trichoderma harzianum | GBSG0000214019 | LEPTMA | DR1770C03-621622X | 75 | | | |
| | | | LEPTMA | DR1771C03-621852X | 50 | | | |
| | | | PYTHUL | DR1770C03-621622X | 100 | | | |
| | | | PYTHUL | DR1771C03-621851X | 50 | | | |
| 112 | Trichoderma harzianum | GBSG0000214026 | LEPTMA | DR1770G03-621630X | 25 | | | |
| | | | LEPTMA | DR1771G03-621859X | 25 | | | |
| 113 | Trichoderma harzianum | GBSG0000214084 | PYTHUL | DR1770C07-621677X | 100 | | | |
| | | | PYTHUL | DR1771C07-621750X | 100 | | | |
| 114 | Trichoderma harzianum | GBSG0000214086 | PYTHUL | DR1770F07-621684X | 100 | | | |
| | | | PYTHUL | DR1771F07-621755X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 115 | Trichoderma harzianum | GBSG0000214087 | LEPTMA | DR1770G07-621687X | 100 | | | |
| | | | LEPTMA | DR1771G07-621758X | 25 | | | |
| 116 | Trichoderma harzianum | GBSG0000214107 | LEPTMA | DR1770A09-621703X | 25 | | | |
| | | | LEPTMA | DR1770A09-621704X | 25 | | | |
| | | | LEPTMA | DR1771A09-621774X | 25 | | | |
| 117 | Trichoderma harzianum | GBSG0000214109 | LEPTMA | DR1770D09-621709X | 25 | | | |
| | | | LEPTMA | DR1771D09-621780X | 25 | | | |
| 118 | Trichoderma harzianum | GBSG0000214111 | LEPTMA | DR1770F09-621714X | 25 | | | |
| | | | LEPTMA | DR1771F09-621784X | 25 | | | |
| 119 | Trichoderma harzianum | GBSG0000214134 | PYTHUL | DR1771H10-621800X | 100 | | | |
| | | | PYTHUL | DR1771H10-621801X | 100 | | | |
| 120 | Trichoderma harzianum | GBSG0000214148 | PYTHUL | DR1790B01-622683X | 100 | | | |
| | | | PYTHUL | DR1790B01-622684X | 100 | | | |
| | | | PYTHUL | DR1791B01-622851X | 100 | | | |
| 121 | Trichoderma harzianum | GBSG0000214150 | PYTHUL | DR1791C01-622853X | 75 | | | |
| | | | PYTHUL | DR1791C01-622854X | 75 | | | |
| 122 | Trichoderma harzianum | GBSG0000214165 | PYTHUL | DR1790D02-622702X | 100 | | | |
| | | | PYTHUL | DR1790D02-622703X | 100 | | | |
| | | | PYTHUL | DR1791D02-622867X | 100 | | | |
| | | | PYTHUL | DR1791D02-622868X | 100 | | | |
| 123 | Trichoderma harzianum | GBSG0000214166 | PYTHUL | DR1790E02-622704X | 100 | | | |
| | | | PYTHUL | DR1791E02-622870X | 100 | | | |
| 124 | Trichoderma harzianum | GBSG0000214187 | PYTHUL | DR1790B03-622719X | 100 | | | |
| | | | PYTHUL | DR1791E03-622883X | 75 | | | |
| 125 | Trichoderma harzianum | GBSG0000214188 | PYTHUL | DR1790F03-622721X | 100 | | | |
| | | | PYTHUL | DR1791F03-622886X | 75 | | | |
| 126 | Trichoderma harzianum | GBSG0000214194 | PYTHUL | DR1790A04-622726X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1791A04-622892X | 100 | | | |
| 127 | Trichoderma harzianumGBSG0000214213 | | PYTHUL | DR1790H04-622740X | 100 | | | |
| | | | PYTHUL | DR1791H04-622905X | 50 | | | |
| 128 | Trichoderma harzianumGBSG0000214214 | | PYTHUL | DR1791A05-622907X | 75 | | | |
| | | | PYTHUL | DR1791A05-622908X | 75 | | | |
| 129 | Trichoderma harzianumGBSG0000214221 | | LEPTMA | DR1791D05-622912X | 50 | | | |
| | | | LEPTMA | DR1791D05-622913X | 75 | | | |
| | | | PYTHUL | DR1790D05-622746X | 100 | | | |
| | | | PYTHUL | DR1791D05-622913X | 100 | | | |
| 130 | Trichoderma harzianumGBSG0000214222 | | PYTHUL | DR1790E05-622747X | 100 | | | |
| | | | PYTHUL | DR1791E05-622914X | 100 | | | |
| 131 | Trichoderma harzianumGBSG0000214236 | | LEPTMA | DR1790G06-622766X | 25 | | | |
| | | | LEPTMA | DR1791G06-622934X | 25 | | | |
| 132 | Trichoderma harzianumGBSG0000214237 | | LEPTMA | DR1791H06-622936X | 75 | | | |
| | | | LEPTMA | DR1791H06-622937X | 25 | | | |
| 133 | Trichoderma harzianumGBSG0000214244 | | PYTHUL | DR1790F07-622784X | 25 | | | |
| | | | PYTHUL | DR1791F07-622946X | 100 | | | |
| 134 | Trichoderma harzianumGBSG0000214253 | | PYTHUL | DR1790D08-622955X | 100 | | | |
| | | | PYTHUL | DR1791D08-622956X | 100 | | | |
| 135 | Trichoderma harzianumGBSG0000214259 | | PYTHUL | DR1790G08-622802X | 100 | | | |
| | | | PYTHUL | DR1791G08-622961X | 100 | | | |
| 136 | Trichoderma harzianumGBSG0000214262 | | PYTHUL | DR1790A09-622805X | 10 | | | |
| | | | PYTHUL | DR1791A09-622966X | 100 | | | |
| 137 | Trichoderma harzianumGBSG0000214267 | | PYTHUL | DR1790E09-622813X | 100 | | | |
| | | | PYTHUL | DR1791E09-622973X | 100 | | | |
| | | | PYTHUL | DR1791E09-622974X | 100 | | | |
| 138 | Trichoderma harzianumGBSG0000214278 | | PYTHUL | DR1791E10-622989X | 75 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1791E10-622990X | 75 | | | |
| 139 | Trichoderma harzianum | GBSG0000214280 | PYTHUL | DR1790H10-622833X | 100 | | | |
| | | | PYTHUL | DR1791H10-622995X | 10 | | | |
| 140 | Trichoderma harzianum | GBSG0000214286 | PYRIOR | DR1790E12-622842X | 25 | | | |
| | | | PYRIOR | DR1790E12-622843X | 25 | | | |
| 141 | Trichoderma harzianum | GBSG0000214288 | PYTHUL | DR1790G12-622845X | 100 | | | |
| | | | PYTHUL | DR1791G12-623008X | 100 | | | |
| 142 | Trichoderma harzianum | GBSG0000214296 | PYTHUL | DR1792F01-627838X | 100 | | | |
| | | | PYTHUL | DR1792F01-627839X | 100 | | | |
| | | | PYTHUL | DR1793F01-627931X | 100 | | | |
| 143 | Trichoderma harzianum | GBSG0000214307 | PYTHUL | DR1792H01-627842X | 100 | | | |
| | | | PYTHUL | DR1793H01-627932X | 100 | | | |
| 144 | Trichoderma harzianum | GBSG0000214309 | CERCZM | DR1793A02-627934X | 50 | | | |
| | | | CERCZM | DR1793A02-627935X | 50 | | | |
| 145 | Trichoderma harzianum | GBSG0000214318 | PYTHUL | DR1792D02-627851X | 100 | | | |
| | | | PYTHUL | DR1793D02-627941X | 100 | | | |
| 146 | Trichoderma harzianum | GBSG0000214319 | PYTHUL | DR1792E02-627852X | 100 | | | |
| | | | PYTHUL | DR1793E02-627943X | 100 | | | |
| 147 | Trichoderma harzianum | GBSG0000214326 | PYTHUL | DR1792C03-627864X | 100 | | | |
| | | | PYTHUL | DR1793C03-627953X | 75 | | | |
| | | | PYTHUL | DR1793C03-627954X | 100 | | | |
| 148 | Trichoderma harzianum | GBSG0000214329 | PYTHUL | DR1792F03-627868X | 100 | | | |
| | | | PYTHUL | DR1792F03-627869X | 100 | | | |
| | | | PYTHUL | DR1793F03-627957X | 25 | | | |
| | | | PYTHUL | DR1793F03-627958X | 25 | | | |
| 149 | Trichoderma harzianum | GBSG0000214332 | PYTHUL | DR1792G03-627870X | 100 | | | |
| | | | PYTHUL | DR1793G03-627960X | 100 | | | |

Figure 6 continued

| SEQ ID NO | GENE LIBRARY | SEQ ID | TEST NAME* | ALIQUOT ID | VISUAL & INHIBITION | CALC. % INHIBITION | AVG. OD 595 | NULL SAMP. OD 595 |
|---|---|---|---|---|---|---|---|---|
| 150 | Trichoderma harzianum | GBSG0000214333 | PYTHUL | DR1792H03-627872X | 100 | | | |
| | | | PYTHUL | DR1792H03-627873X | 100 | | | |
| | | | PYTHUL | DR1793H03-627961X | 100 | | | |
| 151 | Trichoderma harzianum | GBSG0000214336 | PYTHUL | DR1792B04-627877X | 25 | | | |
| | | | PYTHUL | DR1793B04-627965X | 75 | | | |
| | | | PYTHUL | DR1793B04-627966X | 50 | | | |
| 152 | Trichoderma harzianum | GBSG0000214340 | PYTHUL | DR1792E04-627882X | 100 | | | |
| | | | PYTHUL | DR1793E04-627971X | 100 | | | |
| | | | PYTHUL | DR1793E04-627972X | 25 | | | |
| 153 | Trichoderma harzianum | GBSG0000214348 | PYTHUL | DR1792C05-627895X | 100 | | | |
| | | | PYTHUL | DR1793C05-627981X | 100 | | | |
| 154 | Trichoderma harzianum | GBSG0000214350 | PYTHUL | DR1792D05-627896X | 100 | | | |
| | | | PYTHUL | DR1793D05-627982X | 25 | | | |
| 155 | Trichoderma harzianum | GBSG0000214358 | PYTHUL | DR1792G05-627900X | 100 | | | |
| | | | PYTHUL | DR1792G05-627901X | 100 | | | |
| 156 | Trichoderma harzianum | GBSG0000214367 | PYTHUL | DR1792E06-627912X | 100 | | | |
| | | | PYTHUL | DR1792E06-627913X | 100 | | | |
| 157 | Trichoderma harzianum | GBSG0000214368 | PYTHUL | DR1792F06-627914X | 75 | | | |
| | | | PYTHUL | DR1792F06-627915X | 25 | | | |
| | | | PYTHUL | DR1793F06-628001X | 100 | | | |
| 158 | Trichoderma harzianum | GBSG0000214371 | PYTHUL | DR1792A07-627918X | 100 | | | |
| | | | PYTHUL | DR1793A07-628005X | 100 | | | |
| 159 | Trichoderma harzianum | GBSG0000214379 | PYTHUL | DR1792C07-628380X | 100 | | | |
| | | | PYTHUL | DR1792C07-628381X | 75 | | | |
| | | | PYTHUL | DR1793C07-628006X | 75 | | | |
| 160 | Trichoderma harzianum | GBSG0000214380 | PYTHUL | DR1792D07-628382X | 25 | | | |
| | | | PYTHUL | DR1792D07-628383X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 161 | Trichoderma harzianum | GBSG00000214406 | LEPTMA | DR1793A09-628030X | 25 | | | |
| | | | LEPTMA | DR1793A09-628031X | 25 | | | |
| 162 | Trichoderma harzianum | GBSG00000214409 | PYTHUL | DR1793D09-628036X | 100 | | | |
| | | | PYTHUL | DR1793D09-628037X | 100 | | | |
| 163 | Trichoderma harzianum | GBSG00000214411 | PYTHUL | DR1792F09-628414X | 100 | | | |
| | | | PYTHUL | DR1792F09-628415X | 100 | | | |
| 164 | Trichoderma harzianum | GBSG00000214416 | PYTHUL | DR1793B10-628046X | 75 | | | |
| | | | PYTHUL | DR1793B10-628047X | 75 | | | |
| 165 | Trichoderma harzianum | GBSG00000214417 | PYTHUL | DR1792C10-628423X | 100 | | | |
| | | | PYTHUL | DR1792C10-628424X | 100 | | | |
| 166 | Trichoderma harzianum | GBSG00000214421 | PYTHUL | DR1792D10-628425X | 100 | | | |
| | | | PYTHUL | DR1792D10-628426X | 100 | | | |
| 167 | Trichoderma harzianum | GBSG00000214433 | PYTHUL | DR1792C12-628437X | 50 | | | |
| | | | PYTHUL | DR1792C12-628438X | 50 | | | |
| 168 | Trichoderma harzianum | GBSG00000214437 | PYTHUL | DR1792E12-628441X | 75 | | | |
| | | | PYTHUL | DR1792E12-628442X | 75 | | | |
| | | | PYTHUL | DR1793E12-628067X | 75 | | | |
| 169 | Trichoderma harzianum | GBSG00000214438 | PYTHUL | DR1792F12-628444X | 25 | | | |
| | | | PYTHUL | DR1793F12-628070X | 75 | | | |
| 170 | Trichoderma harzianum | GBSG00000214439 | PYTHUL | DR1792G12-628445X | 25 | | | |
| | | | PYTHUL | DR1792G12-628446X | 100 | | | |
| | | | PYTHUL | DR1793G12-628072X | 75 | | | |
| 171 | Trichoderma harzianum | GBSG00000214441 | LEPTMA | DR1793H12-628073X | 25 | | | |
| | | | LEPTMA | DR1793H12-628074X | 25 | | | |
| 172 | Trichoderma harzianum | GBSG00000214443 | PYTHUL | DR1794B01-628077X | 100 | | | |
| | | | PYTHUL | DR1795B01-628222X | 100 | | | |
| | | | PYTHUL | DR1795B01-628223X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 173 | Trichoderma harzianum | GBSG00000214444 | PYTHUL | DR1794C01-628078X | 100 | | | |
| | | | PYTHUL | DR1794C01-628079X | 100 | | | |
| | | | PYTHUL | DR1795C01-628224X | 100 | | | |
| | | | PYTHUL | DR1795C01-628225X | 100 | | | |
| 174 | Trichoderma harzianum | GBSG00000214445 | PYTHUL | DR1794D01-628080X | 100 | | | |
| | | | PYTHUL | DR1794D01-628081X | 100 | | | |
| | | | PYTHUL | DR1795D01-628226X | 100 | | | |
| 175 | Trichoderma harzianum | GBSG00000214447 | PYTHUL | DR1794E01-628082X | 100 | | | |
| | | | PYTHUL | DR1795E01-628227X | 100 | | | |
| | | | PYTHUL | DR1795E01-628228X | 100 | | | |
| 176 | Trichoderma harzianum | GBSG00000214448 | PYTHUL | DR1794F01-628084X | 100 | | | |
| | | | PYTHUL | DR1794F01-628085X | 100 | | | |
| | | | PYTHUL | DR1795F01-628229X | 100 | | | |
| | | | PYTHUL | DR1795F01-628230X | 100 | | | |
| 177 | Trichoderma harzianum | GBSG00000214450 | PYTHUL | DR1794G01-628086X | 100 | | | |
| | | | PYTHUL | DR1795G01-628231X | 100 | | | |
| | | | PYTHUL | DR1795G01-628232X | 100 | | | |
| 178 | Trichoderma harzianum | GBSG00000214452 | PYTHUL | DR1794H01-628088X | 100 | | | |
| | | | PYTHUL | DR1795H01-628233X | 100 | | | |
| 179 | Trichoderma harzianum | GBSG00000214456 | PYTHUL | DR1794A02-628090X | 100 | | | |
| | | | PYTHUL | DR1795A02-628236X | 100 | | | |
| 180 | Trichoderma harzianum | GBSG00000214457 | PYTHUL | DR1795B02-628237X | 100 | | | |
| | | | PYTHUL | DR1795B02-628238X | 100 | | | |
| 181 | Trichoderma harzianum | GBSG00000214459 | PYTHUL | DR1794C02-628094X | 100 | | | |
| | | | PYTHUL | DR1795C02-628239X | 100 | | | |
| | | | PYTHUL | DR1795C02-628240X | 100 | | | |
| 182 | Trichoderma harzianum | GBSG00000214460 | PYTHUL | DR1794D02-628096X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1795D02-628241X | 100 | | | |
| | | | PYTHUL | DR1795D02-628242X | 100 | | | |
| 183 | Trichoderma harzianum | GBSG0000214461 | PYTHUL | DR1795E02-628243X | 100 | | | |
| | | | PYTHUL | DR1795E02-628244X | 100 | | | |
| 184 | Trichoderma harzianum | GBSG0000214465 | PYTHUL | DR1794G02-628100X | 100 | | | |
| | | | PYTHUL | DR1794G02-628101X | 100 | | | |
| 185 | Trichoderma harzianum | GBSG0000214468 | PYTHUL | DR1795B03-628253X | 100 | | | |
| | | | PYTHUL | DR1795B03-628254X | 100 | | | |
| 186 | Trichoderma harzianum | GBSG0000214471 | PYTHUL | DR1794C03-628106X | 100 | | | |
| | | | PYTHUL | DR1794C03-628107X | 100 | | | |
| | | | PYTHUL | DR1795C03-628255X | 100 | | | |
| | | | PYTHUL | DR1795C03-628256X | 100 | | | |
| 187 | Trichoderma harzianum | GBSG0000214473 | LEPTMA | DR1794E03-628108X | 25 | | | |
| | | | LEPTMA | DR1795E03-628259X | 25 | | | |
| 188 | Trichoderma harzianum | GBSG0000214475 | PYTHUL | DR1794F03-628110X | 100 | | | |
| | | | PYTHUL | DR1794F03-628111X | 100 | | | |
| 189 | Trichoderma harzianum | GBSG0000214480 | PYTHUL | DR1794A04-628114X | 100 | | | |
| | | | PYTHUL | DR1794A04-628115X | 100 | | | |
| | | | PYTHUL | DR1795A04-628264X | 100 | | | |
| 190 | Trichoderma harzianum | GBSG0000214481 | PYTHUL | DR1794B04-628116X | 100 | | | |
| | | | PYTHUL | DR1795B04-628267X | 100 | | | |
| 191 | Trichoderma harzianum | GBSG0000214485 | PYTHUL | DR1794E04-628121X | 100 | | | |
| | | | PYTHUL | DR1794E04-628122X | 100 | | | |
| 192 | Trichoderma harzianum | GBSG0000214491 | PYTHUL | DR1795A05-628279X | 100 | | | |
| | | | PYTHUL | DR1795A05-628280X | 100 | | | |
| 193 | Trichoderma harzianum | GBSG0000214493 | PYTHUL | DR1794C05-628131X | 100 | | | |
| | | | PYTHUL | DR1795C05-628282X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 194 | Trichoderma harzianum | GBSG00000214494 | PYTHUL | DR1794D05-628133X | 100 | | | |
| | | | PYTHUL | DR1794D05-628134X | 50 | | | |
| 195 | Trichoderma harzianum | GBSG00000214495 | PYTHUL | DR1794E05-628135X | 50 | | | |
| | | | PYTHUL | DR1795E05-628285X | 100 | | | |
| | | | PYTHUL | DR1795E05-628286X | 100 | | | |
| 196 | Trichoderma harzianum | GBSG00000214496 | PYTHUL | DR1794F05-628138X | 100 | | | |
| | | | PYTHUL | DR1795F05-628288X | 100 | | | |
| 197 | Trichoderma harzianum | GBSG00000214504 | PYTHUL | DR1794A06-628143X | 100 | | | |
| | | | PYTHUL | DR1795A06-628293X | 100 | | | |
| | | | PYTHUL | DR1795A06-628294X | 100 | | | |
| 198 | Trichoderma harzianum | GBSG00000214505 | PYTHUL | DR1794B06-628146X | 100 | | | |
| | | | PYTHUL | DR1795B06-628295X | 100 | | | |
| | | | PYTHUL | DR1795B06-628296X | 100 | | | |
| 199 | Trichoderma harzianum | GBSG00000214506 | PYTHUL | DR1794C06-628148X | 100 | | | |
| | | | PYTHUL | DR1795C06-628297X | 100 | | | |
| | | | PYTHUL | DR1795C06-628298X | 100 | | | |
| 200 | Trichoderma harzianum | GBSG00000214511 | PYTHUL | DR1794E06-628150X | 100 | | | |
| | | | PYTHUL | DR1795E06-628300X | 100 | | | |
| 201 | Trichoderma harzianum | GBSG00000214513 | PYTHUL | DR1795G06-628303X | 100 | | | |
| | | | PYTHUL | DR1795G06-628304X | 100 | | | |
| 202 | Trichoderma harzianum | GBSG00000214515 | PYTHUL | DR1794H06-628151X | 100 | | | |
| | | | PYTHUL | DR1795H06-628305X | 100 | | | |
| | | | PYTHUL | DR1795H06-628306X | 100 | | | |
| 203 | Trichoderma harzianum | GBSG00000214519 | PYTHUL | DR1794A07-628152X | 100 | | | |
| | | | PYTHUL | DR1794A07-628153X | 100 | | | |
| | | | PYTHUL | DR1795A07-628307X | 100 | | | |
| | | | PYTHUL | DR1795A07-628308X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 204 | Trichoderma harzianum | GBSG00000214526 | PYTHUL | DR1794D07-628156X | 100 | | | |
| | | | PYTHUL | DR1794D07-628157X | 100 | | | |
| | | | PYTHUL | DR1795D07-628312X | 100 | | | |
| 205 | Trichoderma harzianum | GBSG00000214533 | PYTHUL | DR1795B08-628322X | 100 | | | |
| | | | PYTHUL | DR1795B08-628323X | 25 | | | |
| 206 | Trichoderma harzianum | GBSG00000214534 | PYTHUL | DR1795C08-628324X | 25 | | | |
| | | | PYTHUL | DR1795C08-628325X | 25 | | | |
| 207 | Trichoderma harzianum | GBSG00000214544 | PYTHUL | DR1794G08-628172X | 75 | | | |
| | | | PYTHUL | DR1795G08-628332X | 25 | | | |
| | | | PYTHUL | DR1795G08-628333X | 100 | | | |
| 208 | Trichoderma harzianum | GBSG00000214545 | PYTHUL | DR1794H08-628173X | 75 | | | |
| | | | PYTHUL | DR1794H08-628174X | 75 | | | |
| | | | PYTHUL | DR1795H08-628334X | 100 | | | |
| | | | PYTHUL | DR1795H08-628335X | 100 | | | |
| 209 | Trichoderma harzianum | GBSG00000214547 | PYTHUL | DR1794A09-628175X | 75 | | | |
| | | | PYTHUL | DR1794A09-628176X | 100 | | | |
| | | | PYTHUL | DR1795A09-628336X | 25 | | | |
| | | | PYTHUL | DR1795A09-628337X | 25 | | | |
| 210 | Trichoderma harzianum | GBSG00000214548 | PYTHUL | DR1794C09-628179X | 100 | | | |
| | | | PYTHUL | DR1795C09-628341X | 100 | | | |
| 211 | Trichoderma harzianum | GBSG00000214549 | PYTHUL | DR1794D09-628181X | 100 | | | |
| | | | PYTHUL | DR1795D09-628342X | 100 | | | |
| | | | PYTHUL | DR1795D09-628343X | 100 | | | |
| 212 | Trichoderma harzianum | GBSG00000214558 | PYTHUL | DR1794A10-628188X | 100 | | | |
| | | | PYTHUL | DR1794A10-628189X | 100 | | | |
| | | | PYTHUL | DR1795A10-628351X | 100 | | | |
| 213 | Trichoderma harzianum | GBSG00000214576 | PYTHUL | DR1794B12-628206X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1794B12-628207X | 100 | | | |
| 214 | Trichoderma harzianumGBSG0000214577 | | PYTHUL | DR1794C12-628208X | 100 | | | |
| | | | PYTHUL | DR1795C12-628368X | 100 | | | |
| 215 | Trichoderma harzianumGBSG0000214578 | | PYTHUL | DR1794E12-628212X | 100 | | | |
| | | | PYTHUL | DR1794E12-628213X | 100 | | | |
| 216 | Trichoderma harzianumGBSG0000214579 | | PYTHUL | DR1794F12-628215X | 25 | | | |
| | | | PYTHUL | DR1795F12-628375X | 50 | | | |
| 217 | Trichoderma harzianumGBSG0000214583 | | PYTHUL | DR1794H12-628218X | 25 | | | |
| | | | PYTHUL | DR1794H12-628219X | 100 | | | |
| 218 | Trichoderma harzianumGBSG0000214584 | | PYTHUL | DR1797B01-628592X | 100 | | | |
| | | | PYTHUL | DR1797B01-628593X | 100 | | | |
| 219 | Trichoderma harzianumGBSG0000214585 | | PYTHUL | DR1796C01-628453X | 100 | | | |
| | | | PYTHUL | DR1796C01-628454X | 100 | | | |
| | | | PYTHUL | DR1797C01-628595X | 100 | | | |
| 220 | Trichoderma harzianumGBSG0000214592 | | PYTHUL | DR1796D01-628455X | 100 | | | |
| | | | PYTHUL | DR1797D01-628596X | 100 | | | |
| | | | PYTHUL | DR1797D01-628597X | 100 | | | |
| 221 | Trichoderma harzianumGBSG0000214595 | | PYTHUL | DR1796F01-628459X | 100 | | | |
| | | | PYTHUL | DR1797F01-628599X | 100 | | | |
| | | | PYTHUL | DR1797F01-628600X | 100 | | | |
| 222 | Trichoderma harzianumGBSG0000214596 | | PYTHUL | DR1796G01-628460X | 100 | | | |
| | | | PYTHUL | DR1796G01-628461X | 100 | | | |
| | | | PYTHUL | DR1797G01-628602X | 100 | | | |
| 223 | Trichoderma harzianumGBSG0000214601 | | PYTHUL | DR1796H01-628462X | 100 | | | |
| | | | PYTHUL | DR1796H01-628463X | 100 | | | |
| | | | PYTHUL | DR1797H01-628603X | 100 | | | |
| | | | PYTHUL | DR1797H01-628604X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 224 | Trichoderma harzianum | GBSG0000214602 | PYTHUL | DR1796A02-628465X | 100 | | | |
| | | | PYTHUL | DR1797A02-628605X | 100 | | | |
| | | | PYTHUL | DR1797A02-628606X | 100 | | | |
| 225 | Trichoderma harzianum | GBSG0000214603 | PYTHUL | DR1796B02-628466X | 100 | | | |
| | | | PYTHUL | DR1796B02-628467X | 100 | | | |
| | | | PYTHUL | DR1797B02-628607X | 100 | | | |
| 226 | Trichoderma harzianum | GBSG0000214604 | PYTHUL | DR1796C02-628468X | 100 | | | |
| | | | PYTHUL | DR1796C02-628469X | 100 | | | |
| | | | PYTHUL | DR1797C02-628609X | 100 | | | |
| | | | PYTHUL | DR1797C02-628610X | 100 | | | |
| 227 | Trichoderma harzianum | GBSG0000214606 | PYTHUL | DR1796E02-628472X | 100 | | | |
| | | | PYTHUL | DR1796E02-628473X | 25 | | | |
| | | | PYTHUL | DR1797E02-628613X | 100 | | | |
| | | | PYTHUL | DR1797E02-628614X | 100 | | | |
| 228 | Trichoderma harzianum | GBSG0000214607 | PYTHUL | DR1796G02-628477X | 100 | | | |
| | | | PYTHUL | DR1797G02-628618X | 100 | | | |
| 229 | Trichoderma harzianum | GBSG0000214608 | PYTHUL | DR1796H02-628478X | 100 | | | |
| | | | PYTHUL | DR1797H02-628619X | 100 | | | |
| | | | PYTHUL | DR1797H02-628620X | 100 | | | |
| 230 | Trichoderma harzianum | GBSG0000214609 | PYTHUL | DR1796A03-628480X | 100 | | | |
| | | | PYTHUL | DR1796A03-628481X | 100 | | | |
| | | | PYTHUL | DR1797A03-628621X | 100 | | | |
| | | | PYTHUL | DR1797A03-628622X | 100 | | | |
| 231 | Trichoderma harzianum | GBSG0000214611 | PYTHUL | DR1796B03-628483X | 100 | | | |
| | | | PYTHUL | DR1797B03-628624X | 100 | | | |
| 232 | Trichoderma harzianum | GBSG0000214612 | PYTHUL | DR1796C03-628484X | 100 | | | |
| | | | PYTHUL | DR1797C03-628626X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 233 | Trichoderma harzianum | GBSG0000214613 | PYTHUL | DR1796D03-628487X | 100 | | | |
| | | | PYTHUL | DR1797D03-628628X | 100 | | | |
| 234 | Trichoderma harzianum | GBSG0000214623 | PYTHUL | DR1796H03-628491X | 100 | | | |
| | | | PYTHUL | DR1797H03-628632X | 100 | | | |
| | | | PYTHUL | DR1797H03-628633X | 100 | | | |
| 235 | Trichoderma harzianum | GBSG0000214624 | PYTHUL | DR1796A04-628492X | 100 | | | |
| | | | PYTHUL | DR1796A04-628493X | 100 | | | |
| | | | PYTHUL | DR1797A04-628634X | 100 | | | |
| 236 | Trichoderma harzianum | GBSG0000214626 | PYTHUL | DR1797D04-628638X | 100 | | | |
| | | | PYTHUL | DR1797D04-628639X | 100 | | | |
| 237 | Trichoderma harzianum | GBSG0000214629 | PYTHUL | DR1796G04-628499X | 100 | | | |
| | | | PYTHUL | DR1797G04-628644X | 100 | | | |
| | | | PYTHUL | DR1797G04-628645X | 100 | | | |
| 238 | Trichoderma harzianum | GBSG0000214632 | PYTHUL | DR1796A05-628503X | 100 | | | |
| | | | PYTHUL | DR1797A05-628648X | 100 | | | |
| | | | PYTHUL | DR1797A05-628649X | 100 | | | |
| 239 | Trichoderma harzianum | GBSG0000214633 | PYTHUL | DR1797B05-628650X | 100 | | | |
| | | | PYTHUL | DR1797B05-628651X | 100 | | | |
| 240 | Trichoderma harzianum | GBSG0000214634 | PYTHUL | DR1796C05-628506X | 100 | | | |
| | | | PYTHUL | DR1797C05-628652X | 100 | | | |
| 241 | Trichoderma harzianum | GBSG0000214637 | PYTHUL | DR1796E05-628507X | 100 | | | |
| | | | PYTHUL | DR1797E05-628654X | 100 | | | |
| | | | PYTHUL | DR1797E05-628655X | 50 | | | |
| 242 | Trichoderma harzianum | GBSG0000214639 | PYTHUL | DR1796F05-628509X | 100 | | | |
| | | | PYTHUL | DR1797F05-628656X | 100 | | | |
| 243 | Trichoderma harzianum | GBSG0000214644 | PYTHUL | DR1796B06-628517X | 100 | | | |
| | | | PYTHUL | DR1796B06-628518X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1797B06-628664X | 100 | | | |
| | | | PYTHUL | DR1797B06-628665X | 100 | | | |
| 244 | Trichoderma harzianum | GBSG0000214656 | PYTHUL | DR1796G06-628527X | 100 | | | |
| | | | PYTHUL | DR1796G06-628528X | 100 | | | |
| | | | PYTHUL | DR1797G06-628674X | 100 | | | |
| | | | PYTHUL | DR1797G06-628675X | 100 | | | |
| 245 | Trichoderma harzianum | GBSG0000214658 | PYTHUL | DR1796H06-628530X | 100 | | | |
| | | | PYTHUL | DR1797H06-628676X | 100 | | | |
| | | | PYTHUL | DR1797H06-628677X | 100 | | | |
| 246 | Trichoderma harzianum | GBSG0000214659 | PYTHUL | DR1796A07-628531X | 100 | | | |
| | | | PYTHUL | DR1796A07-628532X | 100 | | | |
| | | | PYTHUL | DR1797A07-628678X | 100 | | | |
| | | | PYTHUL | DR1797A07-628679X | 100 | | | |
| 247 | Trichoderma harzianum | GBSG0000214666 | PYTHUL | DR1796F07-628540X | 100 | | | |
| | | | PYTHUL | DR1797F07-628688X | 100 | | | |
| | | | PYTHUL | DR1797F07-628689X | 25 | | | |
| 248 | Trichoderma harzianum | GBSG0000214667 | PYTHUL | DR1797G07-628690X | 100 | | | |
| | | | PYTHUL | DR1797G07-628691X | 100 | | | |
| 249 | Trichoderma harzianum | GBSG0000214668 | PYTHUL | DR1796H07-628542X | 100 | | | |
| | | | PYTHUL | DR1797H07-628693X | 100 | | | |
| 250 | Trichoderma harzianum | GBSG0000214672 | PYTHUL | DR1796A08-628544X | 100 | | | |
| | | | PYTHUL | DR1796A08-628545X | 100 | | | |
| 251 | Trichoderma harzianum | GBSG0000214678 | PYTHUL | DR1796C08-628546X | 100 | | | |
| | | | PYTHUL | DR1796C08-628547X | 100 | | | |
| | | | PYTHUL | DR1797C08-628698X | 100 | | | |
| | | | PYTHUL | DR1797C08-628699X | 100 | | | |
| 252 | Trichoderma harzianum | GBSG0000214680 | PYTHUL | DR1796E08-628550X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1796E08-628551X | 100 | | | |
| | | | PYTHUL | DR1797E08-628703X | 50 | | | |
| 253 | Trichoderma harzianum | GBSG0000214690 | PYTHUL | DR1797C09-628711X | 100 | | | |
| | | | PYTHUL | DR1797C09-628712X | 100 | | | |
| 254 | Trichoderma harzianum | GBSG0000214693 | PYTHUL | DR1796F09-628561X | 100 | | | |
| | | | PYTHUL | DR1796F09-628562X | 100 | | | |
| | | | PYTHUL | DR1797F09-628716X | 100 | | | |
| 255 | Trichoderma harzianum | GBSG0000214694 | PYTHUL | DR1796G09-628564X | 100 | | | |
| | | | PYTHUL | DR1797G09-628717X | 100 | | | |
| | | | PYTHUL | DR1797G09-628718X | 100 | | | |
| 256 | Trichoderma harzianum | GBSG0000214695 | PYTHUL | DR1796H09-628565X | 100 | | | |
| | | | PYTHUL | DR1796H09-628566X | 100 | | | |
| | | | PYTHUL | DR1797H09-628719X | 100 | | | |
| | | | PYTHUL | DR1797H09-628720X | 100 | | | |
| 257 | Trichoderma harzianum | GBSG0000214696 | PYTHUL | DR1796A10-628568X | 100 | | | |
| | | | PYTHUL | DR1797A10-628721X | 100 | | | |
| | | | PYTHUL | DR1797A10-628722X | 100 | | | |
| 258 | Trichoderma harzianum | GBSG0000214706 | PYTHUL | DR1797B10-628723X | 100 | | | |
| | | | PYTHUL | DR1797B10-628724X | 100 | | | |
| 259 | Trichoderma harzianum | GBSG0000214707 | PYTHUL | DR1797C10-628725X | 100 | | | |
| | | | PYTHUL | DR1797C10-628726X | 100 | | | |
| 260 | Trichoderma harzianum | GBSG0000214708 | PYTHUL | DR1796D10-628572X | 100 | | | |
| | | | PYTHUL | DR1796D10-628573X | 100 | | | |
| | | | PYTHUL | DR1797D10-628728X | 100 | | | |
| 261 | Trichoderma harzianum | GBSG0000214710 | PYTHUL | DR1796E10-628574X | 100 | | | |
| | | | PYTHUL | DR1796E10-628575X | 100 | | | |
| | | | PYTHUL | DR1797E10-628729X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | PYTHUL | DR1797E10-628730X | 100 | | | |
| 262 | Trichoderma harzianumGBSG0000214711 | | PYTHUL | DR1796F10-628576X | 100 | | | |
| | | | PYTHUL | DR1796F10-628577X | 100 | | | |
| | | | PYTHUL | DR1797F10-628731X | 100 | | | |
| | | | PYTHUL | DR1797F10-628732X | 100 | | | |
| 263 | Trichoderma harzianumGBSG0000214715 | | PYTHUL | DR1796A12-628580X | 100 | | | |
| | | | PYTHUL | DR1797A12-628737X | 100 | | | |
| | | | PYTHUL | DR1797A12-628738X | 100 | | | |
| 264 | Trichoderma harzianumGBSG0000214717 | | PYTHUL | DR1797C12-628739X | 100 | | | |
| 265 | Trichoderma harzianumGBSG0000214719 | | PYTHUL | DR1797F12-628744X | 100 | | | |
| | | | PYTHUL | DR1797F12-628745X | 100 | | | |
| 266 | Trichoderma harzianumGBSG0000214724 | | PYTHUL | DR1796H12-628588X | 100 | | | |
| | | | PYTHUL | DR1796H12-628589X | 100 | | | |
| | | | PYTHUL | DR1797H12-628749X | 100 | | | |
| 267 | Trichoderma harzianumGBSG0000214727 | | PYRIOR | DR1926B04-630985X | 25 | | | |
| | | | PYRIOR | DR1926B04-631070X | 50 | | | |
| 268 | Trichoderma harzianumGBSG0000214756 | | PYRIOR | DR1926A06-630996X | 50 | | | |
| 269 | Trichoderma harzianumGBSG0000214841 | | PYTHUL | DR1946E01-632885X | 75 | | | |
| | | | PYTHUL | DR1947E01-633073X | 100 | | | |
| 270 | Trichoderma harzianumGBSG0000215114 | | LEPTMA | DR2006D08-639279X | 25 | | | |
| | | | LEPTMA | DR2006D08-639193X | 25 | | | |
| 271 | Trichoderma harzianumGBSG0000215167 | | COCHHE | DR2027B02-642247X | 25 | | | |
| | | | COCHHE | DR2027B02-642167X | 25 | | | |
| 272 | Trichoderma harzianumGBSG0000215174 | | COCHHE | DR2027D02-642249X | 25 | | | |
| | | | COCHHE | DR2027D02-642168X | 25 | | | |
| 273 | Trichoderma harzianumGBSG0000215181 | | COCHHE | DR2027G02-642251X | 25 | | | |
| | | | COCHHE | DR2027G02-642170X | 25 | | | |

Figure 6 continued

| SEQ ID NO | GENE LIBRARY | SEQ ID | TEST NAME* | ALIQUOT ID | VISUAL % INHIBITION | CALC. % INHIBITION AVG. OD 595 | NULL SAMP. OD 595 |
|---|---|---|---|---|---|---|---|
| 274 | Trichoderma harzianum | GBSG0000215183 | COCHHE | DR2027H02-642253X | 25 | | |
| | | | COCHHE | DR2027H02-642171X | 25 | | |
| 275 | Trichoderma harzianum | GBSG0000215185 | COCHHE | DR2027B03-642255X | 25 | | |
| | | | COCHHE | DR2027B03-642173X | 25 | | |
| 276 | Trichoderma harzianum | GBSG0000215213 | C-SCLESC | DR2027E04-642183X | 25 | | |
| | | | C-SCLESC | DR2128E04-675523X | 50 | | |
| 277 | Trichoderma harzianum | GBSG0000215221 | COCHHE | DR2027B05-642270X | 25 | | |
| | | | COCHHE | DR2128B05-675527X | 50 | | |
| 278 | Trichoderma harzianum | GBSG0000215255 | GIBBZE | DR2027G07-642286X | 25 | | |
| | | | GIBBZE | DR2128G07-675544X | 25 | | |
| 279 | Trichoderma harzianum | GBSG0000215267 | COCHHE | DR2027E08-642208X | 25 | | |
| | | | COCHHE | DR2128E08-675550X | 50 | | |
| 280 | Trichoderma harzianum | GBSG0000215280 | COCHHE | DR2027G09-642215X | 25 | | |
| 281 | Trichoderma harzianum | GBSG0000215290 | COCHHE | DR2027E10-642307X | 50 | | |
| | | | COCHHE | DR2027E10-642219X | 25 | | |
| 282 | Trichoderma harzianum | GBSG0000215308 | COCHHE | DR2027C12-642233X | 25 | | |
| | | | COCHHE | DR2128C12-675568X | 50 | | |
| 283 | Trichoderma harzianum | GBSG0000215316 | GIBBZE | DR2029B01-642956X | 25 | | |
| | | | GIBBZE | DR2029B01-642701X | 25 | | |
| 284 | Trichoderma harzianum | GBSG0000215338 | GIBBZE | DR2029E02-642966X | 25 | | |
| | | | GIBBZE | DR2029E02-642708X | 100 | | |
| | | | PYTHUL | DR2028E02-642920X | 100 | | |
| | | | PYTHUL | DR2029E02-642708X | 100 | | |
| 285 | Trichoderma harzianum | GBSG0000215343 | GIBBZE | DR2028B03-642828X | 25 | | |
| | | | GIBBZE | DR2028B03-642896X | 25 | | |
| 286 | Trichoderma harzianum | GBSG0000215352 | GIBBZE | DR2028E03-642831X | 25 | | |
| | | | GIBBZE | DR2028E03-642921X | 100 | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | GIBBZE | DR2029E03-642970X | 100 | | | |
| 287 | Trichoderma harzianum | GBSG0000215372 | PYRIOR | DR2028C05-642840X | 25 | | | |
| | | | PYRIOR | DR2029C05-642717X | 100 | | | |
| | | | PYTHUL | DR2028C05-642904X | 100 | | | |
| | | | PYTHUL | DR2029C05-642717X | 100 | | | |
| 288 | Trichoderma harzianum | GBSG0000215373 | PYTHUL | DR2028D05-642841X | 100 | | | |
| | | | PYTHUL | DR2028D05-642914X | 100 | | | |
| 289 | Trichoderma harzianum | GBSG0000215379 | GIBBZE | DR2028E05-642923X | 25 | | | |
| | | | GIBBZE | DR2029E05-642981X | 25 | | | |
| | | | PYTHUL | DR2028E05-642719X | 100 | | | |
| | | | PYTHUL | DR2028E05-642842X | 25 | | | |
| 290 | Trichoderma harzianum | GBSG0000215382 | PYTHUL | DR2029G05-642982X | 100 | | | |
| | | | PYTHUL | DR2029G05-642720X | 100 | | | |
| 291 | Trichoderma harzianum | GBSG0000215383 | PYTHUL | DR2029A06-642984X | 100 | | | |
| | | | PYTHUL | DR2029A06-642722X | 100 | | | |
| 292 | Trichoderma harzianum | GBSG0000215409 | GIBBZE | DR2028H06-642852X | 25 | | | |
| | | | GIBBZE | DR2029H06-642725X | 25 | | | |
| 293 | Trichoderma harzianum | GBSG0000215410 | GIBBZE | DR2029A07-642991X | 25 | | | |
| | | | GIBBZE | DR2029A07-642726X | 25 | | | |
| 294 | Trichoderma harzianum | GBSG0000215420 | C-SCLESC | DR2028D07-642854X | 50 | | | |
| | | | C-SCLESC | DR2028D07-642915X | 25 | | | |
| 295 | Trichoderma harzianum | GBSG0000215429 | GIBBZE | DR2028H07-642949X | 25 | | | |
| | | | GIBBZE | DR2029H07-642996X | 100 | | | |
| 296 | Trichoderma harzianum | GBSG0000215431 | GIBBZE | DR2028A08-642858X | 25 | | | |
| | | | GIBBZE | DR2029A08-642997X | 100 | | | |
| 297 | Trichoderma harzianum | GBSG0000215432 | GIBBZE | DR2028B08-642859X | 25 | | | |
| | | | GIBBZE | DR2029B08-642998X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 298 | Trichoderma harzianum | GBSG0000215461 | GIBBZE | DR2028A09-642864X | 25 | | | |
| | | | GIBBZE | DR2028A09-642893X | 25 | | | |
| 299 | Trichoderma harzianum | GBSG0000215482 | GIBBZE | DR2028E10-642927X | 25 | | | |
| | | | GIBBZE | DR2029E10-643007X | 25 | | | |
| 300 | Trichoderma harzianum | GBSG0000215516 | GIBBZE | DR2046H10-649109X | 25 | | | |
| | | | GIBBZE | DR2047H10-649263X | 5 | | | |
| 301 | Trichoderma harzianum | GBSG0000215523 | GIBBZE | DR2046C12-649110X | 100 | | | |
| | | | GIBBZE | DR2047C12-649264X | 25 | | | |
| 302 | Trichoderma harzianum | GBSG0000215549 | GIBBZE | DR2048B02-649276X | 50 | | | |
| | | | GIBBZE | DR2049B02-649431X | 75 | | | |
| 303 | Trichoderma harzianum | GBSG0000215550 | COCHHE | DR2048C02-649277X | 25 | | | |
| | | | COCHHE | DR2049C02-650289X | 25 | | | |
| 304 | Trichoderma harzianum | GBSG0000215552 | COCHHE | DR2048E02-649278X | 25 | | | |
| | | | COCHHE | DR2049E02-649434X | 25 | | | |
| | | | COCHHE | DR2049E02-650290X | 25 | | | |
| | | | GIBBZE | DR2048E02-649278X | 100 | | | |
| | | | GIBBZE | DR2049E02-649368X | 100 | | | |
| | | | GIBBZE | DR2049E02-650290X | 50 | | | |
| 305 | Trichoderma harzianum | GBSG0000215553 | COCHHE | DR2049G02-649436X | 25 | | | |
| | | | COCHHE | DR2049G02-650292X | 25 | | | |
| 306 | Trichoderma harzianum | GBSG0000215579 | COCHHE | DR2048D04-649291X | 25 | | | |
| | | | COCHHE | DR2049D04-650302X | 25 | | | |
| | | | C-SCLESC | DR2049D04-649446X | 50 | | | |
| | | | C-SCLESC | DR2049D04-650302X | 50 | | | |
| 307 | Trichoderma harzianum | GBSG0000215586 | COCHHE | DR2048G04-649292X | 25 | | | |
| | | | COCHHE | DR2049G04-649448X | 25 | | | |
| | | | COCHHE | DR2049G04-650303X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | C-SCLESC | DR2049G04-649448X | 50 | | | |
| | | | C-SCLESC | DR2049G04-650303X | 50 | | | |
| 308 | Trichoderma harzianum | GBSG0000215593 | GIBBZE | DR2048H04-649380X | 75 | | | |
| | | | GIBBZE | DR2049H04-649449X | 100 | | | |
| 309 | Trichoderma harzianum | GBSG0000215595 | GIBBZE | DR2048A05-649294X | 100 | | | |
| | | | GIBBZE | DR2049A05-649450X | 100 | | | |
| 310 | Trichoderma harzianum | GBSG0000215606 | GIBBZE | DR2049E05-649453X | 100 | | | |
| | | | GIBBZE | DR2049E05-650306X | 100 | | | |
| | | | LEPTMA | DR2048E05-649298X | 25 | | | |
| | | | LEPTMA | DR2049E05-650306X | 25 | | | |
| 311 | Trichoderma harzianum | GBSG0000215611 | LEPTMA | DR2048B06-649303X | 25 | | | |
| | | | LEPTMA | DR2049B06-650311X | 100 | | | |
| 312 | Trichoderma harzianum | GBSG0000215615 | LEPTMA | DR2048C06-649304X | 25 | | | |
| | | | LEPTMA | DR2049C06-649459X | 25 | | | |
| 313 | Trichoderma harzianum | GBSG0000215630 | COCHHE | DR2048G06-649394X | 25 | | | |
| | | | COCHHE | DR2049G06-650314X | 25 | | | |
| 314 | Trichoderma harzianum | GBSG0000215637 | GIBBZE | DR2048B07-649310X | 100 | | | |
| | | | GIBBZE | DR2049B07-649466X | 25 | | | |
| 315 | Trichoderma harzianum | GBSG0000215638 | COCHHE | DR2048C07-649311X | 25 | | | |
| | | | COCHHE | DR2049C07-650317X | 25 | | | |
| 316 | Trichoderma harzianum | GBSG0000215639 | LEPTMA | DR2048D07-649312X | 25 | | | |
| | | | LEPTMA | DR2049D07-650318X | 25 | | | |
| 317 | Trichoderma harzianum | GBSG0000215661 | C-SCLESC | DR2048H08-649323X | 50 | | | |
| | | | C-SCLESC | DR2048H08-649407X | 25 | | | |
| 318 | Trichoderma harzianum | GBSG0000215669 | LEPTMA | DR2048E09-649412X | 25 | | | |
| | | | LEPTMA | DR2049E09-649482X | 25 | | | |
| 319 | Trichoderma harzianum | GBSG0000215670 | C-SCLESC | DR2048F09-649328X | 50 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 320 | Trichoderma harzianum | GBSG0000215672 | C-SCLESC COCHHE | DR2049F09-649483X DR2048G09-649329X | 25 25 | | | |
| 321 | Trichoderma harzianum | GBSG0000215678 | COCHHE C-SCLESC | DR2049G09-649484X DR2048D10-649416X | 25 50 | | | |
| 322 | Trichoderma harzianum | GBSG0000215685 | C-SCLESC COCHHE | DR2049D10-650336X DR2049B12-649492X | 50 25 | | | |
| 323 | Trichoderma harzianum | GBSG0000215722 | COCHHE PYRIOR | DR2049B12-650341X DR2066D02-650571X | 25 25 | | | |
| 324 | Trichoderma harzianum | GBSG0000215747 | PYRIOR PYRIOR | DR2067D02-655349X DR2067D04-655364X | 25 25 | | | |
| 325 | Trichoderma harzianum | GBSG0000215771 | PYRIOR COCHHE | DR2067D04-655441X DR2066G05-655296X | 25 25 | | | |
| 326 | Trichoderma harzianum | GBSG0000215783 | COCHHE C-SCLESC | DR2066G05-655449X DR2066E06-650601X | 25 25 | | | |
| 327 | Trichoderma harzianum | GBSG0000215882 | C-SCLESC PYRIOR | DR2066E06-655302X DR2068C02-649570X | 25 25 | | | |
| 328 | Trichoderma harzianum | GBSG0000215884 | PYRIOR GIBBZE | DR2068C02-649653X DR2068D02-649571X | 25 25 | | | |
| | | | GIBBZE GIBBZE GIBBZE | DR2068D02-649654X DR2069D02-649730X DR2069D02-649810X | 25 25 25 | | | |
| 329 | Trichoderma harzianum | GBSG0000215907 | GIBBZE GIBBZE GIBBZE | DR2068F03-649581X DR2068F03-649663X DR2069F03-649819X | 25 25 25 | | | |
| 330 | Trichoderma harzianum | GBSG0000215915 | GIBBZE GIBBZE GIBBZE | DR2068H03-649583X DR2068H03-649664X DR2069H03-649739X | 25 25 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 331 | Trichoderma harzianum | GBSG0000215917 | GIBBZE | DR2068B04-649666X | 25 | | | |
| | | | GIBBZE | DR2069B04-649822X | 25 | | | |
| | | | PYRIOR | DR2068B04-649585X | 25 | | | |
| | | | PYRIOR | DR2068B04-649666X | 25 | | | |
| | | | PYRIOR | DR2069B04-649822X | 25 | | | |
| 332 | Trichoderma harzianum | GBSG0000215918 | GIBBZE | DR2068D04-649668X | 25 | | | |
| | | | GIBBZE | DR2069D04-649743X | 25 | | | |
| | | | PYRIOR | DR2068D04-649668X | 25 | | | |
| | | | PYRIOR | DR2069D04-649743X | 25 | | | |
| 333 | Trichoderma harzianum | GBSG0000215926 | COCHHE | DR2068G04-649670X | 50 | | | |
| | | | COCHHE | DR2069G04-649746X | 50 | | | |
| | | | GIBBZE | DR2068G04-649746X | 25 | | | |
| | | | GIBBZE | DR2069G04-649824X | 25 | | | |
| 334 | Trichoderma harzianum | GBSG0000215930 | PYRIOR | DR2068A05-649672X | 25 | | | |
| | | | PYRIOR | DR2069A05-649826X | 25 | | | |
| 335 | Trichoderma harzianum | GBSG0000215937 | GIBBZE | DR2068G05-649678X | 25 | | | |
| | | | GIBBZE | DR2069G05-649754X | 25 | | | |
| | | | PYRIOR | DR2068G05-649678X | 25 | | | |
| | | | PYRIOR | DR2069G05-649831X | 25 | | | |
| 336 | Trichoderma harzianum | GBSG0000215940 | COCHHE | DR2068B06-649600X | 50 | | | |
| | | | COCHHE | DR2068B06-649680X | 25 | | | |
| | | | COCHHE | DR2069B06-649834X | 25 | | | |
| | | | GIBBZE | DR2068B06-649680X | 25 | | | |
| | | | GIBBZE | DR2069B06-649834X | 25 | | | |
| 337 | Trichoderma harzianum | GBSG0000215955 | PYRIOR | DR2068A07-649607X | 25 | | | |
| | | | PYRIOR | DR2068A07-649687X | 25 | | | |
| | | | PYRIOR | DR2069A07-649764X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 338 | Trichoderma harzianum | GBSG0000215957 | COCHHE | DR2068B07-649688X | 50 | | | |
|  |  |  | COCHHE | DR2069B07-649842X | 25 | | | |
| 339 | Trichoderma harzianum | GBSG0000215962 | COCHHE | DR2069D07-649767X | 50 | | | |
|  |  |  | COCHHE | DR2069D07-649844X | 25 | | | |
| 340 | Trichoderma harzianum | GBSG0000215968 | GIBBZE | DR2068G07-649692X | 25 | | | |
|  |  |  | GIBBZE | DR2069G07-649846X | 25 | | | |
| 341 | Trichoderma harzianum | GBSG0000215973 | GIBBZE | DR2069A08-649848X | 25 | | | |
| 342 | Trichoderma harzianum | GBSG0000215986 | GIBBZE | DR2068D09-649622X | 25 | | | |
|  |  |  | GIBBZE | DR2068D09-649702X | 25 | | | |
|  |  |  | GIBBZE | DR2069D09-649780X | 25 | | | |
| 343 | Trichoderma harzianum | GBSG0000216008 | GIBBZE | DR2069D10-649787X | 25 | | | |
|  |  |  | GIBBZE | DR2069D10-649862X | 25 | | | |
| 344 | Trichoderma harzianum | GBSG0000216012 | GIBBZE | DR2069A12-649792X | 25 | | | |
|  |  |  | GIBBZE | DR2069A12-649867X | 25 | | | |
|  |  |  | PYRIOR | DR2068A12-649635X | 25 | | | |
|  |  |  | PYRIOR | DR2069A12-649792X | 25 | | | |
| 345 | Trichoderma harzianum | GBSG0000216030 | PYTHUL | DR2047D01-649117X | 50 | | | |
|  |  |  | PYTHUL | DR2047D01-649200X | 100 | | | |
| 346 | Trichoderma harzianum | GBSG0000216036 | PYTHUL | DR2046E01-649045X | 50 | | | |
|  |  |  | PYTHUL | DR2047E01-649118X | 50 | | | |
| 347 | Trichoderma harzianum | GBSG0000216037 | GIBBZE | DR2047F01-649119X | 50 | | | |
|  |  |  | GIBBZE | DR2047F01-649202X | 50 | | | |
| 348 | Trichoderma harzianum | GBSG0000216039 | PYTHUL | DR2046G01-649047X | 50 | | | |
|  |  |  | PYTHUL | DR2047G01-649120X | 50 | | | |
| 349 | Trichoderma harzianum | GBSG0000216046 | PYTHUL | DR2046D02-643032X | 100 | | | |
|  |  |  | PYTHUL | DR2047D02-649125X | 50 | | | |
| 350 | Trichoderma harzianum | GBSG0000216047 | GIBBZE | DR2047E02-649126X | 50 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 351 | Trichoderma harzianum | GBSG0000216059 | GIBBZE<br>COCHHE<br>COCHHE | DR2047E02-649209X<br>DR2046H03-643043X<br>DR2046H03-649063X | 50<br>50<br>25 | | | |
| 352 | Trichoderma harzianum | GBSG0000216061 | PYRIOR<br>PYRIOR | DR2046A04-649064X<br>DR2047A04-649137X | 25<br>25 | | | |
| 353 | Trichoderma harzianum | GBSG0000216062 | PYTHUL<br>PYTHUL | DR2046B04-649065X<br>DR2047B04-649138X | 100<br>50 | | | |
| 354 | Trichoderma harzianum | GBSG0000216067 | GIBBZE<br>GIBBZE | DR2046E04-643048X<br>DR2047E04-649141X | 50<br>50 | | | |
| 355 | Trichoderma harzianum | GBSG0000216071 | PYTHUL<br>PYTHUL | DR2046H04-649070X<br>DR2047H04-649224X | 50<br>100 | | | |
| 356 | Trichoderma harzianum | GBSG0000216076 | GIBBZE<br>GIBBZE<br>GIBBZE | DR2046E05-649073X<br>DR2047E05-649148X<br>DR2047E05-649229X | 25<br>50<br>25 | | | |
| 357 | Trichoderma harzianum | GBSG0000216093 | GIBBZE<br>GIBBZE<br>GIBBZE | DR2046A07-643067X<br>DR2046A07-649083X<br>DR2047A07-649160X | 25<br>50<br>25 | | | |
| 358 | Trichoderma harzianum | GBSG0000216113 | GIBBZE<br>GIBBZE<br>GIBBZE | DR2046E08-643078X<br>DR2046E08-649171X<br>DR2047E08-649249X | 50<br>25<br>50 | | | |
| 359 | Trichoderma harzianum | GBSG0000216130 | GIBBZE<br>GIBBZE | DR2046A10-643090X<br>DR2046A10-649103X | 100<br>100 | | | |
| 360 | Trichoderma harzianum | GBSG0000216131 | GIBBZE<br>GIBBZE | DR2047B10-649182X<br>DR2047B10-649258X | 25<br>50 | | | |
| 361 | Trichoderma harzianum | GBSG0000216157 | C-SCLESC<br>C-SCLESC | DR2113A03-662953X<br>DR2113A03-663382X | 25<br>25 | | | |
| 362 | Trichoderma harzianum | GBSG0000216187 | GIBBZE | DR2112G04-662822X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | GIBBZE | DR2113G04-663396X | 25 | | | |
| 363 | Trichoderma harzianum | GBSG0000216189 | GIBBZE | DR2112A05-662823X | 25 | | | |
| | | | GIBBZE | DR2113A05-663397X | 25 | | | |
| 364 | Trichoderma harzianum | GBSG0000216191 | C-SCLESC | DR2112B05-662824X | 25 | | | |
| | | | C-SCLESC | DR2113B05-662969X | 25 | | | |
| 365 | Trichoderma harzianum | GBSG0000216193 | C-SCLESC | DR2112D05-662897X | 25 | | | |
| | | | C-SCLESC | DR2113D05-662970X | 25 | | | |
| 366 | Trichoderma harzianum | GBSG0000216228 | GIBBZE | DR2112B08-662846X | 25 | | | |
| | | | GIBBZE | DR2113B08-662991X | 50 | | | |
| 367 | Trichoderma harzianum | GBSG0000216237 | LEPTMA | DR2113H08-662996X | 25 | | | |
| | | | LEPTMA | DR2113H08-663424X | 25 | | | |
| 368 | Trichoderma harzianum | GBSG0000216251 | C-SCLESC | DR2112C10-662926X | 25 | | | |
| | | | C-SCLESC | DR2113C10-663005X | 25 | | | |
| | | | C-SCLESC | DR2113C10-663431X | 25 | | | |
| 369 | Trichoderma harzianum | GBSG0000216259 | COCHHE | DR2112B12-662864X | 25 | | | |
| | | | COCHHE | DR2113B12-663437X | 25 | | | |
| 370 | Trichoderma harzianum | GBSG0000216262 | COCHHE | DR2112F12-662935X | 25 | | | |
| | | | COCHHE | DR2113F12-663014X | 50 | | | |
| 371 | Trichoderma harzianum | GBSG0000216268 | C-SCLESC | DR2112H12-662937X | 25 | | | |
| | | | C-SCLESC | DR2113H12-663442X | 25 | | | |
| 372 | Trichoderma harzianum | GBSG0000216270 | COCHHE | DR2086B01-650055X | 25 | | | |
| | | | COCHHE | DR2087B01-650201X | 25 | | | |
| 373 | Trichoderma harzianum | GBSG0000216277 | C-SCLESC | DR2087G01-650133X | 25 | | | |
| | | | C-SCLESC | DR2087G01-650205X | 25 | | | |
| 374 | Trichoderma harzianum | GBSG0000216305 | COCHHE | DR2086F03-649997X | 25 | | | |
| | | | COCHHE | DR2087F03-650147X | 25 | | | |
| 375 | Trichoderma harzianum | GBSG0000216319 | LEPTMA | DR2086G04-650083X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| | | | LEPTMA | DR2087G04-650154X | 25 | | | |
| | | | LEPTMA | DR2087G04-650223X | 50 | | | |
| 376 | Trichoderma harzianum | GBSG0000216320 | PYRIOR | DR2086H04-650006X | 50 | | | |
| | | | PYRIOR | DR2087H04-650202X | 50 | | | |
| 377 | Trichoderma harzianum | GBSG0000216329 | COCHHE | DR2086G05-650009X | 25 | | | |
| | | | COCHHE | DR2087G05-650157X | 25 | | | |
| | | | COCHHE | DR2087G05-650224X | 25 | | | |
| 378 | Trichoderma harzianum | GBSG0000216338 | COCHHE | DR2086E06-650015X | 25 | | | |
| | | | COCHHE | DR2086E06-650091X | 50 | | | |
| 379 | Trichoderma harzianum | GBSG0000216345 | COCHHE | DR2086A07-650018X | 25 | | | |
| | | | COCHHE | DR2086A07-650094X | 25 | | | |
| 380 | Trichoderma harzianum | GBSG0000216351 | C-SCLESC | DR2086H07-650024X | 50 | | | |
| | | | C-SCLESC | DR2087H07-650170X | 25 | | | |
| | | | C-SCLESC | DR2087H07-650236X | 25 | | | |
| 381 | Trichoderma harzianum | GBSG0000216354 | C-SCLESC | DR2086C08-650102X | 50 | | | |
| | | | C-SCLESC | DR2087C08-650239X | 25 | | | |
| 382 | Trichoderma harzianum | GBSG0000216355 | C-SCLESC | DR2086D08-650103X | 25 | | | |
| | | | C-SCLESC | DR2087D08-650174X | 50 | | | |
| 383 | Trichoderma harzianum | GBSG0000216377 | COCHHE | DR2086D10-650041X | 25 | | | |
| | | | COCHHE | DR2086D10-650115X | 25 | | | |
| 384 | Trichoderma harzianum | GBSG0000216408 | COCHHE | DR2088E01-650511X | 25 | | | |
| | | | COCHHE | DR2089E01-650414X | 50 | | | |
| 385 | Trichoderma harzianum | GBSG0000216461 | C-SCLESC | DR2088G04-650483X | 50 | | | |
| | | | C-SCLESC | DR2089G04-650433X | 25 | | | |
| 386 | Trichoderma harzianum | GBSG0000216463 | COCHHE | DR2088H04-650535X | 50 | | | |
| | | | COCHHE | DR2089H04-650389X | 50 | | | |
| 387 | Trichoderma harzianum | GBSG0000216464 | C-SCLESC | DR2088A05-650485X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. NULL SAMP. OD 595 | OD 595 |
|---|---|---|---|---|---|---|---|---|
| | | | C-SCLESC | DR2089A05-650390X | 25 | | | |
| 388 | Trichoderma harzianum | GBSG0000216471 | LEPTMA | DR2088E05-650489X | 25 | | | |
| | | | LEPTMA | DR2088E05-650540X | 25 | | | |
| 389 | Trichoderma harzianum | GBSG0000216477 | CERCZM | DR2089B06-650397X | 25 | | | |
| | | | CERCZM | DR2089B06-650442X | 25 | | | |
| 390 | Trichoderma harzianum | GBSG0000216483 | COCHHE | DR2088F06-650546X | 25 | | | |
| | | | COCHHE | DR2089F06-650444X | 50 | | | |
| 391 | Trichoderma harzianum | GBSG0000219049 | PYTHUL | DR1967F01-633170X | 100 | | | |
| | | | PYTHUL | DR1967F01-633230X | 100 | | | |
| 392 | Trichoderma harzianum | GBSG0000219053 | PYTHUL | DR1966G01-632829X | 100 | | | |
| | | | PYTHUL | DR1967G01-633171X | 100 | | | |
| 393 | Trichoderma harzianum | GBSG0000219080 | PYTHUL | DR1967H02-633176X | 75 | | | |
| | | | PYTHUL | DR1967H02-633236X | 50 | | | |
| 394 | Trichoderma harzianum | GBSG0000219090 | PYTHUL | DR1966C03-632776X | 50 | | | |
| | | | PYTHUL | DR1967C03-633178X | 75 | | | |
| 395 | Trichoderma harzianum | GBSG0000219159 | PYTHUL | DR1967H04-633188X | 100 | | | |
| | | | PYTHUL | DR1967H04-633245X | 100 | | | |
| 396 | Trichoderma harzianum | GBSG0000219178 | C-SCLESC | DR1966C05-632791X | 25 | | | |
| | | | C-SCLESC | DR1967C05-633191X | 25 | | | |
| 397 | Trichoderma harzianum | GBSG0000219215 | PYTHUL | DR1966C06-632795X | 75 | | | |
| | | | PYTHUL | DR1967C06-633252X | 100 | | | |
| 398 | Trichoderma harzianum | GBSG0000219216 | PYTHUL | DR1966D06-632796X | 100 | | | |
| | | | PYTHUL | DR1967D06-633197X | 50 | | | |
| 399 | Trichoderma harzianum | GBSG0000219218 | LEPTMA | DR1966E06-632797X | 25 | | | |
| | | | LEPTMA | DR1967E06-633253X | 75 | | | |
| 400 | Trichoderma harzianum | GBSG0000219224 | PYTHUL | DR1967H06-633200X | 75 | | | |
| | | | PYTHUL | DR1967H06-633254X | 100 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 401 | Trichoderma harzianum | GBSG0000219226 | LEPTMA | DR1966A07-632859X | 25 | | | |
| | | | LEPTMA | DR1967A07-633201X | 25 | | | |
| | | | PYTHUL | DR1966A07-632859X | 100 | | | |
| | | | PYTHUL | DR1967A07-633201X | 100 | | | |
| 8 | Assorted Reg. Factors | GBSG0000104874 | PYRIOR | DR1446D04-586476X | 50 | | | |
| | | | PYRIOR | DR1452D04-586112X | 50 | | | |
| 16 | Assorted Reg. Factors | GBSG0000113718 | PYRIOR | DR1453D03-586198X | 25 | | | |
| | | | PYRIOR | DR1453D03-586199X | 50 | | | |
| 17 | Assorted Reg. Factors | GBSG0000114987 | CERCZM | DR1447E05-586344X | 50 | | | |
| | | | CERCZM | DR1447E05-586345X | 50 | | | |
| 18 | Assorted Reg. Factors | GBSG0000115121 | CERCZM | DR1447G05-586346X | 50 | | | |
| | | | CERCZM | DR1447G05-586347X | 50 | | | |
| 19 | Assorted Reg. Factors | GBSG0000116525 | CERCZM | DR1448B01-592483X | 25 | | | |
| | | | CERCZM | DR1448B01-592484X | 25 | | | |
| 21 | Assorted Reg. Factors | GBSG0000120445 | RHIZSO | DR1447F06-586360X | 50 | | | |
| | | | RHIZSO | DR1447F06-586361X | 50 | | | |
| 23 | Assorted Reg. Factors | GBSG0000120979 | GIBBFU | DR1448H02-592510X | 25 | | | |
| | | | GIBBFU | DR1448H02-592511X | 25 | | | |
| 24; 25 | Assorted Reg. Factors | GBSG0000122157 | GIBBFU | DR1448A04-592524X | 25 | | | |
| | | | GIBBFU | DR1448A04-592525X | 25 | | | |
| 27 | Assorted Reg. Factors | GBSG0000127573 | CERCZM | DR1447D09-586403X | 50 | | | |
| | | | CERCZM | DR1453D09-586266X | 50 | | | |
| 28 | Assorted Reg. Factors | GBSG0000130439 | PYRIOR | DR1526A06-595828X | 25 | | | |
| | | | PYRIOR | DR1526A06-595829X | 25 | | | |
| 29 | Assorted Reg. Factors | GBSG0000130630 | PYRIOR | DR1526C07-595846X | 50 | | | |
| | | | PYRIOR | DR1526C07-595847X | 50 | | | |
| 31 | Assorted Reg. Factors | GBSG0000131003 | PYRIOR | DR1526E10-595894X | 50 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 32 | Assorted Reg. Factors | GBSG0000131272 | PYRIOR | DR1526E10-595895X | 50 | | | |
| 33 | Assorted Reg. Factors | GBSG0000135281 | PYTHUL | DR1527G12-596051X | 50 | | | |
|  |  |  | PYTHUL | DR1527G12-596052X | 50 | | | |
| 34 | Assorted Reg. Factors | GBSG0000135357 | PYRIOR | DR1448F08-592581X | 25 | | | |
|  |  |  | PYRIOR | DR1448F08-592582X | 25 | | | |
| 36 | Assorted Reg. Factors | GBSG0000137131 | PYRIOR | DR1448H08-592585X | 25 | | | |
|  |  |  | PYRIOR | DR1448H08-592586X | 25 | | | |
| 39 | Assorted Reg. Factors | GBSG0000168371 | PYRIOR | DR1449G12-592639X | 25 | | | |
|  |  |  | PYRIOR | DR1449G12-592640X | 25 | | | |
| 40 | Assorted Reg. Factors | GBSG0000171278 | LEPTMA | DR1506F08-597617X | 75 | | | |
|  |  |  | LEPTMA | DR1506F08-597619X | 25 | | | |
|  |  |  | LEPTMA | DR1450C05-597331X | 50 | | | |
|  |  |  | LEPTMA | DR1450C05-597333X | 25 | | | |
|  |  |  | LEPTMA | DR1451C05-597328X | 50 | | | |
|  |  |  | PYRIOR | DR1450C05-597333X | 25 | | | |
|  |  |  | PYRIOR | DR1451C05-597328X | 75 | | | |
| 41 | Assorted Reg. Factors | GBSG0000174874 | PYRIOR | DR1451F01-597292X | 25 | | | |
|  |  |  | PYRIOR | DR1451F01-597294X | 25 | | | |
| 42 | Assorted Reg. Factors | GBSG0000175126 | LEPTMA | DR1451B02-597306X | 50 | | | |
|  |  |  | LEPTMA | DR1451B02-597308X | 75 | | | |
| 44 | Assorted Reg. Factors | GBSG0000175378 | PYTHUL | DR1451A07-597377X | 25 | | | |
|  |  |  | PYTHUL | DR1451A07-597379X | 50 | | | |
| 45 | Assorted Reg. Factors | GBSG0000175535 | CERC2M | DR1451D08-597410X | 25 | | | |
|  |  |  | CERC2M | DR1451D08-597412X | 25 | | | |
|  |  |  | PYRIOR | DR1450D08-597382X | 50 | | | |
|  |  |  | PYRIOR | DR1450D08-597384X | 50 | | | |
| 46 | Assorted Reg. Factors | GBSG0000175706 | COCHHE | DR1451D07-597389X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 47 | Assorted Reg. Factors | GBSG0000175904 | COCHHE | DR1451D07-597391X | 25 | | | |
| | | | LEPTMA | DR1450C06-597348X | 50 | | | |
| | | | LEPTMA | DR1451C06-597357X | 50 | | | |
| 48 | Assorted Reg. Factors | GBSG0000176385 | CERCZM | DR1450G05-597339X | 50 | | | |
| | | | CERCZM | DR1451G05-597340X | 50 | | | |
| 49 | Assorted Reg. Factors | GBSG0000180809 | PYRIOR | DR1528A10-597088X | 25 | | | |
| | | | PYRIOR | DR1528A10-597089X | 25 | | | |
| 50 | Assorted Reg. Factors | GBSG0000183214 | PYRIOR | DR1450F08-597390X | 50 | | | |
| | | | PYRIOR | DR1450F08-597392X | 50 | | | |
| 51 | Assorted Reg. Factors | GBSG0000183295 | PYRIOR | DR1451G08-597418X | 25 | | | |
| | | | PYRIOR | DR1451G08-597420X | 50 | | | |
| 52 | Assorted Reg. Factors | GBSG0000183350 | CERCZM | DR1451H08-597422X | 25 | | | |
| | | | CERCZM | DR1451H08-597424X | 25 | | | |
| | | | LEPTMA | DR1451H08-597422X | 25 | | | |
| | | | LEPTMA | DR1451H08-597424X | 50 | | | |
| 53 | Assorted Reg. Factors | GBSG0000188835 | PYTHUL | DR1450E09-597413X | 50 | | | |
| | | | PYTHUL | DR1451E09-597442X | 25 | | | |
| 54 | Assorted Reg. Factors | GBSG0000188836 | COCHHE | DR1451F09-597446X | 50 | | | |
| | | | COCHHE | DR1451F09-597448X | 25 | | | |
| | | | PYRIOR | DR1450F09-597419X | 50 | | | |
| | | | PYRIOR | DR1451F09-597446X | 25 | | | |
| | | | PYRIOR | DR1451F09-597448X | 50 | | | |
| 55; 56; 57 | Assorted Reg. Factors | GBSG0000188877 | CERCZM | DR1450B10-597433X | 50 | | | |
| | | | CERCZM | DR1451B10-597460X | 25 | | | |
| | | | CERCZM | DR1451B10-597461X | 50 | | | |
| | | | VERTDA | DR1451B10-597460X | 25 | | | |
| | | | VERTDA | DR1451B10-597461X | 25 | | | |

Figure 6 continued

| SEQ ID NO | GENE LIBRARY | SEQ ID | TEST NAME* | ALIQUOT ID | VISUAL % INHIBITION | CALC. % INHIBITION | AVG. OD 595 | NULL SAMP. OD 595 |
|---|---|---|---|---|---|---|---|---|
| 58 | Assorted Reg. Factors | GBSG0000188959 | COCHHE | DR1451H10-597484X | 50 | | | |
| | | | COCHHE | DR1451H10-597486X | 50 | | | |
| 59 | Assorted Reg. Factors | GBSG0000189013 | LEPTMA | DR1450F12-597481X | 75 | | | |
| | | | LEPTMA | DR1450F12-597483X | 75 | | | |
| 60 | Assorted Reg. Factors | GBSG0000189037 | CERCZM | DR1451G12-597501X | 25 | | | |
| | | | CERCZM | DR1451G12-597502X | 50 | | | |
| | | | LEPTMA | DR1450G12-597485X | 52 | | | |
| | | | LEPTMA | DR1450G12-597487X | 50 | | | |
| | | | PYRIOR | DR1450G12-597485X | 25 | | | |
| | | | PYRIOR | DR1450G12-597487X | 25 | | | |
| 61 | Assorted Reg. Factors | GBSG0000200614 | VERTDA | DR1468H02-598283X | 25 | | | |
| | | | VERTDA | DR1468H02-598285X | 25 | | | |
| 62 | Assorted Reg. Factors | GBSG0000200629 | VERTDA | DR1468H04-598383X | 25 | | | |
| | | | VERTDA | DR1468H04-598387X | 25 | | | |
| 63 | Assorted Reg. Factors | GBSG0000200665 | COCHHE | DR1468G09-598673X | 50 | | | |
| | | | COCHHE | DR1507G09-598687X | 50 | | | |
| | | | VERTDA | DR1468G09-598677X | 50 | | | |
| | | | VERTDA | DR1507G09-598687X | 25 | | | |
| 64 | Assorted Reg. Factors | GBSG0000200671 | VERTDA | DR1468E10-598717X | 75 | | | |
| | | | VERTDA | DR1507E10-598727X | 50 | | | |

Test Name Key:
ASPEFL: *Aspergillus flavus*
CERCZM: *Cercospora zeae-maydis*
COCHHE: *Helminthosporium maydis*
GIBBZE: *Fursarium graminearum*
LEPTMA: *Phoma lingam*
PYRIOR: *Pyricularia oryzae*

Figure 6 continued

C-SCLESC: *Sclerotinia sclerotium*
DIAPHE: *Phomopsis helianthi*
GIBBFU: *Fusarium moniforme*

PYTHUL: *Pythium ultimum*
SCLESC: *Sclerotinia sclerotium*
USTIMA: *Ustilago maydis*
VERTDA: *Verticillium dahliae*

Figure 7

*This figure describes the sequences of internal DAS clones that are members of assembled contigs having homology to claimed sequences (see figure 7).*

> SEQ ID NO:1210 105037_300046_1
CCAAAATCCAGGACAAGGAAGGAATTCCCCCAGATCAGCAGAGGCTTATCTTCGCCGGCAAGCAGCTTGAGGACG
GACGT
ACCCTAGCCGATTACAACATCCAGAAGGAATCTACCCTGCACTTGGTCCTCCGTCTGCGTGGTGGGATGCAGATT
TTCGT
CAAAACCCTCACTGGCAAAACAATCACCCTTGAGGTGGAAAGTTCTGACACCATCGACAATGTCAAGGCTAAAAT
TCAGG
ATAAGGAGGGAATTCCACCAGACCAGCAGAGGTTGATCTTCGCCGGCAAGCAGCTTGAGGACGGTCGTACCCTTG
CCGAT
TACAACATCCAGAAGGAGTCTACCCTTCACCTTGTCCTCCGTCTCCGTGGTGGTATGCAGATCTTTGTCAAAACG
CTCAC
CGGCAAAACCATCACCCTTGAGGTCGAGAGTTCCGACACCATCGACAATGTCAAGGCCAAAATTCAGGACAAGGA
GGGCA
TTCCCCCAGACCAGCAGAGGTTGATTTTCGCTGGCAAGCAGCTCGAGGATGGCCGTACACTAGCTGATTATAACA
TCCAG
AAGGAATCCACCCTTCACCTTGTCCTCCGTCTCCGTGGTGGTATGCAGATCTTCGTCAAAACACTCACCG

> SEQ ID NO:1211 106105_300458_1
TCGAGAGTTCCGACACCATCGACAATGTCAAGGCCAAAATTCAGGACAAGGAGGGCATTCCCCCAGACCAGCAGA
GGTTG
ATTTTCGCTGGCAAGCAGCTCGAGGATGGCCGTACACTAGCTGATTATAACATCCAGAAGGAATCCACCCTTCAC
CTTGT
CCTCCGTCTCCGTGGTGGTATGCAGATCTTCGTCAAAACACTCACCGGCAAGACCATCACCCTGGAGGTTGAAAG
CTCTG
ACACCATTGACAATGTTAAGGCCAAGATCCAGGACAAAGAGGGGATTCCCCCAGATCAGCAGAGGTTGATCTTCG
CAGGA
AAGCAGTTGGAAGATGGTCGCACCCTTGCGGACTACAACATTCAGAAGGAGTCTACTCTGCACTTGGTGCTAAGG
CTGAG
GGGAGGAATGCAGATCTTCGTGAAGACATTGACCGGGAAGACCATCACCTTGGAGGTGGAAAGCTCTGACACCAT
CGACA
ATGTCAAAGCTAAGATCCAGGACAAGGAGGGTATCCCACCGGACCAGCAGAGGTTGATCTTTGCTGGTAAGCAGC
TTGAG
GATGGAAGGACCCTGGCCGACTACAATATCCAGAAAGAGTCAACCCTTCACCTTGTCCTCCGTCT

> SEQ ID NO:1212 106137_300458_1
CGACAACGTAAAAGCCAAAATCCAGGATAAGGAAGGAATTCCGGCAGATCAGCAAAGGCTTATCTTCGCCGGCAA
GCAGC
TTGAGGACGGCCGTACTCTCGCCGATTACAACATCCAGAAGGAATCTACTCTTCACTTGGTCCTCCGTCTCCGAG
GTGGG
ATGCAGATCTTCGTCAAAACCCTCACCGGCAAAACAATCACCCTTGAGGTCGAAAGTTCCGACACCATTGATAAT
GTCAA
GGCCAAAATTCAGGATAAAGAGGGAATTCCACCAGACCAGCAGAGGTTGATCTTCGCTGGCAAGCAGCTCGAGGA
TGGTC
GTACGCTCGCCGATTACAACATCCAGAAGGAGTCTACCCTTCACCTTGTCCTCCGTCTCCGTGGTGGTATGCAGA
TCTTC
GTCAAAACCCTCACCGGCAAGACCATCACCCTTGAGGTCGAGAGTTCTGACACCATCGACAATGTCAAGGCCAAA
ATTCA
GGATAAGGAGGGCATTCCCCCAGACCAGCAGAGGTTGATTTTTGCTGGCAAGCAGCTCGAGGATGGCCGTACCCT
AGCTG
ATTACAACATCCAGAAGGAATCCACTCTTCACCTTGTCCTCCGTCTCCGTGGTGGTATGCAGATCTTCGTCAAAA
CCCTC
ACCGGC

> SEQ ID NO:1213 107121_300263_1
AGAAAGAGAAATCTTTCTGTCTTAAGAGTAATTAGCAATGGCTTCCTCAGTTCTTTCCTCAGCAGCAGTTGCCAC
CCGCA

Figure 7 continued

GCAATGTTGCTCAAGCTAACATGGTTGCACCTTTCACAGGTCTTAAGTCTGCTGCCTCATTCCCTGTTTCAAGAAAGCAA

AACCTTGACATCACTTCCATTGCCAGCAACGGCGGAAGAGTGCAATGCATGCAGGTGTGGCCACCAATTAACATGAAGAA

GTATGAGACTCTCTCATACCTTCCCGATTTGAGCCAGGAGCAATTGCTCTCCGAAATTGAGTACCTTTTGAAAAATGGAT

GGGTTCCTTGCTTGGAATTCGAGACTGAGAAAGGATTTGTCTACCGTGAACACCACAAGTCACCAGGATACTATGATGGC

AGATACTGGACCATGTGGAAGCTACCTATGTTCGGATGCACTGATGCCACCCAAGTGTTGGCTGAGGTGGGAGAGGCGAA

GAAGGAATACCCACAGGCCTGGGTCCGTATCATTGGATTTGACAACGTGCGTCAAGTGCAGTGCATCAGTTTCATTGCCT

CCAAGCCTGACGGCTACTGAGTTTCATATTAGGACAACTTACCCTATT

> SEQ ID NO:1214 107135_300263_1

AAACATTCTAGCTTTCCGTGTAGTAGCTGCATTCAAGAGTTGCTCATCTACTTTCTATAATGGCAGCTGCTACAATGGCT

CTCTCTTCCTCTTCATTTGCCGGAAAGGCGGTAAAACTCTCACCATCTTCCTCTAAAATCACTGGAAATGGAAAAGTTAC

CATGAGTAAGACGGTTACCAAGGCCAAGCCTGTTTCTGCTGGTAGCCCGTGGTATGGTCCTGACCGTGTCAAGTACTTGG

GACCATTCTCTGGTGAGTCTCCCAGCTATTTGACTGGTGAGTTTCCTGGTGACTATGGATGGGACACTGCTGGACTTTCA

GCCGATCCTGAAACTTTCGCCAAAAACCGTGAGCTAGAGGTTATCCACTGCAGATGGGCGATGCTTGGAGCTCTTGGTTG

CGTCTTCCCCGAGCTCTTGGCACGTAGCGGTGTCAAATTCGGTGAAGCTGTATGGTTCAAGGCTGGATCCCAAATTTTCA

GCGAGGGTGGACTTGACTACTTGGGCAACCCAAGTTTGGTTCACGCACAAAGCATCTTAGCCATATGGGCTTGCCAAGTT

GTGTTGATGGAGCTGTTG

> SEQ ID NO:1215 107160_300263_1

TCCGAATGGGTGGCCTAATTGGTTCTTCTCAAACTGTGTTGGATGGTGAGCTCAGTGGCTCAGCCCGTTTGAGCACTGTT

AGCAC

> SEQ ID NO:1216 108332_300381_1

GTAAGGGTCTTGATCAAGACGGTTCTGATGATCAACAGGACATCACCCGGGGTAAGGGTATGGTCGACAGTCTTTTCCAG

GCTCCAACGGGTACTGGTACTCACCATGCTGTTTTGCAATCCTACGAATATGTCAGCCAAGGTCTTCGTCAATACAACAT

GGACAACACTTTGGACGGATTCTACATCGCTCCTGCTTTCATGGACAAGCTTGTTGTTCACATCACCAAGAACTTCTTGA

AATTGCCCAACATCAAGGTTCCACTCATCTTGGGTGTCTGGGGAGGCAAAGGTCAAGGTAAATCTTTCCAGTGTGAGCTT

GTCTTCAGAAAGATGGGAATCAACCCTATTATGATGAGTGCCGGAGAATTGGAAAGTGGAAATGCAGGAGAGCCTGCAAA

ATTGATTAGGCAAAGATACAGAGAGGCAGCAGAAATCATCAGGAAAGGAAACATGTGTTGCCTCTTCATCAACGATCTCG

ATGCAGGAGCTGGTAGAATGGGTGGAACTACCCAATACACTGTCAACAACCAGATGGTGAATGCCACTCTCATGAACATT

GCTGATAACCCGACAAACGTCCAGC

> SEQ ID NO:1217 108411_300382_1

GGAAAAGGGAGAAAGAGAAAGGTTTCTGTCTTAAGAGTAATTAGCAATGGCTTCCTCAGTTCTTTCCTCAGCAGCAGTTG

CCACCCGCAGCAATGTTGCTCAAGCTAACATGGTTGCACCTTTCACAGGTCTTAAGTCTGCTGCCTCATTCCCTGTTTCA

Figure 7 continued

AGAAAGCAAAACCTTGACATCACTTCCATTGCCAGCAACGGCGGAAGAGTGCAATGCATGCAGGTGTGGCCACCAATTAA

CATGAAGAAGTATGAGACTCTCTCATACCTTCCCGATTTGAGCCAGGAGCAATTGCTCTCCGAAATTGAGTACCTTTTGA

AAAATGGATGGGTTCCTTGCTTGGAATTCGAGACTGAGAAAGGATTTGTCTACCGTGAACACCACAAGTCACCAGGATAC

TATGATGGCAGATACTGGACCATGTGGAAGCTACCTATGTTCGGATGCACTGATGCCACCCAAGTGTTGGCTGAGGTGGG

AGAGGCGAAGAAGGAATACCCACAGGCCTGGGTCCGTATCATTGGATTTGACAACGTGCGTCAAGTGCAGTGCATCAGTT

TCATTGCCTCCAAGCCTGACGGCTACTGAGTTTCATATTAGGACAACTTACCCTATTGTCTGTCTTTAGGGGCAGTTTGT

TTGAAATGTTACTTAGCTTCTTTTTTTTCCTTCCCATAAAAACT

> SEQ ID NO:1218 108421_300382_1
GGAAAAGGGAGAAAGAGAAATCTTTCTGTCTTAAGAGTAATTAGCAATGGCTTCCTCAGTTCTTTCCTCAGCAGCAGTTG

CCACCCGCAGCAATGTTGCTCAAGCTAACATGGTTGCACCTTTCACAGGTCTTAAGTCTGCTGCCTCATTCCCTGTTTCA

AGAAAGCAAAACCTTGACATCACTTCCATTGCCAGCAACGGCGGAAGAGTGCAATGCATGCAGGTGTGGCCACCAATTAA

CATGAAGAAGTATGAGACTCTCTCATACCTTCCCGATTTGAGCCAGGAGCAATTGCTCTCCGAAATTGAGTACCTTTTGA

AAAATGGATGGGTTCCTTGCTTGGAATTCGAGACTGAGAAAGGATTTGTCTACCGTGAACACCACAAGTCACCAGGATAC

TATGATGGCAGATACTGGACCATGTGGAAGCTACCTATGTTCGGATGCACTGATGCCACCCAAGTGTTGGCTGAGGTGGG

AGAGGCGAANAAGGAATACCCACAGGCCTGGGTCCGTATCATTGGATTTGACAACGTGCGTCAAGTGCAGTGCATCAGTT

TCATTGCCTCCAAGCCTGACGGCTACTGAGTTTCATATTAGGACAACTTACCCTA

> SEQ ID NO:1219 110926_300048_1
CCCACGCGTCCGGACTACTTGGGCAACCCAAGTTTGGTACGGGCACAAAGCATCTTGGCCATTTGGGCTTGCCAAGTTGT

GTTAATGGGAGCCGTTGAGGGTTATCGTGTTGCTGGTGGGCCTCTTGGTGAGGTTGTTGACCCACTTTACCCCGGTGGTA

GCTTCGACCCATTGGGCCTCGCTGAAGACCCAGAGGCTTTTGCTGAGCTCAAGGTAAAGGAGATCAAAAATGGTAGACTT

GCCATGTTCTCCATGTTTGGATTCTTTGTTCAGGCTATCGTAACTGGAAAGGGCCCATTGGAGAACCTTGCCGATCACCT

TGCAGACCCAGTTAATAACAACGCTTGGGCCTACGCAACAAACTTTGTCCCTGGAAAGTGAGTTAACAAAAGTTGATCTT

TAATCTTTAAGTAGTGTGAGACTGAACATGTAGCTTGTGAGTGATGAACCCAAAGAAGGGTCAGAGTTTATTTTTAGCAT

TCTGGGTTATGGGTTCATTAAAGGGATTGTGTAAATTGGTTTGGATTAATTAATGAAGAACATGTGGATCT

> SEQ ID NO:1220 111021_300049_1
ATTTTTTCTGTATAGTAGCTGCATTTTCAAGAGCATTTCAGGTTATTTCTACAACAATGGCAGCTACTACAATGGTTCTT

TCTTCCTCTTCTTTTGTGGGAAAGGCGGTGAAACTCTCACCATCTTCCTCTGAGATCACCGGAAATGGAAAAGTTACCAT

GAGGAAGACTGTTACCAAGGCGAAGCCAGTCTCTTCTGGCAGCCCATGGTATGGTCCTGATCGTGTCAAGTACTTGGGCC

CATTCTCCGGTGAGTCCCCAAGTTACTTGACTGGTGAGTTCCCTGGTGATTATGGGTGGGACACTGCTGGACTTTCAGCT

GATCCCGAAACTTTTGCAAAGAATCGTGAGCTAGAGGTGATCCACTGCAGATGGGCCATGCTTGGAGCTCTTGGTTGTGT

CTTCCCTGAGCTCTTGGCCCGTAATGGTGTCAAATTCGGTGAGGCTGTATGGTTCAAGGCTGGATCTCAAATTTTCAGCG

Figure 7 continued

AGGGTGGACTTGATTACTTGGGCAACCCAAGTTTGGTCCATGCACAAAGTATCTTGGCCATCTGGGCTTGCCAAG
TCGTG
TTGATGGGAG

> SEQ ID NO:1221 111058_300049_1
TTTTTCTGTATAGTAGCTGCATTTTCAAGAGCATTTCACTTGATTTCTACAACAATGGCAGCTACTACAATGGTT
CTTTC
TTCCTCTTCTTTTGTGGGAAAGGCGGTGAAACTCTCACCATCTTCCTCTGAGATCACCGGAAATGGAAAAGTTAC
CATGA
GGAAGACTGTTACCAAGGCGAAGCCAGTCTCTTCTGGCAGCCCATGGTATGGTCCTGATCGTGTCAAGTACTTGG
GCCCA
TTCTCCGGTGAGTCCCCAAGTTACTTGACTGGTGAGTTCCCTGGTGATTATGGGTGGGACACTGCTGGACTTTCA
GCTGA
TCCCGAAACTTTTGCAAAGAATCGTGAGCTAGAGGTGATCCACTGCAGATGGGCCATGCTTGGAGCTCTTGGTTG
TGTCT
TCCCTGAGCTCTTGGCCCGTAATGGTGTCAAATTCGGTGAGGCTGTATGGTTCAAGGCTGGATCTCAAATTTTCA
GCGAG
GGTGGACTTGATTACTTGGGCAACCCAAGTTTGGTCCATGCACAAAGTATCTTGGCCATCTGGGCTTGCCAAGTC
GTGTT
GATGGG

> SEQ ID NO:1222 111059_300049_1
AAAAGGAAAAGAGAGAAAGAGAAATCTTTCTGTCTTAAGTGTGAATTAACAATGGCTTCCTCAGTTCTTTCCTCA
GCAGC
AGTTGCCACCCGCAGCAATGTTGCTCAAGCTAACATGGTTGCACCTTTCACTGGTCTTAAGTCAGCTGCCTCGTT
CCCTG
TTTCAAGGAAGCAAAACCTTGACATCACTTCCATTGCCAGCAACGGCGGAAGAGTGCAATGCATGCAGGTGTGGC
CACCA
ATTAACAAGAAGAAGTACGAGACTCTCTCATACCTTCCTGATTTGAGCGTGGAGCAATTGCTTAGCGAAATTGAG
TACCT
CTTGAAAAATGGATGGGTTCCTTGCTTGGAATTCGAGACTGAGCACGGATTTGTCTACCGTGAACACCACAAGTC
ACCAG
GATACTATGACGGCAGATACTGGACCATGTGGAAGTTGCCTATGTTCGGATGCACTGATGCCACCCAAGTGTTGG
CCGAG
GTGGAAGAGGCGAAGAAGGCATACCCACAAGCCTGGATCCGTATTATTGGATTCGACAACGTGCGTCAAGTGCAG
TGCAT
CAGTTTCATTGCCTACAAGCCAGAAGGCTACTAAGTTTAATATTAGGACAACTTACCCTATTGTCCGACTTT

> SEQ ID NO:1223 111122_300052_1
CGGACGCGTGGGCGGACGCGTGGGCGGACGCGTGGGCGGACGCGTGGGCGGACGCGTGGGGTCGAGTTCCAGCCA
TCTCC
GAAAATGACTTTCAAGAGAAGGAACGGAGGTCGCAACAAGCATGGACGTGGCCACGTCAAATTCGTCCGTTGCTC
CAACT
GCGGCAAATGCTGCCCTAAGGACAAAGCCATCAAGAGGTTTCTTGTGAGAAATATTGTTGAGCAAGCAGCTGTTA
GGGAT
GTGCAGGAAGCTTGTGCTTTTGAAACGTACACTCTGCCTAAGCTGTATCTGAAGATGCAATATTGTGTATCATGT
GCCAT
CCACTCAAAGGTGGATAGGGTCCGCTCTCGAACTGATAGGAGGGTCCGTGAGCCTCCACAGCGATTCATGCGCCC
AAGGG
ATGATGCTCCAAAGCCTGGTCAAGCTCCACGGGTTCCTGGAGCTGCTCCGACAGCAGCAGCTCGTACTTGAGTGC
CTGCT
GTTTTGATCATGTTGTTTAGCTATAGTGTGAAAGTGACTATGG

> SEQ ID NO:1224 111126_300052_1
AAAAATGGCAGCAACAATGTCCACTGTTGTAGGCTTAGTTAGTTCGTCTCTTTCTTCTCCAAAGAAGGCTTGCCT
CAGCT
CAGGCTTCTTGAAATCACCAGCGACAGCAAGAAACCCTTTAAGGGTAGCACAAGCTTCAGGAGGCAAATTTACAT
GTTTT

Figure 7 continued

GAAAGAGATTGGCTGAGGAGAGACTTGAATGTGATTGGATTTGGTTTGATTGGATGGCTGGCTCCTTCTAGCATT
CCAGT
AATCAATGGCAAGAGTTTGAGTGGGCTTTTCTTTGATAGCATTGGCACTGAACTCTCTCATTTCCCCACTGGACC
TGCTC
TCACTTCTCAGTTCTGGCTTTGGTTGGTGTGCTGGCACTTGGGCTTGTTCATCTGCCTAACTTTTGGACAAATTG
GATTC
AAGGGACGGACTGAGGACTATTTCTCAAAGTAGAATATTCCCTTCTGAAAATTGTGTATAAAAAACAAATATGCT
ATTTC
AGTTCTGCATGTTATGAGCGTGAAATACCTTCTACTTTAATTTGCAAGTTTTTTCAAATTTTGC

> SEQ ID NO:1225 111442_300055_1
GAAAGAGAGAAAGAGAAATCTTTCTGTCTTAAGTGTAATTAGCAATGGCTTCCTCAGTTCTTTCCTCAGCAGCA
GTTGC
CACCCGCAGCAATGTTGCTCAAGCTAACATGGTTGCACCTTTCACTGGTCTTAAGTCAGCTGCCTCGTTCCCTGT
TTCAA
GGAAGCAAAACCTTGACATCACTTCCATTGCCAGCAACGGCGGAAGAGTGCAATGCATGCAGGTGTGGCCACCAA
TTAAC
AAGAAGAAGTACGAGACTCTCTCATACCTTCCTGATCTGAGCGTGGAGCAATTGCTTAGCGAAATTGAGTACCTC
TTGAA
AAATGGATGGGTTCCTTGCTTGGAATTCGAGACTGAGCGCGGATTTGTCTACCGTGAACACCACAAGTCACCGGG
ATACT
ATGACGGCAGATACTGGACCATGTGGAAGTTGCCTATGTTCGGATGCACTGATGCCACCCAAGTGTTGGCCGAGG
TGGAA
GAGGCGAAGAAGGCATACCCACAGGCCTGGATCCGTATTATTGGATTCGACAACGTGCGTCAAGTGCAGTGCATC
AGTTT
CATTGCCTACAAGCCAGAAGGCTACTAAGTTTCATATTAGGACAACTTACCCTA

> SEQ ID NO:1226 111443_300055_1
TCCGAAAATATGGCTCTGAGAATGTGGGCTTCTTCAACAGCCAATGCGGTAAGAATCTCTAGAACCAATCTAATT
CCCCC
CTCTTTTTCTCTTTCCAGATGCTTTTCAACTGTTCTTGATGGACTGAAGTATGCATCTTCACATGAATGGGTGAA
ACATG
ACGGTTCAGTTGCCACTGTTGGCATCACTGATCATGCTCAGGACCATCTTGGAGAAGTAGTGTTTGTGGATCTGC
CAGAA
ACAGGTGGTTCTGTTTCCCAAGGAAGCAGCTTTGGAGCTGTTGAGAGTGTCAAAGCCACCAGTGACATTAACTGT
CCTAT
CTCGGGTGAGATTGTTGAGGTCAACACAAAGCTTACTGAAACGCCTGGCTTGGTAAATTCAAGCCCATATGAAGA
TGGAT
GGATGATTAAAGTGAAGCCAAGCAGTCCATCAGAATTGGAGTCTTTGATGGGTTCCAAAGAGTACACAAAATTCT
GTGAA
GAAGAGGATAGTCATTGACACCTGAATGTACTTCTTGGTCCAATTTGGATTAACTGGGGTGCTTAAGGTTGCTAT
TGTTA
TAGAAATTTCCAGTCAATAAATAAAATTGTTCAAGCATAAAAAATTATCTTCCACTTGTCTCATAACATCTTTGC
CTATG
CAGTTCTGTGATTTGAT

> SEQ ID NO:1227 111712_300059_1
CCCACGCGTCCGCAACTTTCTCTCTGTATACGTCCTAATCTGGGGCGACCCTTTTCACTCCGGTCAGTTTCCCGC
CGGGA
AATCTTTAATTCTTGTTGTATTGACAGCTTCCTTGCTTGTACCTTCATCTCGCTTTACCGATCTTGCACTTTACA
GTAAT
CATCATGAATCCAGAATACGACTATCTTTTCAAGCTTTTGCTTATTGGAGATTCTGGTGTTGGCAAATCATGTCT
CCTCT
TGAGATTTGCTGATGATTCATATCTTGAGAGTTACATTAGTACCATTGGTGTGGACTTTAAAATCCGCACAGTCG
AGCAG
GATGGGAAAACCATTAAACTTCAAATTTGGGATACTGCTGGTCAAGAACGTTTTAGGACAATTACCAGCAGCTAC
TATCG
CGGTGCTCACGGCATTATTGTTGTCTATGATGTAACTGATCAAGAGAGCTTCAATAATGTCAAGCAATGGTTGAG
TGAAA

Figure 7 continued

TTGATCGATATGCAAGTGATAATGTGAACAAGCTTCTTGTCGGAAACAAGTGCGATCTCACAGCGCAGAAGGTAG
TTTCC
ACAGAGACAGCTCAGGCTTTTGCTGATGAGATCGGCATTCCTTTCATGGAAACTAGTGCGAAAAATGCCACCAAT
GTGGA
ACA

> SEQ ID NO:1228 111728_300059_1
AAATTTCAGAAGGTTCACCTAAATGGCTCATGCTATGGCTTCAATGGGTGGCCTAATTGGTTCTTCTCAAACTGT
GTTGG
ATGGTCAGCTCTGTGGTTCAGCCCGTTTGAGCACTGTTAGCACCAGCAGAATTGCCTTGGCTAGACCAGGTCTCA
GCATT
AGAGCCCAACAGGGGTCTGCTGACACTGAAACTAGCCGTAGAGCCGTCATCGGTCTTGTTGCTGCTGGCCTTGCT
GGTTC
CTTTGCTCAAGCAGCCTTTGCTGCAGCTAAATCAATCAAGATTGGTGGCGCTCCTCCTCCCTCCGGTGGATTACC
TGGAA
CTTTGAACTCGGATGAGGCAAGGGACTTTGGTCTACCACTTAAGAAGAGGTTTTACCTTCAACCATTGACTCCAG
CTGAA
GCAGCCCAGAGAGTTAAGGATTCAGCCAAGGAGATTGTTAGCGTCAAGAATTTCATCGACAAGAAGGCCTGGCCA
TATGT
CCAGAATGACCTTCGTCTCAGAGCAGAATACCTTCGCTATGACCTTAAAACCGTAATCTCAGCTAAGCCAAAAGA
AGAGA
AGGGAAAGCTCCAGGACCTGACTGGAAAGCTCTTCAAGACCATTAGTGATCTGGACCATGCAGCAAAG

> SEQ ID NO:1229 111736_300059_1
TGAAACATGACGGTTCAGTTGCCACTGTTGGCATCACTGATCATGCTCAGGACCATCTTGGAGAAGTAGTGTTTG
TGGAT
CTGCCAGAAACAGGTGGTTCTGTTTCCCAAGGAAGCAGCTTTGGAGCTGTTGAGAGTGTCAAAGCCACCAGTGAC
ATTAA
CTGTCCTATCTCGGGTGAGATTGTTGAGGTCAACACAAAGCTTACTGAAACGCCTGGCTTGGTAAATTCAAGCCC
ATATG
AAGATGGATGGATGATTAAAGTGAAGCCAAGCAGTCCATCAGAATTGGAGTCTTTGATGGGTTCCAAAGAGTACA
CAAAA
TTCTGTGAAGAAGAGGATAGTCATTGACACCTGAATGTACTTCTTGGTCCAATTTGGATTAACTGGGGTGCTTAA
GGTTG
CTATTGTTATAGAAATTTCCAGTCAATAAATAAAATTGTTC

> SEQ ID NO:1230 113576_300004_1
TTCAAACCATCAAACAATCACTTTTCTTTTTCATACACCATGGCTGCTTCTTCAATGGCTCTTTCTTCCCCTTCT
TTTGC
TGGACAGGCAGTGAAACTCTCCCCATCTGCCTCAGAAATCACTGGAAATGGAAGGGTCTCCATGAGAAAGACTGT
CACCA
AACCTGTTGCATCTAGCAGCCCATGGTACGGCCCAGACCGTGTTAAGTACTTGGGCCCATTCTCCGGTGAGGCCC
CAAGC
TACTTGACCGGTGAATTCCCAGGTGATTACGGATGGGATACTGCTGGACTTTCAGCAGATCCAGAAACCTTTGCC
AAGAA
CCGTGAACTCGAAGTGATCCACTGCAGGTGGGCTATGCTTGGTGCTCTTGGATGTGTCTTCCCTGAGCTCTTGGC
TCGTA
ACGGTGTCAAGTTTGGCGAAGCTGTCTGGTTCAAGGCTGGATCCCAAATCTTTAGCGAGGGTGGACTTGACTACT
GGGGC
AACCCAAGCTTGGTCCATGCACAAAGCATCTTGGCCATCTGGGCTTGCCAAGTTATCTTGATGGGAGCCGTTGAG
GGTTA
CCGCGTTGCTGGTGGGCCTCTTGGTGAAGTTGTCGACCCACTCTACCCTGGTGGCA

> SEQ ID NO:1231 116469_300068_1
CGAATCCACCACACGGTACCCTCCTCTCTCCTCCTCCGACCACCATGGCCATGGCCACGCAAGCCTCCGCCGCCA
AGTGC
CACCTCCTCGCCGCCTGGGCACCGGCGAAGCCGCGCTCATCCACCCTCTCCATGCCCACCTCGAGGGCACCCACC
TCCCT

Figure 7 continued

CAGAGCGGCGGCGGAGGATCAGCCCGCCGCGGCGGCGACGGAGGAGAAGAAGCCAGCCCCCGCGGGGTTCGTGCCGCCGC

AGCTGGACCCCAACACGCCGTCCCCGATCTTCGGCGGGAGCACGGGGGACTCCTCCGGAAGGCGCAGGTGGAGGAGTTC

TACGTCATCACATGGACGTCGCCCAAGGAGCAGGTGTTCGAGATGCCCACGGGCGGCGCCGCCATCATGCGCGAGGGCCC

CAACCTGCTGAAGCTGGCCAGGAAGGAGCAGTGCCTGGCCCTGGGCACCAGGCTCCGCTCCAAGTACAAGATCAACTACC

AGTTCTACCGCGTCTTCCCCAATGGCGAGGTGCAGTACCTCCACCCCAAGGACGGCGTCTACCCGG

> SEQ ID NO:1232 116840_300515_1
CACTTACGTAGCCCTGTGTGCGACGGCGCAAGTGCTTGTACGCTTTCAGCTAGCGTAGCCATGGCTTCCAGGGCATTCCT

CCTCCTGGCTCTAAATCTGGTCCTCTTCTTCACCGTGGCCAGCGCCTGCGGCAAGTACTGCCCGACGCCTTCGACGCCGT

CGACGACGCCATCGACGCCGTCCTACAACACCAAGTGCCCCAAGAACGCGCTCAAGTTCGCGGCGTGCGCCGACGTGCTG

GGCCTCGTCAGCGCCGAGGTCGGCCAGCCGCCGTACGAGCCGTGCTGCGGCGTCCTCGGCGGCCTCGCCGACCTTGAGGC

CGCCGTCTGTCTCTGCACCGCCATCAAGGCCAACGTGCTCGGCATCACCCTCGACATCCCCGTCAAGCTCAGCCTCCTCG

TCAACTACTGCGGCAAGAACGTCCCTAGTGGCTTCATCTGTGCTTAAGCTACGTAACGCGCGTACGGTGTAACGACGTGC

TAGCTTTGCATGCATGCAGCACGCATGCACGAACACATCGTTCGTTCTTGAGTGCCTGCATGCATATCGGTCGAGTCTTT

ACTTACTCT

> SEQ ID NO:1233 120256_300383_1
CTTTCATAATGGACAGCAGGAGATGCAAATGCAAGTGGTGCGGGACGAAAATTTCAGCTCCCATTGGAGCACAAACCATT

TCGTGCCCAAGGTGCCAATCTGTTACCCAACTCCAACCTCCAAGAACCAACAACGGCTTTGCCGCTGGGGTTATTAACAA

TATTATGGGTGCAGTAGTTAACACAGGGTTTCCAGCAAGGCTGGGAAGGATGAATCCAACAGATGCCAATAATTATCAGC

CTCAACCGTTCAACATGTCACCCCAGATTACTATGCAACCTCCAGCTGTTCATGGACGGAAGCGAGCAGTACTCTGTGGA

ATAACCTACCGTGGGCATTCCAAGAGTCTGAAAGGAAGTATTAACGATGTTTTATCCATGAGATATCTTCTGGTTCAGAA

GTTGGGTTTCCCCAATGCATCCGTTCTTGTCCTTACAGAGGATGAGAAAGATCCATACAAAATCCCAACCAAGGGCAATA

TCAGATCAGCCCTACGTTGGCTTGTTCATGGTTGTCAGCCAGGAGATTCACTAGTGTTCCACTACTCTGGCCATGGCACA
C

> SEQ ID NO:1234 120280_300383_1
GGAGAAAGAGAAATCTTTCTGTCTTAAGAGTAATTAGCAAGGGCTTCCTCAGTTCTTTCCTCAGCAGCAGTTGCCACCCG

CAGCAATGTTGCTCAAGCTAACATGGTTGCACCTTTCACAGGTCTTAAGTCTGCTGCCTCATTCCCTGTTTCAAGAAAGC

AAAACCTTGACATCACTTCCATTGCCAGCAACGGCGGAAGAGTGCAATGCATGCAGGTGTGGCCACCAATTAACATGAAG

AAGTATGAGACTCTCTCATACCTTCCCGATTTGAGCCAGGAGCAATTGCTCTCCGAAATTGAGTACCTTTTGAAAAATGG

ATGGGTTCCTTGCTTGGAATTCGAGACTGAGAAAGGATTTGTCTACCGTGAACACCACAAGTCACCAGGATACTATGATG

GCAGATACTGGACCATGTGGAAGCTACCTATGTTCGGATGCACTGATGCCACCCAAGTGTTGGCTGAGGTGGGAGAGGCG

AAAAAGGAATACCCACAGGCCTGGGTCCGTATCATTGGATTTGACAACGTGCGTCAAGTGCAGTGCATCAGTTTCATTGC

Figure 7 continued

CTCCAAGCCTGACGGCTACTGAGTTTCATATTAGGACAACTTACCCTAT

> SEQ ID NO:1235 120635_300428_1
CAAAATGGCTCATGCTATGGCTTCAATGGGTGGCCTAATTGGGGGTTCTCAAACTGTGTTGGATGGTCAGCTCAGTGGCT
CAGCCCGTTTGAGCACTGTTAGCACCAGCAGAATTGCCTTGGCTAGACCAGGACTCAGCATTAGAGCCCAACAGGGGTCT
GCTGACACTGAAACTAGCCGTAGAGCCGTCATCGGTCTTGTTGCTGCTGGCCTTGCTGGTTCCTTTGCTCAAGCAGCCTT
TGCTGCAGCTAAATCAATCAAGATTGGGGGCGCTCCTCCTCCCTCTGGTGGATTACCTGGAACTTTGAACTCGGATGAGG
CAAGGGACTTTGGTCTACCATTGAAGAAGAGGTTTTACCTTCAACCATTGACTCCAGCTGAAGCAGCCCAGAGAGTTAAG
GATTCAGCCAAGGAGATTGTTAGCGTCAAGAATTTCATCGACAAGAAGGCCTGGCCATATGTCCAGAATGACCTTCGTCT
CAGAGCAGAATACCTTCGCTATGACCTTAAAACCGTCATCTCTGCTAAGCCAAAAGAAGAAAAGGGAAAACTCCAGGACC
TGACTGGAAAGCTCTTCAAGACCATTAGTGATCTGGACCATGCAGCAAAGACCAAGAACAGCCCTGAAGCAGAGAAGTAC
TATGCTGAAACTGTATCTACCTTAAATGAT

> SEQ ID NO:1236 120726_300516_1
CATCTTATTGTCACTTCCATCGCATTCTCCTAATTGTCATCACTAGCTTCTAGCTAGCTTAATTAATTAATTAGCCATGG
CGGAGGAGAAGCACCACCACCACCTGTTCCACCACAAGAAGGACGACGAGCCGGCCACCGGAGTAGACTCCTACGGCGAG
GGCGTCTACACGTCGGAGACGGTGACCACCGAGGTGGTCGCCGGCGGCCAGGACGAGTACGAGAGGTACAAGAAGGAGGA
GAAGCAGCACAAGCACAAGCAGCACCTCGGCGAGGCCGGCGCCCTCGCCGCCGGCGCCTTCGCCCTGTATGAGAAGCACG
AGGCGAAGAAGGACCCGGAGAACGCGCACAGGCACAAGATCACGGAGGAGATCGCGGCCACGGCGGCGGTCGGCGCCGGC
GGCTACGCCTTCCACGAGCACCACGAGAAGAAGAAGGACCACAAGAGCGCCGAGGAGTCCACCGGCGAGAAGAAGCACCA
CCTCTTCGGCTGATCGACCTCATCACAA

> SEQ ID NO:1237 126418_300463_1
GCCATTACGGCCGGGGGCCTGAAACAAATTTCAGAAAGTTCACCAAAATGGCTCATGCTATGGCTTCAATGGGTGGCCTA
ATTGGTTCTTCTCAAACTGTGTTGGATGGTCAGCTCAGTGGCTCAGCCCGTTTGAGCACTGTTAGCACCAACAGAATTGC
CTTGGCTAGACCAGGACTCAGCATTAGAGCCCAACAGGGGTCTGCTGACACTGAAACTAGCCGTACAGCCGTCATCGGTC
TTGTTGCTGCTGGCCTTGCTGGTTCCTTTGCTCAAGCAGCCTTTGCTGCAGCTAAATCAATCAAGATTGGGGGCGCTCCT
CCTCCCTCTGGTGGATTACCTGGAACTTTGAACTCGGATGAGGCAAGGGACTTTGGTCTACCATTGAAGAAGAGGTTTTA
CCTTCAACCATTGACTCCAGCTGAAGCAGCCCAAAGAGTTAAGGATTCAGCCAAGGAGATTGTTACCGTCAAGAATTTCA
TCGACAAGAAGGCCTGGCCATATGTCCAGAATGACCTTCGTCTCGGAGCAGAATACCTTCGCTATGACCTTAAAACCGTC
ATCTCTGCTAAGCCAAAAGAAGAAAAGGGAAAACTCCAGGACCTGACTGGAAAGCTCTTCAAGACCATTAGTGATCTGGA
CCATGCAGC

> SEQ ID NO:1238 126767_300466_1
GCCATTACGGCCGGGGAGGGCTGTTAAGGTGGCTTTCACATGAGCGGAGCAGCAGGTAAGCTTAGTTACTGCAGAAAGTG

Figure 7 continued

```
GCGGAGCTGTGACGCTGCTGATTCAAATCTAAAGACCACCAAATGGCTAGAGGTTTGAAGAAACATTTGAAGAGG
CTCAA
TGCCCCAAAGCATTGGACGCTTGACAAGCTTGGAGGAGCTTTCGCTCCCAAGCCTTCGTCTGGTCCGCACAAATC
AAGGG
AGTGTTTGCCGTTGATCATTATCATGAGAAACAGACTGAAGTATGCCCTGACATACGGCGAGGTCATTTCAATTT
TAATA
CAACGACTTGTTATGGTTGATGGAAAAGTTAGGACAGATAAGACTTACCCCGCCGGCTTTATGGATGTTGTTTCA
ATTCC
TAAGACAAATGAGAACTTCCGCCTCATGTATGACACAAAGGGCCGATTTCGTCTTCACTCTGTTAGGGATGAGGA
AGCGA
AGTTTAAGCTGTGCAAGGTCCGATCCGTGCAGTTTGGACAGAAGGGTATTCCATACCTCAACACTTATGATGGAA
GAACA
ATCCGCTACCCCGATCCTCTCATCAAGGCCAATGATACCATCAAGCTGGACTAGAGAACAATAAGATTGTTGACT
TCATC
AAGTTTGATGTCGGAAATGTTGTCATGGTGACTGGTGGTAGAAAC

> SEQ ID NO:1239  127296_300469_1
CCCCCATTGGCTGGAAATGCAGCGAGGGACAACAAGAAGACTAGGATAATACCGAGGCATGTTTTGTTAGCTGTA
AGGAA
TGACGAAGAGCTTGGAAAACTTCTAGCTGGTGTAACCATTGCTCATGGAGGTGTTCTTCCTAACATCAATCCAGT
TCTTC
TGCCTAATAAATCCGACAAAGCTGGAAAAGAACCTACTAAATCGCCAACGAAGGCTACCAAGTCACCCAAGAAGG
CCTAA
TTTGTGACGATGCAGGCTCGTGTGATGGCACAGTGTTCTACTTGAATCCATGTTGTATGGACATTGTATTGTAGC
TTTGC
AATTAGGAGCTTTAATGGTGGTCGTGAAATAATCTGTACTTGTATGTAGTTTTGGTATCTATGGGTTTCATGTAG
GCAAC
GTCTGTTGAAACTAGGGATGTTTGATTTCTGTTATGATGTAAAACTAATGAAATTGGTTCTGTTTTTTC

> SEQ ID NO:1240  127743_300472_1
CCCCCCGGCCAGCCCACACTCTGAATTCTGAAAATAGTTTTGTTAGTTTGGAGTGAAAAGCCATGGCATCTTTGG
CAACC
TTTGCTGCAGTGCAGCCCACTACCAATGTCAAGGGCCTAGCTGGAAGCTCCATTACTGGAACTAAGCTTCATCTC
AAATC
ATCTCGCCTCAATTTGAAGACCACTAAATCCAGGGCCGGCCCTGTGGTTGCCAAATATGGTGACAAGAGTGTATA
CTTTG
ATTTGGAGGATTTGGGCAACACCACTGGCCAGTGGGACCTGTATGGATCAGATGCACCTTCACCATACAACTCTC
TTCAG
AGCAAGTTCTTTGAGACATTTGCTGCTCCATTCACCAAGAGAGGTCTTTTGCTCAAATTCTTGATATTGGGAGGT
GGCTC
CACCCTTGCTTACTTCAGTTCGACAGCATCAGGGGATATCCTACCAATCAAGAAAGGTCCACAACTTCCACCCAA
GCTCG
GCCCACGCGGCAAGATCTAATTGCTTTCGGTCCAAAATTC

> SEQ ID NO:1241  128377_300475_1
CCAGTTTTGTTAGTTTGAAGTGAAGAGCAGGGCATCTTGGGCAACTCTTGCTGCAGTACAGCCCACAACTGCCGT
CAATG
GGCTAGCTGGAAGCTCCATTATTGGAACTAAGCTACATGTTAAATCATCTCGCCTTAATTTGAAGTCTACTAAAT
CCAGG
GCTGGTTCTGTGGTAGCAAAGTATGGTGACAAGAGTGTATACTTTGATTTAGAGGACCTGGGAAACACCACTGGC
CAATG
GGACTTGTATGGTTCAGATGCACCTTCACCATACAACTCCCTTCAGAGCAAGTTTTTCGAGACTTTTGCTGCTCC
TTTCA
CTAAGAGAGGTCTGTTGCTCAAATTCCTGATATTGGGAGGTGGCTCAACTCTTGCATACTTCAGTTCAACTGCAT
CAGGG
GATATACTACCAATCAAGAAAGGACCTCAACTTCCACCCAAGCTTGGGCCACGCGGAAAGATCTAATTCCTTTTC
AATCC
AACTTTCTCAACCTTCATTTTGTAATTGATGTATCTGTCCCCAGCTTGTAAGTATTCTTGAAGCCTACCTGAGAC
CTTTG
```

Figure 7 continued

TTACAGAAGTTAAATCTTATTGCAAAGTTGGAGCATTGCTTTCTA

> SEQ ID NO:1242 129891_300482_1
TTTTTTTTTTTGGGGGGAAATTATACAGTAATCCACATGTTTAATGGTACCTTTGGAACAGGAAAATACAAATTAAGTTC
AAACAATAATTTCATTACATAACCACACAACCTACTGCAGCTCGAGGAAATCAACTACCCCTTGAATATTCCATGGCTAT
GGCAACTCAAGCAGCTCTTTTTACCCCAACTCTTTCCACCTCAAAATCAAGCAATTTACCATGGAAACAATCCTCAACTG
TGTCATTCGCCAGCCCTAAACCATTCAACTTTGCTGCACCACAACGTTCCATTAAGGCCTCAGCTGCTGAAGGAAGACA
GAAGCTCCAGCGAAAGAAGCCCCAGCAGGTTTCACCCCACCAGAGTTGGACCCAAACACACCATCTCCAATCTTCGGAGG
TAGTACTGGTGGATTGTTGCGTAAAGCTCAAGTAGAGGAGTTTTACGTGATCACTTGGGATTCTCCTAAAGAACAAGTAT
TTGAAATGCCAACTGGAGGTGCACCTATCATGAGACAAGGACCTAACTTGCTTAAGTTGGCTTCATGTACCTTAGGAGGA
GCTTCAACTATAAAGCTCTCAAACTTCAATACGGACTTCACAAGGACCAAAGCATGTAGTTTACATACAC

> SEQ ID NO:1243 130224_300486_1
GAATTCAGTTAACAGAGCACCTTTGAGCTTGCCGAGCTCTGGCCAAAGCTCTGCCTTCTTGGGCAGCAGCTTGAAGAAGG
TCAATTCTTCTGTTGCACCAAAACCATCATCAAGAAGCTTCAAAGTTGTTGCTGCACAAGAGGTTGATCCTAAAAAGAAT
GAGGACAAATGGGCCGGTCTTTACTACGACCAGTCTGATGATCAACAAGACATCACCAGAGGAAAGGGAATGGTTGACTC
CCTTTTCCAAGCTCCTATGGATACCGGAACTCACAATGCTATCATGAGTTCTTATGAATACGCCAGCAAGGGACAAGAA
CATACGACTTTGACAACACCATGAGTGGATTCTACATTGCTCCAGCTTTCATGGACAAGCTTGTTGTTCACATTACCAAG
AACTTCATGACCCTTCCCAACATCAAGGTTCCTCTTATTTTGGGAGTCTGGGGAGGAAAGGGACAAGGAAAATCATTCCA
GTGTGAGCTTGTCATGGCCAAGATGGGAATCAACCCAATCATGATGAGTGCCGGAGAGCTTGAGAGTGGAAACGCAGGAG
AGCCCGCAAAGTTGATCAGGCAACGTTACCGTGAAGCAGCTGACATTATCAAGAAGGGAAAAATGTGTTGTTTATTCATC
AACGATCTTGATGCAGGAGCTGGACGTATGGGTGGAACCACTCAATACACAGTTAACAACCAGATGGTTAACGCCACCCT
CATGAACATTGCTGATAACCCAAC

> SEQ ID NO:1244 130439_300487_1
GAATTCAAAAAATAGTAATGGCTTCTTCAGTGATGGCCTCTGCTGCAGTCGCCTCCGTGAGGAGCTCTGCTCCCGCTCAA
GCTAGCATGGTTGCACCATTCAGCGGCTTGAAATCCGTTGCTGCATTCCCAGTTACCCGCAAATCAAACGACATCACCTC
CGTTGCCAGCAACGGTGGAAGAGTTAACTGCATGCAGGTGTGGCCACCAAGTGGTTTGAAGAAGTTTGAGACCCTCTCAT
ACCTTCCCCCATTGACCGTCGAGCAACTATCCAAGGAAGTCGACTACCTTCTCCGTAATGGATGGGTTCCCTGTTTGGAA
TTCGGTGCCAGAGGATTCGTCTACAGAGAACACGGTAACACCCCTGGATACTACGATGGTCGTTACTGGACAATGTGGAA
GCTACCCATGTTCGGTTGTACCGATGCTTCCCAGGTTATCAAGGAACTAGAAGAGGCCAAGGCTGCATACCCTGACTCTT
TCATCAGAATCATTGGATTCGACAACGTTCGTCAAGTACAATGTGTTAGTTTCATCGCATACAAGCCCGAGAGCACCAGC
TACGAACAGTAAAGGATGAATCTTAATCAAGGAGCATAATCCAATTCATTTCTGTATC

> SEQ ID NO:1245 130502_300488_1

Figure 7 continued

GAATTCAAGAGGAGTAACGGCAAGCAAAGTAGTAGGGGCGCAAGCTATAGCATCAGTATCTGGCTTAAGCAGCTT
CTCGC
AAGGTACAAACAGATTGAATGTGGCTACTACCAACAGCCGAACGGCCAGAAGTCGTGTTGGTTTCAGCGTTAGAT
CTGAG
AAGAAGTCGGAATCGGAGACTGCTCAGAGTAGCCGTAGAGCACTATTGGGTGTCTTAGCTGTGGGACTGACCACT
GGATC
TTTCGTAAAGAATGTGCTTGCTGATGCTAGGCCTATTGTAATCGGGCCACCTCCCGCTCCTTCCGGTGGTTTACC
GGGGA
CTCTAAATTCTGATGAAGCAAGGGACTTAGATCTACCCCTAAAAACAAGGTTTTTCCTACAGCCTAAGACTCCAG
AAGAA
GCAGCTCAGAGAGTAAAAGAATCAGCGCAAGCGATCCTAGGTGCCAAGGCACAGATAGACAAAAAGGCATGGCCG
TATGT
CCAGAATGAACTACGATCCAGCGCCGAATATCTTCGTTACGATCTCAGAACTATCATCTCTGCAAAGCCCAAGGA
TGAGA
AGAAACCACTCAAAGAACTGTCTGACAAGCTCATCCAAAACCTCAATAGTCTGGACTATGCTGCAA

> SEQ ID NO:1246 131361_300513_1
GAATTCAGATTCTGGTGTTGGGAAATCATGCCTGCGTGCTGAGATTTGCTGACGATTCATATCTTGAAAGTTACA
TCAGC
ACTATTGGCGTTGACTTTAAAATACGCACTGTGGAGCAGGACGGGAAGACTATTAAACTTCAGATTTGGGACACT
GCCGG
GCAAGAGCGTTTCAGGACAATCACTAGCAGCTACTACCGCGGAGCACATGGATTATTATTGTTTATGATGTCAC
AGACC
AAGAAAGCTTTAACAACGTGAAGCAGTGGTTGAGCGAGATTGATCGTTATGCGAGTGATAATGTTAACAAGCTTC
TGGTT
GGGAACAAGAGTGATCTCACCGCAAATAAAGTCGTGTCAACTGAAACTGCTAAGGCATTTGCTGATGAGATAGGG
ATCCC
ATTCCTTGAAACCAGTGCAAAAAATGCGACTAATGTTGAGCAAGCCTTTATGGCCATGGCTGCTGAAATAAAAAA
CAGGA
TGGCAAGCCAACCTGCTATGAACAGCGCTAAGCCTCCAACCGTTCAGATCCGAGGACAACCCGTTACTCAGAATA
GTGGT
TGCTGCTCCTCTTCTTAAGGATAAGACTTTAGCTCGGACTTTTTATCTCTCTGACAATCTTTGTCCCTCCATCCT
TGTAA
AACTAGTCTCTCTCTGGCACACTTATTCATCAGCCATCT

> SEQ ID NO:1247 131370_300513_1
GAATTCAAGAGGTTGATCCAAAAAAGAATGAGGACAGAGGGGCCGGTCTTTACTACTACCAGTCTGATGATCAAC
AAGAC
ATCACCAGAGGAAAGGGAATGGTTGACTCCCTTTTCCAAGCTCCTATGGATACCGGAACTCACAATGCTATCATG
AGTTC
TTATGAATACGCCAGCAAGGGGCAAAGAACATACGACTTTGACAACACCATGAGTGGATTCTACATTGCTCCAGC
TTTCA
TGGACAAGCTTGTTGTTCACATTACCAATAACTTCATGACCTTGCCCAACATCAAGGTTCCTCTAATTTTGGGAG
TCTGG
GGAGGAAAGGGACAAGGAAAATCATTCCAGTGTGAGCTTGTCATGGCCAAAATGGGAATCAACCCAATCATGATG
AGTGC
TGGAGAGCTTGAGAGTGGAAACGCAGGAGAGCCCGCAAGGTTGATCAGGCAACGTTACCGTGAAGCAGCTGACAT
AATCA
AGAAGGGAAAAATGTGTTGTTTATTCATCAACGATCTTGATGCAGGAGCTGGACGTATGGGTGGAACCACTCAAT
ACACA
GTTAACAACCAGATGGTTAACGCCACCCTCATGAACATTGCTGATAACCCAACAAATGTCCAGCTCCC

> SEQ ID NO:1248 139045_300406_1
CCCCGAGCCAAGAGGGGAAAAAAAAAGGGAAGAAATTTTTTTCTTTTTTTTTGTTCGCCTCCGCTTCTTCCTCA
CGCAG
CTCTCGCCTCGCCTCGCCGCCCGCCACTAGAGAGGAGAGGGAGAAGGAGAAGGAGGCGAATCCCAGCAAAAGAAG
ATGCA
GATCTTCGTGAAGACCCTGACGGGGAAGACCATCACCCTCGAGGTGGAGAGCAGCGACACCATCGACAACGTCAA
GGCCA

Figure 7 continued

AAATCCAGGACAAGGAAGGGATCCCTCCAGATCAACAGCGTTTGATATTCGCCGGCAAGCAGCTGGAAGATGGGCGCACA
CTGGCCGACTACAACATTCAGAAGGAGTCAACTCTTCACTTGGTCCTCAGGCTCAGGGGTGGCACTATGATCAAGGTTAA
GACCCTCACTGGAAAAGAGATTGAAATTGACATTGAGCCCACCGACACGATCGATAGGATCAAGGAGCGTGTTGAGGAGA
AAGAAGGCATTCCTCCCGTGCAGCAAAGGCTTATCTATGCTGGTAAGCAGCTTGCCGACGACAAGACTGCGAAGGACTAT
AACATCGAAGGTGGCTCTGTCCTCCATCTTGTCCTTGCTCTG

> SEQ ID NO:1249 139274_300408_1
CCCGGAGCAGCAGCGGCCGGCCATCATCAGTGATCCTCTACAATCATCGACTTTCAGCAAATTAAGATGGCTGCTGCCTT
CTCCTCCACCGTTGGAGCTCCGGCGTCCACTCCGACCAACTTCCTGGGGAAGAAGCTGAAGAAGCAGGTGACATCGGCGG
TGAACTACCATGGCAAGAGCTCCAACATCAACAGGTTCAAGGTGATGGCCAAGGAGCTGGACGAGGGCAAGCAGACCGAC
CAGGACAGGTGGAAGGGTCTCGCCTACGACATCTCCGATGACCAGCAGGACATCACCAGGGGGAAGGGTTTCGTCGACTC
CCTTTTCCAGGCTCCCACGGGTGATGGCACCCACGAGGCCGTCCTCAGCTCCTACGAGTACCTCAGCCAGGGTCTCAGAA
CGTACGACTTCGACAACACCATGGGAGGCTTCTACATCGCCCCTGCTTTCATGGACAAGCTCGTCGTCCACATCTCCAAG
AACTTCATGACCCTCCCCAACATCAAGGTCCCACTCATCCTGGGTATCTGGGGAGGCAAGGGTCAGGGAAAATCCTTCCA
GTGTGAGCTCGTCTTCGCCAAGATGGGGATCAACCCCATCATGATGAGCG

> SEQ ID NO:1250 139368_300409_1
CCCCCCCCGAGCAAGCAAAGGAAAGAACTTGCCTTGCACCACCACCTGATCAGAGAAGTAGCTAGCTGCAGGAGAGAAAC
CGACCAACAATGGCGGAGTACTACTCCAGCACCGTGGACGAGTGCTACGAGACCACCGGCAGGCAGCACGGCCACGGGCA
CGGCCACGGTCACGGGCACGGGCACGGGCATGGTGGCATGAGGGTGGAGTCCCACACCGACGACTACTACAGCGAGGGCG
GCGAGATCGACCGTGGAGGAGGAACAACTCCATGCACTCGCAGGAGTACCTGATGAGGCAGCAGAGCGGCCATGGCGGC
TACGGCTACGGCGGCGGCCAGCAGCAGGAGTACTACAAGCGGGAGGAGCGCGAGCACAAGCAGCGCGAGCGCGTCGGCGA
GATCGGCGCCCTCGCCAGCGGCGCCTTCGCTCTCTATGAGGGGCACCAGGCGAAGAAGGACCCGGCGAACGCGCAGAGGC
ACAGGATCGAGCAGGGCGTGGCGGCGGTGGCGGCGGTGGGCGCCGGCGGCTACGCCTACCACGAGCACCGCGAGCAGAAG
CAGGCCAGCTACGGCGCCAAGGAGCAGC

> SEQ ID NO:1251 168562_300557_1
GAATTCAGAGCTCAGACACAATTGACAACGTTGGGGCTAAGATTCAAGACAAGGAAGGAATTCCTCCAGACCAACAACGT
TTGATCTTCGCCGGAAAGCAGTTGGAAGATGGAAGAACTTTAGCTGACTACAACATCCAGAAGGAATCAACTCTCCATCT
TGTCCTTCGTCTTAGAGGTGGTATGCAAATCTTTGTCAAAACCTTGACTGGTAAGACCATCACTTTGGAAGTCGAGAGCT
CTGACACCATTGATAACGTTAAGGCTAAGATTCAAGATAAGGAAGGAATTCCTCCAGACCAGCAACGTTTGATCTTCGCC
GGAAAGCAGTTGGAAGATGGTCGTACTCTTGCCGACTACAACATCCAGAAGGAGTCTACTCTCCATTTGGTTCTTCGTCT
CAGAGGTGGTATGCAGATTTTCGTCAAGACCCTTACTGGAAAGACCATCACCTTGGAGGTTGAGAGTTCCGACACCATCG
ATAATGTCAAGGCTAAGATTCAAGATAAGGAGGGTATCCCCCCAGACCAGCAACGTTTGATCTTCGCCGGAAAGCAGCTG

Figure 7 continued

GAAGATGGTCGCACTCTTGCCGACTACAACATTCAGAAGGAGTCTACCCTCCATTTGGTGCTTCGTCTTAGAGGT
GGTAT
GCAAATCTTCGTGAAGACCTTGACCGGAAAGACCATCACTCT

> SEQ ID NO:1252 170330_301609_1
ATTCACCTCATGTTCTGCTTGCAAAGTTTCAATACACTGGAGTGAGTCAGTGAGGTTGGTGAAGCAGAGTGAGGA
AAGGA
GGATGGGAAGGGTGGCGCCTAGCGTCGAGGAGGTCGGGGGCGAGCAGCCGCCGCCCGCGCTTGGGCCCGGCGAGA
CCGTG
AGCGGGACGGTGGCCGAGCTGAGGGCGGCGTACGAGAGCGGCAGGACGCGGAGCCTGGAGTGGAGGCAGTCGCAG
CTCCG
GGGGCTCCTCCGGCTCTTGGCGGAGGAGGAGGCCGCCGCGTTCCGGGCGCTCCGCGAGGACCTCGGCAAGCACCA
AGCCG
AGGCCTACAGAGACGAGATCGGCGTGCTTGTCAAGTCGGCGAACGCCGCGCTGCGTGAGGTCGGGAAATGGATGG
CGCCG
GAGAAGGTCTGGGTGCCGCTAATCGCGTTCCCGGCAAGGGCGCAGCTGGAGCCGCAGCCGCTCGGGGTCATCCTC
GCCTT
CTCTTGCTGGAATG

> SEQ ID NO:1253 171236_300535_1
CCAAGATGCAGATCTTCGGGAAGACCCTGACGGGGAAGACCATCACGCTCGAGGTCGAGAGCAGCGACACCATCG
ACAAT
GTCAAGGCCAAGATCCAGGACAAGGAAGGCATCCCTCCGGACCAGCAGCGCCTCATCTTCGCCGGCAAGCAGCTG
GAGGA
TGGCCGCACCCTGGCCGACTACAACATCCAGAAGGAGTCCACGCTCCACCTCGTCCTCCGCCTCCGCGGTGGCAT
CATCG
AGCCCTCCCTCCAGGCCCTCGCCCGCAAGTACAATCAGGACAAGATGATCTGCCGCAAGTGCTATGCTCGGCTGC
ACCCC
AGGGCTGTCAACTGCCGCAAGAAGAAGTGCGGCCACAGCAACCAGCTGAGGCCCAAGAAGAAGATCAAGAACTAG
AGTTT
GAGATATCATTTCCGCGGATCATTGAAATCAACAGGAAGATCAGAGTTTAAGTTTTTTTGTAGTGTAATGCCTCA
TGTTG
TATGCCGAACTTTCTGTTTATCCTGTTGTATGTTAACCTTGGTTACGCTGGAGAGTACTCCAGCTTATTTTGATG
ACATA
ATTGACTACAAAGTCAAGGTTATATGGTCCGGCCTTAATTTTTGTCCCCTTCG

> SEQ ID NO:1254 171896_300624_1
CTTATTGTCACTTCCATCTCATTCTCCTAATGGTCATCACTAGCTTCTAGCTAGCTTAATTAATTAATTAGCCAT
GGCGG
AGGAGAAGCACCACCACCACCTGTTCCACCACAAGAAGGACGACGAGCCGGCCACCGGAGTAGACTCCTACGGCG
AGGGC
GTCTACACGTCGGAGACGGTGACCACCGAGGTGGTCGCCGGCGGCCAGGACGAGTACGAGAGGTACAAGAAGGAG
GAGAA
GCAGCACAAGCACAAGCAGCACCTCGGCGAGGCCGGCTCCCTCGCCGCCGGCGCCTTCGCCCTGTATGAGAAGCA
CGAGG
CGAAGAAGGACCCGGAGAACGCGCACAGGCACAAGATCACGGAGGAGATCGCGGCCACGGCGGCGGTCGGCGCCG
GCGGC
TACGCCTTCCACGAGCACCACGAGAAGAAGAAGGACCACAAGAGCGCCGAGGAGTCCACCGGGCGAGAAGAAGCA
CCACC
TCTTCGGCTGATCGACCTCATCACAACGTCGCCGGCGGGGCGACGACCTCGCCGTACGTCGCCG

> SEQ ID NO:1255 172017_301608_1
CCTCTTTTTTTTTTTAGCAATTATACATTAAAATCACCTCATCACCTGCGGATACTATTATGCCTATTAATTACT
CGACC
GGCAAAAGCCATCCCAGCATCCTCTTTCGGTAAAGCAGTGGCCTTCACATGCAAACATCGGCTATCGCAACTAAC
ACCCC
CTTCCCCTGTCC

> SEQ ID NO:1256 181950_300658_1

Figure 7 continued

GAATTCAGGAGGGTTTTTGTTAGGGCTGATTTGAATGTCCCGTTGGATGACAATCAGAACATTACTGATGATAGG
GAGAA
TCCGTGCTGCTATTCCAACTATCAAACATTTGATGGCCAATGGTGCTAAAGTCATTCTTACCAGTCATTTGGGAA
GACCA
AAGGGTGTTACTCCAAAATTCAGCTTGGCCCCTCTTGTCCCTAGGCTCTCCGAGCTTCTTGGCATCACTGTTGAG
AAAGC
TGATGATTGTATTGGCCCTGACGTTGAGAAATTGGTTGCTGCACTACCAGAAGGTGGTGTTCTCCTTCTTGAAAA
TGTGA
GATTCTACAAAGAGGAAGAGAAGAACGAACCAGAATTCGCAAAGAAGCTTGCTTCCCTCGCAGACCTATATGTCA
ACGAT
GCCTTTGGAACAGCACACAGAGCTCATGCTTCAACTGAGGGAGTTACCAAATACTTAAAGCCATCTGTTGCTGGT
TTCCT
CTTGCAGAAGGAACTGGACTATCTTGTTGGGGCAGTTTCATCCCCAAAGAGACCATTTGCTGCCATCGTTGGTGG
TTCCA
AGGTGTCATCTAAGATTGGTGTGATTGAGTCGTTGCTAGAGAAGTGTGATATTCTACTTTTGGGTGGAGGTATGA
TCTTC
ACATTCTA

> SEQ ID NO:1257 182235_300659_1
GAATTCGAAGACCGGATGAAGAGTATGATTATCTATTCAAGATCGTTTTAATTGGTGATTCAGGTGTTGGTAAAT
CCAAT
CTTCTCTCCCGTTTCACTCGTAATGAGTTTTGTTTGGAATCTAAATCTACCATTGGAGTTGAATTCGCTACTCGT
ACTCT
TCAGGTTGAAGGCAAGACAATCAAAGCACAAATATGGGATACAGCTGGGCAAGAGCGATACAGAGCAATTACCAG
TGCCT
ATTACAGAGGTGCACTAGGTGCTCTTCTAGTCTATGATGTGACAAAACCAACAACATTTGAGAATGTAACTCGGT
GGCTC
AAGGAACTGCGTGATCATGCTGACTCCAACATTGTGATAATGCTCATTGGAAACAAAACTGATCTGAAGCACCTC
CGTGC
AGTTGCAACAGAAGATGCTCAGAGTTTTGCTGAGAAGGAAGGGCTTTCATTCATCGAGACCTCTGCCCTTGAAGC
AATAA
ATGTTGAGAAGGCTTTCCAAACAATCCTTGGAGAGATATATCGTATAATTAGTAAGAAATCCCTTGCGTCAGAGG
AGTCT
GCACCGTCTAGCATTAAGGAAGGCCAAACAATTGATGTCTCAGGATCAGATGGCAATTCAAAGAAATCATGCTGT
TCTAC
TTAAGGGGTGATTTCTTCCATTCTTTATCCTTTCTGGTGACTAATGTTCTATAGGTCTCAAGTCTTTCAACTATG

> SEQ ID NO:1258 182468_300710_1
GAATTCCAAAGTAGTACTCAGATTGCAGAAGTCTGATCAGACATGGGTGCTGCTTTCTCAACCGTTGGAGCAGTT
AACAT
AGCACCTTTGAGCTTGCCAAGCTCTGGCCAAAGCTCTGCCTTCTTGGGCAGCAGCTTGAAGAAGGTCAATTCTTC
TGTTG
CACCAAAACCATCATCAAGAAGCTTCAAAGTTGTTGCTGCACAAGAGGTTGATCCTAAAAAGAATGAGGACAAAT
GGGCC
GGTCTTTACTACGACCAGTCTGATGATCAACAAGACATCACCAGAGGAAAGGGAATGGTTGACTCCCTTTTCCAA
GCTCC
TATGGATACCGGAACTCACAATGCTATCATGAGTTCTTATGAATACGCCAGCAAGGGACAAAGAACATACGACTT
TGACA
ACACCATGAGTGGATTCTACATTGCTCCAGCTTTCATGGACAAGCTTGTGGTTCACATTACCAAGAACTTCATGA
CCCTT
CCCAACATCAAGGTTCCTCTTA

> SEQ ID NO:1259 188984_300611_1
CACCACAATTCAAATATTATAGTTGAAGCATAGTAGTAGAATCCAACAACAATGAAGATCATTTTCGTATTTGCT
CTCCT
TGCTATTGTTGCATGCAATGCCTCTGCGCGGTTTGATCCTCTTAGTCAAAGTTATAGGCAATATCAACTACAGTC
GCATC
TCCTACTACAGCAACAAGTGCTCAGCCCATGCAGTGAGTTCGTAAGGCAACAGTATAGCATAGTGGCAACCCCCT
TCTGG

Figure 7 continued

CAACCAGCTACGTTTCAATTGATAAACAACCAAGTCATGCAGCAGCAGTGTTGCCAACAGCTCAGGCTGGTAGCACAACA
ATCTCACTACCAGGCCATTAGTATTGTTCAAGCGATTGTGCAACAGCTACAACTGCAGCAATTTAGTGGTGTCTACTTTG
ATCAGACTCAAGCTCAAGCCCAAACTCTGTTGACCTTCAACTTGCCATCCATATGTGGTATCTACCCTAACTACTATAGT
GCTCCCAGGAGCATTGCCACTGTTGGTGGTGTCTGGTACTGAATTGTAACAATATAATAGTTCCGTATGTTAAAAATAAA
GTCATACATCATCATGTGTGACTGTTGAA

> SEQ ID NO:1260 195971_300639_1
CCCACATATCAGACACCCGAGAGAGTCAAGATGTCGGCCAAGCCCACGACCAAGCAGTTCGGGAAGTCGACCCGGGAGGT
TCCCGCCTCCGCGGACCAGGCGAAGAAGTGGTACCCTGCCGACGACGAGAGCGCCCCGAAGAAGGTTCGCAAGTCCGTCC
GAACTTGGGCCCCCCGAAAGACCCTCCAGCCTGGTACCGTCCTGATCCTCCTCGCTGGCCGCTTCCGCGGCAAGCGTGTC
GTCCTCCTCAAGACTCTTGACCAGGGTGTTCTCCTCGTCACTGGTCCCTTCAAGATCAACGGCGTTCCCCTGCGAAGAGT
CAACGCCCGATACGTCATCGCCACCTCCTACAAGGTCGACATCTCCGGCCTTGACGCCGCCAAGATTGAGGAGATCTCTC
AGCCCAAGTACTTCACCGCCGAGAAGGCCAAGGAGAAGGCTTCCGCTGAGGCTTTCTTCAAGCAGGGAGAGAAGCCCCAG
AAGAAGGAGATCAACAGCAGCCGTGCTGCTGACCAGAAGGCCGTCGACAAGGCTCTGCTTGCTAGCATCAAGAAGGTGGA
TCTGTTGGCCAGCTACCTCGCCAGCACCTTCAGCCTGCGGAAGGGTGACAAG

> SEQ ID NO:1261 199906_300754_1
AATTGTTGGGCCTTTTGAGATCCGGAGTGCGGTTTGCACACACGGGCCGGCCACGAGGGGCTGCGGCAGGATCCCAAGAC
GCCGAGAGCCATGGAGAGAATATCTGGGTGTTTGCCCACAGAAGATCAGAACAGGTCATTTACAGCTTCACCAAGCAATT
GGATGGGTTCCATGGCCTGAAACTAGCTGCCGTTCAACGGCAANGAAGACCAANGCCTGCAAGAGCTTCGCACAAGACTA
CTGNGTCACCGNCTCGCCCACATTCGATTCCAGCCCGGCCAAGGATCCGTCGGCCGCTCGGTATTCCAGAAGCTGCGAGA
GCTGAAGCACCTTCACGAGGTTGCATGGACAGACGAGTTGCGACATAAGCGGCCGGAACAGTACACCAGCCAGGACAAGA
AGAAGATTGCCGAGGAGAAGGAAAAGGGATTCGATTACCAACCAATCCGGAGCAAGCAGGAGCGTGGAATCGCTCTCAAC
GCCCAGAAGCAAAATGCGATTGCCGATATGGCATCCGTTTTGGCGGGCGAAGGCCGTGGCAACAAGGTCTTGACCGCGGA
GGCTGAAGGAGGCGAGAAAGAG

> SEQ ID NO:1262 200152_300815_1
AATCTCGTTCCCAATCAACTCCGTCTGCCTCTCTCGCCCGCATCAACAACATTGCGAGCCACATCTCTCCCACAATGGCT
TCCACCACCAGTTTCCCGGCAGAAACGGTGCCCCAGGCGCCTGAAGATCCCCTCTTTGGCCTGGCCCGCGCCTACAAGGC
TGACAACAGCCCGCTAAAGGTCGACCTGGGAATCGGCGCCTACCGAGATAACAATGCGAAGCCATGGGTTCTTCCTGTGG
TAAAGAAGGCTGATGAGATTCTCCGAAACAACCCCGAACTGAACCACGAGTATGCCCCGATTGCAGGTATCGAGAGCTTC
ACCAGCAAGGCTGCGGAGCTGATGCTCGGCGCCGATTCGCCCGCTCTCGCGGAGCGCCGCACTACGTCTATGCAGACCAT
CTCGGGAACCGGTGCCGTTCACTTGGGAGCTCTGTTCCTCGCCAAGTTTTACAAAGGCAGCCAGACCGTCTATGTGTCAA
ATCCCACATGGGCAAACCACCATCAGATCTTTTCCAATGTCGGCATCAAGGTCGCCCAGTATCCCTACTTCAGCAAGGAG

Figure 7 continued

ACCCGGGGGCTGGACTTTGATGGCATG

> SEQ ID NO:1263 204925_300794_1
GTATCTTCACAGTGGCATGAAACGATGGCCGTTGGACAAACGCCACCACCGCTCCCATTTCCCGTTCTCGTTGGCCGAAT
GTCAAAAGCTGGCACAGTACGAACGCCGAGACAAGTGAGAGGAGCTGCTCCCCGGCTTTTCCCACCCCGCACTATGTGCG
CCTTAGGGGGCAAACCGCGGGAAATCTGGGGTAAATCAGGCCATAAGTCGAGATTTCTTCGGCGCTAGCTATCTGGCAA
AGGTTTTGGAATCCGTTCTAGAGCTCGAGGGCCCTTGCGTGGGCTGGTACGAAAAAGTAAGACTGCAGCGGTAAGATATC
GAAGGGTCGATGGACGTTGTTGGGACAATGGGTTGCATTTTCTGACTGCGCTGCGCTCGACCTGCATCCCCCGTCAGGCC
CCGTACATCGGCCAGCCCTCAACTGGACGGACGGCCTATGTGGGTAATGCGAGTACGGCGGTCGGGCTAAAATGTCGCGA
TGCTGGGTTAGGGTTCAAATTTCTTCAGCCAGCGAGCCTCACGTTGCGGTGATTGCACAGGGAATGTTCTCCCATCTGCC
GGAGCAGCCAGTCGCTAGCATCGTTCCCGTACAAGTACTAGAAGGCAAACCCTTGGTGAGCTAGCACACACAG

> SEQ ID NO:1264 206063_300804_1
ATGGGATTGAATCGTCTTTGAGCCATGGTTGAAAAGTGCTTGGGGAGAGGAGATGGGGATGTGGATTATAGAGGGTTCA
TCGTATTAGCAATTTAGCCTAAATAGAGCTTTTGTCTCTGCTACTTTGAGGCGTTGCTAGCAAGCGGTATCTTGGCTCGG
GATCGATGTATACAGTACTTGAGCCAAAGATGATATTGCTCTTGGCCATCCACAAAACTCCGTACGAGTACTCATACTTG
ATACTTCTCATCTCAAGTAATAGATGCCATGCCATAGAGGTAAGCAAGTCAACTTGAGGAACAGGGTATATACAGATTGC
CATCGTTCATCTAAATTCTCTTCGTGCACCTCTTTACCTTTACATGCACCAATTTGAGCACTACCTCCTCCCACTACCCC
TGGCCACGAACCATCAACATCATCAGACAGCCAAGATAACGGCCTGACTGCGGAGCCGGAACCAGACCCGGAGCAATGCC
GGAGCAAGGGACTACGGAATATTCGCATGAGAGATCGGAGCC

> SEQ ID NO:1265 208607_300807_1
GACAGCCTGAAACCGCGAGTACAAGCATGGGGTTGGAAGCTCGACGTGTGAGCTCTCCTTTCGTCTGCCGTCAAAAAGTC
GATGCCAAGGAGGGTATTGCAGATGTGTTGTTGGCCATCAGCTTACCACTGGAGAGATCCAAGCAGTCATCCCGTGTGCA
GGCACAAGCCCAGTAAGCCGCTGCTCCCAATATGGACCACGTCAGCCATGCCGCCAACCGAGTCCCTCACCGTCTTCCAA
GATGGAGATGCTGTAGGGCTCACCCAGCGGTCGAAACATACCGCCTGTCTGAGGCCCCCTCCAGGGCATTTGCTAGCCGA
CCTACTGTACTCGTGTCTCGTACACGGCAGTCGAATTGGTATACCTCCTCCGAAGCTGGTTCGTCATGCGCATGAAAAGG
GTGTAGCGAGCAAGACTCAGCCGGCCAATCACGAATATCTCGGGCATCCTTGTCCGTCCAGGAATAGGCACACCACTCGA
AATTAAGCT

> SEQ ID NO:1266 208615_300807_1
ATTCAGTCATCTTCGGCAGACAGGCAAGGAGCACCGAATCTCCCCGCGGATAAGGCTTCTTTTTTTCCGTCTACAAAACG
TCACCTGTGCAACAACTGAAAGCTCTCTGGCTTCTCCGATTCGGCGGTCCAGGCCTCTCTTTCCACCTCTTCCAACGTTT
CTTTCAACCCTCTCCCTTTGATCAGGCATTTCAGGATACCGCTTCTCGTCCTCACCGGCGATCTCCGACGAGCCAGATG
TTGAACATATGGTCTATGAAAAAAAAGCAAAAGGAGGCTGAAAATGCCGAAGGTCAGGCTGCTGGAGGGAAGAGGAACAA

Figure 7 continued

```
GGTGACGGCGGCACAGCTACGAGTACAAAAAGATTTGTCAGAACTATCTCTCGGCGCAACGATGAAGACTGACTT
CCCTG
ACCCCGACAATATCCTCAACTTTATCCTGTCGATCGAGCCGGACGAGGGCATGTACCGAGGCGGAAAATTCACAT
TCGAC
TTTGCCATCAACCAGAACTTC

> SEQ ID NO:1267 212388_300848_1
TGTCTTGTCATTATACTCGACCACGCGTCCGCAATTCTGGATCTGCTTGAGCCTTCTTTCTTCACTGTCCGCTCC
CAATT
GTCGCCTCGGTTCCACGGCTTCGGATTGGAACACGCGCCCACAGACAGAACGCTCCGTTTCCCATTGAGCGTCAA
CCTCT
ACTGAGCTTTCATCAATCAGTACGAGGCCATCTTCGACAATTTTCAGAAAAAGAAAAAAGCCTTTCGAGAACATC
AATTC
GGAAAGAAGAGCCACTTCTTCACCATGGCTGATGATGAGAAGCACGTTGCGGAGCCTGCCATTTCGGACGTCGCC
CCCGT
CGACTCCTATGCGGCTGCCCAGAACGAGTTTCATGACCGGCCTCCCGGATGGATTTACAAGGGCCACAAGATCTT
CGGTA
GGGAGATCTACTATGCCTCACCCAGAGTCCAGCTCGTGCTGGTTGCTCTCGTGTG

> SEQ ID NO:1268 212412_300849_1
CTTTTTGATATCTCAAAACTCCCCAAACAACCCACATCAATCATCATGACTGGACGCGGCAAAGGTGGCAACGGG
CCTCG
GCAAGGGTGGTGCCAAGCGTCACCGCAAGATTCTTCGTGACAACATCCAGAGTATTACCAAGCCCGCTATCCGAC
GTCTC
GCTCGTCGTGGTGGTGTCAAGCGTATCTCTGCCATGATCTACGAGGAGACCCGTGGTGTCCTCAAGTCCTTCCTC
GAGGG
TGTCATCCGTGATGCCGTCACATACACTGAGCACGCCAAGCGCAAGACCGTCACATCACTAGACGTTGTCTATGC
TCTGA
AACGACAGGGCCGCACCCTGTACGGTTTCGGTGGTTAAGCGATCTGCCACTAGGTCGGGTCGACATAATGTGTTA
TTCGC
GTGTTTGTTACGATTGGGCTTTTCACTATGGGCGCGGGTCATTGCTTTTTGAGATTTCGTACTGTATAACGTACT
GGGAA
ATGGGTGACCCCCGAAAGGGGGTAATTGAGACTTATTCAGTGGTGACCT

> SEQ ID NO:1269 212475_300849_1
GCCTCGCTGCTACTCTCAATTGAACTCGACTCGAGCTCCGTCAATCGCAAATCCCTACAAGATGCTGCGCTCTAT
GGTTC
TACGAGGCAATGCCTTGACGCAGACCACCCGACTGGCTGCATCCAGGGCCATGTCGAGCCAGGCGCTCTCCAACC
CGACC
CTGTCCAACATCGAGAAACGCTGGGAGGGAATGCCTCTCCAGGAGCAGGCCGACCTGTGGATGGCCCTGCGTGAC
CGCAT
GAAGGGCAGCTGGAACGACCTGACCCTGCAGGAGAAGAAGGCCGCTTACTGGATCGCCTTCGGCCCTCACGGCCC
CCGCA
CCGTTGACGCTCCCGGAGCCGGTGCCCGTGTTGCCTGGGGAGTTGCCGTTGGCCTTGCCGCCTCTCTCGCTCTCT
TCGCT
GCCATCCGAGTTGCCGCCAAGCCTGCGCCTTACACCATGAACAAGGAGTACCAGGAGGCCACTAACGAGCTTCTC
AAGGC
TCAAGGTGCTGATCCCCTCACTGGTATCTCTTCTCCCGGCTATACTGGCAAGGGTGTCGTGCAGTCTCCTCCCAA
AAACT
AAAATAAAACACGATAATATCGCTTCAAGCTTCGCACAATTGGGG

> SEQ ID NO:1270 212486_300849_1
GAAAGCTCATCAACGGCACCTGAGCAGGGTCCAATTGCTCTGTTCAGCTCACTTAAGCTTTCAAGATGCCTAGAG
ACGGC
GAGTAAACAACCGCCCTCAGCGGCGACAAACCTCATCGCTGGTGGTGGCGCCGGTATGATGGAAGCCCTCGCCTG
CCACC
CTCTAGACACAATCAAAGTGCGAATGCAGCTCTCTCGC

> SEQ ID NO:1271 212581_300850_1
```

Figure 7 continued

GTGATATCTGATATATATCAAACAGCCCAGCACACCATTCCAAAAACTTCAAGACCCTCGAGTCTACATCAACAACTCTT
ACATCTTAAACAAACTGCTTCAAAAGCACATACACAAACCGGTTTCCCCCAGTTTCACCCCCAAATACCTTCTGAGTGGC
AATGTCCCCTTCTGCTATCAGCAACTCCCCAGAGCAGCGACCTGCAAACAACGGCACCACCCCCGACAACTTCGCTATCC
AGCCTCCCGCCGACTTCACCGGCTATGACCACGTAACGTGGTGGGTTGGCAACGCCAAGCA

> SEQ ID NO:1272 212713_300843_1
GACAAATCAAAACAACCATGCCTCACAAAGGGAAGTCAAAAAAGGGCGAATTTGAAGCAGAATTCGATCTCGCCCCTACA
GAGAAAGCGCGATCTCTTCCAGTAAACAAACGAAAAGCGGCATCAAGTTCTGGAGAGCAAGTCACAAAGAAGCGTGCCAG
AAGCTCATTAAGAGGCAATGACACTCCGCGAGCATTCAAGAGAATCATGGCTGTGGCAGGGGGGAAGAAAATTAGATCAG
GCTTGGATGATGGTCAACTCGAGAAAACGACTACGAAGGCTACCGATGTAACGAGCGAGAAACTTCAAATTCGTCCCGGT
GAAAATTTAGGGGCCTTTGCCAGCCGGGTTGATGCGGGTCTACCAGTATCAGGGCTTGCGAAGAAAACCAGCACGAATGC
AGAGGGCAAAGACGCATTAGGATTGAAAGTGTATCGCACTCGCAAAGAGCGCAAAATGCACAAACTCTACGATCAGTGGA
GGGCATAGGAATCCAAGATACGAGAAAAGAGGGAGGAGGAGCT

> SEQ ID NO:1273 212947_300845_1
CTCAACAAGCGACAAATTATCGCCAGGGTGCTCCAACGCTCGCTCCGCCATCGCCAGTATCCTTTGGACCCATACTTTCG
CTCTACAACACACACAACCCCTCTTACGCCCACATAGCTTCGGCTACGTCAAGTTTCGGCATCATGTCTAGCAGAGATCG
CCGTATAATGAAGGAGCTGCAGGATCTGACCGAGGACAAGGACACTTCCGGCATTCATGCTGCCCTAGAACAAGAGGGCT
CGCTGACCGCTCTCAAGGGCTGGTTCTTTGGCCCTGGAAATACGCCGTACGCTGGTGGCAAATTCGTGATTCACATTCAG
CTTCCCACCGACTACCCCTTCAAGCCACCCAAGATGAAGTTTGAGACCAGGATCTGGCATCCTAATGTCAGCAGTCAGAC
GGGCGTCATTTGTCTCGACACCCTCAACAAGAACTGGTCGCCTGTCCAAACGATCAAGACGGCTCTCCTCTCCGTCCGAA
TGCTTCTCGAAAACCCAAACCCCTCAGATCCACAGGACGGCGAAGTTGCACGGATGCTGCTCGACAGTCCCGACTCGTTT
GTCCAGATGGCTCACGAGTGGGCAGTCAGGCACGCCGG

> SEQ ID NO:1274 213079_300846_1
GCTTGATCGCATCTACCGAACTCCGGAGGGGTCGCCAAAGGTTCGCACATTGTATTTTCGAAAGCGAACATACACATATA
CACAAACAAATACAATATGTCGGACAACCCTACGACAAACGGGCACGACGCCCTTCGAAGAGAAGCTCGGCCGCCTGGCT
AAGAAACCCGGCATCAAGGACAGCCTCGTTTAGGACCGATCAAACGGCGCACCCCTCAAGAAGAACGGGCACATCCACGC
GCTCCACACGGCGAAATCCCGAAACGCGTCAACGGCGGCCTCATTCTCCAACGACGCTCCCGCATGCGGACGAGGGCGAG
GCGCACGGCGTCGAACAGTTTGCGGAAATGATCTGCAACTTCGTCAACAGCTCCGGG

> SEQ ID NO:1275 213124_300847_1
ATCGTCCCTTCGGTTGCACGGTTTCAGATGGGAACTCGCGCCCACAGATACAAATCGCCGTATCCCATCGAACGTCAAAC
TCTACTGAGCTTATATCAATTAGTACTATGCCGTCTTCGAATATTTCCAGAAAAAGACATCTGCCTTTCTATAAAATCAA
TTAGGAAAGAATAGCCAGTTCTTCACCATGGATGATGATGACAATCATGTAGCATGGCCTGTCATTACAGACGTCTCCCC

Figure 7 continued

```
CGTCCAGTCCTATGCGGCTGCCCACAAGGAGTTTCATAAGCGGCTTCCCGGATGGATTTACAAGGGCCACCACAT
CTTTG
GTTGGGAGATGTACTATGCCTCATCCATAGTGCAATTCATGATGGTTGATCTCGTGTGTATCCTCTGCCGCGGGA
TGTAC
AATTTCTTGACTGGTCTGGGATGTGGTGG

> SEQ ID NO:1276 213128_300847_1
CTCAAATAAACCACTCAATCGATTCCTTGATACCCCTTGGGACAAATCTACTTGTTCTCTCCAAACTTATCCCTC
CAAAT
ACCATCATCACCATCACCATGATCAAAGATGTTTCTACCAACGGGTCTTCTGCCGCTCCTGCTACCACCTTTGCC
CTCAA
GGCTGGTCTCGCCCATATGCTCAAGGGCGGGGTCATCATGGACGTCACCAACGCCGAGCAGGCCCGCATCGTCGA
AGAAG
CTGGTGCCTGCGCCGTCGTGGCCCTCGATCGAGTGCCCGCCGATATCCGCAAGGACGGCGGCGTCATCCGCATGT
CCGAG
CCGGGTATGATCAAGGAGATCCAATACGCCGTCACCATCCCCGTCATG

> SEQ ID NO:1277 213169_300847_1
CCCACGCGTCCGCCCACGCGTCCGATCGGTGGGTTTCTTTGGGAGCGTTAATCGACCTTGCTCATTCTTCATACC
ATCGG
CGTCGTTGGCATTTATACGGCATCTCGTCTTGTTTCCTTCGTACTCGAGGTACGGTACCCTGACCG

> SEQ ID NO:1278 213242_300851_1
AAGAAACACAAACAAGCAAATCAATTCCCGAGCAAGAAAAAAAGAAGAAGCCCATCATGAAGATGCTTTCGTTTG
CCGCC
CTCTCGGTGCTCGTGTTGGGCGCTTCGGCCCTGGCTGCGCCGCCGGCCCACCCCCGGCCGACAATGGGTGCTGC
TGCTG
CGACATCAACAAGAAGAGAATCGACTGCGACAGGTCGATCCCGGCGTCGGAGTGCATCTGCCCCCAGGTCATCTG
CCCCG
CCGGCGCGCCCACGTTCACGCACGGCACGCCGCCGAAAGCCACCCCACCGCCCACGCCGCTGCCGACTTACAAGC
AGTGC
TGCTGCTGCAATCCCAACATTAACAAGATTGTGTGCTCGCTGAGGCTCGTGGAGGACTGTATCTGCTTGGCCGTG
ATGTG
TCCGACGGATGCAAAGACCATCTTTGTCAGGCCAACTGGCGTTCCGACTGTCGCTTAAGAGTATTCGTTGGCGAG
CCGAC
TTGCCTGAATCCTGGACCGGGGACATGACATGGGGGGAGGGAAAATACAGGCCAAGGCATTGCTGATGGTGAATG
CACAA
CACGCGTGGCAGACTGGCCGAAAATTGATGATTTACTGATGGGCGACTTTGGACTTGAAATGGGGCATG

> SEQ ID NO:1279 213793_300860_1
CGTTCGGGCCCTCCGTCCTTTTCTCCGAGTCACGCACAGAGACACCAGCTAGCCACGATGTCTACGCAAGCCGCG
CACCC
GGCCCTGCTCATCCCAGGGCCCATTGAGTTTGACGATGCTGTGCTCCAGTCCATGAGCCACTTCAGCGAGTCTCA
TGTTG
GCCCTGGCTTCGTGGCCACCTTTGGCGAGACTCTGAGCATGCTCCGCCAGCTCTTCCAGACCACCGATCCTGCCT
CTCAG
CCCTTCATCCTCAGCGGTTCCGGCACCTTGGGTTGGGATTTGGTGTCTGCTAACTTGATTGAGCCCGGCGAGGAC
GCTTT
GGTTCTAAGCACCGGCTACTTTGGCGACAGCT

> SEQ ID NO:1280 213839_300861_1
CATGTGGCCACGGGAATGACGCAAAAGGCGCCGAGAGCGGAAATGGAGAGAAAAAAAACCCAATTGCACCTCGCT
GATGA
TGCCACTCAAATGTCTGTGGTCGAGCCACTGTGCTTCTACCTACGACTTACATTACCTAACAAGGCAACGAAACA
TTTTG
CGGCAAGGAGAATTGGATCATTGACTTGGCGAATGGGCTAATGAATGTCGTCAATTGCAGGCCTCGTGGTTTGGC
G

> SEQ ID NO:1281 213904_300862_1
```

Figure 7 continued

GAAGTCGATTGCCGGAGGCGGTGCCAACACCTTCTACGGCCGACCTGGTATCAACTTTTACACGCAGCTCAAGAC
GGTGA
CGGCGTTATGGCAGAGCGCCGATGCCGTGGC

> SEQ ID NO:1282 213967_300862_1
AGCAAATACCGCAAAGATGTCTGACGACGGGCTCTCAATATACGATGAGATCGAAATCGAAGATATGACCTTCGA
CGAGG
TTCTTCAAACATACTTCTACCCGTGTCCCTGCGGCGATCGTTTCCAGATCGCTATCGATGACCTGCGCGACGAGC
AGGAT
ATTGCTGTGTGCCCCAGCTGTAGCTTGATGATTAGAGTTATTTTCGACCTTGACGACTTACCCAAACCTCCTCCT
ACTGG
CAATACTGGTGGCCAGATACCAGTCGCTGCTTAAAGCCATCGCTATATTTGAGCTTCCCTGGGCGAATACTTGAT
CTATT
CGGCAGACACATCGAGATACTACACTAATTAGGCCCGCATAGCGTACACAGTGCCTCAACGGCCGTTCTGAAGAG
GCTTC
TCAGATTGATCCGTCTAACATCGGATGTATTGATAGACGCGGACGAGAAGACGACGATGTACCAGCGACAGACCA
AAGTC
ATCCCAAGCATCCAAGCTACTGATGCAAAAATATGCGTGCCTTGGGAGTACCACTCTCCGAGGCAAAAATTCAGT
CACTT
AAAGAGACAGGCTTCGGGAATGCCATGAAGAATTCAGGCTCACGTGGGGACATTTGATGAAAGAA

> SEQ ID NO:1283 213984_300862_1
GCCGAGATATCCGGCTCTTTGGGCGATTTGGGCACCCTGCTTCCCCTGATGATCGCCCTCGCGGCCAAGGGGTAC
ATCGA
CCTGGGCTCGACGCTCGTCTTTTCCGGCGTCTTCAACGTCCTCACCGGAGTTGTCTTTGGCATCCCCTTGCCCGT
GCAGC
CAATGAAGGTATGTCATGTCCAAGTACTACTGCTATTACTACAGTAGCTTGCTGTACTCGTACGAATATGTATGC
TGTGT
GGAGCACTCTTTACCCCCTGGATTTAGACCTCGGTACTCGATACGATACTCCGTATACATGCCTACATACAACTA
CACAC
ATACATGACTGTCTTCTTATCTGCCCAAGGAGCCTTACTTTTTTGCTAATCCTCTTCCCGCCTCATGTGGGTACT
TAGGC
CATCGCC

> SEQ ID NO:1284 214159_300855_1
TACAAACACTTCTCACATCTCTTCCACCCTAAGGAATATCCGTTAACAGTGCATCTTCTTGCACTCTCTACGAAT
CTCCC
AGCGGCCAACGCTTAATCCGCCACCATGCAAATCTTCGTCAAGATCCTCAGCGGCAAGAGCATCACCCTCGAGGT
CAAGT
CTTCCGATACCATCGACAATGTTAAGTCCAAGATCCAGGATAAGGAAGGCATGCCTCCTGACCAGCAGCGTCTGA
TTTTC
GCTGGGAAGCAACTCGAGGATGGCCGAACTCTGTCCGACTACAACATCCAAAAGGAGTCCACCCTCCACCTGGTC
CTCCG
GCTTCGTGGTGGTATGCAGATCTTCGTGAAGACCCTCACTGGAAAGACCATCACCCTCGAGGTGGAGTCATCTGA
TACCA
TCGACAACGTCAAGTCCAAGATCC

> SEQ ID NO:1285 214170_300855_1
ATGAATTCCGCCTCGCGACCCGGCCAGGGGCAATTGTTGGGCCTTTTGAGATCCGGAGTGCGGTTTGCACACACG
GGCCG
GCCACGAGGGGCTGCGGCAGGATCCCAAGACGCCGAGAGCCATGGAGAGAATATCTGGGTGTTTGCCCACAGAAG
ATCAG
AACAGGTCATTTACAGCTTCACCAAGCAATTGGATGTCAGTTTCGCCGTTTCTATCTCCAACTCACAGCCTGCCG
TATCA
TAGTATCTGACTGGGTGTCATAGGGGTTCCATGGCCTGAAACAGCTGCCGTTCAACGGCAAGAAGACCAAGCCTG
CAAAG
CTTCGCAAAGACTACTGGTCACCGCTCGCCCACATTCGATTCCAGCCCGGCCAAGGATCCGTCGGCCGCTCGGTA
TTCCA
GAAGCTGCGAGAGCTGAAGCACCTTCACGAGGTTGCATGGACAGACGAGTTGCGACATAAGCGG

Figure 7 continued

> SEQ ID NO:1286 214221_300856_1
CGCCAATCTCGAACGCCTGTCAAAATGCTCTCCCGCGCCGCCACTCGCACCACCTCCGTGGTCGCCCGCCGAGGCTTCCA
CACCACCCGCCCTCGCATGTCCTCTCCTTACCACTACCCCGAGGGTCCTTACTCCAACTTGCCCTTCAACCCTCGCAGCA
AGTGGTTCGGCGCCGGCTACTGGGCCTTCATGGCCACCGGCTTCTTCGCTCCCTTTGGCATTGCCGTCTACCAAACCTAC
AAGACCCAGTAAACGGATGCTTCGATTACAAAAGGCTTATATGGGCTGGACGCTTGGTGCTATGAATGGGTGGTGGACTG
TTGCGACAGAGTAAATAGCTCGAATTAGACGTGGGACCAATTCACAAGTCACATACATCANAG

> SEQ ID NO:1287 214235_300856_1
GAAGCAACCAAGAATCTGCACCTCACTCGATAATAAAAAGAAATCGGTACTCAAGGTTTATAACTCATTCAAAATGCGTT
ATACTGCTGTCCTCGCTGTCCTCGGCTTCTCCGGAGTCATGGCCAACAAAAACTTCGGACCCTTCGGATTTTTCGGACCC
TGGTTCGATGGCGACTTAACTATCGATGACCTCGCTGACTTTCAGTTTCCTGAGAACCCTTGTGAGTTCATTGGTGGTAC
TTGCGAGATCGCCACTTCCCTTACATTCTGCGCTGGTCGGGGCGACTTCAGCGTTGATTTGCCTTGTGGCGTTGGCCTCG
GCTGCTGCTGGCACCAGGACACCAGCAATGTTTGGTTTGAGCAATGGAAGGAGTGGCTCGAGCTACACAGCCGCATCAAC
TAAAGCCGCTTTAATGTCTTGACGCTTTGATGGCTTGACGCTTCTATGGCTTGACGCTTCTATGGCTTGATGCTTTAATG
GCTTGACGGAGTCTTCAATTGGCACGGTAGTGGGTGATGGAGAAATTAGCCGTACTGAACTCAATGAGAGATTGTTAACC
CTGAAAA

> SEQ ID NO:1288 214236_300856_1
GCAGGAGATCTTCGGCCCCGTGCTGGTGTGCCTCAACGTCGAGACCATCGACGACGCCATTGAGCTCATCAACAAGAACG
AGTACGGCAACGGCGTTGCCATCTTCACAAAGTCGGGCGCCACCGCCGAGACGTTCCGCAAGAACATCGAGGCCGCCAG,
3TGGGCATCAACGTGCCCATCCCCGTGCCGCTGCCCATGTTCTCCTTCACCGGCAACAAGAAGTCGATTGCCGGAGGCGG
TGCCAACACCTTCTACGGCCGACCTGGTATCAACTTTTACACGCAGCTCAAGACGGTGACGGCGTTATGGCAGAGCGCCG
ATGCCGTGGCCAAAAAGGCCGCGGTGCACATGCCCACGCTGCAGTAGAAGATGAAATTGGGTTGAGCGGTTTAGGATTGT
TTGTGTGCGGAATATGACGGAATGGTGGGAAAAATTGATGATGCCTTGATGAAATGAAGGGTGGTTGTCTCACAGAACAT
GCATGTACTGTACATAATATAGCCACGAGCAGATGGGCTGGACAGCATGGGAATTGCTTTTTTTAAGCAGAATGAAATAA
ATCTACGTTAAATC

> SEQ ID NO:1289 214273_300856_1
GGACGGCAGCCATGAATTCCGCCTCGCGACCCGGCCAGGGCCAATTGTTGGGCCTTTTGAGATCCGGAGTGCGGTTTGCA
CACACGGGCCGGCCACGAGGGGCTGCGGCAGGATCCCAAGACGCCAAGAGCCATGGAGAGAATATCTGGGTGTTTGCCCA
CAGAAGATCAGAACAGGTCATTTACAGCTTCACCAAGCAATTGGATGGGTTCCATGGCCTGAAACAGCTGCCGTTCAACG
GCAAGAAGACCAAGCCTGCAAAGCTTCGCAAAGACTACTGGTCACCGCTCGCCCACATTCGATTCCAGCCCGGCCAAGGA
TCCGTCGGCCGCTCGGTATTCCAGAAGCTGCGAGAGCTGAAGCACCTTCACGAGGTTGCATGGACAGACGAGTTGCGACA
TAAGCGGCCGGAACAGTACACCAGCCAGGACAAGAAGAAGATTGCCGAGGAGAAGGAAAAGGGATTCGATTACCAACCAA

Figure 7 continued

TCCGGAGCAAGCAGGAGCGTGGAATCGCTCTCAACGCCCAGAAGCAAAATGCGATTGCCGATATGGCATCCGTTT
TGGCG
GGCGAAGGCCGTGGCAACAAGGTCTTGACCGCGGAGGC

> SEQ ID NO:1290 214288_300856_1
CCCACGCGTCCGCATCCATCGTCTTTGATTCATCAAACAGCTCTTGGATCCGTTCTGATCCAGCCAACCAACCAT
CGCCA
TGTCTGAACCTCTCACCAAGGTCGACTCCGCCGTTCAAGGCCTGTCATCATCACCGCCCAAAGAGAAGGGCCATA
GGAGA
ACAAGCTCTAGCGCGGCTGGTGTTATGACCATTGCGGAAATCAATGAAAGCCATGCTCCTCTAGAACTCGCAATA
GAGAC
ACAGCAGACAGCGTGGAAAATAAATCAGCGGCCCAAGGATCTCGACAATGATCAGCTGCTACAGGTTCCCCTCAC
CAAGC
CTCCCATCAAGAGCATAACATTGAGGTTCCCTCATGGCAAAGAAGTCGTGGCTCGCAACCTGAAGGGCCTGACAA
TAGGT
GACGCCCTGTCGGCCATTCACAAGGCAAACAAGAACCGAGCTGATGATGAGCTTGATAATCCATACCTCAAGGGC
TTCGC
ATGGGATCAGGGCGAGAACTACTTTGAAGTACATCTC

> SEQ ID NO:1291 214316_300857_1
GAAAACTCAAAATTAAATTAAACATAAAGACAGGCTCCCAAAAGGCTGTGACCTCTTCTTATTACATCTTTACAA
GCCTC
CATAGCGTAAGATTCCCTCCACAAGGGTCGGGCTGATTTTATCCTGTCGGAATAATCACTTGCGTAATTCGACGT
CGTTT
CGCTCGCTTCTTACGGCAAGCCTACAAATCCCATTCCGGCAGCGAGCTCGCCTGGCGCGTGCCAAAATACGACGA
CCGAA
AACACCAAGTGCATGTGCCAACGGTGATTGGATTTGTGCGCTCCGAGATACCCAAACCAAAAGTACATGTTAGGA
TGCAC
GCGACCACGCCATGATCGGCGCTTGATCACGGGCCCATAATCGAGAGAGAGGCGCCGCTACCGGACGATAGAACG
GAGGG
AATAGACAGATAGACGATAGACGGGACGAGCGATCGATCAAGTCAGAGACAACAAATACCGAGTGGCGATGCCTT
CATCC
GATAGTCTTGGGAGGCGGGCCTCACACGGCGCTGCCAGCCTGGCGACGTCGGCATCTTCTATACACGGCGCAGCA
GTTGG
GTTTCGAGAAGGCCTGGGCTTGGCTGGAGTTGCG

> SEQ ID NO:1292 214321_300857_1
TGTGAGAACAAGCCACATCGGGGAGACGGGAAGATGGTGACACGGATGCGTTTGTGGAGGTGGGTAAGCTTTGCG
CAACA
TGTGCCAGCCTTATCTTGATATTGGACGCGGCGACGGCGAGATGGTTGGAAGGGTGTGTCTATGTGTACCGACAA
ACGCA
TGGCTGATGAGACGGTGAATAAAACTGCACCAAGAAAGAGATGCATGAGAGATGAATGACCAGTACCTAAGGTCT
ATGAC
ATGTCGCTTTGCACTCGGTCGGACTCATTCACATGTAGTAAATACTACATAACACCCACTTGCTCCAGTAATCAT
CACTT
ATAATAATACGGCGAGAAGACAAGTTGACACAGGGCGAAACAGGGCGGAACAAGGGGCGAAGCGAGGTGGAAAAT
GGTAA
ACGCAGAGACTCTTTCTATGTACTAGCCATCGATCAAAAGGAAGGACAGCTCAGTCTTCGCTGCATGCGAAAAAA
AAAAG
AAAAAAGCACTCAC

> SEQ ID NO:1293 214476_300858_1
GCATTTTGGGGTCGCAAATCTACAGCAAAAATGGCCTCGACAACGACCAAGCAGACCCCGGCGTCCTTTGTCGGG
ACCAG
CAAGGTCGTCGAGACTGACTATCCGCTCATCGACAACGACCCTCACTTTAAGCGGGTTATCGGATATGCGAGAAC
GTCAG
ACTACGTAGCTGGTGCAACCTCTGCGGCCTTTGCACCGACTGCTCTCTATGCCCTCGAGAGGCTCGCCCCGTCGC
ATGTT

Figure 7 continued

GGCCGGGGAGGCTTTGCCAAAGCCATGCGGTTAGCCGGATTCATTGGCTTGGCCGGCGGTTTCCTCTACTTTTAC
CAGCG
ATCAGCCCTTCGATTCTACGGCGCCACTGAGAACTCAAGGGAAGTCGAGATGGATATGCGAGAGATGGTTTCCAA
GGTCA
AGGCGGGACAGCCTCTGTATGGCGAGAGCAAGCTGAGCCCTCACCTGCAGGGAGTTGCGGCCCGACAGAGCAGAT
ACTCT
GCGCTCTTTTTCAGCACAGTACCGTGGTTCAACTTTGTCAACCACAACCAGCACGGCGTGGACACGGCCAAGTAC
TATCA
GCAGGCCGAGAGGGAACTGGAAGCAGAGCGGGCGGCGGGCAAGAGCTAGACGGGACCAAATGTGTATA

> SEQ ID NO:1294 214506_300859_1
GCCAAACAACGCATCTTACGGCTTCACAACAGCTTGGAAAGCTCTCTATTCGCAATGGCTATCGCACCGATCACT
GGAAT
GCTGCGGCGACAGCTCATCCTTGACCTCGGCGTTGGTCTTGGATCCGGATTCATCATGGCCAACTGGTACTGGTA
CGGCT
ACCACATGCCCCGAACCAACGGCCGAGACGCCTACTACGCCAAGAAGGAGGCCGACCGTGCCGCCGCGGCATCAC
AGTAA
GGGGGGCACTTGTATACTCGATGGACCGAGAGGGAATGCGGCATGAACAACTGCTGGTCGAATAGAAGGGGAATG
ACTGG
GCCAACGGGCTGTTCATGCCTGCAGGAGCATAGTTGCTGGACAGATGTCGAATATCACTGAAGAAAGGCAACCGG
GCGAA
CCTCTACTTAGACCAATAAGTCGCGGGGCAATACGATTCAATTATCTCGATTGGCTTATTATATGTTTTTGCCAT
GCCGA
CTCCCCTTTGTTTATTGCTGAAAATAGTGCTGGTGGTTTCTTTCCAATTATGTACAAATTATGTGCTA

> SEQ ID NO:1295 214605_300863_1
ATCAAACTCTTAATCTCTATTCTTAAATACATCTACCTCTCACAATGGATTTCGTCAACAAGGCTATGGGCAAGG
AGGAG
CGCTCCACTCAGGGCACCGCTCCCGCTGCTCCCCAAGCAGGCGGCCAGGTCCAGAAGGACGATTACGTCGACAAG
GCTTT
CGCCATGGGTGCCAAAAAGAGCGGCCACAACATGGATCGCAACACACAGGAGAAGATTACGGATGCAGGCCGTAA
CATGT
ACGAGAAGGTGACAGGAAACAAGGTCGACCCCAAGTGGTCTAATTAATGAACGGACGAGTTATGACTCACAACAA
GACTG
TACAATAGTAATAATAACATCTTATCAACG

> SEQ ID NO:1296 214725_300864_1
ATTTTACCAGTTGCAACAAGCCACTGAATCAATCAGAAAAACCATCAAACAAGACAATCGGCATCAATCTAAATA
TCGAG
CACTCATCAATCGAAATGATGCCGCTGCACAGGCCGGAAACGCCACAACCCGAATCCCCTCTTCCCACCGAGCCC
GATAC
CAGCGAGGGCGACGGCACTGCGGATTACTGAGGGGCAACACAAGCTCAAACTTTGATGACGACAAGGGCCGCTCG
GGAAT
GAGAGAATACGACCGAGTCTAAATGGCACTCAAGAGCGGCGTCGAAATGCTGGTTGCGGAAACGAACTGGGGAAA
CGACC
TAGATTGAATAGACATGCTCGGAGATGGCGCATGGAGGAAACGTCTATGAAGCGCATGTCTTTTTTTGGCTTTCT
TTGTT
TTTTCTTTTTACGGCCGACGACGACACGATACGCCGATAACATATACACTTGCCCCCGCCACTGCCCAAAGAGCG
CGATT
CTGCGGGGGTAGCAGTTTTATCAGAATGAATGCGGATTGGAATTGAGCGAGCGATGTACATTATTTTGTCTTTTA
TTTGA
TTGAGAAATTCTTTCAATTTTTTACGCATTTATCATTTGCCAATGTTGTTGTTGCT

> SEQ ID NO:1297 214966_300876_1
AACCCTCCAGGGCAGCTAGCGAAGAGAGCAGGCCCAGTTCCGGGTGACAGGTCGGGCAACGCCGCGACGGCTGCG
ATTCC
GAGCGAACGGCGCTGGCGTTCCAGACGGCACAGCAGCAAGCACAGCAACAGCACAGCACAGCTACGAACATCGAG
GATCC

Figure 7 continued

CGCTCCAGGAACCGGTGCTATCCAGAACAAGGCCCCGGCGCTAGGACCCGCGGTTGGCAGTGGTGGATCGCAAGG
CTCCA
GTCATGCCATGCAAGCGAGGGAAAAACGCTTGCATGCTCATGCTTTGCTCTGGCTCTAGATGAGTCTGAATCTCA
TCCAT
CCTCGACCTGCTGCTGTGTCTCCCCGTCCCGCACGAGGCTTCGGTCGGCGAGAGCCGGGATCGAGGCGTTGGGGG
ATGGC
GTCTGTGAGCCAGACATGACCTGTCACAGCGCTGCGTCGATGATGAAAATGGCCTGATTTCTTGCTCGCGGAGCT
ATGCC
GGGACCCTGCAACCGCGAAATGGGCTGCCACCGGCCACAGAGAAAA

> SEQ ID NO:1298 215015_300877_1
GCGTCTGAAGCTCTTCGCTGACCCGCTATGGCGGGGTCGGTGTCAGCGAAGCCTCGCCTCTGTAGCCTCGCAACA
ATCGC
AATCACCATCGCAGTATGGGAAACCGCCCTTTCGCTTTGAGACGGGCATTGGGCTGTTTGCAAAGCGGTCGCCTC
GGCCG
TTCCCGCCGCCCTTCTTGTCCCCTCCATCTGTATCCTTCTCAGATCCCCTAAGCACCCATCACCAGAGTCGGGAC
CGTCG
AGCTCGCGCCTTTGTGAATGGAGAACTCATTAAAGGACTTACGAATGGTGACGATGCCGTGTATGCTAGCGACTA
TTTCA
TATGTGCAAACGATGGCGTAGGCGCGTGGGCAGCTCGCCCCAGAGGTCATGCTGGGTAATATATCCCTCCCGTGA
CTTGG
AACACGCATGCTGTAGGAATGCGTCCCTGACGTGAGAAACAGGTTGTGGTCGCGACTGATATTGCACTTCTGGGC
GACGG
CCATCGAAGAAGAGTCGGCGCAGAACCTATTCCAGCAAAAGGCCTACCAGCCTGACCCCGTTGCGTCTCTGCAGA
CGGCA
TTTGAGCAAACACAAGAAGCAACCGGTGCTCATGACTGGCAGGGAACAACGACGGTGTGCGGTGCTCAACTCCAT
TATAA
AACGTTGACAGAT

> SEQ ID NO:1299 215021_300877_1
AAGCCCTCACCTCACATAAACACGGGAGAACTACATTCAAGATGGATTTCTCTAAATTCAGCAAGGGTTTCTCTG
ATTTC
AGTGCGCAGATTACTCCGTTTGCGTCACGGACCTTCCAGTTTACCAAGGAGCAGTTGGGCCAAGCAGATGATCGA
ACTGA
GCTTCCTGCCGATTACATCGACCTCGAGAAAAAGGTCGATGCGCTGAAACAAGCCCACCAGAAGATGCTTGCGGT
GACTT
CGCAATATACCAACGAAGCCTATGACTATCCTCCCAACATCAAGGAGACATTTCAAGATCTTGGCCGAACCGTGA
GTGAG
AAGGTCAGCCTTCTATCTTCGGCTACATCTACTTCAGAGGCCCAAGCAGCTCTTGTGGCTCCAGCATCTGCGAAG
CCGCA
ACCAAAGACTTTCAACCATGCCATCTCTCGTGCGAGCTTATCCAGCAGCCAGCTCCTGCACCAGCACCACACTGG
TGCTG
GCGAAGATCCTCTGGCAACAGCTCTCGAGAAATATGCACTCGCGATGGAACGAGTGGGCGACGCGCGCCTTGCTC
AAGAT
TCACAAATCCAAAGCCGATTCCTAGCAGGATGGAACACAACCCTCAATACCAATCTTACCTTTGCGGCGCGTGCT

> SEQ ID NO:1300 215157_300878_1
GGGAAAATAGACTGCGAGAGAGAGAGCGACGAAAAGAAGGAAATGCTCCGATCACGATTAGGGGCGGAATTGGAA
ATCCG
GAGCTCCGACAGAGTGCGAAATGCGAATGCGATAGTTCAAATGTATGATTGATTTACTGTATGAGGCGACGATGA
TGCGA
TGAAGAAGAACGGAAAATATCCCGAGCTGATGCATACATTGCGGGCTTTCCGGATATCTCGTCAGCCCTCCTTCC
ATTAT
GTCAGAAGCTATTATGCAGTTGGTTTTGATGGATGGGCGAATTTGATGACAAGGTGCAGTTTACTGGACGGGACC
GG

> SEQ ID NO:1301 215159_300878_1
GTTTTCCAAGGATTTACTCCAGCTTGCAGGGGCCAAGATGTCACTGCATGGGGGTTTCGTTAATGAAGCTGTTCA
GGGCA

Figure 7 continued

TGATATGGTGCATGAGGATGCACGAGTGGATACTAACATATGACAGTTGATGCTCTTTTTATAGAGCATCCGTTTGGATA
TAAAAGCATCGAGTGTCGCCAACATTTTGATCTTGTTCCATCCATCAATCGCATCAACCACTCTCAAGCAACAATAACAA
CCTTTACCCAACTTCAAAGACTTTCAGTCTCTCAACTCAACACCTTCAAGATGTCTCCCTGCGCATGCAACTCCTGTGGA
TGCAAGGACAACTGCTCCAGCTGCTCCTGCACCAGCTGCAGCCACTAAATCATCGTGCTCTTTTTCCTTCGCTGGATCTA
TACTCTCTCGGAATGACAGCTTGAGGGCTCGGATGTGCTTAAGACGCCATGGGAAGGGCAAGGCATTTGGGCGAATAGAC
CTCCATCATGTGGGATATAGCAGAATAGGAATTTGAAGATTTTGCCCTA

> SEQ ID NO:1302 215262_300879_1
TTCGCCTGTTGCTCGGAACATGCGGATTGCCGGCTGAGCAGTTCAAGCGACCAAGCCAGAGCCGAGCCTCTGAATTTCAT
GCATCAATCTGACGTCTTTGACCGCTGAGCCTCTGGATTTCCGCAAACCGCAGCAGCAATATAACAATCCTTCTTCTTCT
TGTTCAATTACGACTGTACCAATATTCACAATGGTTCTCACGCACTCCACCAATCACACCTACTCCCACCCTTTCCCGAC
CGTCACCCTCGCCTACTTCCTGCGATACTCTTCGCCTCAGCTCAATCCCTTCGCCGCCCATGTCCTCAGCACCGACACCA
TCTCTAGCCATGTCGACCCGGAAACCCAGCGCCTCTACACCACCCGCATCCACCTGAAGAAGAGCCGCATGCCTAGCGCA
GTCTACAAACTGCTGCCCGCAAGCGTTTCAGGTGGCAACTCTGGCGAGAAGGCTTCCTACATTCTCGAGACCAGTGTTGT
GGACATCAAGGAAGGATGGATGAANACGGAGAGCCGCAACCTCAATTTCACTGGTGTACTTTCCGTTGTCGAAAAGCAAC
ACTTCAAAGTCCCCAGCTCACTTG

> SEQ ID NO:1303 215268_300879_1
TTTACTCCGCGATCTTCTTGATCTTCACCAAAACAACATCATTGCGCCCTTGAAGCCCTCTTAGCAAATATTCGATATAC
CCAAAAGGCATTGAGCCCTTGAGCCTTACGAGAAACACATATATCCAACATGCCTTTCACCGCTAGCGATATCTGCAAGA
TTATTCTTGCCATCATTCTGCCACCCGTCGGTGTCTTCCTCGAGCGAGGCTGCGGTGCAGACCTCTTGATCAACATCCTC
CTCACAATCCTGGGTTACTTCCCTGGTATCATCCACGCTCTGTACATCATATTGAAATACTAAGCCCGCCTTCCGCTCCC
GTATCCCGCCGGATTCAAAGCGTCATGTCGTCGCACCGCATCATGTTGTGCAGACACCAATTACTCCCACGTTTGACCGG
CAATTGTCGTTTTAGAATGGATGCGTCAGTGGAGGAGTGAAGGTTACGGTCGCCGGCTCACCACGTGGCCGGTCATAGAC
GCCATAATGACAGTGGGCTTTCCTTTATGGCTTTTCTTTTGTTTTTTCTTTTCCTCTCTTGTTGGCTGGAGGCAGATGCA
CCCTATTTGAAAGGGGGCGTCAGGTTTGGCTATTGT

> SEQ ID NO:1304 215303_300880_1
CCCACGCGTCCGCGCAAGCGAAAAAGGATTAATCGCAACTCCGAGATCCTGCTGAATCACAATGAGACCTACTCAGGTTC
GTCTGGGCGGCGGCGCCCCTCAACCCAAGACTGGCCACTGGCTCGGTGACTGGGGCTCCTTTGGTGGTGCCAAGCAGAAG
GGCATTATCGACTACGGGCTGTCTGCCAACCGTCAGAACCCCTTTGCCGGTGCTGCCCACGATGCCATCTTCAACACCTT
CCGCCGCACCAAGTCCCAGATCTTCTACTGGCTCCCTCCTATGCTGGCTGGCTACTACCTGCTGAGCTGGGCCACCGAGC
GAAACCACTACCTCAACTCCAAGGCTGGCCGTGCTGAGTTTGCCGACTCGGAGTAAAATGGTGCACGAATATGTTGAATT
ATGGGTGTCCAGGGGACACAGTGTATATCAGCGTCTAGATTAGGAGAAAACAATAGAAACGTTTGACTCTA

Figure 7 continued

> SEQ ID NO:1305 215312_300880_1
AATAACCTACGCCGTGTCAGTCAAGCAGGTGTACATCATCGCATATCGACCGACGACGACCTTGTCCTGCGTCTTCCATC
TCCAATTCTCACCCACCACTTACACCATCACACATCACAATGCCTGCTCCTCAGGTTAACGGCGAGGTCACCAGCCATGT
CAATTCCGCCTTCCTCCAGGTATGCATGGATAAAAGAAGAGATTCGCCTTGTCATCACACAATGGCAAATGCGAATCGAA
CCGAATCGTGATGGCTTTGGTCCGGTTATTGATCATATTGGCAGCACCTCTTCTCCTATCCTCTAGTTAGCGACGGCATT
CACACTGTGACCACCAACGAATACGCACAGCGGCCTATCAAGCTGGGCGAATCTGCCTATAAAACTTTTGCCGCCCCTGT
TCTTCCCTACTTTTCCAAGCCCTATGGTATTGTCTCTCCCTACGTCCAGAGGGCCGACTCCTTTGGCGACAAGACCCTGG
ACCGCATTGACGAGCGTTTTCCCATTGTCAAGAAGCCCACTGGTGATCTCTACAACGAGACCCGTGGTCTGATTCTGTTC
CCCTACCAGAAGGGACTCGAGGGCAAGGAGCACGTTTTCAAGATCTATGCTTCCGAGCTTAAGAAGCTTGAGC

> SEQ ID NO:1306 215352_300880_1
TTCGCTGGTAAGCAGCTTGAGGATGGCGGAACCCTCTCCGACTACAACATCCAGAAGGAGTCCACTCTCCACCTTGTCCT
TCGTCTCCGTGGTGGTATGCAGATCTTCGTCAAGACGTTGACCGGCAAGACCATCACATTGGAGGTTGAATCATCAGACA
CCATCGACAATGTCAAATCAAAGATTCAGGACAAGGAGGGTATTCCCCCGGATCAGCAGCGTCTTATCTTTGCTGGCAAG
CAGCTTGAGGACGGTCGCACCTTGAGCGACTACAACATTCAGAAGGAGAGCACACTTCACCTTGTCCTCCGTCTTCGTGG
TGGTATGCAGATTTTCGTCAAGACTCTGACCGGCAAGACAATCACCCTCGAGGTGGAATCTTCCGACACCATCGACAACG
TTAAGTCCAAGATTCAGGACAAGGAGGGCATTCCTCCTGACCAGCAGCGCTTGATCTTTGCTGGTAAGCAGCTGGAAGAC
GGTCGCACCTTGAGCGACTACAACATCCAGAAGGAGAGCACACTGCACTTGGTCCTGCGTCTGCGTGGTGGCCAGTAAAT
GTGTCTTTTGCTTACGACCGCACTGTTACGACTGAATTGGACGGTTGGGCGTTTTTGGGAACTTTTTTTCAAAGCAGATA
TGGGAAC

> SEQ ID NO:1307 215459_300881_1
CACACACAACTCAACCAGGCTTTCAACTCTCAACTACACCACAACTTACAATCTCATCTCGCGACCAACCAACTTTCACA
ATGGAGACTGTCAAGCAAGCCGTCAACTACGTCGCTGAGTCCGTCCAGGGCGCTGCCTCTGGTATCAGCAAGGAGACCAA
CAAGGAGATTGCCAAGGACAGCAACGTCGACGTTTCCACTCGTTTGTCCGCTGGCAAGGACGCCCTTGGTGACAAGATCG
ACGAGACTGGCCACAACAACAAGGCCGAGGCTCACAAGCAGCTGGCTGAGCACAACTAGATTGGCATAAGGAGCTTCGAT
TGCTTCACAGGCGTTGAACCGGATCAGAGCGAAGGGAATATATAGCCTCACTAGGCAGGAATTGATGATTTGAATTC

> SEQ ID NO:1308 215474_300881_1
CACTGTCGCTATCATGGCCCGCGGAAGGTCAGCGTGATTTGGCGCGCGCAAAAAATCAGAAGAATGCGTCCAAACATGTG
AGTCGGTTTTGCATATAAAATCCTCAACAGGAACCAGGGTTGACTAATTCGGTGTCGTGTCTTTGCAGAAAGGCGGCAAT
ACCGAGAACGGATATGAGCAAGCAAAATCCAAGTTGAGTAACGCCGAGATTATGAGGCAGAAGCAAGCCAAAGGTCCGAA
CAACCAAGTCTACCCAATACCTCTTACGAACCAGTCAACTTACCAAGGCAACAGCCAATGCCGAGAGAGACCTAGCGGCA
GCAAAGGCATTACAAGAGAAAAGGGACGCAAAGGCGAAGAAACCGACTGAATTGGGCGCTTCAGCTGTGGAGGTTACTGG

Figure 7 continued

ACATGCAAATAACCCAAGAGGATAGCAAGAGATGGGAGAAAACACGGCACGGCGAAATCAGGCGCTCCTTGAGACTTTCA
CAATACGGCGCAAATTTGGGACAATCTAGGTGAAGAGGGGGAAGCGTTTTTTGGCTTAATACCAGGTATAGCCATGGATA
ATAGCGAAATGGATATTTTGTTGCGGTATTGCTATTATTATTCTACCAAAAAAAGTTCGACCTTTGTGTCCCTTTTTTTC
CCCTCG

> SEQ ID NO:1309 215476_300881_1
GATTGCTTAGGACGGCAATAGGTCTATTGGCGAGTTAGGCAAGATGCAGATTTTCGTCAAGACCCTCACGGGGAAGACGA
TCACCCTTGAGGTGGAGTCTTCCGACACCATCGACAATGTCAAGTCCAAGATCCAGGACAAGGAGGGCATTCCCCCGGAC
CAGCAGCGATTGATCTTCGCTGGTAAGCAGCTGGAGGATGGCCGAACCCTCTCCGACTACAACATCCAGAAGGAGTCTAC
CCTCCACCTGGTCCTGCGCCTGCGTGGTGGTGCCAAGAAGAGAAAGAAGAAGGTCTACACCACCCCCAAGAAGATTAAGC
ACAAGCGCAAGAAGACCAAGTTGGCTGTCCTCAAGTACTACAAGGTCAGCAACGATGGTAACATCGAGCGTCTCCGCCGC
GAGTGCCCCAGCGAGACTTGCGGTGCTGGTGTCTTCATGGCTGCCATGCCTGACCGTCAATACTGTGGTCGTTGCCACCT
GACCTACGTCTTCGACAAGCAGTAAACGACAAAACTTTCAAAAAGGGAAAAAATTTATTGTGGATTGGACAGCTGGAGCC
ATGGGACTGCCATAACACACAAAGGCGTTGATGTAGCATTAGAGAGCACATCCGGCGGCTTCTGGTAATGAAT

> SEQ ID NO:1310 215523_300882_1
AAACAACCTTCTTCATCAATTCTACTACAACGACCTTCCTACTTAAACAATCTCTCGATACCAACTCCCCAAGATGAAGT
TCACTCTCGTCCTTGCTACCTTTGCCGCCGTCGTCTACGGTCAAACCATCGATGACATTCCCGCATGTGCTCGTACTTGC
ATTGAGAACGCCGTTCTAGCCGCTGGTTGCTCGTCTGGAACTGACGTCGCATGCGCTTGCGCACATTTCACTGGTGTTCA
GAATGGCTCTACTAGCTGTGTCATTGCTGCTTGTGGCGTTTCTGTCGCCATTAACCAAGTTCTGCCTGGCACCCAGGCTC
TTTGTGCCAACCAGTGAACTCATCCATCGAGAGGGAGAAAATGACATGGGAGAAAATCAGGTACTCTTGTACATTGACAA
ACAAGTACATAGCTGAATGGTGTGAATGAATAAAACGCATT

> SEQ ID NO:1311 215629_300883_1
CACAAAAATCGTTCAAGATGCAGATTTTCGTGAAGACCCTGACGGGCAAGACCATCACCCTTGAGGTCGAGTCCTCCGAC
ACGATCGACAATGTCAAGTCCAAGATCCAGGACAAGGAGGGCATTCCCCCGGACCAGCAGCGATTGATCTTTGCTGGCAA
GCAGCTCGAGGATGGCCGCACCCTTTCCGACTACAACATCCAGAAGGAGTCCACCCTCCACCTCGTCCTCCGTCTGCGTG
GTGGTGTCATTGAGCCCTCTCTGAAGGTTCTTGCCTCCAAGTTCAACTGCGACAAGATGATCTGCCGCAAGTGCTACGCC
CGTCTCCCTCCCCGTGCCACCAACTGCCGTAAGCGAAAGTGCGGTCACACCAACCAGCTCCGACCCAAGAAGAAGCTCAA
ATAAATCATTTCACCAAGGATGTGGCGTCTGGGTTATGGCATTCTGGGGTGGCGAGGACAGAGGTGCTTCTGCTTTATTC
CGGATTTTGTTTCTACATTAGCATCAGGGCAGAGGCAAAATATATCAATCTAGATGATGTCT

> SEQ ID NO:1312 215642_300883_1
TCATCCTTTTGCTTCCAGCAGCTATCAAGACTTGACTTAAAAAAACCAGTCCTCATAAAGACATCTACAATCAGTCACCA
TGCAGATCACCAAGAGCCTCATCGCTACCCTCTTTGCCGCTTCGACCGCCTTTGCGGCTCCCACTCCTGCGGACAAGTCC

Figure 7 continued

ATGATGGCCGCTGTCCCTGAGTGGACAATCACCAACCTGAAGAGAGTGTGCAACTCCGGCAATACCTCCTGCACA
TGGAC
CTTTGGCGTCGATACACATCTCGCCACTGCCACCTCATGCACATACACCGTCAAGGCTACCGCCAACGCTTCTCA
GGCCA
CCGGCGGCCCCGTTACTTGCGGCCCTTACACTATCACATCCAGCTGGAGCGGCCAGTTTGGCCCTAACAACGGCT
TCACT
ACCTTTGCTGTTACCGACTTTTCGAAGAAGCTCATCACCTGGCCTGCCTATACCGATGTTCAAGTTCAGGGCGGC
AAGGT
TGTTTCGCCCAACCAGAGCTACGCCCCGACCAACCTGCCATAGATGGAATGAATTTGCTTGGAATTACTATACGC
AAGGT
CAATTTACTCCCAAA

> SEQ ID NO:1313 215681_300883_1
GTCCGAGATTCTGCTGAATCACCTTGAGACCGAGGCAGGTTCGTCTGCGCGGCATCGCCTCTCAACCCAAGACTG
GCCAC
TGGCTCTCTGACTGGGACTCCTTTGGTGGTGCCAAACACAAGGGCATTATCGACTACGGTCTGTCTGCCAACCGT
CACAA
CCCCTTTGCCGTTGCTGTCCACGATGCCATCTTCAACACCTTCCGCCGCACCAAATCCCAGATCTTCTACTGGTT
CCCTC
CTATGCTGGCTGGCTACTACCTGGTGAGCTGGTCCACCGAGCGAAACCACTACCTCAACTCCAATGCTGG

> SEQ ID NO:1314 215764_300884_1
CTCCAATTGTCGCCCGCAAATCGCCCGCTACCGTCGCCGAAGCCGAATCATTCATCATGTCCGACGAGGAAGGCC
AGGAG
CTTGTCACCAAGCCCTTCAAGTTTGTCACTGCTGGCACTGATGCCCGTTTCCCTAACGTGAATCAGACCAAGCAC
TGCTG
GCAAAACTACGTCGACTACCACAAGTGCATTCTCGTTTTTGGAGAGGACTTTGCGCCTTGCCGTCAGTTCTGGTT
GGCCT
ACCGATCACTGTGCCCTTCTGGATGGTACCAGCGATGGGACGAGCAGCGCGAGTCTGGTAACTTCCCTGTGAAGC
TCGAT
GCTTAAATTCCATATTTGAGGTGGCGGGGTACATAAGCAAGGGTGTTCACATAGATTAAGCAGCCAGGCGGCGCA
TGTGC
TGCCAGAAAATGTAGTAGTAGTCAATCACAAGCAAACAGGCTCAATGAAAAAAAAACACACAAAACCCACC

> SEQ ID NO:1315 215782_300884_1
GGGCTCTGCAACAACCAAGGACAACTCGCAAGAGAGAATATGGCGACCAAGCGTGATGCCGCCGCAACACCGGCA
GCACC
GGTACGAGGGCCGGCCGACGTCGGTGTCCTAGCCGTGACGGTAGCTATGGGTTCTTTCTTGTCCGGCAAGTCACC
CCTTT
GAGACGGGCAGCCGCAGAGCAGAAGAAGCTAACCGGTTCGCACCACAGGTGCCATGATGAGCCTGTCGGCATTCG
CGGTG
CCCGTCATCCTCGACACAAACCCGGTCGACGGCGTGCACACGCTGCGGCAGTGGGTGCGCGTCTACCACTACGGA
CACAT
TTACCTGCCGGCCCTGTGCGTGGCCACGACGGGGCTGTACGCCTTTGAAGCCCTGCGGAAGCGCTCTCAGGGCAA
ATACC
AGTGGGTGCGGTACGCACTGGCGGCGGTTTCGACCCTGGTCATGGTGCCCTTTACCTGGATCTTCATGACGCCGA
CCAAT
AATACGCTGTTCGCGCTCGAGGCCGCCGCCGCCGCGTCGGATCCGGGAGCTCTGGCAGACACCCCGGGCGCCGTG
GTACG
CTCGCTGGTCGTCCGGTGGGCATGGCTGCACGTGACGAGGTCGCTGACGCCTCTCTTCGGGGCATATCTAGGCT

> SEQ ID NO:1316 215792_300884_1
GGTTCTCAAAGTCTTCCGGTGCCGCCGGCCGTTTGGCTGCGGACCGAAAGGTGGACAGGAATCAACTCGTGATGA
GATCC
GGGAAATGGCGGCCTCCGCCGGGATTTGGATTCCATTCTTTCGTTTTTTGTTGGTTTCTAACGTTGATGACCATT
CAGTG
GCGGCGGCTATGAAGGATATGATGAGAGGTGGTGCTTATGCCGGTGTGTATCAAGTAACGAGTCCGCCTGGTCCA
GGCAT
CATCATACGATCCATCAATCATAATCAAGGGGAACACAGAGGCAAATCTTCT

Figure 7 continued

> SEQ ID NO:1317 215803_300885_1
CGTATCTGCGGATGCCGGGGATGGACTCCGGTGTACTTGGCACGGCTCGCTTCCGTTTGACATAAAAATGCAGTGTAACA
GGTAGATGGACGTACATGTAGATGTAAATGCGGTACT

> SEQ ID NO:1318 215816_300885_1
GTCATCAGTAGCTCTCCGTTGAACGAAGCAATTGTAAACACCACCGCCAAAATGGTCAAAGCCGTCACTGTCCTCCGAGG
AGACGCCAAGGTCTCCGGCACCGTCATCTTCGAGCAGGCCTCGGAGGGTGCCCCTACCACCATCACCTACGACATCACCG
GCAACGACGCCAACGCAAAGCGTGGCTTCCACATCCACACCTTTGGTGACAACACCAACGGCTGCACCTCTGCCGGCCCT
CACTTCAACCCCTTCAACAAGACTCACGGCTCTCCTTCTGATGAGGCCCGTCACGTTGGTGACCTTGGTAACATCGAGAC
CGATGCTCAGGGTAACGCCAAGGGTACCATCACCGACTCTCTTGTCCAGCTGATTGGCCCCAACAGCGTCATTGGCCGCA
CCGTTGTTGTCCACGCCGGCACCGACGATCTCGGCAAGGGTGACAACGAGGAGTCCCTCAAGACTGGCAACGCTGGCCCT
CGTCCTGCTTGCGGTGTTATCGGTATCTCTGCTTAACCTCGTCAAATGCACTGTAGCTATGCTTGACCTAAGCTCCTTGC
AGATTGAGACAAAATCTATAGAGCGACTGAATTTATGCAGCTCGGGTCGACATAGGTTCTAGGTACATGTAGTTATAGCA
AACAAACAAATAAACAATTC

> SEQ ID NO:1319 215905_300886_1
GTATCTTCACAGTGGCATGAAACGATGGCCTGTTGGACAAACGCCACCACCGCTCCCATTTCCCGTTCTCGTTGGCCGAA
TGTCAAAAGCTGGCACAGTACGAACGCCGAGACAAGTGAGAGGAGCTGCTCCCTGGCTTTTCCCACCCCGCACTATGTGC
GCCTTAGGGGGGCAAACCGCGGGAAATCTGGGGTATTTTATGCCATAAGTCGAGATTTCTTCGGCGCTAGCTATCTGGCA
AAGGTTTTGGAATCCGTTCTAGAGCTCGAGGGCCCTTGCGTGGGCTGGTACGAAAAAGTAAGACTGCAGCGGTAAGATAT
CGAAGGGTCGATGGACGTTGTTGGGACAATGGGTTGCATTTTCTGACTGCGCTGCGCTCGACCTGCATCCCCCGTCAGGC
CCCGTACATCGGCCAGCCCTCAACTGGACGGACGGCCTATGTGGGTAATGCGAGTACGGCGGTCGGGCTAAAATGTCGCG
ATGCTGGGTTAGGGTTCAAATTTCTTCAGCCAGCGAGCCTCACGTTGCGGTGATTGCACAGGGAATGTTCTCCATCTGC
CGGAGCAGCCAGTCGCTAGCATCGTTCCCGTACAAGTACTAGAAGGCAAACCCTTGGTGAGCTAGCACACACAGGTACTC
CGTGCCAGCAAATGGACATGGTCATGGATTAGTAGATCAACATTGGAACAGAGTCATGGCTACTGTA

> SEQ ID NO:1320 215954_300886_1
ACAAGCCAAGCACATCACAGACAAAATGGCGCCTGCAGCTGGAGCAAAGAAGCAAAAGAAGAAGTGGTCCAAGGGCAAGG
TCAAGGACAAGGCCCAGCACGCCGTCCTGCTCGACAAGACCATCTCCGAGAAGCTCTACAAGGATGTCCAGTCTTACCGC
CTCGTCACCGTCGCCGTCCTGGTCGACCGAATGAAGATCAACGGCTCCCTCGCCCGCCAGTGCATCCGCGACCTCGAGGA
GAAGGGCATGATCAAGCCGGTCATCACTCATAGCAAGATGAAGATCTACACCCGTGCCATCGGCGAGTAAATTTACCACC
ATGTTTGAAAGTTAAAGCATTGAGATTTGGCGCCTGGTTGGTCTGAAAGGAAGAAAATGGGACCATGAGTGAAGAGGATG
ATACGAGGTATATAAAGCCTTAGTTGGGACGCTTTTCATGCTCGGTGTAGCATTTCATGGGAACCGGAAACGCTTTAGCA
AATGGCAACGGAATGAAGAACTTCAAAAAACAAAAAAAACAAAAAAAACAAACACAC

Figure 7 continued

> SEQ ID NO:1321 216006_300887_1
ACCACTCTCAAGCAACAATAACAACCTTTACCCAACTTCAAAGACTTTCAGTCTCTCAACTCAACACCTTCAAGATGTCT
CCCTGGTGAGTCTTCTGAGGACCATTGGTCCATCACTTGCTCGGGAGTTCCTCTTTGCTTTACCTTCAGCGTTCCACTAC
CTGATCTATGATACCTTCTTTCCCACCACCGAGCAAAGCACTCATTAGACATGTCACTAACGATTTTCTTTCAATAGCGC
ATGCAACTCCTGTGGATGCAAGGACAACTGCTCCAGCTGCTCCTGCACCAGCTGCAGCGTAAGTCCTGCTTCTCTCCCCT
GCTTTGGGCATTGAGAAACTTTTCCACCAGAAAGCTAACAGATGGGAACATATAGCACTAAATCATCGTGCTCTTTTTCC
TTCGCTGGATCTATACTCTCTCGGAATGACAGCTTGAGGGCTCGGATGTGCTTAAGACGCCATGGGAAGGGCAAGGCATT
TGGGCGAATAGACCTCCATCATGTGGGATATAGCAGAATAGGAATTTGAAGATTTTGCCCTAAC

> SEQ ID NO:1322 216039_300887_1
AAGATCAGGACAAGACAATTCGAGAGTGCCAAAAACAGCAAAAGGGCAGAGAGACGTCATCATGGCTCATGCCAAGTTCG
CCGTTTATCCCAGCCTCGTCGACCGCACCGTCGTCATCACAGGTGGTGC

> SEQ ID NO:1323 216048_300887_1
CCCACGCGTCCGCCCACGCGTCCGCCCACGCGTCCGCGCCAAACAACGCATCTTACGGCTTCACAACAGCTTGGAAAGCT
CTCTATTCGCAATGGCTATCGCACCGATCACTGGAATGCTGCGGCGACAGCTCATCCTTGACCTCGGCGTTGGTCTTGGA
TCCGGATTCATCATGGCCAACTGGTACTGGTACGGCTACCACATTGCCCCGAACCAACGGCCGAGACGCCTACTACGCCA
AGAAGGAGGCCGACCGTGCCGCCGCGGCATCACAGTAAGGGGGGCACTTGTATACTCGATGGACCGAGAGGGAATGCGGC
ATGAACAACTGCTGGTCGAATAGAAGGGGAATGACTGGGCCAACGGGCTGTTCATGCCTGCAGGAGCATAGTTGCTGGAC
AGATGTCGAATATCACTGAAGAAAGGCAACCGGGCGAACCTCTACTTAGACCAATAAGTCGCGGGGCAATACGATTCAAT
TATCTCT

> SEQ ID NO:1324 216061_300887_1
AAGTAACGACACCGCACACCGTCGTCAAAATGGTCAACATTCCCAAGACCCGTAACACCTACTGCAAGGGCAAGGAGTGC
CGCAAGCACACCCAGCACAAGGTCACTCAGTACAAGGCCGGCAATGCTTCCCTGTTCGCCCAGTGTAAGAGACGTTATGA
CCGGAAGCAGAGCGGTTATGGTGGTCAGACCAAGCCCGTCTTTCCACAAGAAGGC

> SEQ ID NO:1325 216162_300866_1
TCTCAAGCAACAATAACAACCTTTACCCAACTTCAAAGACTTTCAGTCTCTCAACTCAACACCTTCAAGATGTCTCCCTG
CGCATGCAACTCCTGTGGATGCAAGGACAACTGCTCCAGCTGCTCCTGCACCAGCTGCAGCGTAAGTCCTGCTTCTCTCC
CCTGCTTTGGGCATTGAGAAACTTTTCCACCAGAAAGCTAACAGATGGGAACATATAGCACTAAATCATCGTGCTCTTTT
TCCTTCGCTGGATCTATACTCTCTCGGAATGACAGCTTGAGGGCTCGGATGTGCTTAAGACGCCATGGGAAGGGCAAGGC
ATTTGGGCGAATAGACCTCCATCATGTGGGATATAGCAGAATAGGAATTTGAAGATTTTGCCCT

> SEQ ID NO:1326 216315_300868_1
AGTCCAGATAGTCAACAGATCAAACACAAGACAAACCTGCCTGTTCGATTACTTTGCCTCCTTGTAGTACAATTCGCAAT
AGTTCACCAAATCACCAGTCATCATGCCTGTCACTGAGTTTGCCATTATCAAGCTGAGGCCCAATTTCGACCCCCTCGAG

Figure 7 continued

TTTCTCGAGACACTCATGGAGTGTCAAGAGATTCAGGACAATTGGATTCGCCGCAATCAGCCATGCAATCTGGCGCCTGG
CATGAACCTGAGCAGCATGTACACGGATGCCACAGACCAATCAACACTTCTCATCACGGCGCCGTGGGATTCGCCCGAGG
GGCATGGGGAATGGATCCAGAGTCTTGAGAACAGGACGGCCAATGGCAACTTAACCGAGTTCAGCGCTCCGGGTTGCGAC
TCCGTCTTGCTCTTCCACATGGACCCGGCGGGAGCGAGGCCACAGATGCGGGAAGCCTTTCAGCACAAGGATACCAACGA
CGTATTCGACGTCTGTCGCTTAACATTCAACGGCGATCAGCGGGAGGCAATACAAACCAAATATCAAGCACTGGAAAACG
AGCTGCGAAAGGAAGGTCTGGAGAAGAGCATATGGGCGGGCTGGAGGATTGAAAA

> SEQ ID NO:1327  216318_300868_1
GTCGTGGATAGCGGATGGATACTTGCAGGGAGTATGGGGTAAGTGAGTGAGTGAGTGAGTGATATGGATACAGCGGGATG
ATGATGATGGTGGTGGTGGTGGTGTTGTCACTGATGTTGTCGAGTGAGTTGTTTGTTTTGTTTACCTTTGGAATTGATTG
AAATGAAATGAAATGAAACAGG

> SEQ ID NO:1328  216339_300868_1
AAACAAGCAAATCAATTCCCGAGCAAGAAAAAAAGAAGAAGCCCATCATGAAGATGCTTTCGTTTGCCGCCCTCTCGGTG
CTCGTGTTGGGCGCTTCGGCCCTGGCTGCGCCGCCGGCCCACCCCCGGCCGACAATGGGTGCTGCTGCTGCGACATCAA
CAAGAAGAGAATCGACTGCGACAGGTCGATCCCGGCGTCGGAGTGCATCTGCCCCCAGGTCATCTGCCCCGCCGGCGCGC
CCACGTTCACGCACGGCACGCCGCCGAAAGCCACCCCACCGCCCACGCCGCTGCCGACTTACAAGCAGTGCTGCTGCTGC
AATCCCAACATTAACAAGATTGTGTGCTCGCTGAGGCTCGTGGAGGACTGTATCTGCTTGGCCGTGATGTGTCCGACGGA
TGCAAAGACCATCTTTGTCAGGCCAACTGGCGTTCCGACTGTCGCTTAAGAGTATTCGTTGGCGAGCCGACTTGCCTGAA
TCCTGGACCGGGGACATGACATGGGGGAGGGAAAATACAGGGGCAAGGCATTGCTGATGGTGAATGCACAACACGCGTG
GCAGACTGGCCGAAAATTGATGATTTACTGATGGGCGACTTTGGACTTGAAATGGGGCATGCCGGATGGGTTACTTGACA
GTATTTACACCATTTCTATTCAACAATAAAT

> SEQ ID NO:1329  216360_300868_1
AAGCCTCTTCGACCACCCTCTGCCATCGTCAGCCTTCGACTCTCTTCACCAAACCTCAACAAGCGACAAATTATCGCCAG
GGTGCTCCAACGCTCGCTCCGCCATCGCCAGTATCCTTTGGACCCATACTTTCGCTCTACAACACACACAACCCCTCTTA
CGCCCACATAGCTTCGGCTACGTCAAGTTTCGGCATCATGTCTAGCAGAGATCGCCGTATAATGAAGGAGCTGCAGGATC
TGACCGAGGACAAGGACACTTCCGGCATTCATGCTGCCCTAGAACAAGAGGGCTCGCTGACCGCTCTCAAGGGCTGGTTC
TTTGGCCCTGGAAATACGCCGTACGCTGGTGGCAAATTCGTGATTCACATTCAGCTTCCCACCGACTACCCCTTCAAGCC
ACCCAAGATGAAGTTTGAGACCAGGATCTGGCATCCTAATGTCAGCAGTCAGACGGGCGTCATTTGTCTCGACACCCTCA
ACAAGAACTGGTCGCCTGTCCAAACGATCAAGACGGCTCTCCTCTCCGTCCGAATGCTTCTCGAAAACCCAAACCCCTCA
GATCCACAGGACGGCGAAGTTGCACGGATGCTGCTCGACAGTCCCGACTCG

> SEQ ID NO:1330  216379_300868_1
CAAAATCGCAGCACAACGTATCATCATGCCGTCAGCTTCTGAAAAGGCGAGAGCAAAGCTCGATGCGGTGTTGAACGACC

Figure 7 continued

CGGGACGATTTGACTGTACCCAACGGTCGAATCGCATAGCGACGACACGATATGCTACAGGCTGTGGCGTAGTCAACTCT
GTTCCGCGTCGCCCCAGCCAGAGTAGCATAGAAAGCGATTCAGGCGGCGTCAGGAACAGACTGAAACGCCTCATGTCCTT
ACCCGCGTACTAAAGCGAAAAAAAAAAGTGACTGGAGAAATATTCTTGATATGGATAACAACCTCGATGGTTGTGAACAG
TTTCATATGTCCTAGTGTCCCATCGAGCAAAGGTTGCCTGTCTATTGGCACGCTCGTACTTTATCTCGTGCCTCCTTGGC
AAGATTGGAAGATGTACACATCTCTTAACCTGAATTTCTCTCCGAAGAGCATTGAGGATCTGTTGTAGTCCATCTCTGTA
GCAGACATGTTAGATGCAATGAATTTTTATCCGAGAA

> SEQ ID NO:1331 218904_300926_1
GTCCTCTCAATCTCGTTCCCAATCAACTCCGTCTGCCTCTCTCGCCCGCATCAACAACATTGCGAGCCACATCTCTCCCA
CAATGGCTTCCACCACCAGTTTCCCGGCAGAAACGGTGCCCCAGGCGCCTGAAGATCCCCTCTTTGGCCTGGCCCGCGCC
TACAAGGCTGACAACAGCCCGCTAAAGGTCGACCTGGTATGTCGCAAGCTGCTTGTTGCTGATAATGTTTTTATTTCATC
TGGATTCACATCCAACCCCTTTTGTCCTTGCTGTCCTTATCCTCCCAAACCCTTCCCGTCGCAGCCGTGACAAGACTCTG
GCGCAATCCTTTACGATTGCGACGTCGGAGCCGGCGAACCCACAAATATCCCATCGCTTGACTAATAGCTACCGTGTCTA
ATGCACTCTATGACTGATGATATTCTTACTTACAGGGAATCGGCGCCTACCGAGATAACAATGCGAAGCCATGGGTTCTT
CCTGTGGTAA

> SEQ ID NO:1332 218912_300926_1
ATATCAGACACCCGAGAGAGTCAAGTATGTCGGCCAAGCCCACGACCAAGCAGTTCGGGAAGTCGACCCGGGAGGTTCCC
GCCTCCGCGGACCAGGCGAAGAAGTGGTACCCTGCCGACGACGAGAGCGCCCCGAAGAAGGTTCGCAAGTCCGTCCGAAC
TTGGGCCCCCCGAAAGACCCTCCAGCCTGGTACCGTCCTGATCCTCCTCGCTGGCCGCTTCCGCGGCAAGCGTGTCGTCC
TCCTCAAGACTCTTGACCAGGGTGTTCTCCTCGTCACTGGTCCCTTCAAGATCAACGGCGTTCCCCTGCGAAGAGTCAAC
GCCCGATACGTCATCGCCACCTCCTACAAGGTCGACATCTCCGGCCTTGACGCCGCCAAGATTGAGGAGATCTCTCAGCC
CACGTACTTCACCGCCGAGAAGGCCAAGGAGAAGGCTTCCGCTGAGGCTTTCTTCAAGCAGGGAGAG

> SEQ ID NO:1333 219145_300928_1
GGACAGGGGAAGGGGGTGTTAGTTGCGATAGCCGATGTTTGCATGTGAAGGCCACTACTTTACCAAAAGAGGATGCTGGG
ATGGCTGTTGCCGGTCGAGTAATTAATATGCATAATAGTATCCGCAGGTGATGAGGTGATTTTAATGTATAATTGCTAAA
AAAAAAACAAAA

> SEQ ID NO:1334 219188_300928_1
TCGACCGACGCTCGGCAACAATGGCGACAATTGCAAGCGGCTTGCGGCATGCGAGATGCGCAAGCTCGATTGCTGCAGCT
CAATGGCGGCCGGCAATCTTCCCGCGGTCGAACTTTCAACTCGCCATCCGGTCTATAACCAGCGACTCTCAAAAGCCTCC
CAGTCTTGAACTTGAAGCCGCCGAGTCCGTCCCGATCCCATACCAGGGCGTTACGCATGCGCGAGTTGTTCCGGCGACAC
CATCTTATTTCTCAAGAGAACCCCAGTTCAACGATTGATACATTGGAATCTCCAATCTGCTCACCAAGTACAACCACCTG
CCCAC

> SEQ ID NO:1335 219284_300929_1

Figure 7 continued

```
AATCTACCAACATCACAAGCGGTTCACCATGTTGAGCTTCCTCGGAAAATCGGTAGCCTTGCTGGCTGCGCTGCA
GGCTA
CTCTCAGCTCTGCAAGCCCCCTAGCCACAGAAGAGCGCTCTGTTGAGAAGAGAGCCAACGGATACGCAAACTCCG
TCTAT
TTCACCAACTGGGGCATTTACGACCGCAACTTCCAGCCTGCCGATTTGGTGGCATCAGATGTCACTCATGTCATC
TACTC
ATTCATGAACCTCCAGGCAGACGGCACAGTTGTCTCTGGCGATACCTACGCTGATTTCGAGAAGCACTATGCCGA
TGATT
CTTGGAATGATGTCGGCACCAATGCCTACGGCTGTGTCAAGCAGCTGTTCAAGGTCAAAAAGGCCAACCGAGGCC
TCAAG
GTTCTGCTCTCCATCGGTGGCTGGACCTGGTCCACCAACTTCCCCTCTGCAGCAAGCACGGATGCCAACCCGAAA
GAACT
TTGC
```

Figure 8

Disease Resistance Assay Results for Homolog Contig Members

This file describes the disease resistance assay results for internal DAS clones that are members of assembled contigs having homology to claimed sequences (see figure 2)

| Contig Name | Contig Members | Tested SeqID | Plant Name | Test Name | Visual % Inhibition | Calc. % Inhibition | Avg. OD 595 | NULL Samp. OD 595 |
|---|---|---|---|---|---|---|---|---|
| 107135_300263 | 1107135_300263 | 1107135 | GH688C05-3X | PHYTIN | 100 | | | |
| 107718_300258 | 1111443_300055 | 1111443 | GH27010C06-1X | PHYTIN | 50 | | | |
| | 111736_300059 | 1111736 | GH8707D05-2X | PHYTIN | 75 | | | |
| 108004_300057 | 1127296_300469 | 1127296 | GH355209H12-2X | DIAPHE | 25 | | | |
| | | 127296 | GH735318C05-1X | DIAPHE | 25 | 0.577838 | 1.414625 | 0.5972 |
| | | 127296 | GH735319C05-2X | DIAPHE | 25 | 0.585119 | 1.414625 | 0.5869 |
| 108295_300261 | 1111021_300049 | 1111021 | GH24935E03-2X | PHYTIN | 50 | | | |
| | 111058_300049 | 1111058 | GH25084B08-3X | DIAPHE | 50 | | | |
| 108425_300382 | 1127743_300472 | 1127743 | GH356150C06-3X | USTIMA | 75 | | | |
| 111165_300052 | 1105037_300046 | 1105037 | GH23847E05-2X | DIAPHE | 100 | | | |
| | 106105_300458 | 1105037 | GH23847E05-2X | PHYTIN | 100 | | | |
| | 106137_300458 | 1105037 | GH583954C01-3X | DIAPHE | | 0.563125 | 1.70255 | 0.7438 |
| 111712_300059 | 1111712_300059 | 1111712 | GH11523D02-2X | COCHHE | 100 | | | |
| 120256_300383 | 1120256_300383 | 1120256 | GH9140H07-3X | DIAPHE | 50 | | | |
| 124727_300437 | 1111122_300052 | 1111122 | GH20692F03-3X | PHYTIN | 100 | | | |
| 126767_300466 | 1126767_300466 | 1126767 | GH353809C09-2X | COCHHE | 25 | | | |
| 127727_300472 | 1107160_300263 | 1107160 | GH1171D08-2X | PHYTIN | 25 | | | |
| | 111728_300059 | 1111728 | GH8631D04-2X | PHYTIN | 100 | | | |
| | 120635_300428 | 1120635 | GH10579C05-2X | PHYTIN | 100 | | | |
| | 126418_300463 | 1120635 | GH10579C05-2X | USTIMA | 50 | | | |
| | | 120635 | GH585874A09-3X | USTIMA | 75 | | | |
| 129566_300480 | 1130224_300486 | 1130224 | GH358661H03-2X | COCHHE | 50 | | | |
| | | 130224 | GH358661H03-2X | DIAPHE | 50 | | | |
| | | 130224 | GH358661H03-2X | PHYTIN | 50 | | | |
| | | 130224 | GH358661H03-2X | USTIMA | 50 | | | |
| | | 130224 | GH740823B01-2X | COCHHE | 25 | 0.381042 | 1.63 | 1.0089 |
| | 131370_300513 | 1131370 | GH363847F09-2X | COCHHE | 50 | | | |

Figure 8 continued

| Contig Name | Contig Members | Tested SeqID | Plant Name | Test Name | Visual % Inhibition | Calc. % Inhibition | Avg. OD 595 | NULL 595 | Samp. OD 595 |
|---|---|---|---|---|---|---|---|---|---|
| | 182468_300710_1 | 182468 | GH473049D09-2X | CERCZM | 50 | | | | |
| 1299891_300482_1 | 1299891_300482_1 | 1299891 | GH360858C12-1X | SCLESC | 25 | | | | |
| 130439_300487_1 | 130439_300487_1 | 130439 | GH581455A06-2X | PYRIOR | 25 | | | | |
| 130502_300488_1 | 130502_300488_1 | 130439 | GH581456A06-3X | PYRIOR | 25 | | | | |
| 131349_300513_1 | 1181950_300658_1 | 181950 | GH471441B07-2X | PHOMLI | 25 | | | | |
| 131361_300513_1 | 131361_300513_1 | 131361 | GH363811E08-2X | USTIMA | 50 | | | | |
| 138074_300688_1 | 1214159_300855_1 | 214159 | GH616139A02-2X | PYTHUL | 100 | | | | |
| | 215352_300880_1 | 215352 | GH636438E03-1X | GIBBZE | 25 | | | | |
| | | 215352 | GH636439E03-2X | GIBBZE | 100 | | | | |
| | | 215352 | GH636439E03-3X | PYTHUL | 100 | | | | |
| | | 215352 | GH636822E03-1X | GIBBZE | 100 | | | | |
| | | 215352 | GH636822E03-1X | PYTHUL | 100 | | | | |
| | | 215352 | GH636823E03-2X | COCHHE | 25 | | | | |
| | 215476_300881_1 | 215476 | GH636639G09-2X | LEPTMA | 25 | | | | |
| | | 215476 | GH637023G09-2X | PYTHUL | 100 | | | | |
| 138074_300688_1 | 1215629_300883_1 | 215629 | GH638091F06-2X | COCHHE | 25 | | | | |
| | | 215629 | GH638091F06-2X | GIBBZE | 25 | | | | |
| 139045_300406_1 | 139045_300406_1 | 139045 | GH447598E06-3X | CERCZM | 75 | | | | |
| 168562_300557_1 | 168562_300557_1 | 168562 | GH424421F08-2X | USTIMA | 50 | | | | |
| 170328_300532_1 | 139368_300409_1 | 139368 | GH444689D09-3X | SCLESC | 25 | | | | |
| 172017_301608_1 | 172017_301608_1 | 172017 | GH555499F05-2X | COCHHE | 75 | | | | |
| | 219145_300928_1 | 219145 | GH632292E04-3X | LEPTMA | 25 | | | | |
| 175459_300542_1 | 1116840_300515_1 | 116840 | GH557520C02-3X | PYRIOR | 50 | | | | |
| | 116840_300515_1 | 116840 | GH560480C02-3X | GIBBFU | 25 | | | | |
| 182235_300659_1 | 182235_300659_1 | 182235 | GH472149C05-2X | CERCZM | 25 | | | | |
| 188984_300611_1 | 188984_300611_1 | 188984 | GH555707B12-2X | C-SCLESC | 50 | | | | |
| | | 188984 | GH555707B12-2X | COCHHE | 25 | | | | |
| | | 188984 | GH555707B12-2X | PYRIOR | 25 | | | | |
| 191114_300739_1 | 139274_300408_1 | 139274 | GH444333B10-3X | CERCZM | 25 | | | | |
| 191511_300702_1 | 1116469_300068_1 | 116469 | GH435896E09-2X | USTIMA | 50 | | | | |
| 194361_300762_1 | 171236_300535_1 | 171236 | GH416482D05-3X | PHYTIN | 50 | | | | |
| 195472_300634_1 | 214476_300858_1 | 214476 | GH618215G03-2X | PYTHUL | 100 | | | | |

Figure 8 continued

| Contig Name | Contig Members | Tested SeqID | Plant Name | Test Name | Visual % Inhibition | Calc. % Inhibition | Avg. OD 595 | NULL OD 595 | Samp. OD 595 |
|---|---|---|---|---|---|---|---|---|---|
| 195541_300635 | 1212475_300849 | 1212475 | GH629170H02-1X | PYRIOR | 25 | | | | |
| | | 1212475 | GH696979C02-2X | COCHHE | 25 | | | | |
| 195734_300637 | 1219188_300928 | 1219188 | GH632327F05-2X | GIBBZE | 25 | | | | |
| | | 1219188 | GH632614F05-1X | COCHHE | 25 | | | | |
| 195810_300638 | 1214605_300863 | 1214605 | GH618938D02-1X | PYTHUL | 100 | | | | |
| | | 1214605 | GH618939D02-2X | PYTHUL | 100 | | | | |
| 195893_300638 | 1216379_300868 | 1216379 | GH641179E10-2X | C-SCLESC | 25 | | | | |
| | | 1216379 | GH641547E10-2X | COCHHE | 50 | | | | |
| 195975_300639 | 1212412_300849 | 1212412 | GH609895G02-3X | LEPTMA | 50 | | | | |
| 196522_300704 | 1170330_301609 | 1170330 | GH415921F04-2X | PHYTIN | 100 | | | | |
| 199488_300749 | 1219284_300929 | 1219284 | GH632702D08-1X | PYTHUL | 100 | | | | |
| 200320_300758 | 1215459_300881 | 1215459 | GH636610H08-1X | C-SCLESC | 25 | | | | |
| | | 1215459 | GH636610H08-1X | GIBBZE | 25 | | | | |
| | | 1215459 | GH636610H08-1X | LEPTMA | 25 | | | | |
| | | 1215459 | GH636610H08-1X | PYRIOR | 25 | | | | |
| 200377_300816 | 1216039_300887 | 1216039 | GH637180G01-3X | PYTHUL | 50 | | | | |
| | | 1216039 | GH637558G01-1X | GIBBZE | 100 | | | | |
| | | 1216039 | GH637558G01-1X | PYTHUL | 50 | | | | |
| 200385_300758 | 1215816_300885 | 1215816 | GH639583H08-2X | C-SCLESC | 50 | | | | |
| | | 1215816 | GH639962H08-1X | LEPTMA | 100 | | | | |
| 200469_300759 | 1213242_300851 | 1213242 | GH611466H03-2X | GIBBZE | 100 | | | | |
| | 1216339_300868 | 1216339 | GH641055F06-2X | LEPTMA | 50 | | | | |
| | | 1216339 | GH641423F06-2X | PYRIOR | 25 | | | | |
| | | 1216339 | GH641424F06-3X | COCHHE | 50 | | | | |
| 205083_300795 | 1214506_300859 | 1214506 | GH618296C06-3X | PYTHUL | 100 | | | | |
| | | 1214506 | GH618678C06-1X | PYTHUL | 100 | | | | |
| | | 1214506 | GH618679C06-2X | PYTHUL | 100 | | | | |
| | | 1214506 | GH686290E02-2X | PYTHUL | 100 | 0.808505 | 1.047025 | | 0.2005 |
| | 1216048_300887 | 1216048 | GH637210G02-1X | LEPTMA | 25 | | | | |
| | | 1216048 | GH637590G02-1X | PYTHUL | 100 | | | | |
| | | 1216048 | GH637592G02-3X | GIBBZE | 50 | | | | |
| 205424_300798 | 1214288_300856 | 1214288 | GH616970G12-1X | PYTHUL | 100 | | | | |

Figure 8 continued

| Contig Name | Contig Members | Tested SeqID | Plant Name | Test Name | Visual % Inhibition | Calc. % Inhibition | Avg. OD 595 | NULL OD 595 | Samp. OD 595 |
|---|---|---|---|---|---|---|---|---|---|
| | | 214288 | GH617351G12-2X | PYTHUL | 100 | | | | |
| | | 214288 | GH685238B06-1X | PYTHUL | 25 | 0.693157 | 1.63015 | | 0.5002 |
| | | 214288 | GH685636B06-3X | PYTHUL | 100 | 0.749367 | 1.330633 | | 0.3335 |
| 205432_300798_1 | 215523_300882_1 | 215523 | GH637516C12-3X | GIBBZE | 100 | | | | |
| | | 215523 | GH637888C12-3X | CERCZM | 25 | | | | |
| | | 215523 | GH637888C12-3X | GIBBZE | 25 | | | | |
| 205666_300800_1 | 215268_300879_1 | 215268 | GH636219F08-2X | COCHHE | 25 | | | | |
| | | 215268 | GH646215F08-2X | LEPTMA | 100 | | | | |
| 205820_300802_1 | 216006_300887_1 | 216006 | GH640388C10-3X | COCHHE | 50 | | | | |
| | | 216006 | GH640770C10-1X | PYRIOR | 25 | | | | |
| 205820_300802_1 | 216162_300866_1 | 216162 | GH644819C03-2X | C-SCLESC | 25 | | | | |
| | | 216162 | GH644820C03-3X | COCHHE | 25 | | | | |
| | | 216162 | GH645203C03-2X | GIBBZE | 25 | | | | |
| 206025_300804_1 | 212581_300850_1 | 212581 | GH609961H04-1X | LEPTMA | 50 | | | | |
| 206059_300804_1 | 215021_300877_1 | 215021 | GH634843D01-2X | COCHHE | 25 | | | | |
| | | 215021 | GH634843D01-2X | GIBBZE | 25 | | | | |
| 206063_300804_1 | 206063_300804_1 | 215021 | GH634843D01-2X | LEPTMA | 75 | | | | |
| 206087_300804_1 | 216061_300887_1 | 216061 | GH637251A04-2X | COCHHE | 25 | | | | |
| | | 216061 | GH637251A04-2X | PYRIOR | 25 | | | | |
| | | 216061 | GH637155A04-2X | PYRIOR | 25 | | | | |
| 208015_300831_1 | 215642_300883_1 | 215642 | GH638510G07-1X | C-SCLESC | 50 | | | | |
| 208604_300807_1 | 215262_300879_1 | 215262 | GH636212D08-3X | GIBBZE | 5 | | | | |
| 208607_300807_1 | 208607_300807_1 | 215262 | GH636212D08-3X | VERTDA | 25 | | | | |
| 208615_300807_1 | 208615_300807_1 | 215262 | GH646207D08-2X | LEPTMA | 100 | | | | |
| 208640_300807_1 | 214235_300856_1 | 214235 | GH616775F06-2X | LEPTMA | 25 | | | | |
| | | 214235 | GH616775F06-2X | PYRIOR | 25 | | | | |
| 210910_300894_1 | 212947_300845_1 | 212947 | GH629332H07-3X | PYTHUL | 100 | | | | |
| | | 216360_300868_1 | 216360 | GH641132A09-3X | C-SCLESC | 25 | | | | |
| | | 216360 | GH641498A09-1X | GIBBZE | 25 | | | | |
| 210955_300963_1 | 1195971_300639_1 | 216360 | GH641499A09-2X | PYRIOR | 25 | | | | |
| | 218912_300926_1 | 218912 | GH631539B08-3X | PYTHUL | 25 | | | | |
| 210976_300894_1 | 212713_300843_1 | 212713 | GH629236H04-3X | PYTHUL | 100 | | | | |

Figure 8 continued

| Contig Name | Contig Members | Tested SeqID | Plant Name | Test Name | Visual % Inhibition | Calc. % Inhibition | Avg. OD 595 | NULL OD 595 | Samp. OD 595 |
|---|---|---|---|---|---|---|---|---|---|
| 211006_300895 | 1 213793_300860 | 1 213793 | GH611673D10-1X | GIBBZE | 100 | | | | |
| | | 213793 | GH611674D10-2X | C-SCLESC | 25 | | | | |
| | | 213793 | GH613647F09-2X | COCHHE | 25 | | | | |
| | | 213793 | GH614028F09-3X | C-SCLESC | 50 | | | | |
| | | 213793 | GH614028F09-3X | COCHHE | 50 | | | | |
| | | 213793 | GH614028F09-3X | GIBBZE | 75 | | | | |
| | | 213793 | GH614028F09-3X | LEPTMA | 75 | | | | |
| | | 213793 | GH614028F09-3X | PYRIOR | 50 | | | | |
| | | 213793 | GH614028F09-3X | RHIZSO | 25 | | | | |
| 211348_300957 | 1 215954_300886 | 1 215954 | GH640278H06-1X | COCHHE | 25 | | | | |
| 211395_300957 | 1 213904_300862 | 1 213904 | GH612321F06-1X | LEPTMA | 25 | | | | |
| | | 213904 | GH612321F06-1X | PYRIOR | 25 | | | | |
| 211395_300957 | 1 214236_300856 | 1 214236 | GH616779G06-2X | COCHHE | 25 | | | | |
| | | 214236 | GH616779G06-2X | LEPTMA | 25 | | | | |
| | | 214236 | GH617158G06-1X | LEPTMA | 25 | | | | |
| | | 214236 | GH617158G06-1X | PYRIOR | 25 | | | | |
| | | 214236 | GH617158G06-1X | PYTHUL | 100 | | | | |
| 211475_300899 | 1 212486_300849 | 1 212486 | GH609926G03-2X | GIBBZE | 25 | | | | |
| 211666_300901 | 1 215312_300880 | 1 215312 | GH646343F12-2X | LEPTMA | 100 | | | | |
| 211921_300872 | 1 214725_300864 | 1 214725 | GH630705H03-2X | PYRIOR | 25 | | | | |
| 212163_300874 | 1 215303_300880 | 1 215303 | GH646324A12-3X | LEPTMA | 100 | | | | |
| | | 215303 | GH700262D07-1X | PYTHUL | 100 | | | | |
| | | 215303 | GH700263D07-2X | GIBBZE | 25 | | | | |
| | | 215303 | GH700263D07-2X | VERTDA | 50 | | | | |
| 212163_300874 | 1 215681_300883 | 1 215681 | GH638227H10-2X | COCHHE | 25 | | | | |
| | | 215681 | GH638610H10-1X | LEPTMA | 25 | | | | |
| 212388_300848 | 1 212388_300848 | 1 212388 | GH697784F01-3X | COCHHE | 75 | | | | |
| | | 212388 | GH824142D01-1X | LEPTMA | 100 | | | | |
| 213124_300847 | 1 213124_300847 | 1 213124 | GH610890H09-2X | PYTHUL | 100 | | | | |
| 213839_300861 | 1 213839_300861 | 1 213839 | GH612202H02-2X | GIBBZE | 50 | | | | |
| 213984_300862 | 1 213984_300862 | 1 213984 | GH612117C12-1X | PYTHUL | 75 | | | | |
| 214170_300855 | 1 199906_300754 | 1 213984 | GH612118C12-2X | VERTDA | 25 | | | | |

Figure 8 continued

| Contig Name | Contig Members | Tested SeqID | Plant Name | Test Name | Visual % Inhibition | Calc. % Inhibition | Avg. NULL OD 595 | Samp. OD 595 |
|---|---|---|---|---|---|---|---|---|
| | 214170_300855_1 | 214170 | GH617036G02-3X | PYTHUL | 100 | | | |
| | 214273_300856_1 | 214273 | GH616879H09-2X | LEPTMA | 25 | | | |
| | | 214273 | GH616879H09-2X | PYTHUL | 100 | | | |
| 214316_300857_1 | 214316_300857_1 | 214316 | GH617399C02-2X | PYTHUL | 100 | | | |
| 215015_300877_1 | 215015_300877_1 | 215015 | GH634424F12-4X | C-SCLESC | 25 | | | |
| 215157_300878_1 | 215157_300878_1 | 215157 | GH645936B01-3X | LEPTMA | 100 | | | |
| 215159_300878_1 | 215159_300878_1 | 215159 | GH635995D01-2X | COCHHE | 25 | | | |
| | | 215159 | GH645982D01-1X | LEPTMA | 100 | | | |
| | | 215159 | GH645983D01-2X | LEPTMA | 100 | | | |
| 215474_300881_1 | 215474_300881_1 | 215474 | GH636635F09-2X | GIBBZE | 25 | | | |
| 215782_300884_1 | 215782_300884_1 | 215782 | GH639884D06-3X | LEPTMA | 100 | | | |
| 215792_300884_1 | 215792_300884_1 | 215792 | GH639911C07-2X | LEPTMA | 100 | | | |
| 215905_300886_1 | 215792_300884_1 | 215792 | GH639912C07-3X | LEPTMA | 100 | | | |
| | 204925_300794_1 | 215905 | GH640167D03-2X | C-SCLESC | 25 | | | |
| 216318_300868_1 | 215905_300886_1 | 216318 | GH641363F04-2X | COCHHE | 25 | | | |
| 216942_300903_1 | 216318_300868_1 | 216318 | GH641363F04-2X | RHIZSO | 75 | | | |
| | 200152_300815_1 | 218904 | GH631522F07-2X | PYTHUL | 100 | | | |
| 217480_300908_1 | 218904_300926_1 | 216315 | GH640982D04-1X | COCHHE | 25 | | | |
| | 216315_300868_1 | 216315 | GH640983D04-2X | C-SCLESC | 25 | | | |
| 218073_300914_1 | 214966_300876_1 | 214966 | GH634313A08-4X | GIBBZE | 25 | | | |
| | | 214966 | GH634313A08-4X | LEPTMA | 75 | | | |
| 218347_300917_1 | 215764_300884_1 | 215764 | GH639856B05-3X | LEPTMA | 100 | | | |
| 218585_300967_1 | 214221_300856_1 | 214221 | GH616736D05-3X | PYTHUL | 100 | | | |
| | | 214221 | GH617114D05-1X | LEPTMA | 50 | | | |
| | | 214221 | GH617115D05-2X | LEPTMA | 75 | | | |
| | | 214221 | GH617115D05-2X | PYTHUL | 100 | | | |
| | | 214221 | GH685594H04-1X | PYTHUL | 75 | 0.655802 | 1.330633 | 0.458 |
| | | 214221 | GH685595H04-2X | PYTHUL | 25 | 0.463638 | 1.330633 | 0.7137 |
| 218875_300925_1 | 215803_300885_1 | 215803 | GH639550H07-1X | C-SCLESC | 25 | | | |
| | | 215803 | GH639931H07-2X | LEPTMA | 100 | | | |
| 219564_300946_1 | 213128_300847_1 | 213128 | GH610899B10-3X | PYTHUL | 75 | | | |
| 220453_300955_1 | 213079_300846_1 | 213079 | GH610851F08-3X | LEPTMA | 75 | | | |

Figure 8 continued

| Contig Name | Contig Members | Tested SeqID | Plant Name | Test Name | Visual % Inhibition | Calc. % Inhibition | Avg. NULL OD 595 | Samp. OD 595 |
|---|---|---|---|---|---|---|---|---|
| 220485_300955_1 | 1213169_300847_1 | 1213169 | GH629492H12-3X | COCHHE | 25 | | | |
| 220892_300939_1 | 1213169_300862_1 | 1213169 | GH629868H12-3X | PYTHUL | 25 | | | |
| | 1213967_300862_1 | 1213967 | GH612058D10-2X | PYTHUL | 100 | | | |
| | | 1213967 | GH612441D10-1X | PYTHUL | 100 | | | |
| | | 1213967 | GH684904H02-2X | PYTHUL | 100 | 0.871729 | 1.63015 | 0.2091 |
| | | 1213967 | GH685530H02-1X | PYTHUL | 100 | 0.876675 | 1.330633 | 0.1641 |
| | | 1213967 | GH685532H02-3X | PYTHUL | 75 | 0.754552 | 1.330633 | 0.3266 |
| 221072_300941_1 | 1214321_300857_1 | 1214321 | GH617419H02-2X | PYTHUL | 100 | | | |
| | | 1214321 | GH617802H02-1X | PYRIOR | 25 | | | |
| 228311_301020_1 | 1120726_300516_1 | 1120726 | GH445998B04-3X | COCHHE | 50 | | | |
| | | 1120726 | GH445998B04-3X | SCLESC | 50 | | | |
| | | 1120726 | GH445998B04-3X | VERTDA | 50 | | | |
| | 171896_300624_1 | 1171896 | GH730691D05-2X | VERTDA | 25 | 0.458366 | 0.876237 | 0.4746 |
| | | 1171896 | GH417489H12-2X | VERTDA | 50 | | | |
| 271223_200032_1 | 1107121_300263_1 | 1107121 | GH631E03-2X | ASPEFL | 25 | | | |
| | | 1107121 | GH631E03-2X | PHYTIN | 50 | | | |
| | 108411_300382_1 | 1108411 | GH8555C02-2X | PHYTIN | 100 | | | |
| | 108421_300382_1 | 1108421 | GH10899E03-2X | CERCZM | 100 | | | |
| | | 1108421 | GH10899E03-2X | SCLESC | 100 | | | |
| | 111059_300049_1 | 1111059 | GH25088C08-3X | USTIMA | 50 | | | |
| | 111442_300055_1 | 1111442 | GH27007B06-2X | A-VERTDA | 25 | | | |
| | 120280_300383_1 | 1120280 | GH9236H10-3X | DIAPHE | 100 | | | |
| 41904_300032_1 | 110926_300048_1 | 1110926 | GH24571B04-2X | DIAPHE | 100 | | | |
| 44507_300427_1 | 113576_300004_1 | 1113576 | GH12267D10-2X | PHYTIN | 100 | | | |
| 44720_300030_1 | 108332_300381_1 | 1108332 | GH14395H04-2X | COCHHE | 75 | | | |
| 57538_300029_1 | 111126_300052_1 | 1111126 | GH20707B04-2X | PHYTIN | 100 | | | |
| 57871_300118_1 | 128377_300475_1 | 1128377 | GH357054E10-3X | USTIMA | 50 | | | |

Figure 9

Additional disease resistance assays of selected clones against target pathogens

| GENE LIBRARY | SEQ ID | TEST NAME | ALIQUOT ID | VISUAL % INHIBITION | CALC. % INHIBITION | AVG. NULL OD 595 | SAMP. OD 595 |
|---|---|---|---|---|---|---|---|
| Trichoderma harzianum | GBSG00000213830 | PYTHUL | DR2210B01-691601X | 100% | 90.51% | 1.630 | 0.155 |
| Trichoderma harzianum | GBSG00000213830 | PYTHUL | DR2211B01-691798X | 100% | 90.49% | 1.331 | 0.127 |
| Trichoderma harzianum | GBSG00000213836 | PYTHUL | DR2210D01-691604X | 100% | 91.79% | 1.630 | 0.134 |
| Trichoderma harzianum | GBSG00000213836 | PYTHUL | DR2211D01-691958X | 100% | 89.19% | 1.331 | 0.144 |
| Trichoderma harzianum | GBSG00000213894 | PYTHUL | DR2210A02-691613X | 50% | 80.84% | 1.630 | 0.312 |
| Trichoderma harzianum | GBSG00000213894 | PYTHUL | DR2211A02-691808X | 100% | 80.82% | 1.331 | 0.255 |
| Trichoderma harzianum | GBSG00000213908 | PYTHUL | DR2210B02-691615X | 25% | 74.87% | 1.630 | 0.410 |
| Trichoderma harzianum | GBSG00000213908 | PYTHUL | DR2211B02-691809X | 100% | 86.29% | 1.331 | 0.182 |
| Trichoderma harzianum | GBSG00000213929 | PYTHUL | DR2210D02-691619X | 100% | 87.42% | 1.630 | 0.205 |
| Trichoderma harzianum | GBSG00000213929 | PYTHUL | DR2211D02-691813X | 100% | 88.52% | 1.331 | 0.153 |
| Trichoderma harzianum | GBSG00000213937 | PYTHUL | DR2210E02-691620X | 100% | 89.43% | 1.630 | 0.172 |
| Trichoderma harzianum | GBSG00000213937 | PYTHUL | DR2210E02-691621X | 100% | 78.81% | 1.630 | 0.346 |
| Trichoderma harzianum | GBSG00000213946 | PYTHUL | DR2211G02-691819X | 100% | 87.99% | 1.331 | 0.160 |
| Trichoderma harzianum | GBSG00000213946 | PYTHUL | DR2211G02-691820X | 100% | 86.70% | 1.331 | 0.177 |

Figure 9 continued

| GENE LIBRARY | SEQ ID | TEST NAME | ALIQUOT ID | VISUAL INHIBITION | CALC % INHIBITION | AVG NEG OD595 | SAMP OD595 |
|---|---|---|---|---|---|---|---|
| Trichoderma harzianum | GBSG00000213967 | PYTHUL | DR2210H02-691627X | 100% | 87.17% | 1.630 | 0.209 |
| Trichoderma harzianum | GBSG00000213967 | PYTHUL | DR2211H02-691821X | 100% | 87.67% | 1.331 | 0.164 |
| Trichoderma harzianum | GBSG00000213967 | PYTHUL | DR2211H02-691822X | 75% | 75.46% | 1.331 | 0.327 |
| Trichoderma harzianum | GBSG00000214019 | LEPTMA | DR2209G01-692429X | 25% | 38.32% | 1.110 | 0.685 |
| Trichoderma harzianum | GBSG00000214019 | LEPTMA | DR2516G01-752707X | 25% | -43.47% | 0.768 | 1.103 |
| Trichoderma harzianum | GBSG00000214084 | PYTHUL | DR2210C03-691632X | 75% | 84.02% | 1.630 | 0.261 |
| Trichoderma harzianum | GBSG00000214084 | PYTHUL | DR2210C03-691633X | 100% | 88.47% | 1.630 | 0.188 |
| Trichoderma harzianum | GBSG00000214084 | PYTHUL | DR2211C03-691827X | 50% | 61.03% | 1.331 | 0.519 |
| Trichoderma harzianum | GBSG00000214084 | PYTHUL | DR2211C03-691828X | 50% | 77.75% | 1.331 | 0.296 |
| Trichoderma harzianum | GBSG00000214148 | PYTHUL | DR2211F03-691830X | 100% | 82.75% | 1.331 | 0.230 |
| Trichoderma harzianum | GBSG00000214148 | PYTHUL | DR2211F03-691831X | 100% | 77.53% | 1.331 | 0.299 |
| Trichoderma harzianum | GBSG00000214165 | PYTHUL | DR2210H03-691642X | 25% | 61.89% | 1.630 | 0.621 |
| Trichoderma harzianum | GBSG00000214165 | PYTHUL | DR2211H03-691835X | 100% | 89.22% | 1.331 | 0.143 |
| Trichoderma harzianum | GBSG00000214166 | PYTHUL | DR2210A04-691645X | 50% | 64.21% | 1.630 | 0.584 |
| Trichoderma harzianum | GBSG00000214166 | PYTHUL | DR2211A04-691836X | 25% | 53.54% | 1.331 | 0.618 |
| Trichoderma harzianum | GBSG00000214166 | PYTHUL | DR2211A04-691837X | 25% | 63.86% | 1.331 | 0.481 |

Figure 9 continued

| GENE LIBRARY | SEQ ID | TEST NAME | LIQUID ID | VISUAL INHIBITION | CALC % INHIBITION | AVG NULL OD 595 | SAMP OD 595 |
|---|---|---|---|---|---|---|---|
| Trichoderma harzianum | GBSG00000214187 | PYTHUL | DR2210B04-691646X | 100% | 84.20% | 1.630 | 0.258 |
| Trichoderma harzianum | GBSG00000214187 | PYTHUL | DR2211B04-691839X | 25% | 48.02% | 1.331 | 0.692 |
| Trichoderma harzianum | GBSG00000214214 | PYTHUL | DR2210G04-691656X | 50% | 80.54% | 1.630 | 0.317 |
| Trichoderma harzianum | GBSG00000214214 | PYTHUL | DR2211G04-691846X | 100% | 72.86% | 1.331 | 0.361 |
| Trichoderma harzianum | GBSG00000214214 | PYTHUL | DR2211G04-691847X | 25% | 29.61% | 1.331 | 0.937 |
| Trichoderma harzianum | GBSG00000214221 | PYTHUL | DR2211H04-691848X | 75% | 65.58% | 1.331 | 0.458 |
| Trichoderma harzianum | GBSG00000214221 | PYTHUL | DR2211H04-691849X | 25% | 46.36% | 1.331 | 0.714 |
| Trichoderma harzianum | GBSG00000214253 | PYTHUL | DR2210C05-691664X | 25% | 69.57% | 1.630 | 0.496 |
| Trichoderma harzianum | GBSG00000214253 | PYTHUL | DR2211C05-691853X | 100% | 88.26% | 1.331 | 0.156 |
| Trichoderma harzianum | GBSG00000214267 | PYTHUL | DR2210F05-691670X | 100% | 82.25% | 1.630 | 0.289 |
| Trichoderma harzianum | GBSG00000214267 | PYTHUL | DR2211F05-691858X | 100% | 83.86% | 1.331 | 0.215 |
| Trichoderma harzianum | GBSG00000214288 | PYTHUL | DR2210B06-691678X | 25% | 69.32% | 1.630 | 0.500 |
| Trichoderma harzianum | GBSG00000214288 | PYTHUL | DR2211B06-691866X | 100% | 74.94% | 1.331 | 0.334 |
| Trichoderma harzianum | GBSG00000214296 | PYTHUL | DR2210C06-691681X | 100% | 83.17% | 1.630 | 0.274 |
| Trichoderma harzianum | GBSG00000214296 | PYTHUL | DR2211C06-691868X | 100% | 86.89% | 1.331 | 0.174 |
| Trichoderma harzianum | GBSG00000214319 | PYTHUL | DR2210F06-691684X | 100% | 88.41% | 1.630 | 0.189 |

Figure 9 continued

| GENE LIBRARY | SEQ ID | TEST NAME | SEQ (UID) | VISUAL INHIBITION | % INHIBITION | AVG AUDT OD595 | SAMP OD595 |
|---|---|---|---|---|---|---|---|
| Trichoderma harzianum | GBSG00000214319 | PYTHUL | DR2210F06-691685X | 100% | 89.03% | 1.630 | 0.179 |
| Trichoderma harzianum | GBSG00000214329 | PYTHUL | DR2211H06-691875X | 100% | 83.83% | 1.331 | 0.215 |
| Trichoderma harzianum | GBSG00000214329 | PYTHUL | DR2211H06-691876X | 100% | 87.81% | 1.331 | 0.162 |
| Trichoderma harzianum | GBSG00000214350 | PYTHUL | DR2210G07-691718X | 100% | 91.14% | 1.462 | 0.130 |
| Trichoderma harzianum | GBSG00000214350 | PYTHUL | DR2211G07-691890X | 100% | 90.06% | 1.474 | 0.147 |
| Trichoderma harzianum | GBSG00000214379 | PYTHUL | DR2211D08-691898X | 100% | 87.54% | 1.474 | 0.184 |
| Trichoderma harzianum | GBSG00000214379 | PYTHUL | DR2211D08-691899X | 100% | 89.13% | 1.474 | 0.160 |
| Trichoderma harzianum | GBSG00000214380 | PYTHUL | DR2210E08-691730X | 100% | 90.04% | 1.462 | 0.146 |
| Trichoderma harzianum | GBSG00000214380 | PYTHUL | DR2210E08-691731X | 50% | 64.56% | 1.462 | 0.518 |
| Trichoderma harzianum | GBSG00000214380 | PYTHUL | DR2211E08-691901X | 100% | 87.61% | 1.474 | 0.183 |
| Trichoderma harzianum | GBSG00000214416 | PYTHUL | DR2211H08-691906X | 100% | 85.93% | 1.474 | 0.208 |
| Trichoderma harzianum | GBSG00000214416 | PYTHUL | DR2211H08-691907X | 100% | 89.75% | 1.474 | 0.151 |
| Trichoderma harzianum | GBSG00000214417 | PYTHUL | DR2210A09-691739X | 100% | 77.58% | 1.462 | 0.328 |
| Trichoderma harzianum | GBSG00000214417 | PYTHUL | DR2211A09-691908X | 100% | 84.53% | 1.474 | 0.228 |
| Trichoderma harzianum | GBSG00000214417 | PYTHUL | DR2211A09-691910X | 100% | 89.60% | 1.474 | 0.153 |
| Trichoderma harzianum | GBSG00000214433 | PYTHUL | DR2210D09-691745X | 25% | 70.75% | 1.462 | 0.428 |

Figure 9 continued

| GENE LIBRARY | SEQ ID | TEST NAME | ALIQUOT ID | VISUAL % INHIBITION | CALC % INHIBITION | AVG NUM OD595 | SAMP OD595 |
|---|---|---|---|---|---|---|---|
| Trichoderma harzianum | GBSG00000214433 | PYTHUL | DR2211D09-691911X | 100% | 86.77% | 1.474 | 0.195 |
| Trichoderma harzianum | GBSG00000214439 | PYTHUL | DR2210G09-691750X | 25% | 73.39% | 1.462 | 0.389 |
| Trichoderma harzianum | GBSG00000214439 | PYTHUL | DR2210G09-691751X | 100% | 70.44% | 1.462 | 0.432 |
| Trichoderma harzianum | GBSG00000214439 | PYTHUL | DR2211G09-691917X | 100% | 84.10% | 1.474 | 0.235 |
| Trichoderma harzianum | GBSG00000214444 | PYTHUL | DR2211A10-691921X | 100% | 90.86% | 1.474 | 0.135 |
| Trichoderma harzianum | GBSG00000214444 | PYTHUL | DR2211A10-691922X | 100% | 75.57% | 1.474 | 0.360 |
| Trichoderma harzianum | GBSG00000214450 | PYTHUL | DR2210E10-691762X | 25% | 61.88% | 1.462 | 0.557 |
| Trichoderma harzianum | GBSG00000214450 | PYTHUL | DR2210E10-691763X | 100% | 81.50% | 1.462 | 0.271 |
| Trichoderma harzianum | GBSG00000214450 | PYTHUL | DR2211E10-691927X | 100% | 89.87% | 1.474 | 0.149 |
| Trichoderma harzianum | GBSG00000214456 | PYTHUL | DR2210H10-691768X | 25% | 62.47% | 1.462 | 0.549 |
| Trichoderma harzianum | GBSG00000214456 | PYTHUL | DR2210H10-691769X | 50% | 79.08% | 1.462 | 0.306 |
| Trichoderma harzianum | GBSG00000214456 | PYTHUL | DR2211H10-691932X | 100% | 88.59% | 1.474 | 0.168 |
| Trichoderma harzianum | GBSG00000214457 | PYTHUL | DR2210A12-691957X | 100% | 88.13% | 1.474 | 0.175 |
| Trichoderma harzianum | GBSG00000214457 | PYTHUL | DR2211A12-691944X | 100% | 85.46% | 1.474 | 0.214 |
| Trichoderma harzianum | GBSG00000214465 | PYTHUL | DR2210F12-691792X | 50% | 82.06% | 1.462 | 0.262 |
| Trichoderma harzianum | GBSG00000214465 | PYTHUL | DR2211F12-691950X | 100% | 89.07% | 1.474 | 0.161 |

Figure 9 continued

| GENE LIBRARY | SEQ ID | TEST NAME | ALT CLUSTER ID | VISUAL INHIBITION | CALCOFLUOR INHIBITION | AVG NULL OD 595 | SAMP. OD 595 |
|---|---|---|---|---|---|---|---|
| Trichoderma harzianum | GBSG00000214468 | PYTHUL | DR2210G12-691794X | 100% | 79.80% | 1.462 | 0.295 |
| Trichoderma harzianum | GBSG00000214468 | PYTHUL | DR2210G12-691795X | 100% | 86.93% | 1.462 | 0.191 |
| Trichoderma harzianum | GBSG00000214480 | PYTHUL | DR2212C01-691965X | 100% | 83.65% | 1.777 | 0.291 |
| Trichoderma harzianum | GBSG00000214480 | PYTHUL | DR2213C01-692137X | 100% | 84.14% | 1.047 | 0.166 |
| Trichoderma harzianum | GBSG00000214481 | PYTHUL | DR2212D01-691968X | 100% | 89.20% | 1.777 | 0.192 |
| Trichoderma harzianum | GBSG00000214481 | PYTHUL | DR2213D01-692138X | 100% | 86.31% | 1.047 | 0.143 |
| Trichoderma harzianum | GBSG00000214504 | PYTHUL | DR2213C02-692152X | 100% | 86.14% | 1.047 | 0.145 |
| Trichoderma harzianum | GBSG00000214504 | PYTHUL | DR2213C02-692153X | 100% | 84.30% | 1.047 | 0.164 |
| Trichoderma harzianum | GBSG00000214526 | PYTHUL | DR2213C03-692165X | 100% | 75.67% | 1.047 | 0.255 |
| Trichoderma harzianum | GBSG00000214526 | PYTHUL | DR2213C03-692166X | 100% | 88.62% | 1.047 | 0.119 |
| Trichoderma harzianum | GBSG00000214534 | PYTHUL | DR2212E03-692000X | 25% | 65.91% | 1.777 | 0.606 |
| Trichoderma harzianum | GBSG00000214534 | PYTHUL | DR2212E03-692001X | 25% | 48.28% | 1.777 | 0.919 |
| Trichoderma harzianum | GBSG00000214534 | PYTHUL | DR2213E03-692167X | 100% | 78.06% | 1.047 | 0.230 |
| Trichoderma harzianum | GBSG00000214534 | PYTHUL | DR2213E03-692168X | 75% | 61.21% | 1.047 | 0.406 |
| Trichoderma harzianum | GBSG00000214545 | PYTHUL | DR2212G03-692004X | 100% | 87.72% | 1.777 | 0.218 |
| Trichoderma harzianum | GBSG00000214545 | PYTHUL | DR2212G03-692005X | 25% | 74.13% | 1.777 | 0.460 |

Figure 9 continued

| GENE LIBRARY | SEQ ID | TEST NAME | ALIQUOT ID | VISUAL % INHIBITION | CALC % INHIBITION | AVG NULL OD595 | SAMP OD595 |
|---|---|---|---|---|---|---|---|
| Trichoderma harzianum | GBSG00000214545 | PYTHUL | DR2213G03-692171X | 75% | 64.63% | 1.047 | 0.370 |
| Trichoderma harzianum | GBSG00000214549 | PYTHUL | DR2212B04-692010X | 25% | 58.98% | 1.777 | 0.729 |
| Trichoderma harzianum | GBSG00000214549 | PYTHUL | DR2213B04-692175X | 100% | 83.64% | 1.047 | 0.171 |
| Trichoderma harzianum | GBSG00000214576 | PYTHUL | DR2212E04-692016X | 25% | 80.32% | 1.777 | 0.350 |
| Trichoderma harzianum | GBSG00000214576 | PYTHUL | DR2213E04-692180X | 100% | 70.33% | 1.047 | 0.311 |
| Trichoderma harzianum | GBSG00000214604 | PYTHUL | DR2213C06-692200X | 100% | 67.55% | 1.047 | 0.340 |
| Trichoderma harzianum | GBSG00000214604 | PYTHUL | DR2213C06-692201X | 100% | 76.38% | 1.047 | 0.247 |
| Trichoderma harzianum | GBSG00000214608 | PYTHUL | DR2213F06-692203X | 100% | 82.58% | 1.047 | 0.182 |
| Trichoderma harzianum | GBSG00000214608 | PYTHUL | DR2213F06-692204X | 100% | 83.52% | 1.047 | 0.173 |
| Trichoderma harzianum | GBSG00000214609 | PYTHUL | DR2212G06-692048X | 100% | 90.88% | 1.777 | 0.162 |
| Trichoderma harzianum | GBSG00000214609 | PYTHUL | DR2213G06-692205X | 100% | 89.01% | 1.047 | 0.115 |
| Trichoderma harzianum | GBSG00000214609 | PYTHUL | DR2213G06-692206X | 100% | 91.02% | 1.047 | 0.094 |
| Trichoderma harzianum | GBSG00000214623 | PYTHUL | DR2212C07-692055X | 100% | 87.05% | 1.221 | 0.158 |
| Trichoderma harzianum | GBSG00000214623 | PYTHUL | DR2213C07-692213X | 100% | 83.10% | 1.301 | 0.220 |
| Trichoderma harzianum | GBSG00000214629 | PYTHUL | DR2212G07-692061X | 100% | 90.10% | 1.221 | 0.121 |
| Trichoderma harzianum | GBSG00000214629 | PYTHUL | DR2212G07-692062X | 100% | 86.22% | 1.221 | 0.168 |

Figure 9 continued

| GENE LIBRARY | SEQ ID | TEST NAME | ALIQUOT ID | VISUAL INHIBITION | CALC. % INHIBITION | AVG NULL OD 595 | SAMP. OD 595 |
|---|---|---|---|---|---|---|---|
| Trichoderma harzianum | GBSG0000214629 | PYTHUL | DR2213G07-692219X | 100% | 83.67% | 1.301 | 0.212 |
| Trichoderma harzianum | GBSG0000214629 | PYTHUL | DR2213G07-692220X | 100% | 84.93% | 1.301 | 0.196 |
| Trichoderma harzianum | GBSG0000214633 | PYTHUL | DR2212A08-692065X | 100% | 85.26% | 1.221 | 0.180 |
| Trichoderma harzianum | GBSG0000214633 | PYTHUL | DR2212A08-692066X | 100% | 91.38% | 1.221 | 0.105 |
| Trichoderma harzianum | GBSG0000214637 | PYTHUL | DR2212C08-692070X | 100% | 86.20% | 1.221 | 0.169 |
| Trichoderma harzianum | GBSG0000214637 | PYTHUL | DR2213C08-692223X | 100% | 77.88% | 1.301 | 0.288 |
| Trichoderma harzianum | GBSG0000214659 | PYTHUL | DR2213H08-692229X | 100% | 83.69% | 1.301 | 0.212 |
| Trichoderma harzianum | GBSG0000214659 | PYTHUL | DR2213H08-692230X | 100% | 89.54% | 1.301 | 0.136 |
| Trichoderma harzianum | GBSG0000214672 | PYTHUL | DR2213E09-692235X | 100% | 80.27% | 1.301 | 0.257 |
| Trichoderma harzianum | GBSG0000214672 | PYTHUL | DR2213E09-692236X | 100% | 70.12% | 1.301 | 0.389 |
| Trichoderma harzianum | GBSG0000214690 | PYTHUL | DR2213H09-692240X | 100% | 80.63% | 1.301 | 0.252 |
| Trichoderma harzianum | GBSG0000214690 | PYTHUL | DR2213H09-692241X | 100% | 71.70% | 1.301 | 0.368 |
| Trichoderma harzianum | GBSG0000214706 | PYTHUL | DR2212E10-692101X | 100% | 84.04% | 1.221 | 0.195 |
| Trichoderma harzianum | GBSG0000214706 | PYTHUL | DR2212E10-692102X | 100% | 91.92% | 1.221 | 0.099 |
| Trichoderma harzianum | GBSG0000214706 | PYTHUL | DR2213E10-692248X | 100% | 81.37% | 1.301 | 0.242 |
| Trichoderma harzianum | GBSG0000214710 | PYTHUL | DR2212A12-692121X | 75% | 81.11% | 1.221 | 0.231 |

Figure 9 continued

| GENE LIBRARY | SEQ ID | TEST NAME | ALIQUOT ID | VISUAL INHIBITION | CALC. INHIBITION | AVG. OD595 | SAMP. OD595 |
|---|---|---|---|---|---|---|---|
| Trichoderma harzianum | GBSG0000214710 | PYTHUL | DR2212A12-692122X | 75% | 75.41% | 1.221 | 0.300 |
| Trichoderma harzianum | GBSG0000214710 | PYTHUL | DR2213A12-692258X | 100% | 89.76% | 1.301 | 0.133 |
| Trichoderma harzianum | GBSG0000215432 | GIBBZE | DR2514B06-760145X | 25% | 23.97% | 1.897 | 1.443 |
| Trichoderma harzianum | GBSG0000215432 | GIBBZE | DR2515B06-760239X | 25% | 11.82% | 1.632 | 1.439 |
| Trichoderma harzianum | GBSG0000215670 | C-SCLESC | DR2512C03-750173X | 25% | 28.93% | 1.403 | 0.997 |
| Trichoderma harzianum | GBSG0000215670 | C-SCLESC | DR2512C03-750174X | 25% | 33.64% | 1.403 | 0.931 |
| Trichoderma harzianum | GBSG0000216131 | GIBBZE | DR2514C04-760122X | 25% | 28.32% | 1.897 | 1.360 |
| Trichoderma harzianum | GBSG0000216131 | GIBBZE | DR2515C04-760216X | 50% | 51.31% | 1.632 | 0.795 |
| Trichoderma harzianum | GBSG0000216187 | GIBBZE | DR2514D04-760123X | 25% | 13.56% | 1.897 | 1.640 |
| Trichoderma harzianum | GBSG0000216187 | GIBBZE | DR2514D04-760124X | 25% | 12.21% | 1.897 | 1.666 |
| Trichoderma harzianum | GBSG0000216338 | COCHHE | DR2510G02-752451X | 25% | 27.08% | 1.490 | 1.086 |
| Trichoderma harzianum | GBSG0000216338 | COCHHE | DR2511G02-752595X | 50% | 58.19% | 1.584 | 0.662 |
| Trichoderma harzianum | GBSG0000216351 | C-SCLESC | DR2513H01-750203X | 25% | 37.16% | 1.403 | 0.881 |
| Trichoderma harzianum | GBSG0000216351 | C-SCLESC | DR2513H01-750204X | 25% | 42.29% | 1.403 | 0.810 |

Test Name
Key:

Figure 9 continued

| GENE LIBRARY | SEQ ID | TEST NAME | ALIQUOT ID | VISUAL % INHIBITION | CALC. % INHIBITION | AVG NULL OD 595 | SAMP OD 595 |
|---|---|---|---|---|---|---|---|
| | | COCHHE:Helminthosporium maydis<br>C-SCLESC:Sclerotinia sclerotium<br>GIBBZE:Fursarium graminearum<br>LEPTMA:Phoma lingam<br>PYTHUL:Pythium ultimum | | | | | |

Figure 10a

Activity of clone DR-VX after Heat and Pk treatment of extracts.

| Harvest Date | Aliquot Name | TestID | Test Name | Sample Treatment | % Inhibition (visual) | % Inhibition (calc.) | Avg null OD595 | Sample OD595 | Heat/Pk Sensitive |
|---|---|---|---|---|---|---|---|---|---|
| 10/31/01 | DR3070-908781X | 1139873IND | GIBBZE | Heat | 0 | 18.74% | 1.35 | 1.097 | Yes |
| 10/31/01 | DR3070-908781X | 1139874IND | GIBBZE | Pk | 0 | 11.12% | 1.64 | 1.4576 | Yes |
| 10/31/01 | DR3070-908781X | 1139875IND | GIBBZE | Untreated | 25 | 33.40% | 2.04 | 1.3586 | |
| 10/31/01 | DR3070-908782X | 1139876IND | GIBBZE | Heat | 0 | 20.10% | 1.35 | 1.0786 | Yes |
| 10/31/01 | DR3070-908782X | 1139877IND | GIBBZE | Pk | 0 | 11.88% | 1.64 | 1.4451 | Yes |
| 10/31/01 | DR3070-908782X | 1139878IND | GIBBZE | Untreated | 25 | 36.34% | 2.04 | 1.2987 | |
| 10/31/01 | DR3070-908783X | 1139879IND | GIBBZE | Heat | 0 | 22.73% | 1.35 | 1.0432 | Yes |
| 10/31/01 | DR3070-908783X | 1139880IND | GIBBZE | Pk | 0 | 18.51% | 1.64 | 1.3365 | Yes |
| 10/31/01 | DR3070-908783X | 1139881IND | GIBBZE | Untreated | 25 | 43.27% | 2.04 | 1.1572 | |
| 10/31/01 | DR3070-908784X | 1139882IND | GIBBZE | Heat | 0 | 17.71% | 1.35 | 1.1109 | Yes |
| 10/31/01 | DR3070-908784X | 1139883IND | GIBBZE | Pk | 0 | 12.18% | 1.64 | 1.4403 | Yes |
| 10/31/01 | DR3070-908784X | 1139884IND | GIBBZE | Untreated | 25 | 28.00% | 2.04 | 1.4689 | |
| 10/31/01 | DR3070-908785X | 1139885IND | GIBBZE | Heat | 0 | 24.12% | 1.35 | 1.0244 | Yes |
| 10/31/01 | DR3070-908785X | 1139886IND | GIBBZE | Pk | 0 | 13.62% | 1.64 | 1.4167 | Yes |

Figure 10a continued

| HTS Test Date | Aliquot Name | Test ID | Test Name | Sample Treatment | % Inhibition (Visual) | % Inhibition (calc.) | Avg null OD595 | Sample OD595 | Hit/P Sensitive |
|---|---|---|---|---|---|---|---|---|---|
| 10/31/01 | DR3070-908785X | 1139887IND | GIBBZE | Untreated | 25 | 37.63% | 2.04 | 1.2723 | |
| 10/31/01 | DR3070-910823X | 1145229IND | GIBBZE | Heat | 0 | 12.48% | 0.609 | 0.533 | Yes |
| 10/31/01 | DR3070-910823X | 1145230IND | GIBBZE | Pk | 0 | -7.85% | 0.946 | 1.0203 | Yes |
| 10/31/01 | DR3070-910823X | 1145231IND | GIBBZE | Untreated | 25 | 30.60% | 1.238 | 0.8592 | |
| 10/31/01 | DR3070-910824X | 1145232IND | GIBBZE | Heat | 0 | 17.55% | 0.609 | 0.5021 | Yes |
| 10/31/01 | DR3070-910824X | 1145233IND | GIBBZE | Pk | 0 | -2.39% | 0.946 | 0.9686 | Yes |
| 10/31/01 | DR3070-910824X | 1145234IND | GIBBZE | Untreated | 25 | 25.60% | 1.238 | 0.9211 | |
| 10/31/01 | DR3070-910825X | 1145235IND | GIBBZE | Heat | 0 | -0.74% | 0.609 | 0.6135 | Yes |
| 10/31/01 | DR3070-910825X | 1145236IND | GIBBZE | Pk | 0 | -13.72% | 0.946 | 1.0758 | Yes |
| 10/31/01 | DR3070-910825X | 1145237IND | GIBBZE | Untreated | 25 | 31.02% | 1.238 | 0.854 | |
| 10/31/01 | DR3070-910826X | 1145238IND | GIBBZE | Heat | 0 | 4.22% | 0.609 | 0.5833 | Yes |
| 10/31/01 | DR3070-910826X | 1145239IND | GIBBZE | Pk | 0 | -6.81% | 0.946 | 1.0104 | Yes |
| 10/31/01 | DR3070-910826X | 1145240IND | GIBBZE | Untreated | 25 | 32.18% | 1.238 | 0.8396 | |
| 10/31/01 | DR3070-910827X | 1145241IND | GIBBZE | Heat | 0 | 13.56% | 0.609 | 0.5264 | Yes |
| 10/31/01 | DR3070-910827X | 1145242IND | GIBBZE | Pk | 25 | 25.92% | 0.946 | 0.7008 | No |

Figure 10a continued

| Harvest Date | Aliquot Name | LogID | Test Name | Sample Treatment | Inhibition (V/V) | % Inhibition (calc) | Ab 100% OD595 | Sample OD595 | Heat/Pk Sensitive |
|---|---|---|---|---|---|---|---|---|---|
| 10/31/01 | DR3070-910827X | 1145243IND | GIBBZE | Untreated | 25 | 43.84% | 1.238 | 0.6953 | |
| 10/31/01 | DR3070-910828X | 1145244IND | GIBBZE | Heat | 0 | 7.91% | 0.609 | 0.5608 | Yes |
| 10/31/01 | DR3070-910828X | 1145245IND | GIBBZE | Pk | 25 | 28.87% | 0.946 | 0.6729 | No |
| 10/31/01 | DR3070-910828X | 1145246IND | GIBBZE | Untreated | 25 | 45.44% | 1.238 | 0.6755 | |
| 10/31/01 | DR3070-910829X | 1145247IND | GIBBZE | Heat | 0 | 20.92% | 0.609 | 0.4816 | Yes |
| 10/31/01 | DR3070-910829X | 1145248IND | GIBBZE | Pk | 25 | 22.73% | 0.946 | 0.731 | No |
| 10/31/01 | DR3070-910829X | 1145249IND | GIBBZE | Untreated | 25 | 37.04% | 1.238 | 0.7794 | |
| 10/31/01 | DR3070-910830X | 1145250IND | GIBBZE | Heat | 0 | 16.80% | 0.609 | 0.5067 | Yes |
| 10/31/01 | DR3070-910830X | 1145251IND | GIBBZE | Pk | 25 | 35.35% | 0.946 | 0.6116 | No |
| 10/31/01 | DR3070-910830X | 1145252IND | GIBBZE | Untreated | 25 | 32.97% | 1.238 | 0.8298 | |
| 10/31/01 | DR3070-910831X | 1145253IND | GIBBZE | Heat | 0 | 13.12% | 0.609 | 0.5291 | Yes |
| 10/31/01 | DR3070-910831X | 1145254IND | GIBBZE | Pk | 25 | 25.45% | 0.946 | 0.7052 | No |
| 10/31/01 | DR3070-910831X | 1145255IND | GIBBZE | Untreated | 25 | 30.92% | 1.238 | 0.8552 | |
| 10/31/01 | DR3070-910852X | 1145316IND | GIBBZE | Heat | 0 | -0.36% | 0.609 | 0.6112 | Yes |
| 10/31/01 | DR3070-910852X | 1145317IND | GIBBZE | Pk | 0 | -12.59% | 0.946 | 1.0651 | Yes |

Figure 10a continued

| Harvest Date | Aliquot Name | TestID | Test Name | Sample Treatment | % Inhibition (Visual) | Inhibition (calc) | | Sample OD595 | |
|---|---|---|---|---|---|---|---|---|---|
| 10/31/01 | DR3070-910852X | 11453181ND | GIBBZE | Untreated | 25 | 36.59% | 1.238 | 0.785 | |
| 10/31/01 | DR3070-910853X | 11453191ND | GIBBZE | Heat | 0 | 14.78% | 0.609 | 0.519 | Yes |
| 10/31/01 | DR3070-910853X | 11453201ND | GIBBZE | Pk | 0 | 15.47% | 0.946 | 0.7997 | Yes |
| 10/31/01 | DR3070-910853X | 11453211ND | GIBBZE | Untreated | 25 | 33.79% | 1.238 | 0.8197 | |
| 10/31/01 | DR3070-910854X | 11453221ND | GIBBZE | Heat | 0 | 0.28% | 0.609 | 0.6073 | Yes |
| 10/31/01 | DR3070-910854X | 11453231ND | GIBBZE | Pk | 0 | -19.18% | 0.946 | 1.1274 | Yes |
| 10/31/01 | DR3070-910854X | 11453241ND | GIBBZE | Untreated | 25 | 31.95% | 1.238 | 0.8425 | |
| 10/31/01 | DR3070-910855X | 11453251ND | GIBBZE | Heat | 0 | 11.49% | 0.609 | 0.539 | Yes |
| 10/31/01 | DR3070-910855X | 11453261ND | GIBBZE | Pk | 0 | -8.04% | 0.946 | 1.0221 | Yes |
| 10/31/01 | DR3070-910855X | 11453271ND | GIBBZE | Untreated | 25 | 33.79% | 1.238 | 0.8197 | |
| 10/31/01 | DR3070-910856X | 11453281ND | GIBBZE | Heat | 0 | -4.12% | 0.609 | 0.6341 | Yes |
| 10/31/01 | DR3070-910856X | 11453291ND | GIBBZE | Pk | 0 | -13.97% | 0.946 | 1.0782 | Yes |
| 10/31/01 | DR3070-910856X | 11453301ND | GIBBZE | Untreated | 25 | 37.41% | 1.238 | 0.7749 | |

Figure 10a continued

Appendix to Figure 10a. NULL Samples used for Calculation of Avg. null above.

| Harvest Date | Aliquot Name | TestID | Test Name | Sample Treatment | % Inhibition (Vsu) | % Inhibition (Glc) | Avg null OD595 | Sample OD595 |
|---|---|---|---|---|---|---|---|---|
| 10/31/01 | DR3068-904582X | 1133880 | GIBBZE | PK | 0 | 2.83% | 0.988 | 0.96 |
| 10/31/01 | DR3068-904582X | 1133881 | GIBBZE | Heat | 0 | 2.21% | 0.674 | 0.6591 |
| 10/31/01 | DR3068-904583X | 1133883 | GIBBZE | PK | 0 | -6.66% | 0.988 | 1.0538 |
| 10/31/01 | DR3068-904583X | 1133884 | GIBBZE | Heat | 0 | 1.23% | 0.674 | 0.6657 |
| 10/31/01 | DR3068-904584X | 1133886 | GIBBZE | PK | 0 | -5.03% | 0.988 | 1.0377 |
| 10/31/01 | DR3068-904584X | 1133887 | GIBBZE | Heat | 0 | 33.29% | 0.674 | 0.4496 |
| 10/31/01 | DR3068-904585X | 1133889 | GIBBZE | PK | 0 | 3.57% | 0.988 | 0.9527 |
| 10/31/01 | DR3068-904585X | 1133890 | GIBBZE | Heat | 0 | -3.37% | 0.674 | 0.6967 |
| 10/31/01 | DR3068-904586X | 1133892 | GIBBZE | PK | 0 | -7.15% | 0.988 | 1.0586 |
| 10/31/01 | DR3068-904586X | 1133893 | GIBBZE | Heat | 0 | 10.37% | 0.674 | 0.6041 |
| 10/31/01 | DR3068-904587X | 1133895 | GIBBZE | PK | 0 | -19.87% | 0.988 | 1.1843 |
| 10/31/01 | DR3068-904587X | 1133896 | GIBBZE | Heat | 0 | 7.27% | 0.674 | 0.625 |
| 10/31/01 | DR3068-904588X | 1133898 | GIBBZE | PK | 0 | -11.13% | 0.988 | 1.098 |
| 10/31/01 | DR3068-904588X | 1133899 | GIBBZE | Heat | 0 | 15.13% | 0.674 | 0.572 |

Figure 10a continued

| Harvest Date | Aliquot Name | TestID | Test Name | Sample Treatment | Inhibition (visual) | Inhibition (calc) | Avg ctrl OD595 | Sample OD595 |
|---|---|---|---|---|---|---|---|---|
| 10/31/01 | DR3068-904589X | 1133901 | GIBBZE | PK | 0 | -2.17% | 0.988 | 1.0094 |
| 10/31/01 | DR3068-904589X | 1133902 | GIBBZE | Heat | 0 | 2.46% | 0.674 | 0.6574 |
| 10/31/01 | DR3068-904590X | 1133904 | GIBBZE | PK | 0 | -4.07% | 0.988 | 1.0282 |
| 10/31/01 | DR3068-904590X | 1133905 | GIBBZE | Heat | 0 | 26.96% | 0.674 | 0.4923 |
| 10/31/01 | DR3068-904591X | 1133907 | GIBBZE | PK | 0 | 2.50% | 0.988 | 0.9633 |
| 10/31/01 | DR3068-904591X | 1133908 | GIBBZE | Heat | 0 | 11.29% | 0.674 | 0.5979 |
| 10/31/01 | DR3068-904592X | 1133910 | GIBBZE | PK | 0 | 13.56% | 0.988 | 0.854 |
| 10/31/01 | DR3068-904592X | 1133911 | GIBBZE | Heat | 0 | -109.44% | 0.674 | 1.4116 |
| 10/31/01 | DR3068-904593X | 1133913 | GIBBZE | PK | 0 | 11.65% | 0.988 | 0.8729 |
| 10/31/01 | DR3068-904593X | 1133914 | GIBBZE | Heat | 0 | -8.83% | 0.674 | 0.7335 |
| 10/31/01 | DR3068-904594X | 1133916 | GIBBZE | PK | 0 | 13.28% | 0.988 | 0.8568 |
| 10/31/01 | DR3068-904594X | 1133917 | GIBBZE | Heat | 0 | -14.35% | 0.674 | 0.7707 |
| 10/31/01 | DR3068-904595X | 1133919 | GIBBZE | PK | 0 | 1.56% | 0.988 | 0.9726 |
| 10/31/01 | DR3068-904595X | 1133920 | GIBBZE | Heat | 0 | -17.40% | 0.674 | 0.7913 |
| 10/31/01 | DR3068-904596X | 1133922 | GIBBZE | PK | 0 | 15.33% | 0.988 | 0.8365 |

Figure 10a continued

| Harvest Date | AliquotName | TestID | Test Name | Sample Treatment | Inhibition (visual) | Inhibition (calc) | Avg null OD595 | Sample OD595 |
|---|---|---|---|---|---|---|---|---|
| 10/31/01 | DR3068-904596X | 1133923 | GIBBZE | Heat | 0 | -0.07% | 0.674 | 0.6745 |
| 10/31/01 | DR3068-904647X | 1134074 | GIBBZE | Heat | 0 | 27.28% | 0.674 | 0.4901 |
| 10/31/01 | DR3068-904647X | 1134075 | GIBBZE | PK | 0 | 1.46% | 0.988 | 0.9736 |
| 10/31/01 | DR3068-904648X | 1134077 | GIBBZE | Heat | 0 | 3.62% | 0.674 | 0.6496 |
| 10/31/01 | DR3068-904648X | 1134078 | GIBBZE | PK | 0 | -2.54% | 0.988 | 1.0131 |
| 10/31/01 | DR3068-904649X | 1134080 | GIBBZE | Heat | 0 | 12.49% | 0.674 | 0.5898 |
| 10/31/01 | DR3068-904649X | 1134081 | GIBBZE | PK | 0 | -4.14% | 0.988 | 1.0289 |
| 10/31/01 | DR3068-904650X | 1134083 | GIBBZE | Heat | 0 | 6.68% | 0.674 | 0.629 |
| 10/31/01 | DR3068-904650X | 1134084 | GIBBZE | PK | 0 | -2.33% | 0.988 | 1.011 |
| 10/31/01 | DR3068-904651X | 1134086 | GIBBZE | Heat | 0 | -8.20% | 0.674 | 0.7293 |
| 10/31/01 | DR3068-904651X | 1134087 | GIBBZE | PK | 0 | -0.74% | 0.988 | 0.9953 |
| 10/31/01 | DR3070-908801X | 1139933 | GIBBZE | Heat | 0 | 8.33% | 1.35 | 1.2376 |
| 10/31/01 | DR3070-908801X | 1139934 | GIBBZE | PK | 0 | 6.96% | 1.64 | 1.5258 |
| 10/31/01 | DR3070-908802X | 1139936 | GIBBZE | Heat | 0 | 0.79% | 1.35 | 1.3393 |
| 10/31/01 | DR3070-908802X | 1139937 | GIBBZE | PK | 0 | 8.72% | 1.64 | 1.497 |

Figure 10a continued

| Harvest Date | Aliquot Name | GSID | Test Name | Sample Treatment | Inhibition (% In1) | Inhibition (% In2) | OD595 | OD595 |
|---|---|---|---|---|---|---|---|---|
| 10/31/01 | DR3070-908803X | 1139939 | GIBBZE | Heat | 0 | 1.42% | 1.35 | 1.3308 |
| 10/31/01 | DR3070-908803X | 1139940 | GIBBZE | PK | 0 | 6.99% | 1.64 | 1.5253 |
| 10/31/01 | DR3070-908804X | 1139942 | GIBBZE | Heat | 0 | 5.78% | 1.35 | 1.272 |
| 10/31/01 | DR3070-908804X | 1139943 | GIBBZE | PK | 0 | 10.55% | 1.64 | 1.4669 |
| 10/31/01 | DR3070-908805X | 1139945 | GIBBZE | Heat | 0 | 1.94% | 1.35 | 1.3238 |
| 10/31/01 | DR3070-908805X | 1139946 | GIBBZE | PK | 0 | 8.89% | 1.64 | 1.4942 |
| 10/31/01 | DR3070-908806X | 1139948 | GIBBZE | Heat | 0 | -12.17% | 1.35 | 1.5143 |
| 10/31/01 | DR3070-908806X | 1139949 | GIBBZE | PK | 0 | 6.52% | 1.64 | 1.533 |
| 10/31/01 | DR3070-908807X | 1139951 | GIBBZE | Heat | 0 | -16.70% | 1.35 | 1.5754 |
| 10/31/01 | DR3070-908807X | 1139952 | GIBBZE | PK | 0 | -13.54% | 1.64 | 1.862 |
| 10/31/01 | DR3070-908808X | 1139954 | GIBBZE | Heat | 0 | -11.48% | 1.35 | 1.505 |
| 10/31/01 | DR3070-908808X | 1139955 | GIBBZE | PK | 0 | 3.95% | 1.64 | 1.5753 |
| 10/31/01 | DR3070-908809X | 1139957 | GIBBZE | Heat | 0 | -16.26% | 1.35 | 1.5695 |
| 10/31/01 | DR3070-908809X | 1139958 | GIBBZE | PK | 0 | -2.05% | 1.64 | 1.6737 |
| 10/31/01 | DR3070-908810X | 1139960 | GIBBZE | Heat | 0 | -8.14% | 1.35 | 1.4599 |

Figure 10a continued

| Harvest Date | Aliquot Name | TestID | Test Name | Sample Treatment | % Inhibition (visual) | % Inhibition (calc.) | Avg. Ctrl OD595 | Sample OD595 |
|---|---|---|---|---|---|---|---|---|
| 10/31/01 | DR3070-908810X | 1139961 | GIBBZE | PK | 0 | -1.05% | 1.64 | 1.6573 |
| 10/31/01 | DR3070-908818X | 1139972 | GIBBZE | Heat | 0 | 15.31% | 1.35 | 1.1433 |
| 10/31/01 | DR3070-908818X | 1139973 | GIBBZE | PK | 0 | -20.33% | 1.64 | 1.9734 |
| 10/31/01 | DR3070-908819X | 1139975 | GIBBZE | Heat | 0 | -0.70% | 1.35 | 1.3595 |
| 10/31/01 | DR3070-908819X | 1139976 | GIBBZE | PK | 0 | -13.01% | 1.64 | 1.8533 |
| 10/31/01 | DR3070-908820X | 1139978 | GIBBZE | Heat | 0 | 6.57% | 1.35 | 1.2613 |
| 10/31/01 | DR3070-908820X | 1139979 | GIBBZE | PK | 0 | -8.24% | 1.64 | 1.7751 |
| 10/31/01 | DR3070-908821X | 1139981 | GIBBZE | Heat | 0 | 6.92% | 1.35 | 1.2566 |
| 10/31/01 | DR3070-908821X | 1139982 | GIBBZE | PK | 0 | -15.87% | 1.64 | 1.9003 |
| 10/31/01 | DR3070-908822X | 1139984 | GIBBZE | Heat | 0 | 10.83% | 1.35 | 1.2038 |
| 10/31/01 | DR3070-908822X | 1139985 | GIBBZE | PK | 0 | -7.53% | 1.64 | 1.7635 |
| 10/31/01 | DR3070-908823X | 1139987 | GIBBZE | Heat | 0 | 12.19% | 1.35 | 1.1854 |
| 10/31/01 | DR3070-908823X | 1139988 | GIBBZE | PK | 0 | 8.77% | 1.64 | 1.4961 |
| 10/31/01 | DR3070-908824X | 1139990 | GIBBZE | Heat | 0 | 9.12% | 1.35 | 1.2269 |
| 10/31/01 | DR3070-908824X | 1139991 | GIBBZE | PK | 0 | 7.77% | 1.64 | 1.5126 |

Figure 10a continued

| Harvest Date | Aliquot Name | Temp ID | Name | Sample Treatment | Inhibition (visual) | Inhibition (calc) | Sample OD595 | Sample OD595 |
|---|---|---|---|---|---|---|---|---|
| 10/31/01 | DR3070-908825X | 1139993 | GIBBZE | Heat | 0 | -1.79% | 1.35 | 1.3741 |
| 10/31/01 | DR3070-908825X | 1139994 | GIBBZE | PK | 0 | 1.59% | 1.64 | 1.6139 |
| 10/31/01 | DR3070-908826X | 1139996 | GIBBZE | Heat | 0 | -6.76% | 1.35 | 1.4412 |
| 10/31/01 | DR3070-908826X | 1139997 | GIBBZE | PK | 0 | 0.18% | 1.64 | 1.6371 |
| 10/31/01 | DR3070-908827X | 1139999 | GIBBZE | Heat | 0 | -0.97% | 1.35 | 1.3631 |
| 10/31/01 | DR3070-908827X | 1140000 | GIBBZE | PK | 0 | 8.08% | 1.64 | 1.5075 |

Figure 10b

Activity of clone GBSG0002l6187 after Heat and Pk treatment of extracts.

| HarvestDate | TAliquot Name | TestID | TestName | Treatment Sample | % Inhibition (Visual) | Inhibition % (Calc) | Avg Null OD595 | Sample OD595 | Sample Pre VPk Sensitivo |
|---|---|---|---|---|---|---|---|---|---|
| 10/31/01 | DR3068-904622X | 1134001IND | GIBBZE | Heat | 0 | 2.12% | 0.674 | 0.6597 | Yes |
| 10/31/01 | DR3068-904622X | 1134000IND | GIBBZE | Pk | 0 | 1.45% | 0.988 | 0.9737 | Yes |
| 10/31/01 | DR3068-904622X | 1133999IND | GIBBZE | Untreated | 25 | 36.77% | 1.1223 | 0.7096 | |
| 10/31/01 | DR3068-904623X | 1134004IND | GIBBZE | Heat | 0 | 1.13% | 0.674 | 0.6664 | Yes |
| 10/31/01 | DR3068-904623X | 1134003IND | GIBBZE | Pk | 0 | 3.38% | 0.988 | 0.9546 | Yes |
| 10/31/01 | DR3068-904623X | 1134002IND | GIBBZE | Untreated | 25 | 28.54% | 1.1223 | 0.802 | |
| 10/31/01 | DR3068-904624X | 1134007IND | GIBBZE | Heat | 0 | 8.10% | 0.674 | 0.6194 | Yes |
| 10/31/01 | DR3068-904624X | 1134006IND | GIBBZE | Pk | 0 | 3.80% | 0.988 | 0.9505 | Yes |
| 10/31/01 | DR3068-904624X | 1134005IND | GIBBZE | Untreated | 25 | 8.53% | 1.1223 | 1.0266 | |
| 10/31/01 | DR3068-904625X | 1134010IND | GIBBZE | Heat | 0 | 7.21% | 0.674 | 0.6254 | Yes |
| 10/31/01 | DR3068-904625X | 1134009IND | GIBBZE | Pk | 0 | 13.89% | 0.988 | 0.8508 | Yes |
| 10/31/01 | DR3068-904625X | 1134008IND | GIBBZE | Untreated | 25 | 33.16% | 1.1223 | 0.7502 | |
| 10/31/01 | DR3068-904626X | 1134013IND | GIBBZE | Heat | 0 | 2.72% | 0.674 | 0.6557 | Yes |
| 10/31/01 | DR3068-904626X | 1134012IND | GIBBZE | Pk | 0 | 5.63% | 0.988 | 0.9324 | Yes |
| 10/31/01 | DR3068-904626X | 1134011IND | GIBBZE | Untreated | 25 | 28.01% | 1.1223 | 0.8079 | |
| 10/31/01 | DR3068-904627X | 1134016IND | GIBBZE | Heat | 0 | 16.65% | 0.674 | 0.5618 | Yes |
| 10/31/01 | DR3068-904627X | 1134015IND | GIBBZE | Pk | 0 | 1.22% | 0.988 | 0.9759 | Yes |
| 10/31/01 | DR3068-904627X | 1134014IND | GIBBZE | Untreated | 25 | 33.78% | 1.1223 | 0.7432 | |
| 10/31/01 | DR3068-904628X | 1134019IND | GIBBZE | Heat | 0 | 15.01% | 0.674 | 0.5728 | Yes |
| 10/31/01 | DR3068-904628X | 1134018IND | GIBBZE | Pk | 0 | -7.71% | 0.988 | 1.0642 | Yes |
| 10/31/01 | DR3068-904628X | 1134017IND | GIBBZE | Untreated | 25 | 26.32% | 1.1223 | 0.8269 | |
| 10/31/01 | DR3068-904629X | 1134022IND | GIBBZE | Heat | 0 | 24.30% | 0.674 | 0.5102 | Yes |
| 10/31/01 | DR3068-904629X | 1134021IND | GIBBZE | Pk | 0 | 16.98% | 0.988 | 0.8202 | Yes |
| 10/31/01 | DR3068-904629X | 1134020IND | GIBBZE | Untreated | 25 | 39.51% | 1.1223 | 0.6789 | |
| 10/31/01 | DR3068-904630X | 1134025IND | GIBBZE | Heat | 0 | 10.79% | 0.674 | 0.6013 | Yes |
| 10/31/01 | DR3068-904630X | 1134024IND | GIBBZE | Pk | 0 | -3.20% | 0.988 | 1.0196 | Yes |
| 10/31/01 | DR3068-904630X | 1134023IND | GIBBZE | Untreated | 25 | 35.81% | 1.1223 | 0.7204 | |

Figure 10b continued

| Harvest Date | Aliquot Name | Test ID | Testing Lab | Sample Treatment | Inhibition Visual | Inhibition Calc. | Avg null OD595 | Null Sample OD595 | Sharp Drop |
|---|---|---|---|---|---|---|---|---|---|
| 10/31/01 | DR3068-904631X | 1134028IND | GIBBZE | Heat | 0 | 12.79% | 0.674 | 0.5878 | Yes |
| 10/31/01 | DR3068-904631X | 1134027IND | GIBBZE | Pk | 0 | -0.12% | 0.988 | 0.9892 | Yes |
| 10/31/01 | DR3068-904631X | 1134026IND | GIBBZE | Untreated | 25 | 36.15% | 1.1223 | 0.7166 | |

*Appendix to figure 10b. NULL Samples used for Calculation of Avg. null above.*

| Harvest Date | Aliquot Name | Test ID | Testing Lab | Sample Treatment | Inhibition Visual | Inhibition Calc. | Avg null OD595 | Null Sample OD595 |
|---|---|---|---|---|---|---|---|---|
| 10/31/01 | DR3068-904582X | 1133880 | GIBBZE | PK | 0 | 2.83% | 0.988 | 0.96 |
| 10/31/01 | DR3068-904582X | 1133881 | GIBBZE | Heat | 0 | 2.21% | 0.674 | 0.6591 |
| 10/31/01 | DR3068-904583X | 1133883 | GIBBZE | PK | 0 | -6.66% | 0.988 | 1.0538 |
| 10/31/01 | DR3068-904583X | 1133884 | GIBBZE | Heat | 0 | 1.23% | 0.674 | 0.6657 |
| 10/31/01 | DR3068-904584X | 1133886 | GIBBZE | PK | 0 | -5.03% | 0.988 | 1.0377 |
| 10/31/01 | DR3068-904584X | 1133887 | GIBBZE | Heat | 0 | 33.29% | 0.674 | 0.4496 |
| 10/31/01 | DR3068-904585X | 1133889 | GIBBZE | PK | 0 | 3.57% | 0.988 | 0.9527 |
| 10/31/01 | DR3068-904585X | 1133890 | GIBBZE | Heat | 0 | -3.37% | 0.674 | 0.6967 |
| 10/31/01 | DR3068-904586X | 1133892 | GIBBZE | PK | 0 | -7.15% | 0.988 | 1.0586 |
| 10/31/01 | DR3068-904586X | 1133893 | GIBBZE | Heat | 0 | 10.37% | 0.674 | 0.6041 |
| 10/31/01 | DR3068-904587X | 1133895 | GIBBZE | PK | 0 | -19.87% | 0.988 | 1.1843 |
| 10/31/01 | DR3068-904587X | 1133896 | GIBBZE | Heat | 0 | 7.27% | 0.674 | 0.625 |
| 10/31/01 | DR3068-904588X | 1133898 | GIBBZE | PK | 0 | -11.13% | 0.988 | 1.098 |
| 10/31/01 | DR3068-904588X | 1133899 | GIBBZE | Heat | 0 | 15.13% | 0.674 | 0.572 |
| 10/31/01 | DR3068-904589X | 1133901 | GIBBZE | PK | 0 | -2.17% | 0.988 | 1.0094 |
| 10/31/01 | DR3068-904589X | 1133902 | GIBBZE | Heat | 0 | 2.46% | 0.674 | 0.6574 |
| 10/31/01 | DR3068-904590X | 1133904 | GIBBZE | PK | 0 | -4.07% | 0.988 | 1.0282 |
| 10/31/01 | DR3068-904590X | 1133905 | GIBBZE | Heat | 0 | 26.96% | 0.674 | 0.4923 |
| 10/31/01 | DR3068-904591X | 1133907 | GIBBZE | PK | 0 | 2.50% | 0.988 | 0.9633 |
| 10/31/01 | DR3068-904591X | 1133908 | GIBBZE | Heat | 0 | 11.29% | 0.674 | 0.5979 |
| 10/31/01 | DR3068-904592X | 1133910 | GIBBZE | PK | 0 | 13.56% | 0.988 | 0.854 |

Figure 10b continued

| Harvest Date | Unique Name | | Tissue | Sample Treatment | Inhibition (visual) | Inhibition (calc.) | OD595 | OD595 |
|---|---|---|---|---|---|---|---|---|
| 10/31/01 | DR3068-904592X | 1133911 | GIBBZE | Heat | 0 | -109.44% | 0.674 | 1.4116 |
| 10/31/01 | DR3068-904593X | 1133913 | GIBBZE | PK | 0 | 11.65% | 0.988 | 0.8729 |
| 10/31/01 | DR3068-904593X | 1133914 | GIBBZE | Heat | 0 | -8.83% | 0.674 | 0.7335 |
| 10/31/01 | DR3068-904594X | 1133916 | GIBBZE | PK | 0 | 13.28% | 0.988 | 0.8568 |
| 10/31/01 | DR3068-904594X | 1133917 | GIBBZE | Heat | 0 | -14.35% | 0.674 | 0.7707 |
| 10/31/01 | DR3068-904595X | 1133919 | GIBBZE | PK | 0 | 1.56% | 0.988 | 0.9726 |
| 10/31/01 | DR3068-904595X | 1133920 | GIBBZE | Heat | 0 | -17.40% | 0.674 | 0.7913 |
| 10/31/01 | DR3068-904596X | 1133922 | GIBBZE | PK | 0 | 15.33% | 0.988 | 0.8365 |
| 10/31/01 | DR3068-904596X | 1133923 | GIBBZE | Heat | 0 | -0.07% | 0.674 | 0.6745 |
| 10/31/01 | DR3068-904647X | 1134074 | GIBBZE | Heat | 0 | 27.28% | 0.674 | 0.4901 |
| 10/31/01 | DR3068-904647X | 1134075 | GIBBZE | PK | 0 | 1.46% | 0.988 | 0.9736 |
| 10/31/01 | DR3068-904648X | 1134077 | GIBBZE | Heat | 0 | 3.62% | 0.674 | 0.6496 |
| 10/31/01 | DR3068-904648X | 1134078 | GIBBZE | PK | 0 | -2.54% | 0.988 | 1.0131 |
| 10/31/01 | DR3068-904649X | 1134080 | GIBBZE | Heat | 0 | 12.49% | 0.674 | 0.5898 |
| 10/31/01 | DR3068-904649X | 1134081 | GIBBZE | PK | 0 | -4.14% | 0.988 | 1.0289 |
| 10/31/01 | DR3068-904650X | 1134083 | GIBBZE | Heat | 0 | 6.68% | 0.674 | 0.629 |
| 10/31/01 | DR3068-904650X | 1134084 | GIBBZE | PK | 0 | -2.33% | 0.988 | 1.011 |
| 10/31/01 | DR3068-904651X | 1134086 | GIBBZE | Heat | 0 | -8.20% | 0.674 | 0.7293 |
| 10/31/01 | DR3068-904651X | 1134087 | GIBBZE | PK | 0 | -0.74% | 0.988 | 0.9953 |
| 10/31/01 | DR3070-908801X | 1139933 | GIBBZE | Heat | 0 | 8.33% | 1.35 | 1.2376 |
| 10/31/01 | DR3070-908801X | 1139934 | GIBBZE | PK | 0 | 6.96% | 1.64 | 1.5258 |
| 10/31/01 | DR3070-908802X | 1139936 | GIBBZE | Heat | 0 | 0.79% | 1.35 | 1.3393 |
| 10/31/01 | DR3070-908802X | 1139937 | GIBBZE | PK | 0 | 8.72% | 1.64 | 1.497 |
| 10/31/01 | DR3070-908803X | 1139939 | GIBBZE | Heat | 0 | 1.42% | 1.35 | 1.3308 |
| 10/31/01 | DR3070-908803X | 1139940 | GIBBZE | PK | 0 | 6.99% | 1.64 | 1.5253 |
| 10/31/01 | DR3070-908804X | 1139942 | GIBBZE | Heat | 0 | 5.78% | 1.35 | 1.272 |
| 10/31/01 | DR3070-908804X | 1139943 | GIBBZE | PK | 0 | 10.55% | 1.64 | 1.4669 |
| 10/31/01 | DR3070-908805X | 1139945 | GIBBZE | Heat | 0 | 1.94% | 1.35 | 1.3238 |
| 10/31/01 | DR3070-908805X | 1139946 | GIBBZE | PK | 0 | 8.89% | 1.64 | 1.4942 |
| 10/31/01 | DR3070-908806X | 1139948 | GIBBZE | Heat | 0 | -12.17% | 1.35 | 1.5143 |

Figure 10b continued

| Harvest Date | Aliquot Name | TestID | Test Name | Sample Treatment | % Inhibition (visual) | % Inhibition (calc) | Average OD595 | Sample OD595 |
|---|---|---|---|---|---|---|---|---|
| 10/31/01 | DR3070-908806X | 1139949 | GIBBZE | PK | 0 | 6.52% | 1.64 | 1.533 |
| 10/31/01 | DR3070-908807X | 1139951 | GIBBZE | Heat | 0 | -16.70% | 1.35 | 1.5754 |
| 10/31/01 | DR3070-908807X | 1139952 | GIBBZE | PK | 0 | -13.54% | 1.64 | 1.862 |
| 10/31/01 | DR3070-908808X | 1139954 | GIBBZE | Heat | 0 | -11.48% | 1.35 | 1.505 |
| 10/31/01 | DR3070-908808X | 1139955 | GIBBZE | PK | 0 | 3.95% | 1.64 | 1.5753 |
| 10/31/01 | DR3070-908809X | 1139957 | GIBBZE | Heat | 0 | -16.26% | 1.35 | 1.5695 |
| 10/31/01 | DR3070-908809X | 1139958 | GIBBZE | PK | 0 | -2.05% | 1.64 | 1.6737 |
| 10/31/01 | DR3070-908810X | 1139960 | GIBBZE | Heat | 0 | -8.14% | 1.35 | 1.4599 |
| 10/31/01 | DR3070-908810X | 1139961 | GIBBZE | PK | 0 | -1.05% | 1.64 | 1.6573 |
| 10/31/01 | DR3070-908818X | 1139972 | GIBBZE | Heat | 0 | 15.31% | 1.35 | 1.1433 |
| 10/31/01 | DR3070-908818X | 1139973 | GIBBZE | PK | 0 | -20.33% | 1.64 | 1.9734 |
| 10/31/01 | DR3070-908819X | 1139975 | GIBBZE | Heat | 0 | -0.70% | 1.35 | 1.3595 |
| 10/31/01 | DR3070-908819X | 1139976 | GIBBZE | PK | 0 | -13.01% | 1.64 | 1.8533 |
| 10/31/01 | DR3070-908820X | 1139978 | GIBBZE | Heat | 0 | 6.57% | 1.35 | 1.2613 |
| 10/31/01 | DR3070-908820X | 1139979 | GIBBZE | PK | 0 | -8.24% | 1.64 | 1.7751 |
| 10/31/01 | DR3070-908821X | 1139981 | GIBBZE | Heat | 0 | 6.92% | 1.35 | 1.2566 |
| 10/31/01 | DR3070-908821X | 1139982 | GIBBZE | PK | 0 | -15.87% | 1.64 | 1.9003 |
| 10/31/01 | DR3070-908822X | 1139984 | GIBBZE | Heat | 0 | 10.83% | 1.35 | 1.2038 |
| 10/31/01 | DR3070-908822X | 1139985 | GIBBZE | PK | 0 | -7.53% | 1.64 | 1.7635 |
| 10/31/01 | DR3070-908823X | 1139987 | GIBBZE | Heat | 0 | 12.19% | 1.35 | 1.1854 |
| 10/31/01 | DR3070-908823X | 1139988 | GIBBZE | PK | 0 | 8.77% | 1.64 | 1.4961 |
| 10/31/01 | DR3070-908824X | 1139990 | GIBBZE | Heat | 0 | 9.12% | 1.35 | 1.2269 |
| 10/31/01 | DR3070-908824X | 1139991 | GIBBZE | PK | 0 | 7.77% | 1.64 | 1.5126 |
| 10/31/01 | DR3070-908825X | 1139993 | GIBBZE | Heat | 0 | -1.79% | 1.35 | 1.3741 |
| 10/31/01 | DR3070-908825X | 1139994 | GIBBZE | PK | 0 | 1.59% | 1.64 | 1.6139 |
| 10/31/01 | DR3070-908826X | 1139996 | GIBBZE | Heat | 0 | -6.76% | 1.35 | 1.4412 |
| 10/31/01 | DR3070-908826X | 1139997 | GIBBZE | PK | 0 | 0.18% | 1.64 | 1.6371 |
| 10/31/01 | DR3070-908827X | 1139999 | GIBBZE | Heat | 0 | -0.97% | 1.35 | 1.3631 |
| 10/31/01 | DR3070-908827X | 1140000 | GIBBZE | PK | 0 | 8.08% | 1.64 | 1.5075 |

NUCLEIC ACID COMPOSITIONS CONFERRING DISEASE RESISTANCE

FIELD OF THE INVENTION

This invention relates to nucleic acid and amino acid sequences that confer disease resistance in plants, as well as disease resistant plants, plant seeds, plant tissues and plant cells comprising such sequences.

BACKGROUND OF THE INVENTION

Ever since the advent of agriculture thousands of years ago, farmers have been engaged in an ongoing battle to minimize the impact of crop pests. Plant diseases caused by bacteria and fungi are currently a major factor in limiting crop production worldwide. For example, it was estimated that head blight, caused by the fungal pathogens *Fusarium graminearum* and *F. poae* caused $3 billion in losses to wheat and barley production in the US between 1991-1996. The impact in less developed countries, where food production is usually at or below sustenance levels, is much more severe. Diseases not only adversely affect overall yield, but have a significant impact on the quality of foods produced. This destruction of crops and decrease in food quality has profound socioeconomic effects, as exemplified by the widespread starvation and subsequent emigration caused by the Irish potato famine of the 1800's. Furthermore, some plant disease agents pose human health hazards, such as mycotoxins produced by fungal phytopathogens.

Fungi are a highly diverse and versatile group of organisms that successfully occupy most natural habitats. Less than 10% of the ~100,000 known fungal species can colonize plants, and of these, a small fraction are responsible for plant diseases. However, virtually all flowering plants are attacked by and susceptible to some form of phytopathogenic fungus, and the specificity of these interactions is determined by host range limitations of both plant and microbe. In general, fungal phytopathogens may be categorized into three classes: 1) opportunistic parasites, that usually have a broad host range but relatively low virulence, 2) facultative pathogens that rely on living plants to grow but can survive as free-living under some circumstances, and 3) obligate pathogens, for which a living host is an absolute requirement for survival. Many of the most serious and virulent plant disease agents fall into the second class of phytopathogen, the facultative parasites, and it is this group of organisms that is of primary interest to agricultural researchers. Agronomically important diseases caused by fungal phytopathogens include: glume and leaf blotch, late blight, stalk/head rot, rice blast, leaf blight and spot, corn smut, wilt, sheath blight, stem canker, root rot, blackleg and kernel rot.

Plant Defense

Over the course of evolution and natural selection, plants have developed several mechanisms of defense against phytopathogens. This process, often referred to as the "evolutionary arms-race," continues due to the rapid ability of most pathogens to overcome plant defenses. Plants have several defensive modes-of-action, that often act in concert to mount responses in both generalized and specific manners. Defense mechanisms such as bark, trichomes and waxy cuticles form physical barriers protecting the plant from contact with disease organisms. Additionally, some plants secrete compounds, such as resins or gums, that not only provide a barrier to pathogen contact, but in some cases may act as a repellent.

In addition to physical barriers, plants have developed the ability to mount defense responses when challenged by pathogens. These induced responses require that a plant recognize a pathogen, activate and elaborate a defense pathway, and localize the infection, preventing invasion/spread of the pathogen and full-blown disease. This type of resistant plant-microbe interaction is described as incompatible, since the pathogen is not able to successfully parasitize and infect the host plant. Incompatible interactions involve a complex set of distinct and networked signal transduction pathways, the study of which has been facilitated by molecular analyses of both plant and microbe genes identified in various mutant screens. Generally, the defense pathways induced during incompatible interactions fall into two categories: the hypersensitive response (HR), and systemic acquired resistance (SAR). However, it is clear that there are many intersecting and overlapping branch points in these pathways.

The HR consists of localized, induced cell death in a host plant at the site of pathogen invasion. HR is frequently associated with the appearance of necrotic flecks containing dead plant cells within a few hours of pathogen contact. This plant cell death deprives the pathogen of access to further nutrients, causing pathogen arrest and protecting the rest of the plant from the disease agent. The mechanisms of HR include both the activation of programmed cell death (apoptosis) by the plant and/or a switch in plant cell metabolism, activating biochemical pathways that produce compounds toxic to both pathogen and plant. The triggering of HR is associated with the presence of reactive oxygen species such as superoxide anions and $H_2O_2$, that can act as signal molecules in addition to being converted to highly reactive and damaging oxygen radicals. HR is also associated with the induction of benzoic acid (BA), salicylic acid (SA), and their respective glucoside conjugates, which also play signaling roles and may be directly antimicrobial, as well as several classes of PR (pathogen response) proteins.

SAR is a broad-spectrum, inducible plant immunity that is activated after the formation of a necrotic lesion, either as a part of HR or as a symptom of disease. Therefore, it is not limited to incompatible interactions, but may be induced by compatible interactions with disease-causing microbes. This immunity or resistance spreads systemically and develops in distal, unchallenged parts of the plant. SAR acts nonspecifically throughout the plant and reduces the severity of disease symptoms caused by all classes of pathogens, including highly virulent ones. It can be induced by the elicitor SA in a dose-dependent manner, and involves a complex set of signal transduction molecules and downstream elicitors. The SAR response is characterized by the coordinate induction in uninfected leaves of several gene families, including chitinases, β-1,3 glucanases, PR-1 proteins and many others. The exact mechanisms of SAR and HR are still being elucidated, and are also targets for bioengineering of plant disease resistance.

Traditional Agricultural Approaches to Plant Disease Control

Over several centuries of agricultural development, farmers have devised methods for controlling plant disease. Husbandry techniques such as crop rotation, controlled irrigation, manure application, and tilling date back to the Roman Empire. Alone, these methods are limited in their efficacy to control diseases (by modern standards). However, they are still considered standard practice, and contribute significantly to any comprehensive pest management program.

In addition to husbandry, breeding methods have been employed to develop disease-resistant cultivars. The ability to select and propagate cultivars of crops containing desirable traits has enabled plant breeders to take advantage of natural genetic variation and/or induced mutations. There are numerous genetic methods and techniques available to breeders, including crossing and hybridization, embryo rescue, cell fusion and mutagenesis. The programs breeders implement depend on both the type of cultivar they want to improve (e.g., hybrid vs. inbred) and the reproductive biology of the particular species (self-pollinated vs. outcrossed). One example of a successful breeding program is that of blight-resistant potatoes that are a result of introducing traits from a Mexican species into >50% of all cultivars. Conventional breeding methods will undoubtedly continue to play a significant role in the improvement of agricultural crops, however, the time-scale and labor requirements of breeding programs may not be adequate to meet increasing demands for many agronomic traits, including disease resistance. Furthermore, the ability of pathogens to rapidly overcome resistance bred into new races of plants limits the utility and useful lifetime of these crops.

Within the last several decades, agricultural techniques have expanded to include widespread and intensive use of chemicals. A recent study of US farm-sector sales of pesticides estimated that for 11 major crops, a total of approximately $8.83 billion was spent in 1997 alone. This represents a significant portion of the US agriculture economy. In addition to chemical control, bio-control methods have gained a smaller, but constantly growing, following among farmers. As concern for the global environment and human health increases, it is imperative that new agricultural practices be developed and implemented.

AgBiotech Approaches to Plant Disease Control

The advent of modern biology, particularly molecular biology and genetics, has opened up new avenues for disease control research and practice. Scientists have focused on utilizing recombinant DNA (rDNA) methods, which allow new varieties of plants to be produced much faster than by conventional breeding. rDNA techniques allow the introduction of genes from distantly related species or even from different biological kingdoms into crop plants, conferring traits that provide significant agronomic advantages. Furthermore, detailed knowledge of the traits being introduced, such as cellular function and localization, can lead to less variability in offspring, and fine-tuning of secondary effects. After a trait has been introduced into a plant by transgenic methods, conventional breeding can be used to hybridize the transgenic line with useful varieties and elite germplasms, resulting in crops containing numerous advantageous properties.

Agricultural biotechnology (AgBiotech) approaches to disease resistance are typically three-fold. First, specific crops that undergo compatible (disease causing) interactions with specific pathogens are analyzed to determine the endogenous factors that enable this interaction, in an effort to prevent the particular disease(s) via bio-engineering. Second, researchers look for exogenous factors (compounds and proteins) from other species/sources that, when produced in crop plants, provide protection from phytopathogens. Finally, efforts are being made to hyper-activate the plant's own defense responses, in order to provide crops with broad-spectrum immunity against several disease agents simultaneously. Each of these approaches has it's advantages and disadvantages, and has met with some limited success to date. However, intensive research and testing continues; between 1987 and May 1999, there were 61 publicly-sponsored and 272 privately-sponsored field trials testing genes for fungal disease resistance in transgenic crops. A recent example of a successfull disease-resistance bioengineered product was described by the Monsanto Company, which demonstrated that a potato engineered to express an alfalfa antifungal peptide (defensin) showed robust resistance to the fungal pathogen *Verticillium dahliae* (Verticillium wilt) under both greenhouse and field conditions.

As AgBiotech hurtles into the genomics and post-genomics era, the massive amounts of genetic and functional data being generated are being used to direct the search for genes that can be utilized with recombinant methods. Additionally, transgenic technology itself is overcoming some of it's rate-limiting obstacles, allowing expression and modulation of several genes simultaneously in transgenic crops. These advances in both the informational and technological tools available to agricultural biotechnologists has and will continue to increase the pace of discovery and product development with regards to disease resistance. As the regulatory and commercial framework is developed, many of these AgBiotech products will be entering the marketplace. It is therefore reasonable to expect that in the very near future, bioengineered crops will be part of a comprehensive, integrated disease management program throughout the agricultural enterprise.

Accordingly, what is needed in the art are gene sequences and polypeptide sequences whose expression in plants, plant seeds, plant tissues and/or plant cells causes resistance to plant pathogens.

SUMMARY OF THE INVENTION

This invention relates to deoxyribonucleic acid (DNA) and amino acid sequences that confer disease resistance phenotypes in plants, as well as disease resistant plants, plant seeds, plant tissues and plant cells comprising such sequences.

In some embodiments, the present invention provides polynucleotides and polypeptides that confer disease resistance phenotypes when expressed in plants. The present invention is not limited to any particular polypeptide or polynucleotide sequences that confer disease resistance phenotypes. Indeed, a variety of such sequences are contemplated. Accordingly, in some embodiments the present invention provides an isolated nucleic acid selected from the group consisting of SEQ ID NOs:1-2318 and nucleic acid sequences that hybridize to any thereof under conditions of low stringency, wherein expression of the isolated nucleic acid in a plant results in a disease resistance phenotype. In further preferred embodiments, the present invention provides vectors comprising the foregoing polynucleotide sequences. In still further embodiments, the foregoing sequences are operably linked to an exogenous promoter, most preferably a plant promoter. However, the present invention is not limited to the use of any particular promoter. Indeed, the use of a variety of promoters is contemplated, including, but not limited to, 35S and 19S of Cauliflower Mosaic Virus, Cassava Vein Mosaic Virus, ubiquitin, heat shock and rubisco promoters. In some embodiments, the nucleic acid sequences of the present invention are arranged in sense orientation, while in other embodiments, the nucleic acid sequences are arranged in the vector in antisense orientation. In still further embodiments, the present invention provides a plant comprising one of the foregoing nucleic acid sequences or vectors, as well as seeds, leaves, and fruit from the plant. In some particularly preferred embodiments, the present invention provides at least one of the foregoing sequences for use in conferring pathogen or disease resistance in a plant.

In still other embodiments, the present invention provides processes for making a transgenic plant comprising providing a vector as described above and a plant, and transfecting the plant with the vector. In other preferred embodiments, the present invention provides processes for providing a disease or pathogen resistance phenotype in a plant or population of plants comprising providing a vector as described above and a plant, and transfecting the plant with the vector under conditions such that a disease resistance phenotype is conferred by expression of the isolated nucleic acid from the vector. In still further embodiments, the present invention provides an isolated nucleic acid selected from the group consisting of SEQ ID NOs:1-2318 and nucleic acid sequences that hybridize to any thereof under conditions of low stringency for use in producing a disease or pathogen resistant plant. In other embodiments, the present invention provides an isolated nucleic acid, composition or vector substantially as described herein in any of the examples or claims.

BRIEF DESCRIPTION OF THE DRAWINGS

FIG. 1 presents the contig sequences corresponding to SEQ ID NOs:1-407 and 2256-2318.

FIG. 2 presents homologous sequences SEQ ID NOs:471-1209 and 1346-2255.

FIG. 3 is a table describing homologues identified using BLAST search algorithms.

FIG. 4 is a table of BLAST search results from the Derwent amino acid database.

FIG. 5 is a table of BLAST search results from the Derwent nucleotide database.

FIG. 6 is a table summarizing the results of the disease resistance screen.

FIG. 7 presents sequences corresponding to SEQ ID NOs:1210-1335.

FIG. 8 is a table summarizing results of a disease resistance screen for sequences shown in FIG. 7.

FIG. 9 is table providing data summarizing the results of disease resistance assays of selected clones against target pathogens.

FIG. 10a is table providing data regarding the activity of clone DR-VX (SEQ ID NO: 2256), including data for heat treated, proteinaseK treated, and untreated samples of extracts.

FIG. 10b is table providing data regarding the activity of clone GBSG000216187 (SEQ ID NO: 2257), including data for heat treated, proteinaseK treated, and untreated samples of extracts.

DEFINITIONS

Before the present proteins, nucleotide sequences, and methods are described, it should be noted that this invention is not limited to the particular methodology, protocols, cell lines, vectors, and reagents described herein as these may vary. It should also be understood that the terminology used herein is for the purpose of describing particular aspects of the invention, and is not intended to limit its scope, which will be limited only by the appended claims.

It must be noted that as used herein and in the appended claims, the singular forms "a", "an", and "the" include plural reference unless the context clearly dictates otherwise. Thus, for example, reference to "a host cell" includes a plurality of such host cells, reference to the "antibody" is a reference to one or more antibodies and equivalents thereof known to those skilled in the art, and so forth.

Unless defined otherwise, all technical and scientific terms used herein have the same meanings as commonly understood by one of ordinary skill in the art to which this invention belongs. Although any methods and materials similar or equivalent to those described herein can be used in the practice or testing of the present invention, the preferred methods, devices, and materials are now described. All publications mentioned herein are incorporated herein by reference for the purpose of describing and disclosing the cell lines, vectors, and methodologies that are reported in the publications that might be used in connection with the invention. Nothing herein is to be construed as an admission that the invention is not entitled to antedate such disclosure by virtue of prior invention.

"Acylate", as used herein, refers to the introduction of an acyl group into a molecule, (for example, acylation).

"Adjacent", as used herein, refers to a position in a nucleotide sequence immediately 5' or 3' to a defined sequence.

"Agonist", as used herein, refers to a molecule which, when bound to a polypeptide (for example, a polypeptide encoded by a nucleic acid of the present invention), increases the biological or immunological activity of the polypeptide. Agonists may include proteins, nucleic acids, carbohydrates, or any other molecules that bind to the protein.

"Alterations" in a polynucleotide (for example, a polypeptide encoded by a nucleic acid of the present invention), as used herein, comprise any deletions, insertions, and point mutations in the polynucleotide sequence. Included within this definition are alterations to the genomic DNA sequence that encodes the polypeptide.

"Amino acid sequence", as used herein, refers to an oligopeptide, peptide, polypeptide, or protein sequence, and fragments or portions thereof, and to naturally occurring or synthetic molecules. "Amino acid sequence" and like terms, such as "polypeptide" or "protein" as recited herein are not meant to limit the amino acid sequence to the complete, native amino acid sequence associated with the recited protein molecule.

"Amplification", as used herein, refers to the production of additional copies of a nucleic acid sequence and is generally carried out using polymerase chain reaction (PCR) technologies well known in the art (Dieffenbach, C. W. and G. S. Dveksler (1995) PCR Primer, a Laboratory Manual, Cold Spring Harbor Press, Plainview, N.Y.).

"Antibody" refers to intact molecules as well as fragments thereof that are capable of specific binding to a epitopic determinant. Antibodies that bind a polypeptide (for example, a polypeptide encoded by a nucleic acid of the present invention) can be prepared using intact polypeptides or fragments as the immunizing antigen. These antigens may be conjugated to a carrier protein, if desired.

"Antigenic determinant", "determinant group", or "epitope of an antigenic macromolecule", as used herein, refer to any region of the macromolecule with the ability or potential to elicit, and combine with, one or more specific antibodies. Determinants exposed on the surface of the macromolecule are likely to be immunodominant, that is, more immunogenic than other (immunorecessive) determinants that are less exposed, while some (for example, those within the molecule) are non-immunogenic (immunosilent). As used herein, "antigenic determinant" refers to that portion of a molecule that makes contact with a particular antibody (for example, an epitope). When a protein or fragment of a protein is used to immunize a host animal, numerous regions of the protein may induce the production of antibodies that bind specifically to a given region or three-dimensional structure on the protein; these regions or structures are referred to as antigenic determinants. An antigenic determinant may compete with the intact antigen (the immunogen used to elicit the immune response) for binding to an antibody.

"Antisense", as used herein, refers to a deoxyribonucleotide sequence whose sequence of deoxyribonucleotide residues is in reverse 5' to 3' orientation in relation to the sequence of deoxyribonucleotide residues in a sense strand of a DNA duplex. A "sense strand" of a DNA duplex refers to a strand in a DNA duplex that is transcribed by a cell in its natural state into a "sense mRNA." Thus an "antisense" sequence is a sequence having the same sequence as the non-coding strand in a DNA duplex. The term "antisense RNA" refers to a RNA transcript that is complementary to all or part of a target primary transcript or mRNA and that blocks the expression of a target gene by interfering with the processing, transport and/or translation of its primary transcript or mRNA. The complementarity of an antisense RNA may be with any part of the specific gene transcript, for example, at the 5' non-coding sequence, 3' non-coding sequence, introns, or the coding sequence. In addition, as used herein, antisense RNA may contain regions of ribozyme sequences that increase the efficacy of antisense RNA to block gene expression. "Ribozyme" refers to a catalytic RNA and includes sequence-specific endoribonucleases.

"Anti-sense inhibition", as used herein, refers to a type of gene regulation based on cytoplasmic, nuclear, or organelle inhibition of gene expression due to the presence in a cell of an RNA molecule complementary to at least a portion of the mRNA being translated. It is specifically contemplated that DNA molecules may be from either an RNA virus or mRNA from the host cell genome or from a DNA virus.

"Antagonist" or "inhibitor", as used herein, refer to a molecule that, when bound to a polypeptide (for example, a polypeptide encoded by a nucleic acid of the present invention), decreases the biological or immunological activity of the polypeptide. Antagonists and inhibitors may include proteins, nucleic acids, carbohydrates, or any other molecules that bind to the polypeptide.

"Biologically active", as used herein, refers to a molecule having the structural, regulatory, or biochemical functions of a naturally occurring molecule.

"Cell culture", as used herein, refers to a proliferating mass of cells that may be in either an undifferentiated or differentiated state.

"Chimeric plasmid", as used herein, refers to any recombinant plasmid formed (by cloning techniques) from nucleic acids derived from organisms that do not normally exchange genetic information (for example, *Escherichia coli* and *Saccharomyces cerevisiae*).

"Chimeric sequence" or "chimeric gene", as used herein, refer to a nucleotide sequence derived from at least two heterologous parts. The sequence may comprise DNA or RNA.

"Coding sequence", as used herein, refers to a deoxyribonucleotide sequence that, when transcribed and translated, results in the formation of a cellular polypeptide or a ribonucleotide sequence that, when translated, results in the formation of a cellular polypeptide.

"Compatible", as used herein, refers to the capability of operating with other components of a system. A vector or plant viral nucleic acid that is compatible with a host is one that is capable of replicating in that host. A coat protein that is compatible with a viral nucleotide sequence is one capable of encapsidating that viral sequence.

"Coding region", as used herein, refers to that portion of a gene that codes for a protein. The term "non-coding region" refers to that portion of a gene that is not a coding region.

"Complementary" or "complementarity", as used herein, refer to the Watson-Crick base-pairing of two nucleic acid sequences. For example, for the sequence 5'-AGT-3' binds to the complementary sequence 3'-TCA-5'. Complementarity between two nucleic acid sequences may be "partial", in which only some of the bases bind to their complement, or it may be complete as when every base in the sequence binds to it's complementary base. The degree of complementarity between nucleic acid strands has significant effects on the efficiency and strength of hybridization between nucleic acid strands.

"Contig" refers to a nucleic acid sequence that is derived from the contiguous assembly of two or more nucleic acid sequences.

"Correlates with expression of a polynucleotide", as used herein, indicates that the detection of the presence of ribonucleic acid that is similar to a nucleic acid (for example, SEQ ID NOs:1-2318) and is indicative of the presence of mRNA encoding a polypeptide (for example, a polypeptide encoded by a nucleic acid of the present invention) in a sample and thereby correlates with expression of the transcript from the polynucleotide encoding the protein.

"Deletion", as used herein, refers to a change made in either an amino acid or nucleotide sequence resulting in the absence of one or more amino acids or nucleotides, respectively.

"Encapsidation", as used herein, refers to the process during virion assembly in which nucleic acid becomes incorporated in the viral capsid or in a head/capsid precursor (for example, in certain bacteriophages).

"Exon", as used herein, refers to a polynucleotide sequence in a nucleic acid that encodes information for protein synthesis and that is copied and spliced together with other such sequences to form messenger RNA.

"Expression", as used herein, is meant to incorporate transcription, reverse transcription, and translation.

"Expressed sequence tag (EST)" as used herein, refers to relatively short single-pass DNA sequences obtained from one or more ends of cDNA clones and RNA derived therefrom. They may be present in either the 5' or the 3' orientation. ESTs have been shown to be useful for identifying particular genes.

"Industrial crop", as used herein, refers to crops grown primarily for consumption by humans or animals or use in industrial processes (for example, as a source of fatty acids for manufacturing or sugars for producing alcohol). It will be understood that either the plant or a product produced from the plant (for example, sweeteners, oil, flour, or meal) can be consumed. Examples of food crops include, but are not limited to, corn, soybean, rice, wheat, oilseed rape, cotton, oats, barley, and potato plants.

"Foreign gene", as used herein, refers to any sequence that is not native to the organism.

"Fusion protein", as used herein, refers to a protein containing amino acid sequences from each of two distinct proteins; it is formed by the expression of a recombinant gene in which two coding sequences have been joined together such that their reading frames are in phase. Hybrid genes of this type may be constructed in vitro in order to label the product of a particular gene with a protein that can be more readily assayed (for example, a gene fused with lacZ in *E. coli* to obtain a fusion protein with β-galactosidase activity). As a non-limiting second example, a fusion protein may comprise a protein linked to a signal peptide to allow its secretion by the cell. The products of certain viral oncogenes are fusion proteins.

"Gene", as used herein, refers to a discrete nucleic acid sequence responsible for a discrete cellular product. The term "gene", as used herein, refers not only to the nucleotide sequence encoding a specific protein, but also to any adjacent 5' and 3' non-coding nucleotide sequence involved in the regulation of expression of the protein encoded by the gene of interest. These non-coding sequences include terminator sequences, promoter sequences, upstream activator sequences, regulatory protein binding sequences, and the like. These non-coding sequence gene regions may be readily identified by comparison with previously identified eukaryotic non-coding sequence gene regions. Furthermore, the person of average skill in the art of molecular biology is able to identify the nucleotide sequences forming the non-coding regions of a gene using well-known techniques such as a site-directed mutagenesis, sequential deletion, promoter probe vectors, and the like.

"Growth cycle", as used herein, is meant to include the replication of a nucleus, an organelle, a cell, or an organism.

The term "heterologous gene", as used herein, means a gene encoding a protein, polypeptide, RNA, or a portion of any thereof, whose exact amino acid.sequence is not normally found in the host cell, but is introduced by standard gene transfer techniques.

"Host", as used herein, refers to a cell, tissue or organism capable of replicating a vector or plant viral nucleic acid and that is capable of being infected by a virus containing the viral vector or plant viral nucleic acid. This term is intended to include prokaryotic and eukaryotic cells, organs, tissues or organisms, where appropriate.

The term "homolog" as in a "homolog" of a given nucleic acid sequence, refers to a nucleic acid sequence (for example, a nucleic acid sequence from another organism), that shares a given degree of "homology" with the nucleic acid sequence.

"Homology" refers to a degree of complementarity. There may be partial homology or complete homology (identity). A partially complementary sequence is one that at least partially inhibits a completely complementary sequence from hybridizing to a target nucleic acid and is referred to using the functional term "substantially homologous." The inhibition of hybridization of the completely complementary sequence to the target sequence may be examined using a hybridization assay (Southern or Northern blot, solution hybridization and the like) under conditions of low stringency. A substantially homologous sequence or probe will compete for and inhibit the binding (the hybridization) of a completely homologous sequence to a target under conditions of low stringency. This is not to say that conditions of low stringency are such that non-specific binding is permitted; low stringency conditions require that the binding of two sequences to one another be a specific (selective) interaction. The absence of non-specific binding may be tested by the use of a second target that lacks even a partial degree of complementarity (for example, less than about 30% identity); in the absence of non-specific binding the probe will not hybridize to the second non-complementary target.

Numerous equivalent conditions may be employed to comprise low stringency conditions; factors such as the length and nature (DNA, RNA, base composition) of the probe and nature of the target (DNA, RNA, base composition, present in solution or immobilized, etc.) and the concentration of the salts and other components (for example, the presence or absence of formarnide, dextran sulfate, polyethylene glycol) are considered and the hybridization solution may be varied to generate conditions of low stringency hybridization different from, but equivalent to, the above listed conditions. In addition, conditions that promote hybridization under conditions of high stringency (for example, increasing the temperature of the hybridization and/or wash steps, the use of formamide in the hybridization solution, etc.) are readily apparent to one skilled in the art.

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

A gene may produce multiple RNA species that are generated by differential splicing of the primary RNA transcript. cDNAs that are splice variants of the same gene will contain regions of sequence identity or complete homology (representing the presence of the same exon or portion of the same exon on both cDNAs) and regions of complete non-identity (for example, representing the presence of exon "A" on cDNA 1 wherein cDNA 2 contains exon "B" instead). Because the two cDNAs contain regions of sequence identity, they will both hybridize to a probe derived from the entire gene or portions of the gene containing sequences found on both cDNAs; the two splice variants are therefore substantially homologous to such a probe and to each other.

When used in reference to a single-stranded nucleic acid sequence, the term "substantially homologous" refers to any probe that can hybridize (it is the complement of) the single-stranded nucleic acid sequence under conditions of low stringency as described above.

The term "hybridization" is used in reference to the pairing of complementary nucleic acids. Hybridization and the strength of hybridization (for example, the strength of the association between the nucleic acids) is impacted by such factors as the degree of complementary between the nucleic acids, stringency of the conditions involved, the melting temperature ($T_m$) of the formed hybrid, and the G:C ratio within the nucleic acids.

"Hybridization complex", as used herein, refers to a complex formed between nucleic acid strands by virtue of hydrogen bonding, stacking or other non-covalent interactions between bases. A hybridization complex may be formed in solution or between nucleic acid sequences present in solution and nucleic acid sequences immobilized on a solid support (for example, membranes, filters, chips, pins or glass slides to which cells have been fixed for in situ hybridization).

"Immunologically active" refers to the capability of a natural, recombinant, or synthetic polypeptide, or any oligopeptide thereof, to bind with specific antibodies and induce a specific immune response in appropriate animals or cells.

"Induction" and the terms "induce", "induction" and "inducible", as used herein, refer generally to a gene and a promoter operably linked thereto which is in some manner dependent upon an external stimulus, such as a molecule, in order to actively transcribed and/or translate the gene.

"Infection", as used herein, refers to the ability of a virus to transfer its nucleic acid to a host or introduce viral nucleic acid into a host, wherein the viral nucleic acid is replicated, viral proteins are synthesized, and new viral particles assembled. In this context, the terms "transmissible" and "infective" are used interchangeably herein.

"Insertion" or "addition", as used herein, refers to the replacement or addition of one or more nucleotides or amino acids, to a nucleotide or amino acid sequence, respectively.

"In cis", as used herein, indicates that two sequences are positioned on the same strand of RNA or DNA.

"In trans", as used herein, indicates that two sequences are positioned on different strands of RNA or DNA.

"Intron", as used herein, refers to a polynucleotide sequence in a nucleic acid that does not encode information for protein synthesis and is removed before translation of messenger RNA.

"Isolated", as used herein, refers to a polypeptide or polynucleotide molecule separated not only from other peptides, DNAs, or RNAs, respectively, that are present in the natural source of the macromolecule. "Isolated" and "purified" do not encompass either natural materials in their native state or natural materials that have been separated into components (for example, in an acrylamide gel) but not obtained either as pure substances or as solutions".

"Kinase", as used herein, refers to an enzyme (for example, hexokinase and pyruvate kinase) that catalyzes the transfer of a phosphate group from one substrate (commonly ATP) to another.

"Marker" or "genetic marker", as used herein, refer to a genetic locus that is associated with a particular, usually readily detectable, genotype or phenotypic characteristic (for example, an antibiotic resistance gene).

"Metabolome", as used herein, indicates the complement of relatively low molecular weight molecules that is present in a plant, plant part, or plant sample, or in a suspension or extract thereof. Examples of such molecules include, but are not limited to: acids and related compounds; mono-, di-,and tri-carboxylic acids (saturated, unsaturated, aliphatic and cyclic, aryl, alkaryl); aldo-acids, keto-acids; lactone forms; gibberellins; abscisic acid; alcohols, polyols, derivatives, and related compounds; ethyl alcohol, benzyl alcohol, methanol; propylene glycol, glycerol, phytol; inositol, furfuryl alcohol, menthol; aldehydes, ketones, quinones, derivatives, and related compounds; acetaldehyde, butyraldehyde, benzaldehyde, acrolein, furfural, glyoxal; acetone, butanone; anthraquinone; carbohydrates; mono-, di-, trisaccharides; alkaloids, amines, and other bases; pyridines (including nicotinic acid, nicotinamide); pyrimidines (including cytidine, thymine); purines (including guanine, adenine, xanthines/hypoxanthines, kinetin); pyrroles; quinolines (including isoquinolines); morphinans, tropanes, cinchonans; nucleotides, oligonucleotides, derivatives, and related compounds; guanosine, cytosine, adenosine, thymidine, inosine; amino acids, oligopeptides, derivatives, and related compounds; esters; phenols and related compounds; heterocyclic compounds and derivatives; pyrroles, tetrapyrroles (corrinoids and porphines/porphyrins, w/w/o metalion); flavonoids; indoles; lipids (including fatty acids and triglycerides), derivatives, and related compounds; carotenoids, phytoene; and sterols, isoprenoids including terpenes.

"Modulate", as used herein, refers to a change or an alteration in the biological activity of a polypeptide (for example, a polypeptide encoded by a nucleic acid of the present invention). Modulation may be an increase or a decrease in protein activity, a change in binding characteristics, or any other change in the biological, functional or immunological properties of the polypeptide.

"Movement protein", as used herein, refers to a noncapsid protein required for cell to cell movement of replicons or viruses in plants.

"Multigene family", as used herein, refers to a set of genes descended by duplication and variation from some ancestral gene. Such genes may be clustered together on the same chromosome or dispersed on different chromosomes. Examples of multigene families include those which encode the histones, hemoglobins, immunoglobulins, histocompatibility antigens, actins, tubulins, keratins, collagens, heat shock proteins, salivary glue proteins, chorion proteins, cuticle proteins, yolk proteins, and phaseolins.

"Nucleic acid sequence", as used herein, refers to a polymer of nucleotides in which the 3' position of one nucleotide sugar is linked to the 5' position of the next by a phosphodiester bridge. In a linear nucleic acid strand, one end typically has a free 5' phosphate group, the other a free 3' hydroxyl group. Nucleic acid sequences may be used herein to refer to oligonucleotides, or polynucleotides, and fragments or portions thereof, and to DNA or RNA of genomic or synthetic origin that may be single- or double-stranded, and represent the sense or antisense strand.

"Polypeptide", as used herein, refers to an amino acid sequence obtained from any species and from any source whether natural, synthetic, semi-synthetic, or recombinant.

"Oil-producing species," as used herein, refers to plant species that produce and store triacylglycerol in specific organs, primarily in seeds. Such species include soybean (*Glycine max*), rapeseed and canola (including *Brassica napus, Brassica rapa* and *Brassica campestris*), sunflower (*Helianthus annus*), cotton (*Gossypium hirsutum*), corn (*Zea mays*), cocoa (*Theobroma cacao*), safflower (*Carthamus tinctorius*), oil palm (*Elaeis guineensis*), coconut palm (*Cocos nucifera*), flax (*Linum usitatissimum*), castor (*Ricinus communis*) and peanut (*Arachis hypogaea*). The group also includes non-agronomic species that are useful in developing appropriate expression vectors such as tobacco, rapid cycling *Brassica* species, and *Arabidopsis thaliana*, and wild species that may be a source of unique fatty acids.

"Operably linked" refers to a juxtaposition of components, particularly nucleotide sequences, such that the normal function of the components can be performed. Thus, a coding sequence that is operably linked to regulatory sequences refers to a configuration of nucleotide sequences wherein the coding sequences can be expressed under the regulatory control, that is, transcriptional and/or translational control, of the regulatory sequences.

"Origin of assembly", as used herein, refers to a sequence where self-assembly of the viral RNA and the viral capsid protein initiates to form virions.

"Ortholog" refers to genes that have evolved from an ancestral locus.

"Overexpression" refers to the production of a gene product in transgenic organisms that exceeds levels of production in normal or non-transformed organisms.

"Cosuppression" refers to the expression of a foreign gene that has substantial homology to an endogenous gene resulting in the suppression of expression of both the foreign and the endogenous gene. As used herein, the term "altered levels" refers to the production of gene product(s) in transgenic organisms in amounts or portions that differ from that of normal or non-transformed organisms.

"Phenotype" or "phenotypic trait(s)", as used herein, refers to an observable property or set of properties resulting from the expression of a gene. "Visual phenotype", as used herein, refers to a plant displaying a symptom or group of symptoms that meet defined criteria. "Disease resistance phenotype", as used herein, refers to a phenotype where substantial resistance to any pathogen (for example, fungal phytopathogens) is displayed upon challenge with a pathogen. "Fungal phytopathogen control or resistance phenotype" refers to a phenotype wherein the plant exhibits substantial germination and/or growth inhibition of at least one phytopathogen.

"Plant", as used herein, refers to any plant and progeny thereof. The term also includes parts of plants, including seed, cuttings, tubers, fruit, flowers, etc. In a preferred embodiment, "plant" refers to cultivated plant species, such as corn, cotton, canola, sunflower, soybeans, sorghum, alfalfa, wheat, rice, plants producing fruits and vegetables, and turf and ornamental plant species.

"Plant cell", as used herein, refers to the structural and physiological unit of plants, consisting of a protoplast and the cell wall.

"Plant organ", as used herein, refers to a distinct and visibly differentiated part of a plant, such as root, stem, leaf or embryo.

"Plant tissue", as used herein, refers to any tissue of a plant in planta or in culture. This term is intended to include a whole plant, plant cell, plant organ, protoplast, cell culture, or any group of plant cells organized into a structural and functional unit.

"Portion", as used herein, with regard to a protein ("a portion of a given protein") refers to fragments of that protein. The fragments may range in size from four amino acid residues to the entire amino acid sequence minus one amino acid (10 nucleotides, 20, 30, 40, 50, 100, 200, etc.). A "portion" is preferably at least 25 nucleotides, more preferably at least 50 nucleotides, and even more preferably at least 100 nucleotides.

"Positive-sense inhibition", as used herein, refers to a type of gene regulation based on cytoplasmic inhibition of gene expression due to the presence in a cell of an RNA molecule substantially homologous to at least a portion of the mRNA being translated.

"Production cell", as used herein, refers to a cell, tissue or organism capable of replicating a vector or a viral vector, but which is not necessarily a host to the virus. This term is intended to include prokaryotic and eukaryotic cells, organs, tissues or organisms, such as bacteria, yeast, fungus, and plant tissue.

"Progeny" of a particular plant, as used herein, refers to any descendents of the plant containing all or part of the plant's DNA.

"Promoter", as used herein, refers to the 5'-flanking, non-coding sequence adjacent a coding sequence that is involved in the initiation of transcription of the coding sequence.

"Protoplast", as used herein, refers to an isolated plant cell without cell walls, having the potency for regeneration into cell culture or a whole plant.

"Purified", as used herein, when referring to a peptide or nucleotide sequence, indicates that the molecule is present in the substantial absence of other biological macromolecular, for example, polypeptides, polynucleic acids, and the like of the same type. The term "purified" as used herein preferably means at least 95% by weight, more preferably at least 99.8% by weight, of biological macromolecules of the same type present (but water, buffers, and other small molecules, especially molecules having a molecular weight of less than 1000 can be present).

"Pure", as used herein, preferably has the same numerical limits as "purified" immediately above. "Substantially purified", as used herein, refers to nucleic or amino acid sequences that are removed from their natural environment, isolated or separated, and are at least 60% free, preferably 75% free, and most preferably 90% free from other components with which they are naturally associated.

"Recombinant plant viral nucleic acid", as used herein, refers to a plant viral nucleic acid that has been modified to contain non-native nucleic acid sequences. These non-native nucleic acid sequences may be from any organism or purely synthetic, however, they may also include nucleic acid sequences naturally occurring in the organism into which the recombinant plant viral nucleic acid is to be introduced.

"Recombinant plant virus", as used herein, refers to a plant virus containing a recombinant plant viral nucleic acid.

"Regulatory region" or "regulatory sequence", as used herein, in reference to a specific gene refers to the non-coding nucleotide sequences within that gene that are necessary or sufficient to provide for the regulated expression of the coding region of a gene. Thus the term regulatory region includes promoter sequences, regulatory protein binding sites, upstream activator sequences, and the like. Specific nucleotides within a regulatory region may serve multiple functions. For example, a specific nucleotide may be part of a promoter and participate in the binding of a transcriptional activator protein.

"Replication origin", as used herein, refers to the minimal terminal sequences in linear viruses that are necessary for viral replication.

"Replicon", as used herein, refers to an arrangement of RNA sequences generated by transcription of a transgene that is integrated into the host DNA that is capable of replication in the presence of a helper virus. A replicon may require sequences in addition to the replication origins for efficient replication and stability.

"Sample", as used herein, is used in its broadest sense. A biological sample suspected of containing nucleic acid encoding a polypeptide (for example, a polypeptide encoded by a nucleic acid of the present invention) or fragments thereof may comprise a tissue, a cell, an extract from cells, chromosomes isolated from a cell (for example, a spread of metaphase chromosomes), genomic DNA (in solution or bound to a solid support such as for Southern analysis), RNA (in solution or bound to a solid support such as for northern analysis), cDNA (in solution or bound to a solid support), and the like.

"Silent mutation", as used herein, refers to a mutation that has no apparent effect on the phenotype of the organism.

"Site-directed mutagenesis", as used herein, refers to the in vitro induction of mutagenesis at a specific site in a given target nucleic acid molecule.

"Subgenomic promoter", as used herein, refers to a promoter of a subgenomic mRNA of a viral nucleic acid.

"Specific binding" or "specifically binding", as used herein, in reference to the interaction of an antibody and a protein or peptide, mean that the interaction is dependent upon the presence of a particular structure (the antigenic determinant or epitope) on the protein; in other words, the antibody is recognizing and binding to a specific protein structure rather than to proteins in general.

"$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation: $T_m=81.5+ 0.41(\% G+C)$, when a nucleic acid is in aqueous solution at 1 M NaCl (See for example, Anderson and Young, Quantitative Filter Hybridization, in *Nucleic Acid Hybridization* [1985]). Other references include more sophisticated computations that take structural as well as sequence characteristics into account for the calculation of $T_m$.

"Stringency" is used in reference to the conditions of temperature, ionic strength, and the presence of other compounds such as organic solvents, under which nucleic acid hybridizations are conducted. Those skilled in the art will recognize that "stringency" conditions may be altered by varying the parameters just described either individually or in concert. With "high stringency" conditions, nucleic acid base pairing will occur only between nucleic acid fragments that have a high frequency of complementary base sequences (for example, hybridization under "high stringency" conditions may occur between homologs with about 85-100% identity, preferably about 70-100% identity). With medium stringency conditions, nucleic acid base pairing will occur between nucleic acids with an intermediate frequency of complementary base sequences (for example, hybridization under "medium stringency" conditions may occur between homologs with about 50-70% identity). Thus, conditions of "weak" or "low" stringency are often required with nucleic acids that are derived from organisms that are genetically diverse, as the frequency of complementary sequences is usually less.

"High stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 0.1×SSPE, 1.0% SDS at 42° C. when a probe of about 500 nucleotides in length is employed.

"Medium stringency conditions" when used in reference to nucleic acid hybridization comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.5% SDS, 5×Denhardt's reagent and 100 µg/ml denatured salmon sperm DNA followed by washing in a solution comprising 1.0×SSPE, 1.0% SDS at 42° C. when a probe of about 500 nucleotides in length is employed.

"Low stringency conditions" comprise conditions equivalent to binding or hybridization at 42° C. in a solution consisting of 5×SSPE (43.8 g/l NaCl, 6.9 g/l $NaH_2PO_4$ $H_2O$ and 1.85 g/l EDTA, pH adjusted to 7.4 with NaOH), 0.1% SDS, 5×Denhardt's reagent [50×Denhardt's contains per 500 ml: 5 g Ficoll (Type 400, Pharamcia), 5 g BSA (Fraction V; Sigma)] and 100 µg/ml denatured salmon sperm DNA followed by washing in a solution comprising 5×SSPE, 0.1% SDS at 42° C. when a probe of about 500 nucleotides in length is employed.

"Substitution", as used herein, refers to a change made in an amino acid of nucleotide sequence that results in the replacement of one or more amino acids or nucleotides by different amino acids or nucleotides, respectively.

"Symptom", as used herein refers to a visual condition resulting from the action of the GENEWARE® vector or the clone insert.

"Systemic infection", as used herein, denotes infection throughout a substantial part of an organism including mechanisms of spread other than mere direct cell inoculation but rather including transport from one infected cell to additional cells either nearby or distant.

"Transcription", as used herein, refers to the production of an RNA molecule by RNA polymerase as a complementary copy of a DNA sequence.

"Transcription termination region", as used herein, refers to the sequence that controls formation of the 3' end of the transcript. Self-cleaving ribozymes and polyadenylation sequences are examples of transcription termination sequences.

"Transformation", as used herein, describes a process by which exogenous DNA enters and changes a recipient cell. It may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells that transiently express the inserted DNA or RNA for limited periods of time.

"Transfection", as used herein, refers to the introduction of foreign nucleic acid into eukaryotic cells. Transfection may be accomplished by a variety of means known to the art including calcium phosphate-DNA co-precipitation, DEAE-dextran-mediated transfection, polybrene-mediated transfection, electroporation, microinjection, liposome fusion, lipofection, protoplast fusion, retroviral infection, and biolistics. Transfection may, for example, result in cells in which the inserted nucleic acid is capable of replication either as an autonomously replicating molecule or as part of the host chromosome, or cells that transiently express the inserted nucleic acid for limited periods of time.

"Transposon", as used herein; refers to a nucleotide sequence such as a DNA or RNA sequence that is capable of transferring location or moving within a gene, a chromosome or a genome.

"Transgenic plant", as used herein, refers to a plant that contains a foreign nucleotide sequence inserted into either its nuclear genome or organellar genome.

"Transgene", as used herein, refers to a nucleic acid sequence that is inserted into a host cell or host cells by a transformation technique.

"Variants" of a polypeptide (for example, a polypeptide encoded by a nucleic acid of the present invention), as used herein, refers to a sequence resulting when a polypeptide is altered by one or more amino acids. The variant may have "conservative" changes, wherein a substituted amino acid has similar structural or chemical properties, for example, replacement of leucine with isoleucine. More rarely, a variant may have "nonconservative" changes, for example, replacement of a glycine with a tryptophan. Variants may also include sequences with amino acid deletions or insertions, or both. Guidance in determining which amino acid residues may be substituted, inserted, or deleted without abolishing biological or immunological activity may be found using computer programs well known in the art.

"Vector", as used herein, refers to a DNA and/or RNA molecule, typically a plasmid containing an origin of replication, that transfers a nucleic acid segment between cells.

"Virion", as used herein, refers to a particle composed of viral RNA and viral capsid protein.

"Virus", as used herein, refers to an infectious agent composed of a nucleic acid encapsidated in a protein. A virus may be a mono-, di-, tri- or multi-partite virus.

DESCRIPTION OF THE INVENTION

I. Identification of Nucleotide and Amino Acid Sequences

The invention is based on the discovery of nucleic acid and amino acid sequences that confer disease resistance when expressed in plants. In particular, the present invention encompasses the nucleic acid sequences encoded by SEQ ID NOs:1-407 and 2256-2318 and variants and portions thereof. Some of these sequences are contiguous sequences prepared from a database of 5' single pass sequences and are thus referred to as contig sequences. Full length sequences are designated FL.

Nucleic acids of the present invention were identified in clones generated from a variety of cDNA libraries. The cDNA libraries were constructed in the GENEWARE® vector. The GENEWARE® vector is described in U.S. application Ser. No. 09/008,186 (incorporated herein by reference). Each of the complete set of clones from the GENEWARE® library were used to prepare an infectious viral unit. An infectious unit corresponding to each clone was used to inoculate *Nicotiana benthamiana* (a dicotyledonous plant). The plants were grown under identical conditions and a phenotypic analysis of each plant was carried out. The disease resistance phenotype was observed in the plants that had been infected by an infectious unit created from the nucleic acids of the present invention.

Following the identification of the disease resistance phenotype in plant samples, further analyses of the sequences were carried out. In particular, bioinformatics methods such as those described below may be used by one of skill in the art to analyze the nucleotide sequences of the present invention.

II. Bioinformatics Methods

A. Phred, Phrap and Consed

Phred, Phrap and Consed are a set of programs that read DNA sequencer traces, make base calls, assemble the shotgun DNA sequence data and analyze the sequence regions that are likely to contribute to errors. Phred is the initial program used to read the sequencer trace data, call the bases and assign quality values to the bases. Phred uses a Fourier-based method to examine the base traces generated by the sequencer. The output files from Phred are written in FASTA, phd or scf format. Phrap is used to assemble contiguous sequences from only the highest quality portion of the sequence data output by Phred. Phrap is amenable to high-throughput data collection. Finally, Consed is used as a finishing tool to assign error probabilities to the sequence data. Detailed description of the Phred, Phrap and Consed software and its use can be found in the following references: Ewing et al., Genome Res., 8:175 [1998]; Ewing and Green, Genome Res. 8:186 [1998]; Gordon et al., Genome Res. 8: 195 [1998].

B. BLAST

The BLAST (Basic Local Alignment Search Tool) set of programs may be used to compare the large numbers of sequences and obtain homologies to known protein families. These homologies provide information regarding the function of newly sequenced genes. Detailed descriptions of the BLAST software and its uses can be found in the following references Altschul et al., J. Mol. Biol., 215:403 [1990]; Altschul, J. Mol. Biol. 219:555 [1991].

Generally, BLAST performs sequence similarity searching and is divided into 5 basic subroutines: (1) BLASTP compares an amino acid sequence to a protein sequence database; (2) BLASTN compares a nucleotide sequence to a nucleic acid sequence database; (3) BLASTX compares translated protein sequences done in 6 frames to a protein sequence database; (4) TBLASTN compares a protein sequence to a nucleotide sequence database that is translated into all 6 reading frames; (5) TBLASTX compares the 6 frame translated protein sequence to the 6-frame translation of a nucleotide sequence database. Subroutines (3)-(5) may be used to identify weak similarities in nucleic acid sequence.

The BLAST program is based on the High Segment Pair (HSP), two sequence fragments of arbitrary but equal length whose alignment is locally maximized and whose alignment meets or exceeds a cutoff threshold. BLAST determines multiple HSP sets statistically using sum statistics. The score of the HSP is then related to its expected chance of frequency of occurrence, E. The value, E, is dependent on several factors such as the scoring system, residue composition of sequences, length of query sequence and total length of database. In the output file will be listed these E values, typically in a histogram format, which are useful in determining levels of statistical significance at the user s predefined expectation threshold. Finally, the Smallest Sum Probability, P(N), is the probability of observing the shown matched sequences by chance alone and is typically in the range of 0-1.

BLAST measures sequence similarity using a matrix of similarity scores for all possible pairs of residues and these specify scores for aligning pairs of amino acids. The matrix of choice for a specific use depends on several factors: the length of the query sequence and whether or not a close or distant relationship between sequences is suspected. Several matrices are available including PAM40, PAM120, PAM250, BLOSUM 62 and BLOSUM 50. Altschul et al. (1990) found PAM120 to be the most broadly sensitive matrix (for example point accepted mutation matrix per 100 residues). However, in some cases the PAM120 matrix may not find short but strong or long but weak similarities between sequences. In these cases, pairs of PAM matrices may be used, such as PAM40 and PAM 250, and the results compared. Typically, PAM 40 is used for database searching with a query of 9-21 residues long, while PAM 250 is used for lengths of 47-123.

The BLOSUM (Blocks Substitution Matrix) series of matrices are constructed based on percent identity between two sequence segments of interest. Thus, the BLOSUM62 matrix is based on a matrix of sequence segments in which the members are less than 62% identical. BLOSUM62 shows very good performance for BLAST searching. However, other BLOSUM matrices, like the PAM matrices, may be useful in other applications. For example, BLOSUM45 is particularly strong in profile searching.

C. FASTA

The FASTA suite of programs permits the evaluation of DNA and protein similarity based on local sequence alignment. The FASTA search algorithm utilizes Smith/Waterma- and Needleman/Wunsch-based optimization methods. These algorithms consider all of the alignment possibilities between the query sequence and the library in the highest scoring sequence regions. The search algorithm proceeds in four basic steps:

1. The identities or pairs of identities between the two DNA or protein sequences are determined. The ktup parameter, as set by the user, is operative and determines how many consecutive sequence identities are required to indicate a match.
2. The regions identified in step 1 are re-scored using a PAM or BLOSUM matrix. This allows conservative replacements and runs of identities shorter than that specified by ktup to contribute to the similarity score.
3. The region with the single best scoring initial region is used to characterize pairwise similarity and these scores are used to rank the library sequences.
4. The highest scoring library sequences are aligned using the Smith-Waterman algorithm.

This final comparison takes into account the possible alignments of the query and library sequence in the highest scoring region.

Further detailed description of the FASTA software and its use can be found in the following reference: Pearson and Lipman, Proc. Natl. Acad. Sci., 85: 2444 [1988].

D. PFAM

Despite the large number of different protein sequences determined through genomics-based approaches, relatively few structural and functional domains are known. Pfam is a computational method that utilizes a collection of multiple alignments and profile hidden Markov models of protein domain families to classify existing and newly found protein sequences into structural families. Detailed descriptions of the Pfam software and its uses can be found in the following references: Sonhammer et al., Proteins: Structure, Function and Genetics, 28:405 [1997]; Sonhammer et al., Nucleic Acids Res., 26:320 [1998]; Bateman et al., Nucleic Acids Res., 27: 260 [1999].

Pfam 3.1, the latest version, includes 54% of proteins in SWISS_PROT and SP-TrEMBL-5 as a match to the database and includes expectation values for matches. Pfam consists of parts A and B. Pfam-A contains a hidden Markov model and includes curated families. Pfam-B uses the Domainer program to cluster sequence segments not included in Pfam-A. Domainer uses pairwise homology data from Blastp to construct aligned families.

Alternative protein family databases that may be used include PRINTS and BLOCKS, which both are based on a set of ungapped blocks of aligned residues. However, these programs typically contain short conserved regions whereas Pfam represents a library of complete domains that facilitates automated annotation. Comparisons of Pfam profiles may also be performed using genomic and EST data with the programs, Genewise and ESTwise, respectively. Both of these programs allow for introns and frame shifting errors.

E. BLOCKS

The determination of sequence relationships between unknown sequences and those that have been categorized can be problematic because background noise increases with the number of sequences, especially at a low level of similarity detection. One recent approach to this problem has been tested that efficiently detects and confirms weak or distant relationships among protein sequences based on a database of blocks. The BLOCKS database provides multiple alignments of sequences and contains blocks or protein motifs found in known families of proteins.

Other programs such as PRINTS and Prodom also provide alignments, however, the BLOCKS database differs in the manner in which the database was constructed. Construction of the BLOCKS database proceeds as follows: one starts with a group of sequences that presumably have one or motifs in common, such as those from the PROSITE database. The PROTOMAT program then uses a motif finding program to scan sequences for similarity looking for spaced triplets of amino acids. The located blocks are then entered into the MOTOMAT program for block assembly. Weights are computed for all sequences. Following construction of a BLOCKS database one can use BLIMPS to performs searches of the BLOCKS database. Detailed description of the construction and use of a BLOCKS database can be found in the following references: Henikoff, S. and Henikoff, J. G., Genomics, 19:97 [1994]; Henikoff, J. G. and Henikoff, S., Meth. Enz., 266:88 [1996].

F. PRINTS

The PRINTS database of protein family fingerprints can be used in addition to BLOCKS and PROSITE. These databases are considered to be secondary databases because they diagnose the relationship between sequences that yield function information. Presently, however, it is not recommended that these databases be used alone. Rather, it is strongly suggested that these pattern databases be used in conjunction with each other so that a direct comparison of results can be made to analyze their robustness.

Generally, these programs utilize pattern recognition to discover motifs within protein sequences. However, PRINTS goes one step further, it takes into account not simply single motifs but several motifs simultaneously that might characterize a family signature. Other programs, such as PROSITE, rely on pattern recognition but are limited by the fact that query sequences must match them exactly. Thus, sequences that vary slightly will be missed. In contrast, the PRINTS database fingerprinting approach is capable of identifying distant relatives due to its reliance on the fact that sequences do not have match the query exactly. Instead they are scored according to how well they fit each motif in the signature. Another advantage of PRINTS is that it allows the user to search both PRINTS and PROSITE simultaneously. A detailed description of the use of PRINTS can be found in the following reference: Attwood et al., Nucleic Acids Res. 25: 212 [1997].

III. Nucleic Acid Sequences, Including Related, Variant, Altered and Extended Sequences This invention encompasses nucleic acids, polypeptides encoded by the nucleic acid sequences, and variants that retain at least one biological or other functional activity of the polynucleotide or polypeptide of interest. A preferred polynucleotide variant is one having at least 80%, and more preferably 90%, sequence identity to the sequence of interest. A most preferred polynucleotide variant is one having at least 95% sequence identity to the polynucleotide of interest.

In particularly preferred embodiments, the invention encompasses the polynucleotides comprising a polynucleotide encoded by SEQ ID NOs:1-407 and 2256-2318. In particularly preferred embodiments, the nucleic acids are operably linked to an exogenous promoter (and in most preferred embodiments to a plant promoter) or present in a vector.

It will be appreciated by those skilled in the art that as a result of the degeneracy of the genetic code, a multitude of nucleotide sequences encoding a given polypeptide (for example, a polypeptide encoded by a nucleic acid of the present invention), some bearing minimal homology to the nucleotide sequences of any known and naturally occurring gene, may be produced. Thus, the invention contemplates each and every possible variation of nucleotide sequence that could be made by selecting combinations based on possible codon choices. These combinations are made in accordance with the standard triplet genetic code as applied to the nucleotide sequence of the naturally occurring polypeptide, and all such variations are to be considered as being specifically disclosed.

Although nucleotide sequences that encode a given polypeptide (for example, a polypeptide encoded by a nucleic acid of the present invention) and its variants are preferably capable of hybridizing to the nucleotide sequence of the naturally occurring polypeptide under appropriately selected conditions of stringency, it may be advantageous to produce nucleotide sequences encoding the polypeptide or its derivatives possessing a substantially different codon usage. Codons may be selected to increase the rate at which expression of the peptide occurs in a particular prokaryotic or eukaryotic host in accordance with the frequency with which particular codons are utilized by the host. Other reasons for substantially altering the nucleotide sequence encoding a polypeptide and its derivatives without altering the encoded amino acid sequences include the production of RNA transcripts having more desirable properties, such as a greater half-life, than transcripts produced from the naturally occurring sequence.

The invention also encompasses production of nucleic acid sequences, or portions thereof, that encode a polynucleotide and its variants, entirely by synthetic chemistry. After production, the synthetic sequence may be inserted into any of the many available expression vectors and cell systems using reagents that are well known in the art. Moreover, synthetic chemistry may be used to introduce mutations into a sequence encoding a polynucleotide of the present invention or any portion thereof.

Also encompassed by the invention are polynucleotide sequences that are capable of hybridizing to SEQ ID NOs: 1-407 and 2256-2318 under various conditions of stringency (for example, conditions ranging from low to high stringency). Hybridization conditions are based on the melting temperature $T_m$ of the nucleic acid binding complex or probe, as taught in Wahl and Berger, Methods Enzymol., 152:399 [1987] and Kimmel, Methods Enzymol., 152:507 [1987], and may be used at a defined stringency.

Altered nucleic acid sequences encoding a polynucleotide of the present invention include deletions, insertions, or substitutions of different nucleotides resulting in a polynucleotide that encodes the same polypeptide or a functionally equivalent polynucleotide or polypeptide. The encoded protein may also contain deletions, insertions, or substitutions of amino acid residues that produce a silent change and result in a functionally equivalent polypeptide. Deliberate amino acid substitutions may be made on the basis of similarity in polarity, charge, solubility, hydrophobicity, hydrophilicity, and/or the amphipathic nature of the residues as long as the biological activity of the polypeptide is retained. For example, negatively charged amino acids may include aspartic acid and glutamic acid; positively charged amino acids may include lysine and arginine; and amino acids with uncharged polar head groups having similar hydrophilicity values may include leucine, isoleucine, and valine; glycine and alanine; asparagine and glutamine; serine and threonine; phenylalanine and tyrosine.

Also included within the scope of the present invention are alleles of the genes encoding polypeptides. As used herein, an "allele" or "allelic sequence" is an alternative form of the gene that may result from at least one mutation in the nucleic acid sequence. Alleles may result in altered mRNAs or polypeptides whose structure or function may or may not be altered. Any given gene may have none, one, or many allelic forms. Common mutational changes that give rise to alleles are generally ascribed to natural deletions, additions, or substitutions of nucleotides. Each of these types of changes may occur alone, or in combination with the others, one or more times in a given sequence.

Methods for DNA sequencing that are well known and generally available in the art may be used to practice any embodiments of the invention. The methods may employ such enzymes as the Klenow fragment of DNA polymerase I, SEQUENASE (US Biochemical Corporation, Cleveland, Ohio), TAQ polymerase (U.S. Biochemical Corporation, Cleveland, Ohio), thermostable T7 polymerase (Amersham Pharmacia Biotech, Chicago, Ill.), or combinations of recombinant polymerases and proofreading exonucleases such as the ELONGASE amplification system (Life Technologies, Rockville, Md.). Preferably, the process is automated with machines such as the MICROLAB 2200 (Hamilton Company, Reno, Nev.), PTC200 DNA Engine thermal cycler (MJ Research, Watertown, Mass.). and the ABI 377 DNA sequencer (Perkin Elmer).

The nucleic acid sequences encoding a polynucleotide of the present invention may be extended utilizing a partial nucleotide sequence and employing various methods known in the art to detect upstream sequences such as promoters and regulatory elements. For example, one method that may be employed, "restriction site" PCR, uses universal primers to retrieve an unknown sequence adjacent to a known locus (Sarkar, PCR Methods Applic. 2:318 [1993]). In particular, genomic DNA is first amplified in the presence of primer to a linker sequence and a primer specific to the known region. The amplified sequences are then subjected to a second round of PCR with the same linker primer and another specific primer internal to the first one. Products of each round of PCR are transcribed with an appropriate RNA polymerase and sequenced using reverse transcriptase.

Inverse PCR may also be used to amplify or extend sequences using divergent primers based on a known region (Triglia et al., Nucleic Acids Res. 16:8186 [1988]). The primers may be designed using OLIGO 4.06 primer analysis software (National Biosciences Inc., Plymouth, Minn.), or another appropriate program, to be 22-30 nucleotides in length, to have a GC content of 50% or more, and to anneal to the target sequence at temperatures about 68-72° C. The method uses several restriction enzymes to generate a suitable fragment in the known region of a gene. The fragment is then circularized by intramolecular ligation and used as a PCR template.

Another method that may be used is capture PCR that involves PCR amplification of DNA fragments adjacent to a known sequence in human and yeast artificial chromosome DNA (Lagerstrom et al., PCR Methods Applic. 1:111 [1991]). In this method, multiple restriction enzyme digestions and ligations may also be used to place an engineered double-stranded sequence into an unknown portion of the DNA molecule before performing PCR.

Another method that may be used to retrieve unknown sequences is that of Parker et al., Nucleic Acids Res., 19:3055 [1991]. Additionally, one may use PCR, nested primers, and PROMOTERFINDER DNA Walking Kits libraries (Clontech, Palo Alto, Calif.) to walk in genomic DNA. This process avoids the need to screen libraries and is useful in finding intron/exon junctions.

When screening for full-length cDNAs, it is preferable to use libraries that have been size-selected to include larger cDNAs. Also, random-primed libraries are preferable, in that they will contain more sequences that contain the 5' regions of genes. Use of a randomly primed library may be especially preferable for situations in which an oligo d(T) library does not yield a full-length cDNA. Genomic libraries may be useful for extension of sequence into the 5' and 3' non-transcribed regulatory regions.

Capillary electrophoresis systems that are commercially available (for example, from PE Biosystems, Inc., Foster City, Calif.) may be used to analyze the size or confirm the nucleotide sequence of sequencing or PCR products. In particular, capillary sequencing may employ flowable polymers for electrophoretic separation, four different fluorescent dyes (one for each nucleotide) that are laser activated, and detection of the emitted wavelengths by a charge coupled device camera. Output/light intensity may be converted to electrical signal using appropriate software (for example, GENOTYPER and SEQUENCE NAVIGATOR from PE Biosystems, Foster City, Calif.) and the entire process from loading of samples to computer analysis and electronic data display may be computer controlled. Capillary electrophoresis is especially preferable for the sequencing of small pieces of DNA that might be present in limited amounts in a particular sample.

It is contemplated that the nucleic acids disclosed herein can be utilized as starting nucleic acids for directed evolution. In some embodiments, artificial evolution is performed by random mutagenesis (for example, by utilizing error-prone PCR to introduce random mutations into a given coding sequence). This method requires that the frequency of mutation be finely tuned. As a general rule, beneficial mutations are rare, while deleterious mutations are common. This is because the combination of a deleterious mutation and a beneficial mutation often results in an inactive enzyme. The ideal number of base substitutions for targeted gene is usually between 1.5 and 5 (Moore and Arnold, Nat. Biotech., 14, 458-67 [1996]; Leung et al., Technique, 1:11-15 [1989]; Eckert and Kunkel, PCR Methods Appl., 1:17-24 [1991]; Caldwell and Joyce, PCR Methods Appl., 2:28-33 [1992]; and Zhao and Arnold, Nuc. Acids. Res., 25:1307-08 [1997]). After mutagenesis, the resulting clones are selected for desirable activity. Successive rounds of mutagenesis and selection are often necessary to develop enzymes with desirable properties. It should be noted that only the useful mutations are carried over to the next round of mutagenesis.

In other embodiments of the present invention, the polynucleotides of the present invention are used in gene shuffling or sexual PCR procedures (for example, Smith, Nature, 370:324-25 [1994]; U.S. Pat. Nos. 5,837,458; 5,830,721; 5,811,238; and 5,733,731, each of which is herein incorporated by reference). Gene shuffling involves random fragmentation of several mutant DNAs followed by their reassembly by PCR into full length molecules. Examples of various gene shuffling procedures include, but are not limited to, assembly following DNase treatment, the staggered extension process (STEP), and randomrpriming in vitro recombination. In the DNase mediated method, DNA segments isolated from a pool of positive mutants are cleaved into random fragments with DNaseI and subjected to multiple rounds of PCR with no added primer. The lengths of random fragments approach that of the uncleaved segment as the PCR cycles proceed, resulting in mutations in present in different clones becoming mixed and accumulating in some of the resulting sequences. Multiple cycles of selection and shuffling have led to the functional enhancement of several enzymes (Stemmer, Nature, 370:398-91 [1994]; Stemmer, Proc. Natl. Acad. Sci. USA, 91, 10747-51 [1994]; Crameri et al., Nat. Biotech., 14:315-19 [1996]; Zhang et al., Proc. Natl. Acad. Sci. USA, 94:4504-09 [1997]; and Crameri et al., Nat. Biotech., 15:436-38 [1997]).

IV. Vectors, Engineering, and Expression of Sequences

In another embodiment of the invention, the polynucleotide sequences of the present invention and fragments and portions thereof, may be used in recombinant DNA molecules to direct expression of an mRNA or polypeptide in appropriate host cells. Due to the inherent degeneracy of the genetic code, other DNA sequences that encode substantially the same or a functionally equivalent amino acid or mRNA sequence may be produced and these sequences may be used to clone and express polypeptides (for example, a polypeptide encoded by a nucleic acid of the present invention).

As will be understood by those of skill in the art, it may be advantageous to produce nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life that is longer than that of a transcript generated from the naturally occurring sequence.

The nucleotide sequences of the present invention can be engineered using methods generally known in the art in order to alter the polypeptide sequences for a variety of reasons, including but not limited to, alterations that modify the cloning, processing, and/or expression of the gene product. DNA shuffling by random fragmentation and PCR reassembly of gene fragments and synthetic oligonucleotides may be used to engineer the nucleotide sequences. For example, site-directed mutagenesis may be used to insert new restriction sites, alter glycosylation patterns, change codon preference, produce splice variants, or introduce mutations, and so forth.

In another embodiment of the invention, natural, modified, or recombinant nucleic acid sequences encoding a polypeptide may be ligated to a heterologous sequence to encode a fusion protein. For example, to screen peptide libraries for inhibitors of the polypeptides activity (for example, enzymatic activity), it may be useful to encode a chimeric protein that can be recognized by a commercially available antibody. A fusion protein may also be engineered to contain a cleavage site located between the polypeptide encoding sequence and the heterologous protein sequence, so that the polypeptide of interest may be cleaved and purified away from the heterologous moiety.

In another embodiment, sequences encoding a polypeptide (for example, a polypeptide encoded by a nucleic acid of the present invention) may be synthesized, in whole or in part, using chemical methods well known in the art (See for example, Caruthers et al., Nucl. Acids Res. Symp. Ser. 215 [1980]; Horn et al., Nucl. Acids Res. Symp. Ser. 225 [1980]). Alternatively, the protein itself may be produced using chemical methods to synthesize the amino acid sequence of the polypeptide of interest (for example, a polypeptide encoded by a nucleic acid of the present invention), or a portion thereof. For example, peptide synthesis can be performed using various solid phase techniques (Roberge et al., Science 269:202 [1995]) and automated synthesis may be achieved, for example, using the ABI 431A peptide synthesizer (PE Corporation, Norwalk, Conn.).

The newly synthesized peptide may be substantially purified by preparative high performance liquid chromatography (See for example, Creighton, T. (1983) Proteins, Structures and Molecular Principles, WH Freeman and Co., New York, N.Y.). The composition of the synthetic peptides may be confirmed by amino acid analysis or sequencing (for example, the Edman degradation procedure; or Creighton, supra). Additionally, the amino acid sequence of the polypeptide of interest or any part thereof, may be altered during direct synthesis and/or combined using chemical methods with sequences from other proteins, or any part thereof, to produce a variant polypeptide.

In order to express a biologically active polypeptide (for example, a polypeptide encoded by a nucleic acid of the present invention) or RNA, the nucleotide sequences encoding the polypeptide or functional equivalents, may be inserted into appropriate expression vector, that is, a vector that contains the necessary elements for the transcription and translation of the inserted coding sequence.

Methods that are well known to those skilled in the art may be used to construct expression vectors containing sequences encoding polypeptides (for example, a polypeptide encoded by a nucleic acid of the present invention) and appropriate transcriptional and translational control elements. These methods include in vitro recombinant DNA techniques, synthetic techniques, and in vivo genetic recombination. Such techniques are described in Sambrook. et al. (1989) Molecular Cloning, A Laboratory Manual, Cold Spring Harbor Press, Plainview, N.Y., and Ausubel, F. M. et al. (1989) Current Protocols in Molecular Biology, John Wiley & Sons, New York, N.Y.

A variety of expression vector/host systems may be utilized to contain and express sequences encoding a polypeptide of interest. These include, but are not limited to, microorganisms such as bacteria transformed with recombinant bacteriophage, plasmid, or cosmid DNA expression vectors; yeast transformed with yeast expression vectors; insect cell systems infected with virus expression vectors (for example, baculovirus); plant cell systems transformed with virus expression vectors (for example, cauliflower mosaic virus, CaMV; tobacco mosaic virus, TMV; brome mosaic virus) or with bacterial expression vectors (for example, Ti or pBR322 plasmids); or animal cell systems.

The "control elements" or "regulatory sequences" are those non-translated regions of the vector (for example, enhancers, promoters, 5' and 3' untranslated regions) that interact with host cellular proteins to carry out transcription and translation. Such elements may vary in their strength and specificity. Depending on the vector system and host utilized, any number of suitable transcription and translation elements, including constitutive and inducible promoters, may be used. For example, when cloning in bacterial systems, inducible promoters such as the hybrid lacZ promoter of the BLUESCRIPT phagemid (Stratagene, LaJolla, Calif.) or PSPORT1 plasmid (Life Technologies, Inc., Rockville, Md.) and the like may be used. The baculovirus polyhedrin promoter may be used in insect cells. Promoters or enhancers derived from the genomes of plant cells (for example, heat shock, RUBISCO; and storage protein genes) or from plant viruses (for example, viral promoters or leader sequences) may be cloned into the vector. In mammalian cell systems, promoters from mammalian genes or from mammalian viruses are preferable. If it is necessary to generate a cell line that contains multiple copies of the sequence encoding a polypeptide, vectors based on SV40 or EBV may be used with an appropriate selectable marker.

In bacterial systems, a number of expression vectors may be selected depending upon the use intended for the polypeptide of interest. For example, when large quanties of the polypeptide are needed for the induction of antibodies, vectors that direct high level expression of fusion proteins that are readily purified may be used. Such vectors include, but are not limited to, the multifunctional E. coli cloning and expression vectors such as BLUESCRIPT phagemid (Stratagene, La Jolla, Calif.), in which the sequence encoding the polypeptide of interest may be ligated into the vector in frame with sequences for the amino-terminal Met and the subsequent 7 residues of beta-galactosidase so that a hybrid protein is produced; pIN vectors (Van Heeke and Schuster, J. Biol. Chem. 264:5503 [1989]; and the like. pGEMX vectors (Promega Corporation, Madison, Wis.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems may be designed to include heparin, thrombin, or factor XA protease cleavage sites so that the cloned polypeptide of interest can be released from the GST moiety at will.

In the yeast Saccharomyces cerevisiae, a number of vectors containing constitutive or inducible promoters such as alpha factor, alcohol oxidase, and PGH may be used. For reviews, See for example, Ausubel et al. (supra) and Grant et al., Methods Enzymol. 153:516 [1987].

In cases where plant expression vectors are used, the expression of sequences encoding polypeptides may be driven by any of a number of promoters. In a preferred embodiment, plant vectors are created using a recombinant plant virus containing a recombinant plant viral nucleic acid, as described in PCT publication WO 96/40867. Subsequently, the recombinant plant viral nucleic acid that contains one or more non-native nucleic acid sequences may be transcribed or expressed in the infected tissues of the plant host and the product of the coding sequences may be recovered from the plant, as described in WO 99/36516.

An important feature of this embodiment is the use of recombinant plant viral nucleic acids that contain one or more non-native subgenomic promoters capable of transcribing or expressing adjacent nucleic acid sequences in the plant host and that result in replication and local and/or systemic spread in a compatible plant host. The recombinant plant viral nucleic acids have substantial sequence homology to plant viral nucleotide sequences and may be derived from an RNA, DNA, cDNA or a chemically synthesized RNA or DNA. A partial listing of suitable viruses is described below.

The first step in producing recombinant plant viral nucleic acids according to this particular embodiment is to modify the nucleotide sequences of the plant viral nucleotide sequence by known conventional techniques such that one or more non-native subgenomic promoters are inserted into the plant viral nucleic acid without destroying the biological function of the plant viral nucleic acid. The native coat protein coding sequence may be deleted in some embodiments, placed under the control of a non-native subgenomic promoter in other embodiments, or retained in a further embodiment. If it is deleted or otherwise inactivated, a non-native coat protein gene is inserted under control of one of the non-native subgenomic promoters, or optionally under control of the native coat protein gene subgenomic promoter. The non-native coat protein is capable of encapsidating the recombinant plant viral nucleic acid to produce a recombinant plant virus. Thus, the recombinant plant viral nucleic acid contains a coat protein coding sequence, which may be native or a nonnative coat protein coding sequence, under control of one of the native or non-native subgenomic promoters. The coat protein is involved in the systemic infection of the plant host.

Some of the viruses that meet this requirement include viruses from the tobamovirus group such as Tobacco Mosaic virus (TMV), Ribgrass Mosaic Virus (RGM), Cowpea Mosaic virus (CMV), Alfalfa Mosaic virus (AMV), Cucumber Green Mottle Mosaic virus watermelon strain (CGMMV-W) and Oat Mosaic virus (OMV) and viruses from the brome mosaic virus group such as Brome Mosaic virus (BMV), broad bean mottle virus and cowpea chlorotic mottle virus. Additional suitable viruses include Rice Necrosis virus (RNV), and geminiviruses such as tomato golden mosaic virus (TGMV), Cassava latent virus (CLV) and maize streak virus (MSV). However, the invention should not be construed as limited to using these particular viruses, but rather the method of the present invention is contemplated to include all plant viruses at a minimum.

Other embodiments of plant vectors used for the expression of sequences encoding polypeptides include, for example, viral promoters such as the 35S and 19S promoters of CaMV or CsVMV used alone or in combination with the omega leader sequence from TMV (Takamatsu, EMBO J. 6:307 [1987]). Alternatively, plant promoters such as ubiqutin, the small subunit of RUBISCO or heat shock promoters may be used (Coruzzi et al., EMBO J. 3:1671 [1984]; Broglie et al., Science 224:838 [1984]; and Winter et al., Results Probl. Cell Differ. 17:85 [1991]). These constructs can be introduced into plant cells by direct DNA transformuation or pathogen-mediated transfection. Such techniques are described in a number of generally available reviews (See for example, Hobbs, S. or Murry, L. E. in McGraw Hill Yearbook of Science and Technology (1992) McGraw Hill, New York, N.Y.; pp. 191-196.

The present invention further provides transgenic plants comprising the polynucleotides of the present invention. In some embodiments, more than one of the sequences is expressed in an individual plant. The sequences may be contained in the same or separate vectors. In some preferred embodiments, *Agrobacterium* mediated transfection is utilized to create transgenic plants. Since most dicotyledonous plant are natural hosts for *Agrobacterium*, almost every dicotyledonous plant may be transformed by *Agrobacterium* in vitro. Although monocotyledonous plants, and in particular, cereals and grasses, are not natural hosts to *Agrobacterium*, work to transform them using *Agrobacterium* has also been successfully carried out (Hooykas-Van Slogteren et al. (1984) Nature 311:763-764). Plant genera that may be transformed by *Agrobacterium* include *Arabidopsis, Chrysanthemum, Dianthus, Gerbera, Euphorbia, Pelaronium, Ipomoea, Passiflora, Cyclamen, Malus, Prunus, Rosa, Rubus, Populus, Santalum, Allium, Lilium, Narcissus, Ananas, Arachis, Phaseolus, Pisum, Gossypium* and *Zea*.

For transformation with *Agrobacterium*, disarmed *Agrobacterium* cells are transformed with recombinant Ti plasmids of *Agrobacterium tumefaciens* or Ri plasmids of *Agrobacterium rhizogenes* (such as those described in U.S. Pat. No. 4,940,838, the entire contents of which are herein incorporated by reference). The nucleic acid sequence of interest is then stably integrated into the plant genome by infection with the transformed *Agrobacterium* strain. For example, heterologous nucleic acid sequences have been introduced into plant tissues using the natural DNA transfer system of *Agrobacterium tumefaciens* and *Agrobacterium rhizogenes* bacteria (for review, See Klee et al. (1987) Ann. Rev. Plant Phys. 38:467-486).

There are three common methods to transform plant cells with *Agrobacterium*. The first method is co-cultivation of *Agrobacterium* with cultured isolated protoplasts. This method requires an established culture system that allows culturing protoplasts and plant regeneration from cultured protoplasts. The second method is transformation of cells or tissues with *Agrobacterium*. This method requires (a) that the plant cells or tissues can be transformed by *Agrobacterium* and (b) that the transformed cells or tissues can be induced to regenerate into whole plants. The third method is transformation of seeds, apices or meristems with *Agrobacterium*. This method requires micropropagation.

The efficiency of transformation by *Agrobacterium* may be enhanced by using a number of methods known in the art. For example, the inclusion of a natural wound response molecule such as acetosyringone (AS) to the *Agrobacterium* culture has been shown to enhance transformation efficiency with *Agrobacterium tumefaciens* (Shahla et al., (1987) Plant Molec. Biol. 8:291-298). Alternatively, transformation efficiency may be enhanced by wounding the target tissue to be transformed. Wounding of plant tissue may be achieved, for example, by punching, maceration, bombardment with microprojectiles, etc. (See e.g., Bidney et al., (1992) Plant Molec. Biol. 18:301-313).

In still further embodiments, the plant cells are transfected with vectors via particle bombardment (i.e., with a gene gun). Particle mediated gene transfer methods are known in the art, are commercially available, and include, but are not limited to, the gas driven gene delivery instrument descried in McCabe, U.S. Pat. No. 5,584,807, the entire contents of which are herein incorporated by reference. This method involves coating the nucleic acid sequence of interest onto heavy metal particles, and accelerating the coated particles under the pressure of compressed gas for delivery to the target tissue.

Other particle bombardment methods are also available for the introduction of heterologous nucleic acid sequences into plant cells. Generally, these methods involve depositing the nucleic acid sequence of interest upon the surface of small, dense particles of a material such as gold, platinum, or tungsten. The coated particles are themselves then coated onto either a rigid surface, such as a metal plate, or onto a carrier sheet made of a fragile material such as mylar. The coated sheet is then accelerated toward the target biological tissue. The use of the flat sheet generates a uniform spread of accelerated particles that maximizes the number of cells receiving particles under uniform conditions, resulting in the introduction of the nucleic acid sample into the target tissue.

An insect system may also be used to express polypeptides (for example, a polypeptide encoded by a nucleic acid of the present invention). For example, in one such system, *Autographa californica* nuclear polyhedrosis virus (AcNPV) is used as a vector to express foreign genes in *Spodoptera frugiperda* cells or in *Trichoplusia* larvae. The sequences encoding a polypeptide of interest may be cloned into a non-essential region of the virus, such as the polyhedrin gene, and placed under control of the polyhedrin promoter. Successful insertion of the nucleic acid sequence encoding the polypeptide of interest will render the polyhedrin gene inactive and produce recombinant virus lacking coat protein. The recombinant viruses may then be used to infect, for example, *S. frugiperda* cells or *Trichoplusia* larvae in which the polypeptide may be expressed (Engelhard et al., Proc. Nat. Acad. Sci. 91:3224 [1994]).

In mammalian host cells, a number of viral-based expression systems may be utilized. In cases where an adenovirus is used as an expression vector, sequences encoding polypeptides may be ligated into an adenovirus transcription/translation complex consisting of the late promoter and tripartite leader sequence. Insertion in a non-essential E1 or E3 region of the viral genome may be used to obtain a viable virus that is capable of expressing the polypeptide in infected host cells (Logan and Shenk, Proc. Natl. Acad. Sci., 81:3655 [1984]). In addition, transcription enhancers, such as the Rous sarcoma virus (RSV) enhancer, may be used to increase expression in mammalian host cells.

Specific initiation signals may also be used to achieve more efficient translation of sequences encoding the polypeptide of interest. Such signals include the ATG initiation codon and adjacent sequences. In cases where sequences encoding the polypeptide of interest, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic. The efficiency of expression may be enhanced by the inclusion of enhancers that are appropriate for the particular cell system that is used, such as those described in the literature (Scharf et al., Results Probl. Cell Differ., 20:125 [1994]).

In addition, a host cell strain may be chosen for its ability to modulate the expression of the inserted sequences or to process the expressed protein in the desired fashion. Such modifications of the polypeptide include, but are not limited to, acetylation, carboxylation, glycosylation, phosphorylation, lipidation, and acylation. Post-translational processing that cleaves a "prepro" form of the protein may also be used to facilitate correct insertion, folding and/or function. Different host-cells such as CHO, HeLa, MDCK, HEK293, and WI38, that have specific cellular machinery and characteristic mechanisms for such post-translational activities, may be chosen to ensure the correct modification and processing of the foreign protein.

For long-term, high-yield production of recombinant proteins, stable expression is preferred. For example, cell lines that stably express the polypeptide of interest (for example, a polypeptide encoded by a nucleic acid of the present invention) may be transformed using expression vectors that may contain viral origins of replication and/or endogenous expression elements and a selectable marker gene on the same or on a separate vector. Following the introduction of the vector, cells may be allowed to grow for 1-2 days in an enriched media before they are switched to selective media. The purpose of the selectable marker is to confer resistance to selection, and its presence allows growth and recovery of cells that successfully express the introduced sequences. Resistant clones of stably transformed cells may be proliferated using tissue culture techniques appropriate to the cell type.

Any number of selection systems may be used to recover transformed cell lines. These include, but are not limited to, the herpes simplex virus thymidine kinase (Wigler et al., Cell 11:223 [1977]) and adenine phosphoribosyltransferase (Lowy et al., Cell 22:817 [1980]) genes that can be employed in tk⁻ or aprt⁻ cells, respectively. Also, antimetabolite, antibiotic, or herbicide resistance can be used as the basis for selection; for example, dhfr, which confers resistance to methotrexate (Wigler et al., Proc. Natl. Acad. Sci., 77:3567 [1980]); npt, which confers resistance to the aminoglycosides neomycin and G-418 (Colbere-Garapin et al., J. Mol. Biol., 150:1 [1981]); als, which confers resistance to imidazolinones, sulfonyl ureas and chlorsulfuron); and pat/bar, which confer resistance to glufosinate, (Murry, supra). Additional selectable genes have been described, for example, trpB, which allows cells to utilize indole in place of tryptophan, or hisD, which allows cells to utilize histinol in place of histidine (Hartnan and Mulligan, Proc. Natl. Acad. Sci., 85:8047 [1988]). Recently, the use of visible markers has gained popularity with such markers as anthocyanins, α-glucuronidase and its substrate GUS, and luciferase and its substrate luciferin, being widely used not only to identify transformants, but also to quantify the amount of transient or stable protein expression attributable to a specific vector system (Rhodes et al., Methods Mol. Biol., 55:121 [1995]).

Although the presence/absence of marker gene expression suggests that the gene of interest is also present, its presence and expression may need to be confirmed. For example, if the sequence encoding a polypeptide is inserted within a marker gene sequence, recombinant cells containing sequences encoding the polypeptide can be identified by the absence of marker gene function. Alternatively, a marker gene can be placed in tandem with a sequence encoding the polypeptide under the control of a single promoter. Expression of the marker gene in response to induction or selection usually indicates expression of the tandem gene as well.

Alternatively, host cells that contain the nucleic acid sequence encoding the polypeptide of interest (for example, a polypeptide encoded by a nucleic acid of the present invention) and express the polypeptide may be identified by a variety of procedures known to those of skill in the art. These procedures include, but are not limited to, DNA-DNA or DNA-RNA hybridizations and protein bioassay or immunoassay techniques that include membrane, solution, or chip based technologies for the detection and/or quantification of nucleic acid or protein.

The presence of polynucleotide sequences encoding a polypeptide of interest (for example, a polypeptide encoded by a nucleic acid of the present invention) can be detected by DNA-DNA or DNA-RNA hybridization or amplification using probes or portions or fragments of polynucleotides encoding the polypeptide. Nucleic acid amplification based assays involve the use of oligonucleotides or oligomers based on the sequences encoding the polypeptide to detect transformants containing DNA or RNA encoding the polypeptide. As used herein "oligonucleotides" or "oligomers" refer to a nucleic acid sequence of at least about 10 nucleotides and as many as about 60 nucleotides, preferably about 15 to 30 nucleotides, and more preferably about 20-25 nucleotides, that can be used as a probe or amplimer.

A variety of protocols for detecting and measuring the expression of a polypeptide (for example, a polypeptide encoded by a nucleic acid of the present invention), using either polyclonal or monoclonal antibodies specific for the protein are known in the art. Examples include enzyme-linked immunosorbent assay (ELISA), radioimmunoassay (RIA), and fluorescence activated cell sorting (FACS). A two-site, monoclonal-based immunoassay utilizing monoclonal antibodies reactive to two non-interfering epitopes on the polypeptide is preferred, but a competitive binding assay may be employed. These and other assays are described, among other places, in Hampton et al., 1990; Serological Methods, a Laboratory Manual, APS Press, St Paul, Minn. and Maddox et al., J. Exp. Med., 158:1211 [1983]).

A wide variety of labels and conjugation techniques are known by those skilled in the art and may be used in various nucleic acid and amino acid assays. Means for producing labeled hybridization or PCR probes for detecting sequences related to polynucleotides encoding a polypeptide of interest include oligonucleotide labeling, nick translation, end-labeling or PCR amplification using a labeled nucleotide. Alternatively, the sequences encoding the polypeptide, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits from Pharmacia & Upjohn (Kalamazoo, Mich.), Promega Corporation (Madison, Wis.) and U.S. Biochemical Corp. (Cleveland, Ohio). Suitable reporter molecules or labels, which may be used, include radionuclides, enzymes, fluorescent, chemiluminescent, or chromogenic agents as well as substrates, cofactors, inhibitors, magnetic particles, and the like.

Host cells transformed with nucleotide sequences encoding a polypeptide of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides that encode the polypeptide of interest (for example, a polypeptide encoded by a nucleic acid of the present invention) may be designed to contain signal sequences that direct secretion of the polypeptide through a prokaryotic or eukaryotic cell membrane. Other recombinant constructions may be used to join sequences encoding the polypeptide to nucleotide sequence encoding a polypeptide domain that will facilitate purification of soluble proteins. Such purification facilitating domains include, but are not limited to, metal chelating peptides such as histidine-tryptophan modules that allow purification on immobilized metals, protein A domains that allow purification on immobilized immunoglobulin, and the domain utilized in the FLAGS extension/affinity purification system (Immunex Corp., Seattle, Wash.). The inclusion of cleavable linker sequences such as those specific for Factor XA or enterokinase (available from Invitrogen, San Diego, Calif.) between the purification domain and the polypeptide of interest may be used to facilitate purification. One such expression vector provides for expression of a fusion protein containing the polypeptide of interest and a nucleic acid encoding 6 histidine residues preceding a thioredoxin or an enterokinase cleavage site. The histidine residues facilitate purfication on IMIAC (immobilized metal ion affinity chromatography) as described in Porath et al., Prot. Exp. Purif., 3:263 [1992] while the enterokinase cleavage site provides a means for purifying the polypeptide from the fusion protein. A discussion of vectors that contain fusion proteins is provided in Kroll et al., DNA Cell Biol., 12:441 [1993]).

In addition to recombinant production, fragments of the polypeptide of interest may be produced by direct peptide synthesis using solid-phase techniques (Merrifield, J. Am. Chem. Soc., 85:2149 [1963]). Protein synthesis may be performed using manual techniques or by automation. Automated synthesis may be achieved, for example, using the Applied Biosystems 431A peptide synthesizer (Perkin Elmer). Various fragments of the polypeptide may be chemically synthesized separately and combined using chemical methods to produce the full length molecule.

V. Alteration of Gene Expression

It is contemplated that the polynucleotides of the present invention (for example, SEQ ID NOs:1-407 and 2256-2318) may be utilized to either increase or decrease the level of corresponding mRNA and/or protein in transfected cells as compared to the levels in wild-type cells. Accordingly, in some embodiments, expression in plants by the methods described above leads to the overexpression of the polypeptide of interest in transgenic plants, plant tissues, or plant cells. The present invention is not limited to any particular mechanism. Indeed, an understanding of a mechanism is not required to practice the present invention. However, it is contemplated that overexpression of the polynucleotides of the present invention will alter the expression of the gene comprising the nucleic acid sequence of the present invention.

In other embodiments of the present invention, the polynucleotides are utilized to decrease the level of the protein or mRNA of interest in transgenic plants, plant tissues, or plant cells as compared to wild-type plants, plant tissues, or plant cells. One method of reducing protein expression utilizes expression of antisense transcripts (for example, U.S. Pat. Nos. 6,031,154; 5,453,566; 5,451,514; 5,859,342; and 4,801,340, each of which is incorporated herein by reference). Antisense RNA has been used to inhibit plant target genes in a tissue-specific manner (for example, Van der Krol et al., Biotechniques 6:958-976 [1988]). Antisense inhibition has been shown using the entire cDNA sequence as well as a partial cDNA sequence (for example, Sheehy et al., Proc. Natl. Acad. Sci. USA 85:8805-8809 [1988]; Cannon et al., Plant Mol. Biol. 15:39-47 [1990]). There is also evidence that 3' non-coding sequence fragment and 5' coding sequence fragments, containing as few as 41 base-pairs of a 1.87 kb cDNA, can play important roles in antisense inhibition (Ch'ng et al., Proc. Natl. Acad. Sci. USA 86:10006-10010 [1989]).

Accordingly, in some embodiments, the nucleic acids of the present invention (for example, SEQ ID NOs: 1-407 and 2256-2318, and fragments and variants thereof) are oriented in a vector and expressed so as to produce antisense transcripts. To accomplish this, a nucleic acid segment from the desired gene is cloned and operably linked to a promoter such that the antisense strand of RNA will be transcribed. The expression cassette is then transformed into plants and the antisense strand of RNA is produced. The nucleic acid segment to be introduced generally will be substantially identical to at least a portion of the endogenous gene or genes to be repressed. The sequence, however, need not be perfectly identical to inhibit expression. The vectors of the present invention can be designed such that the inhibitory effect applies to other proteins within a family of genes exhibiting homology or substantial homology to the target gene.

Furthermore, for antisense suppression, the introduced sequence also need not be full length relative to either the primary transcription product or fully processed mRNA. Generally, higher homology can be used to compensate for the use of a shorter sequence. Furthermore, the introduced sequence need not have the same intron or exon pattern, and homology of non-coding segments may be equally effective. Normally, a sequence of between about 30 or 40 nucleotides and up to about the full length of the coding region should be used, although a sequence of at least about 100 nucleotides is preferred, a sequence of at least about 200 nucleotides is more preferred, and a sequence of at least about 500 nucleotides is especially preferred.

Catalytic RNA molecules or ribozymes can also be used to inhibit expression of the target gene or genes. It is possible to design ribozymes that specifically pair with virtually any target RNA and cleave the phosphodiester backbone at a specific location, thereby functionally inactivating the target RNA. In carrying out this cleavage, the ribozymre is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs that are capable of self-leavage and replication in plants. The RNAs replicate either alone (viroid RNAs) or with a helper virus (satellite RNAs). Examples include RNAs from avocado sunblotch viroid and the satellite RNAs from tobacco ringspot virus, luceme transient streak virus, velvet tobacco mottle virus, Solanum nodiflorum mottle virus and subterranean clover mottle virus. The design and use of target RNA-specific ribozymes is described in Haseloff, et al., Nature 334:585-591 (1988).

Another method of reducing protein expression utilizes the phenomenon of cosuppression or gene silencing (for example, U.S. Pat. Nos. 6,063,947; 5,686,649; and 5,283,184; each of which is incorporated herein by reference). The phenomenon of cosuppression has also been used to inhibit plant target genes in a tissue-specific manner. Cosuppression of an endogenous gene using a full-length cDNA sequence as well as a partial cDNA sequence (730 bp of a 1770 bp cDNA) are known (for example, Napoli et al., Plant Cell 2:279-289 [1990]; van der Krol et al., Plant Cell 2:291-299 [1990]; Smith et al., Mol. Gen. Genetics 224:477-481 [1990]). Accordingly, in some embodiments the nucleic acids (for example, SEQ ID NOs: 1-407, and fragments and variants thereof) from one species of plant are expressed in another species of plant to effect cosuppression of a homologous gene. Generally, where inhibition of expression is desired, some transcription of the introduced sequence occurs. The effect may occur where the introduced sequence contains no coding sequence per se, but only intron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. Substantially greater identity of more than about 80% is preferred, though about 95% to absolute identity would be most preferred. As with antisense regulation, the effect should apply to any other proteins within a similar family of genes exhibiting homology or substantial homology.

For cosuppression, the introduced sequence in the expression cassette, needing less than absolute identity, also need not be full length, relative to either the primary transcription product or fully processed mRNA. This may be preferred to avoid concurrent production of some plants that are over-expressers. A higher identity in a shorter than full length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

VI. Expression of Sequences Producing Disease Resistant Phenotypes

The present invention provides nucleic sequences involved in providing disease resistance to plants. Plants transformed with viral vectors comprising the nucleic acid sequences of the present invention were screened for a disease resistance phenotype. The results are presented in FIG. 6. Accordingly, in some embodiments, the present invention provides nucleic acid sequences that produce a disease resistance phenotype when expressed in plant (SEQ ID NOs:1-407 and 2256-2318, FIG. 1). The present invention is not limited to the particular nucleic acid sequences listed. Indeed, the present invention encompasses nucleic acid sequences (including sequences of the same, shorter, and longer lengths) that hybridize to the listed nucleic acid sequences under conditions ranging from low to high stringency and that also cause the disease resistance phenotype. These sequences are conveniently identified by insertion into GENEWARE® vectors and expression in plants as detailed in the examples.

In some embodiments, the sequences are operably linked to a plant promoter or provided in a vector as described in more detail above. These present invention also contemplates plants transformed or transfected with these sequences as well as seeds from such transfected plants. Furthermore, the sequences can expressed in either sense or antisense orientation. In particularly preferred embodiments, the sequences are at least 30 nucleotides in length up to the length of the full-length of the corresponding gene. It is contemplated that sequences of less than full length (for example, greater than about 30 nucleotides) are useful for down regulation of gene expression via antisense or cosuppression. Suitable sequences are selected by chemically synthesizing the sequences, cloning into GENEWARE® expression vectors, expressing in plants, and selecting plants with a disease resistance phenotype.

VII. Identification of Homologs to Sequences

The present invention also provides homologs and variants of the sequences described above, but which may not hybridize to the sequences described above under conditions ranging from low to high stringency. In some preferred embodiments, the homologous and variant sequences are operably linked to an exogenous promoter. FIG. 3 provides BLASTX search results from publicly available databases. The relevant sequences are identified by Accession number in these databases. FIG. 4 contains the top blastx hits (identified by accession number) versus all the amino acid sequences in the Derwent biweekly database. FIG. 5 contains the top blastn hits (identified by accession number) versus all the nucleotide sequences in the Derwent biweekly database.

In some embodiments, the present invention comprises homologous nucleic acid sequences (SEQ ID NOs:408-2255) identified by screening an internal database with SEQ ID NOs.1-407 and 2256-2318 at a confidence level of Pz<1.00E-20. These sequences are provided in FIG. 2. The headers list the sequence identifier for the sequence that produced the actual phenotypic hit first and the sequence identifier for the homologous contig second.

As will be understood by those skilled in the art, the present invention is not limited to the particular sequences of the homologs described above. Indeed, the present invention encompasses portions, fragments, and variants of the homologs as described above. Such variants, portions, and fragments can be produced and identified as described in Section III above. In particularly preferred embodiments, the present invention provides sequences that hybridize to SEQ ID NOs:408-2255 under conditions ranging from low to high stringency. In other preferred embodiments, the present invention provides nucleic acid sequences that inhibit the binding of SEQ ID NOs:408-2255 to their complements under conditions ranging from low to high stringency. Furthermore, as described above in Section IV, the homologs can be incorporated into vectors for expression in a variety of hosts, including transgenic plants.

EXAMPLES

Example 1

Construction of Tissue-specific *N. benthamiana* cDNA Libraries

A. mRNA Isolation: Leaf, root, flower, meristem, and pathogen-challenged leaf cDNA libraries were constructed. Total RNA samples from 10.5 μg of the above tissues were isolated by TRIZOL reagent (Life Technologies, Rockville, Md.). The typical yield of total RNA was 1 mg PolyA$^+$RNA which was purified from total RNA by DYNABEADS oligo $(T)_{25}$. Purified mRNA was quantified by UV absorbance at $OD_{260}$. The typical yield of mRNA was 2% of total RNA. The purity was also determined by the ratio of $OD_{260}/OD_{280}$. The integrity of the samples had OD values of 1.8-2.0.

B. cDNA Synthesis: cDNA was synthesized from mRNA using the SUPERSCRIPT plasmid system (Life Technologies, Rockville, Md.) with cloning sites of NotI at the 3' end and SalI at the 5' end. After fractionation through a gel column to eliminate adapter fragments and short sequences, cDNA was cloned into both GENEWARE® vector p1057 NP (Large Scale Biology, Inc., Vacaville, Calif.) and phagemid vector PSPORT (Life Technologies, Rockville, Md.) in the multiple cloning region between Not1 and Xho1 sites. Over 20,000 recombinants were obtained for all of the tissue-specific libraries.

C. Library Analysis: The quality of the libraries was evaluated by checking the insert size and percentage from representative 24 clones. Overall, the average insert size was above 1 kb, and the recombinant percentage was >95%.

Example 2

Construction of Normalized *N. benthamiana* cDNA Library in GENEWARE® Vectors A. cDNA synthesis. A pooled RNA source from the tissues described above was used to construct a normalized cDNA library. Total RNA samples were pooled in equal amounts first, then poly A+RNA was isolated by DYNABEADS oligo $(dT)_{25}$. The first strand cDNA was synthesized by the Smart III system (Clontech, Palo Alto, Calif.). During the synthesis, adapter sequences with Sfi1a and Sfi1b sites were introduced by the polyA priming at the 3' end and 5' end by the template switch mechanism (Clontech, Palo Alto, Calif.). Eight μg first strand cDNA was synthesized from 24 μg mRNA. The yield and size were determined by UV absorbance and agarose gel electrophoresis.

B. Construction of Genomic DNA driver. Genomic DNA driver was constructed by immobilizing biotinylated DNA fragments onto streptavidin-coated magnetic beads. Fifty μg genomic DNA was digested by EcoR1 and BamH1 followed by fill-in reaction using biotin-21-dUTP. The biotinylated fragments were denatured by boiling and immobilized onto DYNABEADS by the conjugation of streptavidin and biotin.

C. Normalization Procedure. Six μg of the first strand cDNA was hybridized to 1 μg of genomic DNA driver in 100 μl of hybridization buffer (6×SSC, 0.1% SDS, 1×Denhardt's buffer) for 48 hours at 65° C. with constant rotation. After hybridization, the cDNA bound on genomic DNA beads was washed 3 times by 20 μl 1×SSC/0.1% SDS at 65° C. for 15 min and one time by 0.1×SSC at room temperature. The cDNA bound to the beads was then eluted in 10 μl of fresh-made 0.1N NaOH from the beads and purified by using a QIAGEN DNA purification column (QIAGEN GmbH, Hilden, Germany), which yielded 110 ng of normalized cDNA fragments. The normalized first strand cDNA was converted to double strand cDNA in 4 cycles of PCR with Smart primers annealed to the 3' and 5' end adapter sequences.

D. Evaluation of normalization efficiency. Ninety-six non-redundant cDNA clones selected from a randomly sequenced pool of 500 clones of a previously constructed whole seedling library were used to construct a nylon array. One hundred ng of the normalized cDNA fragments vs. the non-normalized fragments were radioactively labeled by $^{32}P$ and hybridized to DNA array nylon filters. The hybridization images and intensity data were acquired by a PHOSPHORIMAGER (Amersham Pharmacia Biotech, Chicago, Ill.). Since the 96 clones on the nylon arrays represent different abundance classes of genes, the variance of hybridization intensity among these genes on the filter were measured by standard deviation before and after normalization. The results indicated that by using this type of normalization approach, a 1000-fold reduction in variance among this set of genes could be achieved.

E. Cloning of normalized cDNA into GENEWARE® vector. The normalized cDNA fragments were digested by Sfi1 endonuclease, which recognizes 8-bp sites with variable sequences in the middle 4 nucleotides. After size fractionation, the cDNA was ligated into GENEWARE® vector p1057 NP in antisense orientation and transformed into DH5α cells. Over 50,000 recombinants were obtained for this normalized library. The percentage of insert and size were evaluated by Sfi digestion of randomly picked 96 clones followed by electrophoresis on 1% of agarose gel. The average insert size was 1.5 kb, and the percentage of insert was 98% with vector only insertions of >2%.

F. Sequence analysis of normalized cDNA library. Two plates of 96 randomly picked clones have been sequenced from the 5' end of cDNA inserts. One hundred ninety-two quality sequences were obtained after trimming of vector sequences and other standard quality checking and filtering procedure, and subjected to BLASTX search in DNA and protein databases. Over 40% of these sequences had no hit in the databases. Clustering analysis was conducted based on accession numbers of BLASTX matches among the 112 sequences that had hits in the databases. Only three genes (tumor-related protein, citrin, and rubit) appeared twice. All other members in this group appeared only once. This was a strong indication that this library is well-normalized. Sequence analysis also revealed that 68% of these 192 sequences had putative open reading frames using the ORF finder program (as described above), indicating possible full-length cDNA.

Example 3

Rice cDNA Library Construction in GENEWARE® Vectors

*Oryzae sativa* var. Indica IR-7 was grown in greenhouses under standard conditions (12/12 photoperiod, 29° C. daytime temp., 24° C. night temp.). The following types of tissue were harvested, immediately frozen on dry ice and stored at −80° C.: young leaves (20 days post sowing), mature leaves and panicles (122 days post sowing). Mature and immature root tissue (either 122 or 20 days post sowing) was harvested, rinsed in ddH$_2$O to remove soil, frozen on dry ice and stored at −80° C.

The following standard method (Life Technologies) was used for generation of cDNA and cloning. High quality total RNA was purified from target tissues using Trizol (LTI) reagent. mRNA was purified by binding to oligo (dT) and subsequent elution. Quality of mRNA samples is essential to cDNA library construction and was monitored spectrophotmetrically and via gel electrophoresis. 2-5 µg of mRNA was primed with an oligo (dT)-Not1 primer and cDNA was synthesized (no isotope was used in cDNA synthesis). Sal1 adaptors were ligated to the cDNA, which was then subjected to digestion with Not1. Restriction fragments were fractionated based on size and the first 10 fractions were measured for DNA quantity and quality. Fractions 6 to 9 were used for ligations. 100 ng of GENEWARE® vector was ligated to 20 ng synthesized cDNA. Following ligations, the mixtures were kept at −20° C. For transformation, 1 µl to 10 µl ligation reaction mixture was added to 100 µl of competent *E. coli* cells (strain DH5α) and transformed using the heat shock method. After transformation, 900 µl SOC medium was added to the culture, which was then incubated at 37° C. for 60 minutes. Transformation reactions were plated out on 22×22 cm LB/Amp agar plates and incubated overnight at 37° C.

Example 4

Poppy cDNA Library Construction in GENEWARE® Vectors

A. Plant Growth. A wild population of *Papaver rhoeas* resistant to auxin 2,4-Dichlorophenoxyacetic acid (2,4-D) was identified from a location in Spain and seed was collected. The seed was germinated at Dow AgroSciences LLC (Indianapolis, Ind.) and yielded a morphologically heterogeneous population. Leaf shape varied from deeply to shallowly indented. Latex color in some individuals was pure white when freshly cut, slowly changing to light orange then brown. Latex in other individuals was bright yellow or orange and rapidly changed to dark brown upon exposure to air. A single plant (PR4) with the white latex phenotype was used to generate the library.

B. RNA extraction. Approximately 1.5 g of leaves and stems were collected and frozen on liquid nitrogen. The tissue was ground to a fine powder and transferred to a 50 mL conical polypropylene screw cap centrifuge tube. Ten mL of TRIZOL reagent (Life Technologies, Rockville, Md.) was added and vortexed at high speed for several minutes of short intervals until an aqueous mixture was attained. Two mL of chloroform was added and the suspension was again vortexed at high speed for several minutes. The tube was centrifuged 15 minutes at 3100 rpm in a tabletop centrifuge (GP Centrifuge, Beckman Coulter, Inc, Fullerton, Calif.) for resolution of the phases. The aqueous supernatant was then carefully transferred to diethylpyrocarbonate (DEPC)-treated 1.5 mL microtubes and total RNA was precipitated with 0.6 volumes of isopropanol. To facilitate precipitation, the solution was allowed to stand 10 minutes at room temperature after thorough mixing. Following centrifugation for 10 minutes at 8000 rpm in a microcentrifuge (model 5415C, Eppendorf AG, Hamburg), the pellet of total RNA was washed with 70% ethanol, briefly dried and resuspended in 200 µL DEPC-treated deionized water. A 10 µL aliquot was examined by non-denaturing agarose gel electrophoresis.

C. cDNA synthesis. To generate cDNA, approximately 50 µg of total RNA was primed with 250 pmole of first strand oligo (TAIL: 5'-GAG-GAT-GTT-AAT-TAA-GCG-GCC-GCT-GCA-G(T)$_{23}$-3')(SEQ ID NO:2324) in a volume of 250 µL using 1000 units of Superscript reverse transcriptase (Life Technologies, Rockville, Md.) for 90 minutes at 42° C. Phenol extraction was performed by adding an equal volume of phenol:chloroform:isoamyl alcohol (25:24:1 v/v), vortexing thoroughly, and centrifuging 5 minutes at 14,000 rpm in an Eppendorf microfuge. The aqueous supernatant phase was transferred to a fresh microfuge tube and the first strand cDNA:mRNA hybrids were precipitated with ethanol by adding 0.1 volume of 3 M sodium acetate and 2 volumes of absolute ethanol. After 5 minutes at room temperature, the tube was centrifuged 15 minutes at 14,000 rpm. The pellet was washed with 80% ethanol, dried briefly and resuspended in 100 µL TE buffer (10 mM TrisCl, 1 mM EDTA, pH 8.0). After adding 10 µL Klenow buffer (RE buffer 2, Life Technologies, Rockville, Md.) and dNTPs (Life Technologies, Rockville, Md.) to a final concentration of 1 mM, second strand cDNA was generated by adding 10 units of Klenow enzyme (Life Technologies, Rockville, Md.), 2 units of RNase H (Life Technologies, Rockville, Md.) and incubating at 37° C. for 2 hrs. The buffer was adjusted with β-nicotinamide adenine dinucleotide β-NAD) by addition of *E. coli* ligase buffer (Life Technologies, Rockville, Md.) and adenosine triphosphate (ATP, Sigma Chemical Company, St. Louis, Mo.) added to a final concentration of 0.6 mM. Double stranded phosphorylated cDNA was generated by addition of 10 units of *E. coli* DNA ligase (Life Technologies, Rockville, Md.), 10 units of T4 polynucleotide kinase (Life Technologies, Rockville, Md.) and incubating for 20 minutes at ambient temperature.

The double stranded cDNA was isolated through phenol extraction and ethanol precipitation, as described above. The pellet was washed with 80% ethanol, dried briefly and resuspended in a minimal volume of TE. The resuspended pellet was ligated overnight at 16° C. with 50 pmole of kinased AP3-AP4 adapter (AP-3: 5'-GAT-CTT-AAT-TAA-GTC-GAC-GAA-TTC-3'/AP-4: 5'-GAA-TTC-GTCGAC-TTA-ATT-AA-3')(SEQ ID NOs: 2319 and 2320) and 2 units of T4 DNA ligase (Life Technologies, Rockville, Md.). Ligation products were amplified by 20 cycles of PCR using AP-3 primer and examined by agarose gel electrophoresis.

Expanded adapter-ligated cDNA was digested overnight at 37° C. with PacI and NotI restriction endonucleases. The GENEWARE® vector pBSG1056 (Large Scale Biology Corporation, Vacaville, Calif.) was similarly treated. Digested cDNA and vector were electrophoresed a short distance through low-melting temperature agarose. After visualizing with ethidium bromide and excising the appropriate fraction(s), the fragments were then isolated by melting the agarose and quickly diluting 5:1 with TE buffer to keep from solidifying. The diluted fractions were mixed in the appropriate ratio (approximately 10:1 vector:insert ratio) and ligated overnight at 16° C. using T4 DNA ligase. Characterization of the ligation revealed an average insert size of 1.27 kb. The ligation was transferred to Large Scale Biology Corporation (Vacaville, Calif.), where large scale arraying was carried out. Random sequencing of nearly 100 clones indicated that about 40% of the inserts had full length open frames.

Example 5

Regulatory Factors cDNA Library Construction in GENEWARE® Vectors

Transcription factors represent a class of genes that regulate and control many aspects of plant physiology, including growth, development, metabolism and response to the environment. In order to analyze a collection of regulatory factor genes, the PCR-based methods described below were used to construct a library of such genes from *Arabidopsis thaliana* and *Saccharomyces cerevisiae*. In addition, clones containing genes corresponding to regulatory factors from *N. benthamiana*, *Oryzae sativa* and *Papaver rhoeas* were selected, based on cDNA sequence, from the libraries generated in GENEWARE® vectors as described above.

A. Regulatory Factor Gene Targeting. Publicly accessible databases of genome sequence include data on a wide range of organisms, from microbes to human. Many of these databases include annotation along with gene sequences that predict function of the genes based on either experimental data or homology to characterized genes. The MIPS (Munich Information Center for Protein Sequences) database contains sequence information and annotation for both *Arabidopsis thaliana* and *Saccharomyces cerevisiae* genomes. Based on this annotation, open reading frame sequences of predicted yeast and *Arabidopsis* transcription factors were downloaded from MIPS and used for PCR primer design.

B. PCR Primer Design 18-20 base pairs of nucleotide sequences at both ends of each downloaded ORF were extracted and used to design the gene-specific portion of individual primers. In addition, flanking sequence and restriction sites were added to the ends of primers as shown in the following example:

```
5' primer
GCCTTAATTAACTGCAGC atgtcgggtcgtgaagatgaag      SEQ ID NO. 2321
    PacI    ------
            PstI  5' gene-specific sequence 3' primer
TTGATATCTAGAGCGGCCGCTTA tcatgtttcatcatcgaaatcatca SEQ ID NO: 2322
    EcoRV    NotI
             ------   3' gene-specific sequence
             XbaI
```

C. *Arabidopsis* and Yeast Template Preparation. Total RNA was isolated from flowers and apical meristems of the *Arabidopsis* ecotype Columbia using the Qiagen RNA-easy kit (Cat. no. 75162). mRNA was subsequently isolated from total RNA using the MACS mRNA isolation kit from Miltenyl Biotec (cat. no. 751-02). First strand cDNA was synthesized from 10 μg of mRNA in the presence of Superscript II reverse transcriptase (Gibco BRL cDNA synthesis kit; cat. no. 18248-013) and NotI primer (5'-GACTAGT-TCTAGATCGCGAGCGGCCGCCC(T)$_{30}$VN-3')(SEQ ID NO:2323). The second strand was synthesized based on the manufacturers instructions. This cDNA was diluted 1:5 prior to DNA amplification.

Since most yeast genes do not contain introns, genomic DNA was used directly as a template for PCR. Genomic DNA from *S. cerevisiae* S288C was obtained directly from Research Genetics (ResGen, an Invitrogen company, Huntsville Ala., catalog #40802).

D. PCR Amplification. 1 μl of template DNA was subjected to PCR using the Hi Fi Platinum (hot start) DNA polymerase (Gibco-BRL cat. no. 11304-011) and gene-specific primers for each ORF. Each 50 μl reaction contained: 5 μl 10×buffer, 1 μl of 10 mM dNTP, 2 μl of 50 mM MgSO$_4$, 1 μl of template cDNA, 10 pmoles of each primer and 0.2 unit of Platinum Hi Fi DNA polymerase. PCR reactions were carried out in a MJ Research (Model PTC 200) thermal cycler programmed with the following conditions:

3 min at 95° C.

30 cycles [95° C. 30 sec., 50° C. 30 sec., 72° C. 3 min.]

72° C. 10 min.

Following PCR, reactions were stored at −20° C. until ready for ligation.

D. Subcloning ORFs into GENEWARE® Vectors. To minimize cost and the labor involved in cloning of individual ORF, PCR products containing different ORFs were cloned into the GENEWARE® vectors as pooled DNAs. 30-75 PCR products were pooled, digested with PacI and NotI and purified from an agarose gel. Purified DNA was subsequently ligated into the GENEWARE® vector (5PN-Cap digested with PacI and NotI). Single colonies were selected, grown and their DNA analyzed for the presence of insert. Inserts were gel purified and sequenced, and the sequence compared to the MIP protein database to confirm that they covered the complete ORF. Unique sequences representing various related genes were selected to cover different genes within a multi-gene family. The efficiency of pooled cloning ranged from 30-50% (i.e., 30-50 clones were identified from analysis of 100 pooled PCR products). Following sequence identification of the clones, PCR products that were not represented in the first round of cloning were subsequently pooled together and subjected to a second round.

Example 6

Other Libraries: Regulatory Gene Selection

For each of the cDNA libraries generated from *N. benthamiana*, *Oryzae sativa* and *Papaver Rhoeas*, a unigene set of clones was established. Following basic library construction, all DNA sequences were subjected to BLASTN analysis against each other. Sequences that showed perfect homology across a minimum of 50 base pairs were clustered together. At this level each cluster putatively represents a unique gene. The size of cluster varies depends on the size and complexity of sequence population (sequenced library). A cluster may have only one sequence member, or consist of hundreds of member sequences. The clone with 5'-most sequence in a cluster was then selected to represent the gene. A collection of all the 5'-most sequences or clones was established as the unigene set for that particular library. In the example illustrated below, 4 EST sequences were clustered, representing a putative gene. The EST Seq 1 contained the most sequence information toward the 5'-end, indicating that this clone had the longest insert relative to other cluster members. This process allows removal of redundant clones and selection of the longest and most-likely full-length clones for subsequent screens.

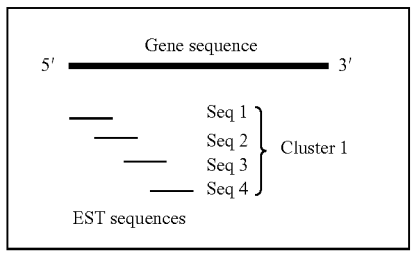

Based on the analysis of the sequence, and annotations of each unigene from each library, all clones that were homologous to known regulatory genes/transcription factors were targets for selection. Depending on the level of homology, some of the clones represented well characterized regulatory genes; however, many of the selected clones had only a modest level of homology to known genes or genes of very distantly related organisms. It is believed that this selection process can increase the probability of gene discovery, and by eliminating non-relevant clones, increase screen efficiency.

Example 7

Trichoderma cDNA Library Construction in GENEWARE® Vectors

A. Growth and Induction of *Trichoderma harzianum* rifai 1295-22. Cultures of *Trichoderma harzianum* rifai 1295-22 were obtained from ATCC (cat.# 20847) and propagated on PDA. Liquid cultures were inoculated and induced using a protocol derived from Vasseur et al. (*Microbiology* 141:767-774, 1995) and Cortes et al. (*Mol. Gen. Genet.* 260:218-225, 1998): agar-grown cells were used to inoculate a 100 ml culture in PDB and grown 48 hours at 29° C. with agitation. Mycelia were harvested by centrifugation, transferred to Minimal Media (MM)+0.2% glucose, and incubated overnight at 29° C. with agitation. Mycelia were harvested again by centrifugation, washed with MM, resuspended in MM and incubated 2 hours at 29° C. with agitation. Mycelia were harvested again by centrifugation, divided into 2 aliquots, and used to inoculate 1) 125 ml MM+0.2% glucose or 2) 125 ml MM+1 mg/ml elicitor. Elicitor is a preparation of cell walls from *Rhizoctonia solani* grown in liquid culture and isolated according to Goldman et al. (*Mol. Gen. Genet.* 234:481-488, 1992). Induced and uninduced cultures were incubated at 29° C. with agitation, harvested after 24 and 48 hours by filtration and immediately frozen in liquid nitrogen. Aliquots were assayed for induction using 2-D gel SDS-PAGE to compare induced and uninduced cultures. Both induced and uninduced (24 hours) tissue was used for subsequent RNA isolation and library construction.

B. RNA Isolation and Library Construction. mRNA isolation was accomplished by magnetically labeling polyA+ RNA with oligo (dT) microbeads and selecting the magnetically labeled RNA over a column. The purified polyA+ RNA was then used for cDNA synthesis using a modified version of the full-length enrichment reactions (cap-capture method) described by Seki et al. (*Plant J.* 15:707-720, 1998). Specifically, isolated mRNA was primed with NotI-oligo d(T) primer to synthesize the first strand cDNA. After the synthesis reaction, a biotin group was chemically introduced to the diol residue of the cap structure of the mRNA molecule. RNase I treatment was then used to digest the mRNA/cDNA hybrids, followed by binding of streptavidin magnetic beads. After this step, the full-length cDNAs were then removed from the beads by RNaseH and tailed with oligo dG by terminal transferase or used directly in the second strand synthesis. For the oligo dG tailed samples, the second strand cDNAs were then synthesized with PacI-oligo dC primers and DNA polymerase. Additional modifications to the published procedure include: addition of trehalose and BSA as enzyme stabilizers in the reverse transcriptase reaction, a temperature of 50 to 60° C. for the first strand cDNA synthesis reaction, high stringency binding and washing conditions for capturing biotinylated cap-RNA/cDNA hybrids and substitution of the cDNA poly (dG) tailing step with a Sal-I linker ligation.

The cDNA was size-fractionated over a column and the largest 2-3 fractions were collected and used to ligate with GENEWARE® vector pBSG1057. The ligation reaction was transformed into *E.coli* DH5α and plated, the transformation efficiency was calculated and the DNA from the transformants was subjected to the quality control steps described below:

1. cDNA synthesis/cloning: The cloning efficiency must be greater than $8\times10^5$ cfu/µg.
2. Restriction enzyme digestion and sequencing: 500 to 1,000 transformants were picked and DNA isolated. cDNA inserts were digested out by appropriate restriction enzymes and checked by gel electrophoresis. The average insert size was calculated from 100 random clones. If the average size was >0.9 kbp, the DNA preps were then passed on to the sequencing group to obtain 5'-end sequences. Those sequences were used to further evaluate the of the library. Libraries that did not meet QC standards, such as high vector background (>5%), low full-length percentage (<60%), or short average insert size (<0.7 kbp), were discarded, and the entire procedure repeated.

C. Library Subtraction. The induced *Trichoderma* library in GENEWARE® was constructed as above and a large number of clones were arrayed on a nylon membrane at high density (HD array). Based on the genomic size and expression levels of *S. cerevisiae,* 18,000 colonies were imprinted to provide 3-fold coverage of the expressed genes. Freshly grown colonies were plated out and picked into 384 well plates and then imprinted on Nylon membranes in 3×3 format at duplicated locations. First strand cDNAs to use as probes were synthesized from mRNAs isolated from both induced and uninduced tissue and used to hybridize the HD arrays. The intensity of each clone after hybridization was quantitated by phosphoimage scanning. The locations of all 18,000 spots were tracked by Array Vision software, which also determined the local background and calculated the signal/noise ratio for every clone on the membrane. The data generated were then converted to Excel format and analyzed to obtain the fold of induction or down-regulation. Based on the measured noise level, a 5-fold increase or decrease, relative to controls, was used as a cutoff value. Clones displaying ≧5-fold induction or reduction on duplicated samples were chosen. These clones were robotically re-arrayed using a Qbot device (see below, Colony Array) DNA was prepped as described below and sequenced. Based on the clustering results, 5'-most unigenes were selected and rearrayed using the procedures described for the Poppy library above: the total number of clones that were selected was 1,019 for the up-regulated library (Th03), and 851 for the down-regulated library (Th04). These clones were prepared as described below (DNA Preparation, Transcription, Inoculation) and tested in a functional genomic screen for disease resistance.

Example 8

Colony Array

A. Colony Array—Picking. Ligations were transformed into *E.coli* DH5α cells and plated onto 22×22 cm Genetix "Q Trays" prepared with 200 ml agar, Amp$^{100}$. A Qbot device (Genetix, Inc., Christchurch, Dorset UK) fitted with a 96 pin picking head was used to pick and transfer desired colonies into 384-well plates according to the manufacturers specifications and picking program SB384.SC1, with the following parameters:

Source

Container: Genetix bioassay tray
Color: White
Agar Volume: 200 ml
Destination

Container: Hotel (9 High)
Plate: Genetix 384 well plate
Time In Wells (sec): 2
Max Plates to use: # of 384 well plates
1$^{st}$ Plate: 1
Dips to Inoculate: 10
Well Offset: 1
Head Head: 96 Pin Picking Head
First Picking Pin: 1
Pin Order: A1–H1, H2–A2 . . . (snaking)
Sterilizing Qbot Bath #1
Bath Cycles: 4
Seconds in Dryer: 10

Wait After Drying: 10
(approximate picking time: 8 hrs/20,000 colonies)

Following picking, 384 well plates containing bacterial inoculum were grown in a HiGro chamber fitted with O$_2$ at 30° C., speed 6.5 for 12-14 hours. Following growth, plates were replicated using the Qbot with the following parameters, 2 replication runs per plate:

Source

Container: Hotel (9 High)
Plate: Genetix Plate 384 Well
Plates to replicate: 24
Start plate No.: 1
No. of copies: 1
Destination Container: Universal Dest Plate Holder
Plate: Genetix Plate 384 Well
No. of Dips: 5
Head Head: 384 Pin Gravity Gridding Head
Sterilizing Qbot Bath #1
Bath cycles: 4

-continued

Seconds in Dryer: 10
Wait After Drying: 10

Airpore tape was placed over the replicated 384 well plates and the replicated plates were grown in the HiGro as above for 18-20 hours, sealed with foil tapes and stored at −80° C.

B. Colony Array—Gridding. Membrane filters were soaked in LB/Ampicillin for 10 minutes. Filters were aligned onto fresh 22×22 cm agar plates and allowed to dry on the plates 30 min. in a Laminar flowhood. Plates and filters were placed in the Qbot and UV sterilized for 20 minutes. Following sterilization, plates/filters were gridded from 384 well plates using the Qbot according to the manufacturers specifications with the following parameters:

Gridding Routine

Name: 3X3
Source

Container: Hotel (9 High)
Plate: Genetix Plate 384 Well
Max Plates: 8
Inking time (ms): 1000
Destination Filter holder: Qtray
Gridding Pattern: 3X3, non-duplicate, 8
Field Order: front 6 fields
No. Filters: up to 15
Max stamps per ink: 1
Max stamps per spot: 1
Stamp time (ms): 1000
No. Fields in Filter: 2
No. Identical Fields: 2
Stamps between sterilize: 1
Head: 384 pin gravity gridding head
Pin Height Adjustment: No change
Qbot Bath #1

Bath cycles: 4
Dry time: 10 (Seconds)
Wait After Drying: 10 (Seconds)

C. Plate Rearray. 384 well plates were rearrayed into deep 96 well block format using the Qbot according to the manufacturers instructions and the following rearray parameters ×2 per plate:

Source

Container: Hotel (9 High)
Plate: Genetix Plate 384 Well
1$^{st}$ Plate: 1
Destination Container: Universal Dest Plate Holder
Plate: Beckman 96 Deep Well Plate
1$^{st}$ plate: 1
Dips to Inoculate: 5
Well offset: 1
Max plates to use: 12 (or less)
Time in wells (sec): 2
Qbot Bath #1
Head: 96 pin picking head
First Picking Pin: 1
Pin Order: A1–H1, A2–H2, A3–H3 . . .

-continued

Bath cycles: 4
Sec. In dryer: 10
Wait after drying: 10

Following rearray, the 96-well blocks were covered with airpore tape and placed in incubator shakers at 37° C., 500 rpm for a total of 24 hours. Plates were removed and used for DNA preparation.

Example 9

DNA Preparation

Plasmid DNA was prepared in a 96-well block format using a Qiagen Biorobot 9600 instrument (Qiagen, Valencia Calif.) according to the manufacturers specifications. In this 96-well block format, 900 µl of cell lysate was transferred to the Qiaprep filter and vacuumed 5 min. at 600 mbar. Following this vacuum, the filter was discarded and the Qiaprep Prep-Block was vacuumed for 2 min at 600 mbar. After adding buffer, samples were centrifuged for 5 min at 600 rpm (Eppendorf benchtop centrifuge fitted with 96-wp rotor) and subsequently washed ×2 with PE. Elution was carried out for 1 minute, followed by a 5 min. centrifugation at 6000 rpm. Final volume of DNA product was approximately 75 µl.

Example 10

Generation of Raw Sequence Data and Filtering Protocols

High-throughput sequencing was carried out using the PCT200 and TETRAD PCR machines (MJ Research, Watertown, Mass.) in 96-well plate format in combination with two ABI 377 automated DNA sequencers (PE Corporation, Norwalk, Conn.). The throughput at present is six 96-well plates per day. The quality of sequence data is improved by filtering the raw sequence output from sequencer. One criteria is to make sure that the unreadable bases are less than 10% of the total number of bases for any sequence and that there are no more than ten consecutive Ns in the middle part of the sequence (40-450). The sequences that pass these tests are defined as being of high quality. The second step for improving the quality of a sequence is to remove the vectors from the sequence. There are two advantages of this process. First, when locating the vector sequence, its position can be used to align to the input sequence. The quality of the sequence can be evaluated by the alignmnent between the vector sequence and the target sequence. Second, the removal of the vector sequence greatly improves the signal-to-noise ratio and makes the analysis of the resulting database search much easier. A third important pre-filtering step is to eliminate the duplicates in a library so it will speed up the analysis and reduce redundant analyses.

Example 11

Automated Tranfscriptions and Encapsidations

Plasmid DNA preparations were subjected to automated transcription reactions in a 96-well plate format using a Tecan Genesis Assay Workstation 200 robotic liquid handling system (Tecan, Inc., Research Triangle Park, N.C.) according to the manufacturers specifications, operating on the Gemini Software (Tecan, Inc.) program "Automated_Txns.gem. For these reactions, reagents from Ambion, Inc. (Austin, Tex.) were used according to the manufacturers specifications at 0.4×reaction volumes. Following the robotic set-up of transcription reactions, 96-well plates were removed from the Tecan, shaken on a platform shaker for 30 sec., centrifuged in an Eppendorf tabletop centrifuge fitted with a 96-well plate rotor at 700 rcf for 1 minute and incubated at 37° C. for 1.5 hours.

During the transcription reaction incubation, encapsidation mixture was prepared according to the following recipe:

|  | 1X Solution |
|---|---|
| Sterile ddi $H_2O$ | 100.5 µl |
| 1 M Sodium Phosphate | 13.0 µl |
| TMV Coat Protein (20 mg/ml) | 6.5 µl |
|  | 120 µl per well |

This mixture was placed in a reservoir of the Tecan and added to the 96-well plates containing transcription reaction following the incubation period using Gemini software program "9_Plates.gem". After adding encapsidation mixture, plates were shaken for 30 sec. on a platform shaker, briefly centrifuged as described above, and incubated at room temperature overnight. Prior to inoculation, encapsidated transcript was sampled and subjected to agarose gel analysis for QC.

Example 12

Infection of N. benthamiana Plants with GENEWARE® Viral Transcripts Plant Growth N. benthamiana seeds were sown in 6.5 cm pots filled with Redi-earth medium (Scotts) that had been pre-wetted with fertilizer solution (147 kg Peters Excel 15-5-15 Cal-Mag (The Scotts Company, Marysville Ohio), 68 kg Peters Excel 15-0-0 Cal-Lite, and 45 kg Peters Excel 10-0-0 MagNitrate in 596 L hot tap $H_2O$, injected (H. E. Anderson, Muskogee Okla.) into irrigation water at a ratio of 200:1). Seeded pots were placed in the greenhouse for 1 d, transferred to a germination chamber, set to 27° C., for 2 d (Carolina Greenhouses, Kinston, N.C.), and then returned to the greenhouse. Shade curtains (33% transmittance) were used to reduce solar intensity in the greenhouse and artificial lighting, a 1:1 mixture of metal halide and high pressure sodium lamps (Sylvania) that delivered an irradiance of approximately 220 µmol $m^2s^{-1}$ was used to extend day length to 16 h and to supplement solar radiation on overcast days. Evaporative cooling and steam heat were used to regulate greenhouse temperature, maintaining a daytime set point of 27° C. and a nighttime set point of 22° C. At approximately 7 days post sowing (dps), seedlings were thinned to one seedling per pot and at 17 to 21 dps, the pots were spaced farther apart to accommodate plant growth. Plants were watered with Hoagland nutrient solution as required. Following inoculation, waste irrigation water was collected and treated with 0.5% sodium hypochlorite for 10 minutes to neutralize any viral contamination before discharging into the municipal sewer.

Example 13

Plant Inoculation

For each GENEWARE® clone, 180 μL of inoculum was prepared by combining equal volumes of encapsidated RNA transcript and FES buffer (0.1M glycine, 0.06 M $K_2HPO_4$, 1% sodium pyrophosphate, 1% diatomaceous earth (Sigma), and either 1% silicon carbide (Aldrich), or 1% Bentonite (Sigma)). The inoculum was applied to three greenhouse-grown *Nicotiana benthamiana* plants at 14 or 17 days post sowing (dps) by distributing it onto the upper surface of one pair of leaves of each plant (~30 μL per leaf). Either the first pair of leaves or the second pair of leaves above the cotyledons was inoculated on 14 or 17 dps plants, respectively. The inoculum was spread across the leaf surface using one of two different procedures. The first procedure utilized a Cleanfoam swab (Texwipe Co, NJ) to spread the inoculum across the surface of the leaf while the leaf was supported with a plastic pot label (¾×5 2M/RL, White Thermal Pot Label, United Label). The second implemented a 3" cotton tipped applicator (Calapro Swab, Fisher Scientific) to spread the inoculum and a gloved finger to support the leaf. Following inoculation the plants were misted with deionized water and maintained in the greenhouse.

At 13 days post inoculation (dpi), the plants were examined visually and a numerical score was assigned to each plant to indicate the extent of viral infection symptoms. 0=no infection, 1=possible infection, 2=infection symptoms limited to leaves<50-75% fully expanded, 3=typical infection, 4=atypically severe infection, often accompanied by moderate to severe wilting and/or necrosis.

Example 14

Disease Resistance Assay

The genes listed in FIG. 1 were identified through functional screening in an in vitro growth assay. The assay was carried out as follows: tobacco (*Nicotiana benthamiana*) plants expressing genes of interest in GENEWARE® vectors were grown for 14 days post infection as described above. Fresh leaf tissue (~60 mg.) was excised from infected leaves using a cork borer and placed into plastic deep-well 96-well plates (Marsh Biomedical Products, Rochester N.Y.) on dry ice. Plates were subsequently frozen 1 hour or overnight at −70° C. Upon removal from the freezer, one pre-chilled tungsten carbide ball (Valenite Corp, Westbranch Mich.) was placed in each well and frozen samples were pulverized in A Kleco 4-96 disruptor (Kinetic Laboratory Equipment Company, Visalia Calif.). At this point, samples were either stored at −70° C. or immediately extracted.

To extract, 1 ml buffer (50 mM K-Phosphate, pH 5.8, 0.1 mM DTT, 100 μg/ml ampicillin) was added to each well and the plates homogenized using the Kleco 4-96 disruptor, followed by 5 min. centrifugation in an Eppendorf refrigerated benchtop centrifuge. Supernatent was decanted to new deep well 96-well plates and 80 μl of each sample was dispensed to 96-well ELISA plates containing fungal spore inoculum.

Fungal spore inoculum was generated using one of three methods, depending on the fungal species: 1) Liquid medium was added to petri dish containing actively growing fungus, the plate was scraped and suspension filtered through cheese cloth. 2) Liquid medium was added to petri dish containing actively growing fungus, the plate was scraped and suspension blended in Waring blender (Fisher Scientific, Pittsburgh Pa.) for 15 seconds. 3) Actively growing liquid cultures of fungus were diluted to the appropriate concentration using liquid medium. All fungal spore inoculums were quantitated using either spore counts (hemocytometer) or optical density, and diluted to appropriate concentrations using liquid medium. 100 μl of fungal inoculum was aliquotted to each well of an ELISA plate using electronic liquid handling.

Plates containing extract and fungal inoculum were covered and incubated under appropriate conditions (depending on growth habit of pathogen). Following incubation period, results were assessed visually. To determine % inhibition of fungal growth, plates were placed on an ELISA grid and the turbidity assessed relative to negative controls (0, 25, 50, 75, 100% inhibition). Plates were also quantitated using a spectrophotometer (Molecular Devices Spectra Max 340 PC, Sunnyvale Calif.) to determine $OD_{595}$, and percent inhibition was calculated relative to negative controls. Results were recorded on scoring sheets/transferred directly from plate reader to workstation and entered in database. Samples designated as hits were selected, the DNA clones were rearrayed using the procedure described below, and the DNA preparation, transcription, encapsidation, inoculation and assaying procedure was repeated.

Clones designated as hits from screening were identified and rearrayed from master 384-well plates of frozen *E.coli* glycerol stocks using a the Tecan Genesis RSP200 device fitted with a ROMA arm, according to the manufacturers specifications and operating on Gemini software (Tecan) program "worklist.gem" according to instructions downloaded from a proprietary LIMS program (Large Scale Biology, Inc., Vacaville, Calif.).

Example 15

Additional Disease Resistance Assays of Selected Clones

Based on the Disease Resistance screening assay data described in FIG. 6a and the BLASTX results for those hits described in FIG. 3a, a subset of clones was selected for additional study. Clones were selected based on novelty, source organism, homology to known defense genes and/or strength of the disease-resistance phenotype observed during screening. The ability of these selected clones to reproducibly confer disease-resistance phenotypes against their identified targets was re-assayed and characterized as described below.

*E. coli* strains transformed with GENEWARE® vectors containing clones of interest were inoculated into 5 ml of TB (terrific broth: 24 g yeast extract, 12 g Bacto tryptone, 4 ml glycerol in 35 mM $KH_2PO_4$, 35 mM $K_2HPO_4$) and cultured overnight. DNA was extracted using Qiagen plasmid miniprep spin columns. Plasmid DNA was subjected to in vitro transcription reactions using Ambion (Austin, Tex.) mMessage Machine T7 transcription kits (cat. # 1344) as per the manufacturers instructions. Transcript was encapsidated by incubating with purified TMV coat protein at room temperature overnight and used to inoculate *N. benthamiana* plants grown as described in Example 12. For these experiments, each transcription reaction, corresponding to a single gene of interest, was used to inoculate 4-6-individual plants on 2 leaves per plant as described in Example 13. Only those plants with a level 3 infection were subsequently analyzed. It should be noted that due to the nature of GENEWARE® expression, one expects a high level of variability in both expression levels and activity of proteins, and a high level of viral infection does not necessarily guarantee a high level of gene expression and active protein. Expression and activity levels may vary due to plant-to-plant and experiment-to-experiment differences in infection kinetics, viral mobility, gene stability, expression efficiency and proper protein folding and/or modifications. The ability to detect activity may also depend on protein efficacy, protein dose in the particular tissue samples and general fungal health and growth. Therefore, in order to detect potentially rare activity events, multiple samples were tested per clone.

Disease resistance assays were carried out as described in Example 14. As a negative control, each experiment also included sampling and extraction from plants infected with a null GENEWARE® construct, which contains a non-coding DNA in the expression cassette. To determine % inhibition of fungal growth, plates were placed on an alpha-numerical ELISA grid and the turbidity assessed relative to negative controls (0, 25, 50, 75, 100% inhibition). Plates were also quantitated using a spectrophotometer (Molecular Devices Spectra Max 340 PC, Sunnyvale Calif.) to determine $OD_{595}$. In this method, OD readings from several (2-4) null-inoculated extract samples per plate were averaged, and percent inhibition of experimental samples was calculated from observed $OD_{595}$ readings relative to negative controls. Results were recorded on scoring sheets or transferred directly from plate reader to workstation and entered in database.

Results from these assays are shown in FIG. 9, expressed as % inhibition relative to null samples. Both actual $OD_{595}$ values and % inhibition values are shown. Due to the variability observed in these assays (discussed above) clones that showed significant inhibition of fungal growth relative to null negative controls in 2 or more of the samples tested were considered positives for fungicidal activity. These results exemplify the reproducibility and types of disease-resistance antifungal activities conferred by genes identified in our screens.

Example 16

Sensitivity of Selected Activities to Treatment with Heat and ProteinaseK

Based on the Disease Resistance screening assay data described in FIGS. 6 and 9, and the BLASTX results for those hits described in FIG. 3, a subset of clones was selected for further study. Representative clones were selected based on novelty, source organism, homology to known defense genes and/or strength of the disease-resistance phenotypes against the target pathogen *Fusarium graminearum* (GIBBZE). To determine whether such disease-resistance activity is mediated by a proteinaceous mode-of-action, the sensitivity of two clones/activities to treatments such as heat denaturation and proteinaseK (Pk) enzymatic proteolysis was evaluated. It is expected that antifungal activity against GIBBZE, such as that described in Examples 14 and 15 and FIGS. 6 and 9, which is mediated by proteins would be diminished in extracts that have been subjected to conditions that denature or digest proteins, such as heat and Pk.

Plant material expressing selected clones was generated as follows: *E. coli* strains transformed with GENEWARE® vectors containing clones of interest were inoculated into 5 ml of TB (terrific broth: 24 g yeast extract, 12 g Bacto-tryptone, 4 ml glycerol in 35 mM $KH_2PO_4$, 35 mM $K_2HPO_4$) and cultured overnight. DNA was extracted using Qiagen (Valencia, Calif.) plasmid mini-prep spin columns. Plasmid DNA was subjected to in vitro transcription reactions using Ambion (Austin, Tex.) mMessage Machine T7 transcription kits (cat. # 1344) as per the manufacturers instructions. Transcript was encapsidated by incubating with purified TMV coat protein at room temperature overnight and used to inoculate *N. benthamiana* plants grown as described in example 12. For these experiments, each transcription reaction, corresponding to a single gene of interest, was used to inoculate multiple plants (10-25) on 2 leaves per plant as described in example 13. Only those plants with a level 3 infection were subsequently analyzed. It should be noted that due to the nature of GENEWARE® expression, one expects a high level of variability in both expression levels and activity of proteins, and a high level of viral infection does not necessarily guarantee a high level of gene expression and active protein. Expression and activity levels may vary due to plant-to-plant and experiment-to-experiment differences in infection kinetics, viral mobility, gene stability, expression efficiency and proper protein folding and/or modifications. The ability to detect activity may also depend on protein efficacy, protein dose in the particular tissues sampled and general fungal health and growth vigor. Therefore, in order to detect potentially rare activity events, multiple samples were tested per clone.

For each experiment, extracts were generated from multiple plants expressing a given clone. As a negative control, each experiment also included sampling and extraction from plants infected with a null GENEWARE® construct, which contains a non-coding DNA in the expression cassette. Leaf tissue from plants infected as described in example 13 was harvested using a scalpel into 50-ml conical plastic tubes and immediately frozen on dry ice, then stored at −80° C. until ready for extraction. Upon removal from the freezer, two prechilled 0.376"-diameter tungsten-carbide balls (Valenite Inc, Westbranch, Mich.) were added to each tube. The frozen tissue was macerated by vigorously shaking the tube in a Kleco disruptor device (Kinetic Laboratory Equipment Company, Visalia, Calif.) for 2×2'. For each plant, crude extract was generated using the following method: frozen, macerated tissue was weighed out into a prechilled 15-ml conical plastic tube containing 2 prechilled tungsten-carbide balls of 0.188"-diameter (Valenite, Westbranch, Mich.) and briefly vortexed. Extraction buffer (50 mM K-Phosphate, 0.1 mM DTT, pH. 5.8, 100 ug/ml ampicillin) was added at a weight/volume ratio of 0.25 g/ml and samples were vortexed for 2-3' to homogenize. Samples were briefly centrifuged (5' at 5 Kg) to pellet un-macerated tissue. The supernatant was removed and re-centrifuged as before. Extract (supernatent) was removed again and transferred to a fresh tube on ice.

Each extract was divided into three 600 ul aliquots. The first aliquot was treated with proteinaseK as follows: proteinaseK enzyme (Promega, Madison, Wis.) was added to extract at a concentration of 300 ug/ml, sample was mixed and incubated overnight at 37° C. The remaining aliquots were stored on ice in a 4° C. refrigerator overnight. The following day, the second aliquot was heat treated by incubating in a water bath at 80° C. for 15 minutes, then removed from heat. The sample was vortexed and centrifuged briefly to pellet precipitate, and the supernatant was transferred to a fresh tube. The third aliquot was left untreated.

Fungal spore inoculum of GIBBZE was generated as follows: liquid medium was added to petri dish containing actively growing fungus, the plate was scraped and suspension filtered through cheese cloth. All fungal spore inoculums were quantitated using either spore counts (hemocytometer) or optical density, and diluted to appropriate-concentrations using liquid medium. 100 ul of fungal inoculum was aliquotted to each well of a 96-well ELISA plate using electronic liquid handling. Subsequently, 100 ul of each sample-extract aliquot was added to each of 5 experimental wells containing fungal inoculum. Heat treated, proteinaseK treated, and untreated samples were incubated on separate replicate plates with negative controls (extracts derived from null-infected plants) included on each plate. Plates were covered and incubated for 3-5 days at 24° C. with 12 hours of white light. Following incubation period, results were assessed visually. To determine % inhibition of fungal growth, plates were placed on an alphanumerical ELISA grid and the turbidity assessed relative to negative controls (0, 25, 50, 75, 100% inhibition). Plates were also quantitated using a spectrophotometer (Molecular Devices Spectra Max 340 PC, Sunnyvale Calif.) to determine $OD_{595}$. In this method, OD readings from several (2-4) null-inoculated extract samples per plate were averaged, and percent inhibition of experimental samples was calculated from observed $OD_{595}$ readings relative to negative controls. Results were recorded on scoring sheets or transferred directly from plate reader to workstation and entered in database.

Results of these assays are shown in FIG. 10, expressed as % inhibition relative to null samples. Both actual $OD_{595}$ values and % inhibition values are shown. Due to the variability observed in these assays (discussed above) clones that showed significant inhibition of fungal growth relative to null negative controls in 2 or more of the untreated plants/extracts tested were considered positives for fungicidal activity. The ability of that activity to be diminished and/or abolished by heat and Pk treatment, as shown in FIG. 10, indicates that these activities are sensitive to treatments targeted towards deactivation of proteins. This implies that the activity observed is due to a proteinaceous mode-of-action. These results exemplify the types of disease-resistance activity conferred by genes identified in our screens.

Example 17

Bioinformatic Analysis of Hits

A. Phred and Phrap. Phred is a UNIX based program which can read DNA sequencer traces and make nucleotide base calls independent of any software provided by the DNA sequencer manufacturer. Phred also provides a quality score for each base that can be used by the investigator to trim those sequences or preferably by Phrap to help its assembly process.

Phrap is another UNIX based program which takes the output ofPhred and tries to assemble the individual sequencing runs into larger contiguous segments on the assumption that they all belong to a single DNA molecule. While this is clearly not the case with collections of Expressed Sequence Tags (ESTs) or with heterogeneous collections of sequencing runs belonging to more than one contiguous segment, the program does a very good job of uniquely assembling these collections with the proper manipulation of its parameters (mainly-penalty and -minseore; settings of 15 and 40 respectively provide contiguous sequences with exact homology approaching 95% over lengths of approximately 50 nucleotide base pairs or more). As with all assemblies it is possible for proper assemblies to be missed and for improper assemblies to be constructed, but the use of the above parameters and judicious use of input sequences will keep these to a minimum.

Detailed descriptions of the Phred and Phrap software and it's use can be found in the following references which are hereby incorporated herein by reference: Ewing et al., Genome Res. 8:175 [1998]; Ewing & Green, Genome Res. 8:186 [1998]; Gordon, D., C. Abajian, and P. Green., Genome Res. 8:195 [1998].

Blast

The BLAST set of programs may be used to compare a set of sequences against databases composed of large numbers of nucleotide or protein sequences and obtain homologies to sequences with known function or properties. Detailed description of the BLAST software and its uses can be found in the following references which are hereby incorporated herein by reference: Altschul et al., J. Mol. Biol. 215:403 [1990]; Altschul et al., J. Mol. Biol. 219:555 [1991].

Generally, BLAST performs sequence similarity searching and is divided into 5 basic subroutines of which 3 were used: (1) BLASTN compares a nucleotide sequence to a nucleic acid sequence database; (2) BLASTX compares translated protein sequences from a nucleotide sequence done in six frames to a protein sequence database; (3) TBLASTX compares translated protein sequences from a nucleotide sequence done in six frames to the six frame translation of a nucleotide database. BLASTX and TBLASTX are used to identify homologies at the protein level of the nucleotide sequence.

B. Contig Sequence Assembly for Hits. Phred sequence calls and quality data for the individual sequencing runs associated with SEQ ID NOs: 1-407 (FIG. 1) were stored in a relational database. All the sequence runs stored in the database for the SEQ ID NOs: 1-407 to be assembled were extracted from the database and the files needed by Phrap recreated with the aid of a Perl script. Perl is an interpreted computer language useful for data manipulation. The same script ran Phrap on the assembled files and then stored the assembled contiguous sequences and singletons in a relational database. The script then assembled two files. One file was a FASTA format file of the sequences of the assembled contigs and singletons (FIG. 1). The other file was a record of the assembled sequences and which sequencing runs they contained (data not shown). FASTA format is a standard DNA sequence format recognized by the BLAST suite of programs as well as by Phrap. Both of these files were then inspected manually to detect incorrect assemblies or to add sequence information not present in the relational database. Any incorrect assemblies found were corrected before this file was used in BLAST searches to identify function and well as other homologous sequences in our databases. Correct assemblies that contained more than one SEQ ID were separated. Although these represent parts of the same sequence, since these are ESTs and contain limited gene sequence data, a one-to-one nucleotide match cannot be predicted at this time for the entire length of a contig representing a single SEQ ID with those containing multiple SEQ IDs. Some fill length sequences were obtained and are designated with a FL.

C. Identification of Function. The FASTA formatted file obtained as described above was used to run a BLASTX query against the GenBank non-redundant protein database using a Perl script. The data from this analysis was parsed out by the Perl script such that the following information was extracted: the query sequence name, the level of homology to the hit and the description of the hit sequence (the highest scoring hit from the analysis). The script filtered all hits less than 1.00E-04, to eliminate spurious homologies. The data from this file was used to identify putative functions and properties for the query sequences (see FIGS. 3a and 3b).

D. Identification of Similar Sequences in Derwent. The FASTA formatted file obtained as described above was used to run a BLASTN query against the Derwent non-redundant nucleotide database as well as a BLASTX against the Derwent non-redundant protein database using Perl scripts. These Derwent non-redundant databases were created by extracting all the sequence information in the Derwent database. The data from this analysis was parsed out by the Perl script such that the following information was extracted, the query sequence name, the level of homology to the hit and the description of the hit sequence (the highest scoring hit from the analysis). The script filtered all hits less than 1.00E-04, to eliminate spurious homologies (see FIGS. 4 and 5)

E. Identification of Homologous Sequences. eBRAD, an internal relational database, stored sequence data and results from biological and metabolic screens of multiple organisms (*Nicotiana benthamiana, Oryzae sativa* (var. Indica IR7), *Papaver rhoeas, Saccharomyces cerevisiae* and *Trichoderma harzianum* (Rifai 1295-22). In order to identify sequences in the database with high levels of homology to the sequences functionally identified as "hits" and contained in the FASTA formatted file described above, the following analysis was performed.

All the sequences were extracted in FASTA format from the eBRAD relational database with standard SQL commands and converted into a searchable BLAST database using tools provided in the BLAST download from the National Center for Biotechnology Information (NCBI). A Perl script then ran a BLASTN search of our query file against the ebrad database containing all relevant sequences. The script then extracted from all hits the following information: the query name, the level of homology and the identity of the hit sequences. The script then filtered all homologies less than 1.00E-20 as well as all the redundant hit sequences.

This analysis was repeated again using a TBLASTX query. Both files were then combined and the redundancies eliminated. Since the query sequences are also present in the database, those query sequences were eliminated as redundant.

These results were used to extract the sequence and quality score data from the ebrad relational database in order to repeat the analysis described in "Contig Sequence Assembly for Hits" (except that contig assemblies from the same organism were permitted to be comprised of independently cloned, but overlapping sequences). FIG. 2 provides the assembled search hits with homologies better than 1.00E-20 to the sequences shown in FIG. 1.

All publications and patents mentioned in the above specification are herein incorporated by reference. Various modifications and variations of the described compositions and methods of the invention will be apparent to those skilled in the art without departing from the scope and spirit of the invention. Although the invention has been described in connection with particular preferred embodiments, it should be understood that the inventions claimed should not be unduly limited to such specific embodiments. Indeed, various modifications of the described modes for carrying out the invention which are obvious to those skilled in the art and in fields related thereto are intended to be within the scope of the following claims.

SEQUENCE LISTING (2324 sequences)

SEQ ID NO: 1 - DNA, 653 bp, Nicotiana benthamiana
tggtatgaacgcagagtggccattcggccggggatatcacccaattacaattacttgtcggtgaactagcaaatataaagtgtgactatataatttcacatccctttcatttacttccattgttcacattcaatcaattggagcaaaaaagggtacctttggatcaaacaagtaagaagcaaagatatgggtcgtggagtcagcagtggaggaggtcagagctcattaggatacttgtttgggagtggtgaggctccaaaatctaccccaacaaatccccaggctgttcaaagtgaagctcagccaataaataaagagccatctccaaagcctgttgctgctgctcctcttgctgatgctactaagcagattcccgcaggtattcagagtatcagggcagatggtcaaaacacgggcaactttatcacggaccgaccatctaccaaaatccatgctgcccctggtggtggatcttctctgggatatctctttggtggtggcagcagctgataaagacatcccaaatcacccatcacggttttattatttctgtacgttatctttcaactatgttgtaagtgtgattgtgagtattgcagaatgtcagtgttattttatgttgctacctagtgggtgagggagttttctgtgtc

SEQ ID NO: 2 - DNA, 644 bp, Nicotiana benthamiana
tggtatcaacgcagagtggccatacggccggggactcaacactcaaattacaatccaaaagcttatattttttctgttacttctctgtactcaagctttgttaacagttcgttcacaacaatggaagcagcaaccaagacgaccaaaggtgccggaggaaggaaaggcggaggcccaagaaagaaggctgtaaccaaatctgtcaaggctggtcttcagttcccagttggtcgtattgctcgtttcctgaagaagggtcgttatgctcagcgtgttggaagtggtgctccaatttacctcgctgctgttcttgaataccttgctgctgaggtgttggagttggctggaaatgcagcgagagataataagaaaagtaggattgttcctaggcatgtacttttggcagtaaggaatgatgaagagttggggaaattgctgagtggagttaccattgcaagtggaggtgttcttccaaacattaacccagtcttgttgccaaagaaatctgctgcagccgaggagaaggcatcaacgcccaggtccaccaagtcgccaaagaaggcgtaggactatcaattacaattgatcttttggtaaaatatggcgggccactcttttgtctagtttattggtatacttcttgt

SEQ ID NO: 3 - DNA, 414 bp, Nicotiana benthamiana
atcaaaatgttttggaaaactaatctttttatttgtgtttctttggctattttgctaatagtaatactccaactagctgatgcaagggagatgtctaaggcggctgctccaattacccaaggaatggattcaaacaacattagtgatcaagcgggttatgctcgggttttacgttgtttggcttgcagatgttgtgtcggttaaattttatatattttttacgatcaaatattatacaatgtttttgtatgtgctaaaagtaataatactccaaaataaggcacaacattgtggtagtattagtttgtgttgttatacatgtcttgtccggttgtctttcaactttgtggtactgtaattttaattctggtcaataaatagtactactaattagtgtataagaaaaaagaacaa

SEQ ID NO: 4 - DNA, 562 bp, Nicotiana benthamiana
agaaatgattggaaatgtcatgatagatgctcgatcaacaggaaaatactatcattttgtgcggctcatggggcgtgctgcttcacacattactctagagtgtgctttgcaaactcatccaaacattactttgattggagaagaggtatttgcaaagaaactgactcttaagaatgttaccgactacattgctgatgtgatctgcaagcgtgcagagtcaggttacaattatggagtgatcctcattcctgaaggacttatagatttcattcctgagattcagcaactcattgcggaactaaacgaaatattggctcatgatgtcgtggatgaagctggtgtttggaaaaagaagcttactccccagtgtcttgagctctttgagttgctgcccctagcaattcaggaacaactgctgcttgagagagatccacacggaaatgtccaggtagctaaaattgaaactgagaaaatgcttattcaaatggttgaaactgaattaggtcagaggaagcagaagggtggatataatgctcaatttaaaggacaatcccactttttc

SEQ ID NO: 5 - DNA, 593 bp, Nicotiana benthamiana
ccagcttggttctccttcacagcatcagaagaatgcatttcatcttgcttctctgcagcctcctcagtagtttggacttcatctttcttctctacatctttctccatatccttgttttcatcttttccctcatcctgtttctgttcgacctccttctcagcttccatagacagagtatccttttcatgtttttcagcttcttgcatgtcaacatccttttcatcctttgccgcttctgtttcttcatggacttcattgtctttcacagccttcttagaagctgaagattttctgcttcgctttttttggagtctcactttccgctgaaggtgaagctgcctttgcctttccactgagtcttgaggatcttctcggagtttcaccagctccccagtcaaactccgtgattggcggactgccagggtgtgacttcaggtactgctccaactgtctctttgtagtgatctcctcccccgttggcgcagtaaatacgatctcttttttctttggagtccctcctcctcctttcttgggcagaaacttctcaaataaatatttataaggtcctgctcttagagcccggccgtaatggc

SEQ ID NO: 6 - DNA, 632 bp, Nicotiana benthamiana
ggtgggttttttaaacacaaacaaaatcgcattatattgtcaggtaactcacaacagctttacaaggccatcaaacaatcagaattttgagaatgttttaagattcactttccgggaacaaagtttgtggcgtaggcccacgcattgttgttaacggggtctgcaaggtggtcagcaaggttctccaatggaccttttccggtaacaatggcctgaacaaagaatccgaacatagagaacatggcaagtctaccattcttgatctcctttactttgagctcagcaaatgcctctgggtcatcagcaaggcctaatgggtcaaagctgccaccagggtagagtgggtcgacaacttcaccaagaggcccaccagcaacgcggtaaccctcaacggctcccatcaagataacttggcaagcccagatggccaagatgctttgtgcatggaccaagcttgggttgcccaagtagtcaagtccaccctcgctaaagatttgggatccagccttgaaccagacagcttcgccaaacttgacaccgttacgagccaagagctcagggaagacacatccaagagcaccaagcatagcccccctgcagtggatcacttcgagttccccggccgtaatggc

SEQ ID NO: 7 - DNA, 357 bp, Nicotiana benthamiana
acaataaagttgtctccatatgacgaataggccacggattcgagccgtggaaacagccactaatgtttacataagggtaggttgtctatgtcacaccccctcgggatacggccctttcctgaatcttgcataaacgcgagatgccttgtgcatcgagctgtgccctttaacaaagagaaatcactaaggtatcatctgattaacagtgatgtcttcttagacaaactggttcacctagatcactaaacctaaagttaaagttgttcctcattcatctaacaatcatctctatcagatgcgtaaaccatttcaccttgccttctcaaagttctcaaatgttatcccggccgtaatggc

SEQ ID NO: 8 - DNA, 681 bp, Nicotiana benthamiana
cttggcaacaggtggtccaagattgcttctaatttaccgggacgaactgataatgaaatcaagaatcactggaatacacatattaagaagaagctgaagaaaatggggattgatccagtcacacaccagccaattactgttaaccaaccaaacatagaacagccaacaaaaaatcaaccaattattcaacaagaaaaacaaacaacaatgccaatttccccatctcatgttgtcccagaaataatggatattcttgatcacaacaaggagctggttgaaactcctatattatcaacaatcacagatatcaaattagacgacgacaacaacaataacagcaatatcaacaataataagaatacggggacaagcttctgtactgacgaagtccccgtaattaaaccacatgaaattttattccattctgaatcaaccacttcaacatcatcatcttcttcaccaacatccattattcttgaagatacgcagtttgatttcaattggggagatgatttcagcagaacattggattatttacttaatgatgatattgacatgaataatgtcatttcccaagattggtcaaaggtgttggaagtttgagcaaattttacttgtgattaattttcaaaggggggctgaattaagctttgttcttttgattggcaagtcacttttttc

SEQ ID NO: 9 - DNA, 636 bp, Nicotiana benthamiana
aattttcattaatgatggcagaagaaacagctaaggatgttgccgatgataaagccatcgttccatttgctcttccttcttctaaagaagaaaaagacaaatccaatgactcaaaacctcttgccatcgtcgaaactaaagcattagtacctgttgagaaaagaggatctattgatagagatgcaactcttgcacgatttacgacagagaagaggttgtccctaatcaaagcatgggaagaaagcgagaaatcaaaagctgaaaacaaagctcagagaaagcaatctgaaatccttgcatgggagaacagcaagaaagcaagcttggaggctgagctcaaaaagattgaggagcaattgttgaaaaagaaggcagagtacattgagaaaatgaaaaacaagattgctctactccacaagtcagcagaagaaaagagagcgataattgaagctaaacgtggagaagatcttcttatggcagaggaaacagcagcaaaacaccgtgccactgaaacttctccaaagaaacctctccttggatgtttttgaagtggcaaaatatcatatactcctatacaattattggttacaaacattgtatagtgaagtgtgcggactgggaatttctttgcattag

SEQ ID NO: 10 - DNA, 343 bp, Nicotiana benthamiana
aagtctactaaatccagggctggttctgtggtagcaaaggatggagacaagagtgtatactttgatttagaggacttgggcaacaccactgggcagtgggacttgtatggttcagatgcaccttcaccatacaatccccttcagagcaagtttttcgagacttttgctgctcctttcactaagagaggtctgttgctcaaattcctgatattgggagggggctcaactcttgcatacttcagttcaacagcatcagcggatatattaccaatcaagaaaggacctcaacttccacccaagcttgggccacgcggaaagatctaatttcttttcaatccaactt

SEQ ID NO: 11 - DNA, 624 bp, Nicotiana benthamiana
aaatttcagaaggttcacctaaatggctcatgctatggcttcagtgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattggtggcgctcctcctccctccggtggattacctggaactttgaactcggatgaggcaagggactttggtctaccacttaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtaatctcagctaagccaaaagaagagaagggaaagctccaggacctgactggaaagctcttcaagaccattagtgatctggaccatgcagc

SEQ ID NO: 12 - DNA, 604 bp, Nicotiana benthamiana
aaccacccaaaatttaccctgccgatgacgtggcaaaaccgcttgtcaacaaacacaaaccaaaacccacgaaacttagagcaagtattacacctggtactgttttaattatccttgccggtaagtttaagggtaagagagttgtgtttttgaaacagcttaaatctgggcttttacttgttagtggaccatttaagcttaatggtgttcctttgaggcgtgtgaatcaagcttatgttattggtacttcaactaaagtggatatttctggtgtgagtgttgagaagtttgacgataagtattttgcaaagcaagctgagaagaaacagaagaagggtgagggagagttctttgaagacaagaaagaggagaagaagaatgtgcttccacaggaaaagaaggatgaccagaaagctgtggatgaagcattgatcaaagccgttgaatgtgttcctgaattgaaggcttatttgtcagctaggttctccctcaagtcgggcatgaaaccccatgagcttgtcttttaggctgtgagatgtttaaaatactctttatgaaattgattttgttagatttattttgggttatgttctgttttggacct

SEQ ID NO: 13 - DNA, 581 bp, Nicotiana benthamiana
tttaaaggaaaaaaaaggaaaagagagaaagagaaatctttctgtcttaagtgtaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatctgagcgtggagcaattgcttagcgaaattgagtacctcttgaaaaatggatgggttccttgcttggaattcgagactgagcgcggatttgtctaccgtgaacaccacaagtcaccgggatactatgacggcagatactggaccatgtggaagttgcctatgttcggatgcactgatgccacccaagtgttggccgaggtggaagaggcgaagaaggcatacccacaggcctggatccgtattattggattcgacaacgtgcgtcaagtgcagtgcatcagtttcatt

SEQ ID NO: 14 - DNA, 529 bp, Nicotiana benthamiana
cacaatactacttcttttttcttcttatttttttgctaagaattataatcatggctactacatggttttcttttttcttgagtttccttttgcttttgcatggcaattatgctcaacaaaggtctcaccatcaatatggccagcagtgtcaaattaacagactcaatccacaagagccttcctttataatggaagcacaagctggagttactgagttttttgacagaaataatcaccaatttcaatgtgctggagtttcactatttcgccatgttatacaatccagaggccttctcttgccttcttatactaattctccactgcttgcctatgttgctcaaggtcgaggattttatgggatcatgaactcggcttgccccgagacattccaatcatctcaacaaactcaacagacaattataggcagaacatttctagaccgtcatccaaagattgaacaatttatgcaggctgatattatggcatttcctgcatgtgctgcacattgactctataatgaacgaaatga

SEQ ID NO: 15 - DNA, 594 bp, Nicotiana benthamiana
acaattttaagtatcataccaatagctgtgccagtatctgggagagctcaatttttagtcaaaggctataatttgtcaaagccatccacaaggttactttgtgctttataaagtaattacctggttccagaagctaataatgaggtagaagaaaatattgatggcattgacaaggatgataagctccaatccctaagtttcacatgttcagttccagcagttactggaagaggatttattgaggttgaagatcacggacttagcaatagcttcttccctttcatagttgcagaggaagatgttcgctctgagatccgtatgcttgagagtgaattagacttgacttcagctaattatgtcacgggacatataaataatatggaagcatgaaatcaagccatggattttattcatgaactgggttggctgcttcatagaaataatttgaaggctagattagagcactttggtcctgatgctgttctctatcctttgaagcggttcaagtggcttattgatttctgcgtagaccatgaatggtgtgcagtagttaaaaaactgttgaatattcttcttgatggaactgtgggcgca

SEQ ID NO: 16 - DNA, 529 bp, Nicotiana benthamiana
atttggtgcaaagccaatcttgggtatttttgtgtgtagaggcaggcatttgttggtttacaacatgaaccaagaaatgagtggcgttatagttgcggatcagaagcagcagcaagaaatgaaaggtgtgaatgggggtgttcatgaggatattaagattgactacgtgtttaaggttgtggtaattggggactctgctgtcggtaaaactcaggtgctgtccaggtttgccaagaatgagttctgttttgactccaaatctaccattggtgtggagtttcagactaggactgtctccattcagtccaaaatcatcaaagcccagatctgggacactgctggccaagaaaggtacagagcagtgacaagtgcatattatagaggagcactaggagctatgttagtttacgacataacaaagagacagagctttgatcatgtagctagatgggttgatgaactcagggctcatgccgatagttccattgtgatcacgttgatcggtaacaaagctgatctagtcgacttg

SEQ ID NO: 17 - DNA, 623 bp, Nicotiana benthamiana
tttgttaatttcatgtttttaattggtggtggatgaagatagatggagactcctcaagaagaagtggtaggagtctctaatgacctctcccacattgttaagggcaagcggactaaacgtcttaggcctcaatctcccatccctttcaccatctccgtgcattcatcaactggtgataatggcggagatggtagagagatcgccatcattaacaataataataatagcgacagtaatattagtcagcctcttgccacttcagctgaaaacttcccttatgaggatgtccccaccgaggaagaagaagaaacggccaagtgtctaatcctcttgtctcaaggtggtcatccttcttcacgtcaaagatttatagaatcaccacctaaaaaattgttcgatcttttcaatgatgacatggggttgtacccaagcaaatacaatagcaaaaggtacgttgagacgattaatattggaaatggtgccaaggcagggacagatgtgtacgaatgcaagacatgtaatcgtacattcccctcattccaagccttaggtggacacagagcaagtcataaaaaaccaaaaccactaaccattgaaccaaaaaaatcattcttctatttttc

SEQ ID NO: 18 - DNA, 601 bp, Nicotiana benthamiana
tttctgtcaaaacctaaccagcacttcttcccccggggcaccgaaccttcggccgtccggcagagaacgtcacctcaaatggagttcgatgagtacgattatctggagaagactgtagaagagcccaacggtggtccttctacaaagagcaaagacaacaacaacaacagcagcgctgagaaggagaagagcgagaaagcctatcgccggagggagagagacgggagcgaggaatacgctgccgaagacgacaatagagatcgccggagcagcaaaaggtctcgcggcgacggcgaaaaggataaggatagagataaagatagagatagggaaagggaaagatcttcgaggcatcggagcagggagcgagaatcggagagagacagagagagaagctcaaaggaccgagaccgagaacgtgacagagagaagagggagaaggagaaagagagggagaaggagaaggaacgagagagggagaggaagagtagagatcgggatagggagagagataaggaacgggagaaggagaaggatagagagagggagaggtcaaggaggagccggagtcgctccaggattgaacgagagcgagagcgag

SEQ ID NO: 19 - DNA, 583 bp, Nicotiana benthamiana
ctcgaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcg

SEQ ID NO: 20 - DNA, 664 bp, Nicotiana benthamiana
caagattgcaactcctgtcttacggattcaatactcgcgttgtgttctgcagatagctgaacagcaagtacctctcctgttgccttgacaagcctacctaggactgctcgagagtcaccaaggttggcaatatataatgtcccgttgcagataactccaacaagacagcatgatccaacagcagcaatctgtggtttcatcggccattgacttgatacaacagagaggaaaccctcttctgttgcttgaaatgcctttcgaatcacgtccacagacattgattgctgctcagaactgaaccctgcaagattagaagttaagtgaataagcgacaaaacagattcagcccccctctggtcatgaatcacccaaaatagctcaataatggatacaaaatggaaagaagaagttactcttgagatgttgaaagaggtgattattgatgaatcttgaagtctcaggaccgccatggccatcataaactccaacaaaagtaccataaggaccagaatcatttaagctcaagcagccagatttaagttggctctggtcttccagtagattattagcttgaactacagccattgagaactctccattaaaatgttgtccaatatccttataccataggagcccatcttgacgaccgccggcatctgaactt

SEQ ID NO: 21 - DNA, 613 bp, Nicotiana benthamiana
tgaaggagaagaggatgttcgggcctggttcccttgccctttgtgttatgttgaaattgaagtccagatgctttgcaaccatttgcaagaagagcattgctttgactttagaaacgcggtttgtcccatatgtgctgcaaatttaggtaaagatcctttggggcattttacgttgcagcatgcacaatcagtaaagaggaggagaaaataccagaagtcaggcttctggaacaatgcttcagcaataagtggcaaggatccccatgaaataacttcattcttgtgcacaaatttaatggttggccgctgcaatgtacaagaacctgctcctgatccccttctgctgccatttctctgcagtacggctcattctgattcaaaagatggtctacaagatgagtcccctggtagtgttgctgctactcctgatgcagaaaggtacctgtaattttgttatgcatgcgtatatatattaattcattttctctcagctttcctgcaaatctaacaaaaaacaaattggaatcactagtgctaaatgtgaaataatatataagcaaacttgcaattcctactagaagatgtacctttctgtataagtcgtcactggaat

SEQ ID NO: 22 - DNA, 577 bp, Nicotiana benthamiana
gttatccacctggtgaccccagcaaacgtgcatttgcttacgttgtcttgacaggaggcaggtttgtctatgcctcattggttcgcctcctgattcttaagtttgttctgagcatgtctgccagtaaagatgtccttgcacttgcttctcttgaggtggatctttccagcattgaacctgggacaactgttactgtcaagtggcgtgggaagcctgttttcatcagacgccgtactgatgaggacatcaatttggcgaacagtgtcgatcttggctcccttcgcgatccacaacaagatgctgagagggtcaaaaatccagaatggcttgttgttatcggggtatgtactcatctagggtgcatacctttaccaaatgctggtgattttggtggttggttttgcccatgccatggctcccactatgacatctctggtaggattcgcaaaggacctgcaccatataatctggaggtgcctacctacagtttcatggaggagaacaagttacttattggttgagaaattttgtttaagttgcaggacaacttgtagctgctggacctaaattggatctt

SEQ ID NO: 23 - DNA, 585 bp, Oryza sativa
ggtcatctccatgcagatgggtgcagtgcaggcatgcgagccctactgccccaccccgacgccgccggtgacgccgcctccgtcgccgccgtcgggtggagggaataagtgcccgatcgacgcgctgaagctgggcgtgtgcgccaacgtgctcaacctgctcaagctcaaggtgggggtgccggcgagcgaggagtgctgcccgctgctgggggggctcgtcgacctcgacgccgccgtctgcctctgcaccgccatcaaggccaacgtcctcggcatcaacatcaacgtccccgtcgacctcgtcctcctcctcaactactgccacaagacctgcccttccgacttctcctgcccactcatctgattcttaatcttcattaccaccacaaccctagctacctaattaaggcttaagctttgcatggcttagtctgtgtgttgcagttgtgtcatacatatatacttatctcgatctatcagtgtgattattgatgatcagatcgatcatctaatatatgtatcttgttattttaatgcgtactgtcaaataaaagtttcctccagtgtacgtacgttctatct

SEQ ID NO: 24 - DNA, 542 bp, Oryza sativa
ccccattgggtagctcagctttgctctccttttattttttatttttttttctgtttgttccaaggtttcttgcatcactttgcggcttatcttgttggttttccttctattttaaggtgtaaagtttgtctccttgtcttggttgtgcttgctgttcttgtttgtttcaaccaacttgtgcagttatacttgatgcttctttttttttctttttctatgtggtttatgcaggttgtgaatttcttggggggacacaagaatcgtgggatggatggcaatgcgagatcggcggcgaatcagacgaagcaaatcgtcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttccc

SEQ ID NO: 25 - DNA, 545 bp, Oryza sativa
cccccccttaatagcatcagcaagaatgcgagggagacggcggagagctcgggaagctgaccctgtgcctgagccattcaccattgacgatgaggtctcccatctcaccaggattagatcagagccaagtcaaaagactcttggtgctttttacgccggtcgcaagaggggcatctcaacgttcgggctgttgtccgggagggagtctggccgttcgggtgctggtggattctctagagccgattgcgcttacgctgcccggaaacacctgccaacaaaaggaccatggtgtgtggatgacatgactagtgaggcgtatgtgtcgcagttctctagtgatggttcactgcttgttgctgggtttcggggaagccgcatcagaatttacgatgccgataacgggtggaaggttcataaggatataagctgccgaagcctgcagtggacggtttcagatattgctctatcacctgatcagcaattacttgcatattccagtttgtcgcctactgttcacatagtgaatgtgcagagttctgcaaagg

SEQ ID NO: 26 - DNA, 469 bp, Nicotiana benthamiana
cccccattggctggaaatgcagcgagggacaacaagaagactaggataataccgaggcatgttttgttagctgtaaggaatgacgaagagcttggaaaacttctagctggtgtaaccattgctcatggaggtgttcttcctaacatcaatccagttcttctgcctaataaatccgacaaagctggaaaagaacctactaaatcgccaacgaaggctaccaagtcacccaagaaggcctaatttgtgacgatgcaggctcgtgtgatggcacagtgttctacttgaatccatgttgtatggacattgtattgtagctttgcaattaggagctttaatggtggtcgtgaaataatctgtacttgtatgtagttttggtatctatgggtttcatgtaggcaacgtctgttgaaactagggatgtttgatttctgttatgatgtaaaactaatgaaattggttctgttttttc

SEQ ID NO: 27 - DNA, 673 bp, Nicotiana benthamiana
ccgctctttttctttcctttcactcttctcgggtcccgttggagatattccccttcatcattttttcctgagaaaattcaaatggccgttccacccgctagagctcgagccgattatgattacctaatcaagctcctcttgatcggcgacagcggtgtgggtaagagttgccttcttttacgtttctcagatggctccttcacgaccagttttattacaactattggcattgacttcaagataaggaccatagagcttgatagcaaacgaatcaaactacaaatctgggatactgctggtcaggagcggttccgaacaattacaactgcttactaccgtggagccatgggtatattgctggtgtatgacgtgactgatgagtcatcttttaacaacatcaggaactggataagaaacattgagcagcatgcttccgacaatgtcaacaaaattctggtcggcaacaaggctgacatggacgaaagcaaaagggctgttcctacatcaaaaggtcaagcactagccgacgaatatggcattaaattctttgagacaagtgccaagacaaatatgaatgtggaagaggttttcttttccatagctcgggatataaaacaaagacttgctgaatctgattcaaaggctgagccacagactatcaggataaatcaac

SEQ ID NO: 28 - DNA, 618 bp, Poppy
gaattcaaaaaatagtaatggcttcttcagtgatggcctctgctgcagtcgcctccgtgaggagctctgctcccgctcaagctagcatggttgcaccattcagcggcttgaaatccgttgctgcattcccagttacccgcaaatcaaacgacatcacctccgttgccagcaacggtggaagagttaactgcatgcaggtgtggccaccaagtggtttgaagaagtttgagaccctctcataccttcccccattgaccgtcgagcaactatccaaggaagtcgactaccttctccgtaatggatgggttccctgtttggaattcggtgccagaggattcgtctacagagaacacggtaacacccctggatactacgatggtcgttactggacaatgtggaagctacccatgttcggttgtaccgatgcttcccaggttatcaaggaactagaagaggccaaggctgcataccctgactctttcatcagaatcattggattcgacaacgttcgtcaagtacaatgtgttagtttcatcgcatacaagcccgagagcaccagctacgaacagtaaaggatgaatcttaatcaaggagcataatccaattcatttctgtatc

SEQ ID NO: 29 - DNA, 606 bp, Poppy
gaattcaaggggtagattttccatattttattctgaatgcaccaagcaacatctctatgttttttccttcaaactgtttcccgttatctgataccaattgtgctgggattccaaatctgcaaattatattttcaaagatgaaagtgaaaacatccttatcgcggatgtgctgaacagctttcacttctgcccatttggtgaaatggtctgtcgcaactatcaagtatctcttttgtcttgtacatgataagaaaggtccacaatatctagcccccactttccaaagggccaacaacttgctgatgaggttaaggacgctcctggggcatgtattcttttgccatggcgttgacaatctttacatctttgcgacagcttttttggatcatcatgcatatatggccaaaaatacccttgcgtcttagctctgtgggataatgatctccctgcactgtgattgccggcttctccgctatgcatcatctgtaatatattttgtctttcttcttttgataaacatctaatagatggtccactaaaggtttttcgatataatattccttctcttaattcttagttagtagctttacctcttaacttatgggc

SEQ ID NO: 30 - DNA, 730 bp, Poppy
gaattcaaaattagggtaaacctaatttacagtgggagaactcaatcatggcgaggggattgaagaagcatttgaagaggcttaatgcccccaaacattggatgcttgataaacttggaggcgcttttgctcccaagccatcatcaggtccacacaaatctagggagtgtcttcccttgattcttatcctgcgaaacagattgaagtatgcccttacataccgtgaggttattgctattttgatgcaaaggcacattcttgttgatggaaaagtgcgaactgaccagaagtatccatctggatttatggatgttgtgtcaatccccaagacgaacgagaactaccgtcttttgtatgataccaagggtcgtttccgtctccactcaatcaaggatgaggaagctaagttcaagctttgcaaggtcagaaatgtacactttggatctaagggtatcccatacattaacaccttcgatggtcgcaccatccgttaccctgaccctcttatcaaggccaatgacaccattaagctagatatggagagcaataagatcgttgattttatcaagtttgatattggtaatgtcgtcatggttactggaggtagaaacagaggccgtgttggtgtaaccaagaacagagagaagcataagggaagtttcgacacccttcacatccaggattctactggccatgagttcgccacccgtttggccaatgtgttcaccat

SEQ ID NO: 31 - DNA, 619 bp, Poppy
gaattcaactctcctgctatcttttacagaaagtagggctcagattgcagaagtctgatcagacatggctgctgctttctcaaccgttggagcagttaacagagcacctttgagcttgccaagctctggccaaagctctgccttcttgggaagcagcttgaataaggtcaattcttctgttgcaccaaaaccatcatcaagaagcttcaaagttgttgctgcacaagaggttgatccaaaaaagaatgaggacaaatgggccggtctttactacgaccagtctgatgatcaacaagacatcaccagaggaaagggaatggttgactcccttttccaagctcctatggataccggaactcacaatgctatcatgagttcttatgaatacgccagcaaggggcaaagaacatacgactttgacaacaccatgagtggattctacattgctccagctttcatggacaagcttgttgttcacattaccaagaacttcatgaccttgcccaacatcaaggttcctctaattttgggagtctggggaggaaagggacaaggaaaatcattccagtgtgagcttgtcatggccaaaatgggaatcaacccaatcatgatgagtgct

SEQ ID NO: 32 - DNA, 438 bp, Poppy
gaattcaaaacacagagcaacaaagtcatcgtactttaaaaaaaaaaaatgcctgcacgaagaagaacccttttaaaggtcataatcctcggcgacagtggggttgggaagacttctctgatgaaccagtatgtgaataagaagtttactaatcagtataaagcaaccattggagctgatttcctgactaaggaagttcaatttgaagataggctttttactctacagatatgggacacggctgggcaggaaaggttccaaagtctaggcgttgccttttaccgtggtgcagactgctgtgatcttgtatatgatggtaatgttgccaagtcatttgaaaatttgaacaactggagggaagaatttcttattcaggctagcccatcagacccagacaattttccctttgttgttgtgggtaacaaggttgacgtggac

SEQ ID NO: 33 - DNA, 590 bp, Poppy
gctagccacgccgtccgctcgggccgaggcgcatcgcgcggggggagaaggggaggagaagatgtcgagcgacggagggccggtgcttggcggcctcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtatt

SEQ ID NO: 34 - DNA, 507 bp, Oryza sativa
gctctccccctccccttcctcccgctccggcgaaggcgagcgcgcggatcggcgtgatggcggcggcggcgccctctcccccacccgtcgcggcgctggagcagatgagcaggaccaaaatgttcggcggccacaacctccgcttccgccaccacagcgccacgctcggctgccccatgaccttctccgtcttcctcccgccgtcgccggcatccgacctccccgtgctgtactggctctccggcctcacgtgcaacgacgagaacttcgtcaccaaggccggcgcgcagcgcgccgccgccgcccacggcatcgccctcgtcgcccccgacacctccccacgtgggcttaatatagagggagaggcagacagttgggattttggtgttggtgctggattctatttgaatgcaacaaatgaaaagtggaaaaattggcgcatgtatgactatgttgtgaaggagcttccaaaagttttaagtgacaactttgaacagctgaacactt

SEQ ID NO: 35 - DNA, 628 bp, Oryza sativa
ccgaaccttccagaagctccagattccaaacgcagcaggagtcgcctcgcctcctccttcatcctcctcgtcgtcgccgcgggggtcgcctgagatcacattaacaatggtgaaggctgttgttgtgcttggtagcagtgagattgttaagggcactatccactttgtccaagagggagatggtcccaccactgtgactggaagtgtctctggcctcaagcctggtctccatgggttccatattcatgcacttggtgacaccaccaatggttgcatgtcaactgggccacactacaatcctgccggaaaggagcatggagcaccagaagatgagacccgccatgctggtgatcttggaaatgtcaccgctggagaagatggtgttgctaatatccatgttgttgacagtcagattccacttactggaccaaattcaatcattggcagagccgtcgttgtgcatgccgatcctgatgatcttggaaagggtgggcacgagctgagcaagaccaccggaaacgctggtggccgtgttgcttgcgggatcatcggacttcaaggctgaaacctggaggtgtgaactcaccttccatctcccagcaccagaagcctgaaactctacgagctc

SEQ ID NO: 36 - DNA, 612 bp, Oryza sativa
cccccgaactttctgcttgcaaagtttcaatgcactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgtcttctcttgctggaatgtcccgttgggcctctctctggagcctctcgttggagcattggcggccggcaatgcggtcgcgctgaagccatcggagctggcgccggccaccgctaagttcctcggcgacaacgtcggca

SEQ ID NO: 37 - DNA, 461 bp, Oryza sativa
  misc_feature (461)..(461): The residue at this position can be any nucleotide.
cgacacacacactcctcatcccagagcaagaagctcagctcctcctcctctcgcatggcagccatggccaccaccgcgtccagcctcctcaagacctccttcgccggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgttttttttttcgggatttgctttgatccccttgtttgttttagctctggatgttgattagcgtcttgttcatagcaattccactgccaccgtgtgtgtgtgctctgcttgcctgatgagggcaagaaaacttccatggatccgtctctctgggaggaatgaataaaaaggatgaggaaataaaaatgattcagtgccn

SEQ ID NO: 38 - DNA, 611 bp, Poppy
gaattcacctcatctctccctccatggcttggttactggctaatggtagttcaagatttactccacaatcacccatagaaacatcaaaaaccctaaaagcttttcctccaagaatcgaaaccccaaaatttctaatccccaatgtaaggtttcccagaatacgtgcagaatcgcaaacagttgaccaagcagctccattaacaggtaataaaccttcttcctctaacgatgcaatcgataaatttcttaaaagagattataaatggggatttgtatcggatattgaatctttttcaatacctaaaggattatcagaagaaacagttagatttatatctgcgaaaaaacaagagcctgaatggatgcttgaatttaggttaaaatcttatgaaaagtttttgaagatgaaagaacctaattggtctgataataggtatccaaaaattgattttcagaatatgtgttattattcagaaccaaagaagaaacccactttgaaaagtttagaagaagctgatcctgagcttcttaaatatttcgaaaggttaggggttccattaactgagcagaataggttagctaatgttgctgttgatgcagtatttgatagt

SEQ ID NO: 39 - DNA, 705 bp, Poppy
gaattcaagattgaattctgtgaactgagtagggagagtaagaagaattagctgaacgttcttgattaattctatcagaaatggagagagttttgatgagattgagtaagttaagatcatcatcatcagtatcatcaagattttgttatgggagaaaagcaggattttcaagtgatgcgaagatagatttgtcgtcatcgaaatcgtttgttcagaagattagagatctacccatggatcttcctggaatcaatgtcaagaaagatgtttctcagttgattgggagaactccattggtatatctcaacaaagtttccgcaggatgtggtgcttacatcgcctgcaagcaggagatgatgcagcctactgcaagcatcaaagacagacctgcacttgctatgattgaagatgcagaaaggagaaaccttatctctcctgagaaaaccctgttgattgagccaacatcaggaaacatgggaataagtatggcattcatggcagcactgaaaggttacaagattgctttaacaatgccatcttacacaagtttggaaagaagggttaccatgagagcatttggagctgaactaatcttaactgaccccgccaaaggaatgggaggaactgttaagcatgcttatgatcttttggaatctagagagaatgcctacatgctccaacaattttcaaatccagctaatactc

SEQ ID NO: 40 - DNA, 655 bp, Oryza sativa
cttagatcaccatcttgggggagacggttgaagtcacctatcatttctaggctcctggttaccacactttgagctttgggattactgctttctttggcgtgatggcggagcagagaggaaatatgttgatgaaaaagtatgagatggggaaattactcgggcaaggaacctttgccaaggtttaccatgcccgtaacaccgagacttctgagagtgttgctatcaagatgattgataaagagaaggttttgaaaggcgggctcatggatcagatcaaacgtgagatttctgtgatgaagttggtgaggcatccaaacattgtgcagttatatgaggtcatggctaccaagactaagatatattttgtgctggagcacgtcaaaggtggagagttgttcaacaaagttcagagaggaagactaaaggaagatgcagcaaggaagtacttccaacaactgatttgcgctgttgacttttgccacagcaggggtgtttatcaccgtgatttgaagccagaaaatcttcttcttgatgagaacagcaatctgaaggtttcagattttggcctaagtgctcttgctgattgcaaaagacaggatgggctgctccacacaacctgtggcacacctgcttatgttgctccagaagtgatcaa

SEQ ID NO: 41 - DNA, 583 bp, Oryza sativa
atccattaattactcgcttcgtggtcggaatccatggccgccgccgcagccgctgtcgggaaccctaacgcggctgccgccgctgcgtcggtctcggcgtcgagggtcggtgcgggggcgctgcgcgcggggggtttgagggtggcggcggggggaagtgtggcgaggaggggaggggctgtggtggcggcggcaatgcggccggcgaaggcggtggcgtcgccggcgaaggaggcggccggggaggtgaacggggcggcgccgggggggttcgcgaggcccgacgcgttcgggaggttcgggaagttcgggggcaagtacgtgcccgagacgctgatgcacgcgctcaccgagctcgaggccgcgttccacgccctcgccggcgacgaggatttccagaaagaacttgatggtatcctcaaggattacgtcggccgtgagaccccgctgtactttgcggagcgattgactgagcactacaagcgcgctgatggcacaggccccaagatttacctcaagagggaggatcttaaccacactggcgcccacaagatcaacaatgctgtcgcgcaagtcttgcttg

SEQ ID NO: 42 - DNA, 681 bp, Oryza sativa
gggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccatta

SEQ ID NO: 43 - DNA, 381 bp, Oryza sativa
cccacgcgtccgctccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtctatcagtttgtgtgtctggttttgaaaaacatttgcttttggattatgcagggtttgcttgtagctttcgctgctgtgacctgtgttgtttatgtgaaccttctttgtggcatctttaatatccaaatgagtggtttgtcgt

SEQ ID NO: 44 - DNA, 466 bp, Oryza sativa
cccccggtggacaccctgcgctgcagccgaacgaccgagctaccgagccaatccagccatggcctccaccgcgctctccaccgcctccaaccctactcagctgtgcaggtctcgcgcctcgctgggcaagcccgtcaagggcctgggcttcggccgggagcgcgtgccgaggacggcgacgaccatcacatgccaggccgcgagcagcatcccggccgaccgcgtcccggacatgggcaagcgccagctgatgaacctcctcctgctcggcgccatctcgctccccaccgtcggcatgctcgtcccctacggcgccttcttcatccccgccgggtccgggaacgccggcggcgggcaggtcgccaaggacaagctcggcaacgacgtgctcgccgaggagtggctcaagacacacggccccaacgaccgcaccctcacccaggggctcaagggtgacccgacgtac

SEQ ID NO: 45 - DNA, 666 bp, Oryza sativa
ccccccgatgagaatggccgcgccgcagcgggtgcatgtgcgtgccgccccgctcgcgcgcgcgctccgaactcgcgtcgccgccgccgccgcgtctgcgagctctcccgaacgcgcgctcctcggcctctccgaaccagatctccggcagctcgccgtcgacctcggccagcaaagttacagggggaagcagcttcacgacctcctctacaagtccagggccaagcaaatccaagaatttagccacgtaccaaaggtgttccgtgaggccttggtcggcgctggctggaaggttggccgctcgccagtgcaccatgctgtgacggcctccgatggcactaccaagatacttctcaagttggaggataacagattgatcgaaacagtagggatccctgtcgatgatgacaaaggcccgtcaagactcactgcctgcgtttcatcacaggttggctgccccttgcgttgctcattttgtgccactggcaagggagggtttgcaagaaaccttcatgcacatgagattgttgagcaggttttggccatagaggagacgttccaacacagggtgacaaatgtagtgttcatggggatgggtgagcctatgttgaacctgaaatcagttttagaggcacatcgatgcttgaacaaggaactaaaaattgg

SEQ ID NO: 46 - DNA, 616 bp, Oryza sativa
ccccacagcatagtaaccaaccgaaccaggcatcagccatggcgcgaaggctctcgctgctggccgtcgtgctggcgatggtggcggccgtgtcggcgagcacggcggcggcgcagagctgcgggtgcgcgtcggaccagtgctgcagcaagtgggggttctgcggcaccggcagcgactactgcggcacggggtgccaggcgggcccctgcgacgtgccggccaccaacgacgtgtccgtggcgagcatcgtcacgccggagttcttcgcggcgctcgtcgcccaggccgacgacggctgcgccgccaagggcttctacacccgcgacgccttcctcaccgccgccggtggctacccttccttcggccgcaccggctccgtcgacgactccaagcgcgagatcgccgccttcttcgcccacgccaaccacgagaccataaagttctgctacatcgaggagatcgacggaccgagcaagaactactgcgacgagacgagcacgcagtggccgtgcatggcggggaaggggtactacgggcgcgggccgctgcagatctcgtggaacttcaactacgggccggcggggcagagcatcgggttcgacgggctgggcga

SEQ ID NO: 47 - DNA, 598 bp, Oryza sativa
cccccccccccggaagagctcggcggtggaacagctcgctcgatcatggccgccgccgccgccgcctcaagggcgctctgggcttgccgcaccgcctcctaccttcggatctcctccttccccagggctttctccaccgtccttaaagatctaaaatatgctgatactcatgagtgggtgaaggttgagggtgattcagcaaccataggggtcacagaccatgctcaggaccatttgggtgatgttgtgtatgttgagcttccacaagttggttccacagtatcacaaggaacgaactttggtgcggttgaaagtgtgaaagcaaccagtgatatcaatgcaccagtatctggagagattattcaagtaaatgatgaactaagtgaaaaaccaggatttataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgc

SEQ ID NO: 48 - DNA, 559 bp, Oryza sativa
ccccccccccccgaccgggatgctgtacatcgtggggctcggcctcggcgacgagcgcgacatcaccgtgcgggggctcgacgccgtccgccgctgcgccaaggtctacatggaggcctacacctccctcctttccctcggcctcgacccctccgcgctctccaacctcgagaagatgtatgggaaggagatcacggtggcggaccgcgagatggtggaggagcgcgccgaccagatgctccgcgaggccgccgacgcggacgtcgccttcctcgtcgtcggcgaccccttcggcgcaactacacacactgatctggtggttcgcgccaagaacatgggggtggaagtgaaggtgatccacaatgcgtccgtcatgaatgcagttggagtttgcggattgcaactttaccgctacggggagaccatctctatacctttcttcacggagacatggaggccggacagtttctatgagaagattcagaacaatcgacggcttggactgcacacactttgcttactagatattcgtgttaaggaaccaacgcttgagtcttta

SEQ ID NO: 49 - DNA, 465 bp, Oryza sativa
gaattccagaaaacaaaaacaacaatggcttcaacagcttcagggactactctatctctactcagaacaacagcatcatcttcatctgctcgcaacaaccgtgtatcatcaacattacaagttgcagcagcatctcgattgagaaacatcggattacaagttagaaacccaaaaagtcttgggttttctggtgttgcagtagatcctcttctttcatcacacgtttcttcacaaattggagctgttaatggtaaaggggtgagaggtgttgtttcaatggctaacaaaagtgttggggatttgagtgcatctgaattgaaaggtaaaagggtttttgttagggctgatttgaatgtcccgttggatgacaatcagaacattactgatgatactagaatccgtgctgctattccaactatcaaacatttgatggccaatggtgctaaagtcattcttaccagtcat

SEQ ID NO: 50 - DNA, 637 bp, Oryza sativa
cgagacttctctacgcttctcctcgccgccgaaacgaagcaacccgtcgcctcgccgccgccgccatgtcggtgacgctgcacacgaatctcggggacatcaagtgcgaggtgttctgcgaccaggcgccgcggacggcggagaacttcctggcgctgtgcgcgagcggctactacgacggcaccatcttccaccgcaacatcaaggggttcatgatccagggcggcgacccgacgggcacggggaaggggggcacctcgatctgggggaagaagttcgccgacgagttcagggagtcgctcaagcacaacgcccgcggggtgatgtcgatggcgaacagcgggcccaacaccaacgggagccagttcttcatcacctacgccaagcagcctcacctcaacggccactacaccgtgttcgccaaggtcatccatggattcgaggtgctcgacctcatggagaaggcgcagacggggcccggcgaccgccccctcgccgagatcaggctcaaccgcgtcaccatccacgccaaccctctcgccaactaatcctatctactccatctagtttaaaatctttggaattctgattgcttttttctgtgtggatgtgttgtgttctgctgctatctgaatct

SEQ ID NO: 51 - DNA, 643 bp, Oryza sativa
  misc_feature (499)..(499): The residue at this position can be any nucleotide.
cgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaagatggatgggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccanacatctgtgggtacagcaccaagaaggtccatactatctttactaagaatgacaagaaccatttgatcaagaaggatgtcccctgcgagactgatcagctgtcccatgtgtacactttgatcatccatcctgatgctacataca

SEQ ID NO: 52 - DNA, 674 bp, Oryza sativa
cccacgcgtccgcacttcaccaaccctctgcctcccttccgccgccctccgccgccgcatgcaagccatcctcgccgctgccatggccgcccagaccctcttgttctccgccaccgcccctcccgcctcccttttccagtccccttcctctgcccgccctttccactcgctccgcctcgccgccggccccgcgggcgccgccgctgccagggcgctcgtcgtcgccgacgccaccaagaaggccgtcgccgtgctcaagggcacctcccaggttgagggagtcgtcaccctcacccaggatgaccaaggtcctacaacagtgaatgtccgtgtgacgggacttactcctggacttcacggcttccacctccacgagtttggcgatactacgaatgggtgcatatcaacaggaccacattttaacccaaacaatttgacgcacggtgcaccagaagatgaagtccgtcatgcgggtgacctgggaaacattgttgccaatgctgaaggtgtagctgaggcaaccattgttgataagcagattcctctgagtggcccaaattctgttgttgggagagcattcgttgttcatgagcttgaagatgatttggggaagggtggccatgagcttagtctcagtactggaaatgctggtgggcgacttgcatgcggtgttg

SEQ ID NO: 53 - DNA, 606 bp, Oryza sativa
ggcttccatgtctaccattcttccattgtgccttggcctccttctcttcttccaagtgtccatggcacaattttcatttgggggaagcccacttcagagcccacgtggatttaggggagaccaagatagtcgtcatcaatgtcgttttgagcacctcaccgcccttgaggcaacacaccagcagagatctgaagctggattcactgagtactacaacattgaggcaagaaatgagttccgttgtgccggagtgagcgtgaggcgcttagtcgtcgagagcaagggcttagttttaccaatgtatgctaatgctcacaagcttgtctacatcgtccaaggtcggggagtgtttgggatggcactgcctggttgtccagagacgttccagtcagttaggtctccctttgagcaagaggtggcaacagctggtgaggctcaatcatcaatccaaaaaatgagagacgagcaccagcaacttcaccaattccaccaaggtgatgtaatcgcagtgccagctggagtagcccactggctatataacaatggtgattctcctgtggttgctttcactgtcatcgacaccagcaacaatgccaaccagctcga

SEQ ID NO: 54 - DNA, 565 bp, Oryza sativa
ctggaatcttgtttaacactagtattgtagaatcagcaatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgttgatcaaacgttggttacatgtactctagtaataaggtgttgcatactatcgtgtgcaaacactagaaataagaaccattgaataaaatatcaatcattttcagaaaaacaaaaacaaacaaccc

SEQ ID NO: 55 - DNA, 658 bp, Oryza sativa
caaaaaaaaaaggaaaaaaaaacaaaacacaccaagccaaataaaagcgacaatgggatcgctcaccaccaacatcgtcctcgccgtcgccgtggtggcagcgctggtcggcggcgggtcgtgcggcccgcccaaggtgccacccggcccgaacatcacgaccaactacaacgccccgtggctccccgccagggccacctggtacggccagccctacggctccggctccaccgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgccgacgacggtgacgtcatccagatggac

SEQ ID NO: 56 - DNA, 575 bp, Oryza sativa
gatccggcgttaccatacgcttcgtcatcggcgatgacctcaacattatcaacaaccaacaacaaaaccccatttctgggtttcacatttgcctctgcaaaaccttcttttttagttaaaaccttaaataacaataattctaagcagcaatctctttcgattcgttgtcaaaacctaaccgctgtacctaaagatgaacgatggatgtttgaagattctgaaatcggcggaccagacatttggaacaagacctggtatcctaaagctgctgatcacataaacacagagaagaaatggtatgtggttgatgcgactgacttaattttgggcagaatggcatcaaccatcgccattcacattcgtgggaagaatctcgcaacctatactcccagtgttgacatgggggcttttgtaattgtggttaatgcagaaaaagttgctgtatctgggaagaaaagattgcaaaagctatataggagacattctggaacaccaggtggtatgaacgtacagacttttgatcagctccaacagagaattcctgaaagaataatcgagcatgctgtccgcggaat

SEQ ID NO: 57 - DNA, 391 bp, Oryza sativa
gaataatcgagcatgctgtccccggaatgcttccgaaaggaagactgggtagagcgttattcaaccatctcaaggtatacaagggtggggagcatccacatgaggcccaaatgcctgttgatcttccaataagagacaaaaggatacggattcagaaataggcataccacatgaagtatggagttagttggggttttaacacttctgaagattgtggtcatgagcctaggctttcttgaatatgtacaacttattattgtgtatgattttgtatgaatctagtggatatcaagtaaatttcattttgagttttgtagaatctatatccgactttgagttctcatgtaatgcaaggaatttcataaaaaaagaaaaaagaagaaaaactcaa

SEQ ID NO: 58 - DNA, 628 bp, Oryza sativa
ggaggagatcgaggaggggatggggatccggttcgtggtgatggtgaacaagcaggggcagacgcgggtggcgcaatactacgagcacctctccgtcgacgagcgccgcgccctcgagggcgagatcgtccgcaagtgcctcgcccgcaccgaccaccagtgttctttcgtggagcaccgcaactacaaggtggtgtaccggcgctacgcctccctcttcttcctagtcggcgtcgacaacgatgagaatgagttagctatccttgaattcattcatcttttggttgaaactatggaccgtcactttggcaatgtgtgtgagctcgacattatgttccatctggagaaggtgcacttcatgctggaagagatggtgatgaatggttgcattgttgaaaccagtaaacagaacatcttggcaccaatccacctgatggagaaaacttcttagaaaaatgctatccaataggggagtgcctcatactcttctgcttatggccaccgcctctgtgattctattgatttttcatctcaatgtgtaaccatcaacgatttccatgtgcatagactattaaacttgacctgataggaaataatgagaatatggcagatgccatctatgttcctt

SEQ ID NO: 59 - DNA, 564 bp, Oryza sativa
cacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgta

SEQ ID NO: 60 - DNA, 519 bp, Oryza sativa
ctcaactcaaacattacagcgaaagcataacaactagaatcccaccacaatgaagatcattttcttctttgctctccttgctattgctgcatgtagcgcctctgcgcagtttgatgctgttactcaagtttacaggcaatatcagctgcagccgcatctcatgctgcagcaacagatgcttagcccatgcggtgagttcgtaaggcagcagtgcagcacagtggcaacccccttcttccaatcacccgtgtttcaactgagaaactgccaagtcatgcagcagcagtgctgccaacagctcaggatgatcgcgcaacagtctcactgccaggacattagcagtgttcaggcgattgtgcagcagctacagctacaacagtttgctggcgtctacttcgatcaggctcaagctcaagcccaagctatgttggccctaaacttgccgtcaatatgcggtatctacccaagctacaacactgctccctgtagcattcctaccgtcggtggtatctggtattg

SEQ ID NO: 61 - DNA, 631 bp, Saccharomyces cereviseae
gaattccagctgaccaccatgtctaccacactactttggttttcaagtgtgataggctacgtgattcaaacaaaatgtttgtctaacatacaatctaaaaaggaaatctccgtggggcccaatggtacaattgcaacgcctgaaactaacggcgacaacggaaactcaagttcattagccttctatctgacctttatgtattttgcttcgtggctgctcttggtgcctgcatctcgactttgggagaagatgagaccgatgtttgtctctgactcagactcgaacaggaattctcagtttgacaacaacaacagcgggtctgtgacaaacgaagatgtcgatacgttctcgcacgtgttggatgatcctcaaccacggattccagcccaacagcagaagcaaaaaatcatatccgtggctaccttcaaatatgtggctaagctaacagtgctggctctcataatgattgtcgctgatttgacttataacatggctttgtcattgtcaccggcatttgatgttgctttgatgcaaaatactgccattttcgaaattgtcactttactatatggtgtttgtggaatctccaggaagaactacgttttccgtaatttcctcatcatgatgaacg

SEQ ID NO: 62 - DNA, 600 bp, Saccharomyces cereviseae
gaattccagctgaccaccatgcaccaagattttcaagaagacgagcatgagtatccagacatcagacgcaatccgctgcatgaggtgaccatgacttcctacatactggggattcttttaggtatatttgttggtctttttccacaaattagattcaagaattttaacctctttattattgccctgtccttattccattttttggagtataatattacagctagatacaatcctcttaaggtacattcagagtcctttcttctgaacaacggcaaaagttacatggcggcacattcctttgctattctggaatgcctcgtagaaagctttctttttcctgatctgaaaatttttagctactctctagctaccaagctttgtacagtacttggatgtcttctagttattctgggacaatataccagaactattgctatgcatactgcgggacattccttttctcatattgtgaagaccaagaaggagtccgatcatgttttagtgaaaactggcgtttactcctggtcaagacatccaagttatcttgggttcttttggtgggcaattggcactcagctactgcttctaaatcccctatca

SEQ ID NO: 63 - DNA, 875 bp, Saccharomyces cereviseae
gaattccagctgaccaccatgcattatttgcctgttgcgatagtaacaggtgccactaggggtataggcaaggcaatatgtcaaaagttatttcaaaagggtttaagttgcattatacttgggtctactaaagaaagtatagagcgcaccgcgatagatagaggccaattacaatcgggattatcatatcagcggcaatgtgctatagcaattgattttaagaaatggcctcactggcttgactatgagtcatatgacggtatcgaatatttcaaagatagaccgcccttgaaacagaaatattccacattgttcgacccatgtaacaaatggtcaaataatgaacgccgctactacgtaaacttattgattaactgcgcaggcttgactcaagaatcattaagtgtaagaaccactgcatctcaaattcaggacataatgaatgttaactttatgagccctgcgacgatgacaaacatctgtattaagtatatgatgaagtcgcaaaggagatggccggaactcagtggtcaatctgctcgacccaccatcgtaaatatttcctccattctacactccggaaaagtgaaggttccaggtacatctgtttactccgcctctaaagccgcactgtccagatttacagaagttttagctgcagaaatggaaccaagaaacattaggtgttttacgatatctccaggtttagtcaaagggaccgatatgatccaaaatttgccagtggaggctaaagaaatgctggagagaaccattggggcaagcggtacaagcgcacccgctgaaatagcggaagaagtctggtctctatacagtagaactgctttggagacgtaacatggcaattcccggggatc

SEQ ID NO: 64 - DNA, 631 bp, Saccharomyces cereviseae
gaattccagctgaccaccatgaacgtaacatcgaatgcaactgcagccggttcctttccactagcatttggtctcaagacctcatttgggtttatgcactatgccaaggcccctgccattaatttacgccccaaggaatccttgctgccggaaatgagtgatggtgtgctggccttggttgcgccggttgttgcctactgggcgttgtctggtatattccatgtaatagacactttccatctggctgagaagtacagaattcatccgagcgaagaggttgccaagaggaacaaggcgtcgagaatgcatgctttccttgaagtgattctacaacatatcatacagaccattgttggccttatctttatgcacttcgagccgatctacatgactgggtttgaagaaaatgccatgtggaagcttcgtgcagaccttcctcggattattccagatgccgctatttattacggctatatgtacggaatgtccgctttgaagatctttgcaggctttttattcgttgatacatggcaatactttttgcatagattgatgcatatgaataagaccttatacaaatggttccactctgttcatcatgaactatacgtgccatatgcttacggtgctc

SEQ ID NO: 65 - DNA, 474 bp, Trichoderma harzianum
acgcgtcgagctggagaatcggaaccgcatggctctcaggtaacactcgggtggtccagtgcatcaactactaagatatcgaaaatgtggtggcccttgcatctagccatatctagagaggttcggcaggcccagtgcagcttagaagggaatgcagttacctacgtaaattacattcatccagtgttcggtattacttgcgatgcgggatgctgaatcggcatttccctgactaagggactctcgctggacagtacaatgaatgatcaagctacaaaggcatatatttttagacgggcaaagtcttacattcagagacatgtagccgttgttcccctacataggtttcagctgtaagggcttgtgttatgaagccggcatcccgagttctcctccttacatctcgtgctttttcatatagtggcatagtaatcaggtacttgcacaccatcttaattaacgatagtgatttct

SEQ ID NO: 66 - DNA, 373 bp, Artificial
  Synthetic
cccacgcgtccgcccacgcgtccgaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcg

SEQ ID NO: 67 - DNA, 196 bp, Trichoderma harzianum
gaagagggactgtactgtacagtaactgtaccttatgcaattgtgcaggattatgtctctgctgtaatgtatctgcggacgtatctgcggatgccggggatggactccggtgtacttggcacggctcgcttccgtttgacataaaaatgcagtgtaacaggtagatggacgtacatgtagatgtaaatgcggtact

SEQ ID NO: 68 - DNA, 224 bp, Trichoderma harzianum
tcgaccgagactcgggccacgatctgccaattggcggagctagacggagtatggcatagcgccaattgctcagagcagctgagcttgcgcaattggccctcatcacaaggattcagccctccctctggaggttcagcttcattgatattgcgaggtggtgtctactgtacatactatacaatattcagcacaggagctttcggtaccaaaacccttcaacaccg

SEQ ID NO: 69 - DNA, 147 bp, Trichoderma harzianum
cccacgcgtccgatttggcaattcctcaagctcacccatttgttgactctggcagtgtagcacacagtctgctcaacaaaccacatcaccatgtccgccgcagagaagaccacggtggcgaccgacgtcgcaaatccccccagtcgc

SEQ ID NO: 70 - DNA, 197 bp, Trichoderma harzianum
ggtttcggagagctagattgaatcggaggggctgcctatattgcggcagaggaatagtgacgtcatgactatcaaggaccctgggaggttacctaaaagaaaagcatctggacgaggtgacgtagccatcaatgcgatcgattgtttgctctatctcctcgggtcggctgttgatttagtattaaactaatggatat

SEQ ID NO: 71 - DNA, 301 bp, Trichoderma harzianum
gtgatatctgatatatatcaaacagcccagcacaccattccaaaaacttcaagaccctcgagtctacatcaacaactcttacatcttaaacaaactgcttcaaaagcacatacacaaaccggtttcccccagtttcacccccaaataccttctgagtggcaatgtccccttctgctatcagcaactccccagagcagcgacctgcaaacaacggcaccacccccgacaacttcgctatccagcctcccgccgacttcaccggctatgaccacgtaacgtggtgggttggcaacgccaagca

SEQ ID NO: 72 - DNA, 658 bp, Trichoderma harzianum
tctcatccacctcgtccatctcatcctttggcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaaggaacagctggtgataattggaaacgacaatgaatcaggcgaggggggatacgtaccacaaaa

SEQ ID NO: 73 - DNA, 540 bp, Trichoderma harzianum
cgaatccaaagtcgtacaaatctcaatgaatggaaagcttccggcctacagcttgccagggtcccgctggaaccactagaattatttaggttctgatggccactccaggggggggggcaccactccgatccactacgcagaagcaaaaatagccgcatgacgcaactcatgatgtgtggagtggcctgacttttttgagcagctgaatgcaaaagcaaaaacccttgtgatcaaaaaccgcataatgcaggtttgcgggcgagacacgcgcgtgcaacgcatcaagacatttgtcgtttgtgtcgaggtgagggcgaaaatggctcggatgaggtgcacacgtgcctcacagactgcgcgttaaagcgaatacgaaggagtccagcgacacttcatattgcctggttgggggccccttgcatatgcagagatgcgtgcgattcccactttgggcctatttctcgggatctatctcgtagtaatcgtatagtctatggagtcttattccagaaaaccaaatagtagtagtaatttcactgc

SEQ ID NO: 74 - DNA, 483 bp, Trichoderma harzianum
cgcccgacaggttacccgcaacgccccgcggtgtgctgcgcagctgcgcactcccatgcagggccgcttcgccagcaccgccgagaacgagttcatcgctgagcgccagcacatcaaggaacacgccaagggcaccactgagctttggaagaagatttccatctacgccgttgttcctgcgctggctatcgccggtgccaatgcctactggctgtggactgagcactgggagcactggagccatcttcctcctctgcccgagcgcaccgagtacccctaccagaacatccggaccaagaactaccagtggggtgatggtgacaagactatcttctggaacgacaacgtcaactaccacaacaaggacaagaccaaataagctggaacaatggctcccggaggaaaactgctggtatttgtagattaccctttttgggacccctctgtatatttcccttggagcttcaatcgattacactgtgg

SEQ ID NO: 75 - DNA, 572 bp, Trichoderma harzianum
cgacacgctctgaaaggctgcgctctaaagtggccacattgattctcggttttttattatcatttttttacatggatctatggcttctcgcatggcctctcctctccgcggcacagtatcgttgcaatcgcagcccttgtacacccacccccttccacccgaatgcttccctccccctgccaaaagtcgggactcgtccgcagaacatgccgagcaaagtgctctgctctactgtacgagcatcttcgtccttgctctctatttgtcttgctcgagtttgtccccccagtgcaaaaaaaaaactttactttttcttcattttatccggtcagctgatttccttttaacatactgtaccttgtgcatcggccctcactcgctccgggcaaggggtgcactacgcaccgccatcacctcgattcggtgagatttctgaatatgacaggctgcctgataaatactagtcgtatccctacccaaaatgccgtaattctctgtttaatatccatatgcatatacagtatgcagtaccccgtaaatgggccaatgaaaggatacatcatgtcgtaaaa

SEQ ID NO: 76 - DNA, 295 bp, Trichoderma harzianum
cccacgcgtccgatcgaaccgatgttcggtggcctcggttcggtttgagtcggagatgctgcgttgctcgtttgggatgttgatctacaggctgtgccgccgtggctgaaagctggagaaggaaatggagtttagttgtgaatatagaacggactagttcgtggaaatgcatgtgaaatcttgaggggcttcgtataaaaatcgacttttgatcacggtaggaggatttagccagccccgcattcctatgatataaggcacaatacatctcatgttcacagagcaaaaaaaaaag

SEQ ID NO: 77 - DNA, 568 bp, Trichoderma harzianum
aatcatcttacaaaagcttcccaaaatggccccggtattaaagattgcacttattcagtttcaggccaagcctctttgtgtgcaagaaaactttgacaaagcggtttcagaaatccgatccgctgcctctcaaggaagccatttagttgtattgccagaatatcacctcacatcatgggttccagaggacccttcctttgctacagcctgtgcagcttccacgcaatatctttcacagtatcaaaagctagctagggagttaaatgttcacatcgttccaggtaccattgttgaacctgttactatccaaccatcaaatgtcgttgctacttctcatgcagagcaagacgtacttgcaggtgatctcatagtggagctacacaacaagacatacttcatcgctgcaacttctggagatatcctaggaacataccaaaagaaaaacttgtggcacgtcgagcgcggcgttttgaccgctgataggcgaacgccgcacaaggcgtttgatgttccactccccggtggccatatcgtgcgagtcggtctgcttatatgctgggatctcgcc

SEQ ID NO: 78 - DNA, 588 bp, Trichoderma harzianum
ctttactccgcgatcttcttgatcttcaccaaaacaacatcattgcgcccttgaagccctcttagcaaatattcgatatacccaaaaggcattgagcccttgagccttacgagaaacacatatatccaacatgcctttcaccgctagcgatatctgcaagattattcttgccatcattctgccacccgtcggtgtcttcctcgagcgaggctgcggtgcagacctcttgatcaacatcctcctcacaatcctgggttacttccctggtatcatccacgctctgtacatcatattgaaatactaagcccgccttccgctcccgtatcccgccggattcaaagcgtcatgtcgtcgcaccgcatcatgttgtgcagacaccaattactcccacgtttgaccggcaattgtcgttttagaatggatgcgtcagtggaggagtgaaggttacggtcgccggctcaccacgtggccggtcatagacgccataatgacagtgggctttcctttatggcttttcttttgttttttcttttcctctcttgttggctggaggcagatgcaccctatttgaaagggggcgtcaggttt

SEQ ID NO: 79 - DNA, 252 bp, Trichoderma harzianum
aacgggcctccatcgactccagaccatccaggacctacacggaagtggcaagagatcgaaatcgtctgcagcttacccctgcaacggccttaacaagctcccgactcggcgggaagctatagcgatccaagccgctcttgtctcgtatataaccaagagctagacttcgcattagatagttcttcgtccttgtgtctgaggacaactcccttcttcattacatacaattgattcaacctgaccacaatggct

SEQ ID NO: 80 - DNA, 486 bp, Trichoderma harzianum
cacaatgaatcgaaaacattccgagactgggatcaccgacgaggcggctattgaaggccatgacctcattcacaacgccgagattgaggagcagagggtatatgtcaaccactaatgtcgtatcttgggttacacgattctaataatgttttagaggctcatggcgagcaggcattgacgcagccagacgagggagatgcgccgctcaacgcaacgaagcagtccgagcccgccatggcgggacaaaccggacgccgccattcagcgatggacaagataaaggagacactgcatctcaagaaataaatgagagatgaaaaagatgaggtcggaaataattacaaaaaaatggtcaaactgatgatacctggcggatgggcagtctggatggtgggacgaaaacaaaagaaaaccacaaataaagaggaagggcacgtgtgtgtcacgtttcgtcaaagtgtattatatgaattccccacatccgcc

SEQ ID NO: 81 - DNA, 559 bp, Trichoderma harzianum
gtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactattgataagctcactgcatgggctagtaataatagct

SEQ ID NO: 82 - DNA, 519 bp, Trichoderma harzianum
  misc_feature (498)..(498): The residue at this position can be any nucleotide.
gtcttgtcattatttttcgacagcgtcgagtaacgacaccgcacaccgtcgtcaaaatggtcaacattcccaagacccgtaacacctactgcaagggcaaggagtgccgcaagcacacccagcacaaggtcactcagtacaaggccggcaaggcttccctgttcgcccagggtaagagacgttatgaccggaagcagagcggttatggtggtcagaccaagcccgtcttccacaagaaggccaagaccaccaagaaggtcgtcctgcggttggagtgcgtcaagtgcaagaccaagttgcagctggccctgaagcgatgcaagcacttcgagctgggtggtgacaagaagacaaagggtgctgctctggtgttctaaatgcgttgttctccggtattatcaattcttatgcttctcctggcggcatacgggcatcatggaacttggcgaagggggtactggtccttgtttagaggacagcggctcataggaaacgaantaaaagatttcttcatggacc

SEQ ID NO: 83 - DNA, 491 bp, Trichoderma harzianum
agtaacgacaccgcacaccgtcgtcaaaatggtcaacattcccaagacccgtaacacctactgcaagggcaaggagtgccgcaagcacacccagcacaaggtcactcagtacaaggccggcaaggcttccctgttcgcccagggtaaaagacgttatgaccggaaccaaagcggttttggtggtcaaaccaagcccgttttccacaaaaaggccaaaaccaccaaaaaggtcttccggcggtgggattgcgtcaagtgcaaaaccaagttgcagctggccctgaaccgatgcaagcacttcaacctgggtggtgacaaaaaaacaaagggtgctgctctggtgtcctaaatgcttggtcctccggtataatcaatcctaatgctcctcctgccggattacgggcttcatggaactgggcaaagggggtacgggtccttgtttaaaggacaccggttcttaggaaacgattaaaaagatttcttcatggacc

SEQ ID NO: 84 - DNA, 392 bp, Trichoderma harzianum
atgctccataaggaacgatatgtttgtaagattggagaaaagggggcaatttacttgcctctagccgctgagggagggctcgatgattggaggtccatgggcaatctatctggagcaggcagagcgtggggtcaattgcaagtcgtcaatggcactaggggtttggtttggggactgctgaaggcgggaggcgtgtgtgtacaagactccccgatgagtcgaatgccaatggacggatatatggatggatggatatcatgtaaggggaacgaagccaaaagggcagcgtgctcatcatttgtcattactcacagcaatgaacgaatgctctgcagcagtgctagcatcaatccttacaaggcaagtaatcaaacaaaaaaacacaaaaacac

SEQ ID NO: 85 - DNA, 172 bp, Trichoderma harzianum
cgtcgcacactctcaggagctgaagtggcgaaggaaccagccggctggcagctgggactcggcaacggcatgccgaaacgctcacgacggagaagactccgaagatgaggcagaagaacctcccacacggagctggcaagaagaagaagaagagaaagcccaagaagaagaa

SEQ ID NO: 86 - DNA, 117 bp, Trichoderma harzianum
tctaaggtaatgggggagcgaagccgttgtaaattcacgttggcaaagccgaacggtatgtaataaaattttaagcagcgcttcaactctgtctagcgaattgattcgagtattgag

SEQ ID NO: 87 - DNA, 352 bp, Trichoderma harzianum
cgttcgggccctccgtccttttctccgagtcacgcacagagacaccagctagccacgatgtctacgcaagccgcgcacccggccctgctcatcccagggcccattgagtttgacgatgctgtgctccagtccatgagccacttcagcgagtctcatgttggccctggcttcgtggccacctttggcgagactctgagcatgctccgccagctcttccagaccaccgatcctgcctctcagcccttcatcctcagcggttccggcaccttgggttgggatttggtgtctgctaacttgattgagcccggcgaggacgctttggttctaagcaccggctactttggcgacagct

SEQ ID NO: 88 - DNA, 441 bp, Trichoderma harzianum
gcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattaggattaggactttgcacggtagtattactaggacccctaggcagaaagttggatatagattgcattggatgttttgattgagttgccttgctgggatgttgagagtctatcaagcaagcaaggcagacgaggatgccttgtgcagagacggcatttcaattcactaattggataaaatagatatcaacgtattatacagaaatactgcatgcaaagtaataacg

SEQ ID NO: 89 - DNA, 486 bp, Trichoderma harzianum
  misc_feature (306)..(306): The residue at this position can be any nucleotide.
aggacatgcacacgcgcaagaagctcatggccgaggaggtcttcaacggcgggccgggaagcggcttcatcgccctcagcggcggctacggcaccgtcgaggagctcttcgaggtcgtcacctggaaccagctcggcatccacaagcgcggcatctgcatgctcaacatcaacggctactgggacggcatcatccagtgggtcgacaaggccgtcgagcagggcttcgtcaagctgcccaacaaggacatcctcgtcaccgcaaacaccgccgaggacgccatcctgggtctgatgaactaccagngttctgagggtacttttaagctggaatggggaacacaatagactttgggttaggttaggttagggatatagaggataaaccgtacaaagggaatgcttggactgttcaggactgcaaacaagcaagccctgcatctgcttaattactatttgtttattttgttgaaaaaacaaacaaaaa

SEQ ID NO: 90 - DNA, 619 bp, Trichoderma harzianum
gagggagctttgctgctctccaggccgtcatactgctcagacctctgtcatatttggagccgtttcctcgactccccgaatctagccatgcggataagactgccctttgcaggtgttttcctgcttctcctgctcctggcgggctatgctggtctatcgactatacagctcggcgcttatgtcaacgacaaggtccttcacttcgtaacgttcttcctactgacggtcgtattctactgggtcgttgataccaatcgtcggcgaaccctacacatgaccctagtggtctgcactctcatacttggtgtcggatccgaattcgtacagagtttcctccccaacgatcgagatttcgacatctacgatatagtagcaaacatcgttggtagtttacttggacttggcatctgcgcctggtatcacaaagcgaatgcttgaaagaaaacgacagcgcaaacactatgacgccgttccaggtgaggacactgaagatgtagagctggggcaaggtcaggagtctggaataacagacgcttcaagtcgaagcaggactctcgaagaagaagtcgataactgggatgaaaacgccgaagacaactgggatgatgacaacgcatcg

SEQ ID NO: 91 - DNA, 665 bp, Trichoderma harzianum
gaggtaaccaccagcacacgcaaacgatacgaaaaaccgagaacaagtataccttcagctccgcggacaacaatcatcaccgcggacaacaatcgtcactgcacgtctgcctagttgagagttccaagtgtaaaaacatcagcagttgccttgctgcgtggttcccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgcaatctggcgcctggcatgaacctgagcagcatgtacacggatgccacagaccaatcaacacttctcatcacggcgccgtgggattcgcccgaggggcatggggaatggatccagagtcttgagaacaggacggccaatggcaacttaaccgagttcagcgctccgggttgcgactccgtcttgctcttccacatggacccggcgggagcgaggccacagatgcgggaagcctttcagcacaaggataccaacgacgtattcgacgtctgtcg

SEQ ID NO: 92 - DNA, 323 bp, Trichoderma harzianum
gtccaagacagagcaaaaggcctgcctcagtacgtctccttctcctactcctacgcctcatcctcactcccaacaattgccccgccatgcctctcccacccttcaaccaattccgcgcccaaacctgcgtcgcgtcaaatcagcgccggccgcggttcagattgaatcgccgcctaagaggccggattatgtccttgcctgctgctttgttctggtgtatcttgagcttgggtggctaattctactgctgttgcgctcttacagtcgtcattgatggctggggcatcccctccgacgagagccccaaggatggcgatgccatt

SEQ ID NO: 93 - DNA, 356 bp, Trichoderma harzianum
tgtctgacagggatgataatgatataacgaaaagaagaagataaggaattaatcccagatgtcgtgtgttgggaaaagggagagaggtagtatgggcgatagggctcccgtttgcagaaccggtagagcggtttgaggtatcacggcagaagcacagagacaatgggcggcacgagaccacttatgcaccctttttatgacggatggcggagcggctatctgggaaaagaaaaaaaagaagacggagaaagggggagaggacgagatgagaggcgtctgagagaaaggacggtgctctcagctatatttcactatgtacagcacaagtacctccttgtcctgatgagtccggcaca

SEQ ID NO: 94 - DNA, 327 bp, Trichoderma harzianum
gcgggtgactcaagagcgccggccgggctcggggcggtcgcttgtgggcagattggcaatccagcatcaaaggtgacgccaagttggtgggctgtttttcgcccctcgggcaggcatggagttcgagatgctggaggggggaaatttttcgattatcgtgttgcattgaagcccggcaatgggtgacggagatggttgtcttgtgtcacaaggaccaagctgtgtgcagagcatcgatgtactgtacgcggtttttacgtcgaggcgacatgacctcaaagccgcgatgtgctcaattcaatcaattcattgctgcaatgaaaaaaa

SEQ ID NO: 95 - DNA, 272 bp, Trichoderma harzianum
ccacgcgcgcgtgaaacattgttggacaacgccattcagctacggctgagcgaggtggcgcccttggcttggatgagatgtcggtacttgcatttattcggtatgttggactgtgccgctatctcttatctacggcactgtttgatatatatatgttccttgcgaaatgctggtagattctgtggctttaagatgctttgagattctgaatgttggattcaagtacttgtaaatgtaactaggttgcgtgaagaaaccaatattgtatcata

SEQ ID NO: 96 - DNA, 390 bp, Trichoderma harzianum
ctcgaccacgcgtcgagaggcttttcgtagaaagccggaagtagtagtgagaaagaaagagccctttgtttgcgccagcgcatgacccgcagagtaagttgtagatgttttttactccggaaatgggagtcatggagacaagcttggacttggggctcttcttggcgctggaagcagagcggctcttcttctttgaggcctgcttgcggcgctccttctcaagcatgatctggcgcatgcactcgcgctgcagagcaagcttctctcgctgcatctccaggacctcggcgtcagtcaagcgaggaggggactgcatcatcatgatgggagaggacgaggcgctggagctggcaatgctgtggctgtcactgtcgaaggggtccgacagga

SEQ ID NO: 97 - DNA, 357 bp, Trichoderma harzianum
catgtggccacgggaatgacgcaaaaggcgccgagagcggaaatggagagaaaaaaaacccaattgcacctcgtgatgatgccactcaaatgtctgtggtcgagccactggcttctacctacgcttacattacctaacaaggaacgaaacattttgcggcaaggagaattggatcattgacttggcgaatggcctaatgaatgtcgtcaattgcaggcctcgtggtttggcggttggatgagagggggaattggagtgagtgggatggggagttggagtcattggattcatttgacaattggttattacgagcggtttaggtaagaatgtaacaatggaacagcaaaacgtgcacgc

SEQ ID NO: 98 - DNA, 79 bp, Trichoderma harzianum
tgcccacgcgtctgcccacgcgtctgcccacgcgtctgcccacgcgtccgcccacgcgtctgcggctggggggaaaaac

SEQ ID NO: 99 - DNA, 582 bp, Trichoderma harzianum
gcccacgcgtccggcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatg

SEQ ID NO: 100 - DNA, 513 bp, Trichoderma harzianum
  misc_feature (475)..(475): The residue at this position can be any nucleotide.
gaagcgagagctggggtatgttgaaatcagcccatgagagattgagctgaaagcatgtggtcatatggttccctttacgcgaggaactagaagatcacaaatgcctcacgtctcgagtgcgggcctttacgatctaacagtgtctagatgttcatagtgttcatagtccagcttatgctctcggccagtaccttagcgagtcacgcaatccggacggggcagatatacacctccagggctgtataatctcttcgatactggtttccaccgagatactaacctcttttgcgtcagcttctggtcggtgctgttacacatcagtccgagtcttcatattgagctgctgagctgcacctgctttagtcccgaaacccggcatgtcccgaccagtcgtcgccttgttccggagaacataacgttagatgtggagatgcagataacaatttgtttgatcatatgatttatcctaagcggncatatcacgccaattgctagacagacgtttatcccttg

SEQ ID NO: 101 - DNA, 102 bp, Trichoderma harzianum
  misc_feature (1)..(1): The residue at this position can be any nucleotide.
ngaatagagggaaaacaagaagcgctgcttagccccgatcatgcgtacaatcttcacacacttgtgtcagctcataccaaatcgagctgggattggttgcct

SEQ ID NO: 102 - DNA, 95 bp, Trichoderma harzianum
gcaaagaatccgcggccgacgtgcccaccaacgggcactatgtttccaatggcatgggctctggacagcaattccagccccagcagtatcagcag

SEQ ID NO: 103 - DNA, 268 bp, Trichoderma harzianum
gacggacttgagcttctgctcatccctttcctcttacattgctttacctttatattctcttttcttcttatctactcgaatccacctatagtaacttcatctaccttaaccttttgtcctcggcgtatctacctcttacatctcaaactctcttcctctctcttctctctcatacttttgcgtcaccattctacatcacatttacctcttgttaaatacaatcaatcccactatacctttctactcagcttgaagctattcctctatc

SEQ ID NO: 104 - DNA, 602 bp, Trichoderma harzianum
gtccaagtacgagtgtaaatggcacagacaggttagatgagctggttgtttgattgttgaatgttggttaagagagtggccacaacggaaccggaaacagtggtaaggtgatgcaaaagcagcaacatttggcgatgtctacggacttctgccaggataaagcgatcctggccggcatcgaattgacatactcgcagacctccttcctacctagtagtccatggcattgggccagtctgatggtatccagcattcatgtgtcagatacaatccatcctgtattaggtagtagatatccggacagacatcaagcagcatcagcatcaggtacgagtaggtatggggtactgcgtacacttagccaggcacaggcgccgggccagggtcctgtaccagtgaccggctgcgcggattgctcaatcaggaaaggggggtcaacaggacacaaagaatggcaccaaaatgcgatcaattagcagttggttgcgccgaggaggatccattcatgtaccaacaacagctggtgtaactctccggatgtgagaaatgatggtaataacagcaaaagctggtaatactcgtactggtagtgagcgtactgt

SEQ ID NO: 105 - DNA, 535 bp, Trichoderma harzianum
acagttgacgttgcactgggagcattcgggggcaagttggagagcggacgagaattaggagtaggggtggccctggtagtcgccgcttgtttctctgccggtttgtcttctttcgctgggggaacggcagcggcattggcattggcagtagcagtggtggtgggagtgggggtagaggctttgctttccacaggcttgaggtttgacgattgattctcaataggcttttgagtttcgttcttggcctgggctccgttcttgagggcatcagcagccgtagcctttgatggctcagacgcttgcgcaggctgcttcttcggcacagccttaatctgcgaagagatgattgctggatcgacaggagcacccttgacagtggcctgtccagttggagctcgtttagctggaggcatgtaccgattctcccgtccagatgccagaggggggaagtcttgacggcggacaccgctgtacctattttgatagtttagtacaacagtacgcagggtgaacaagttcgatggatgcaaaaaaa

SEQ ID NO: 106 - DNA, 407 bp, Trichoderma harzianum
gtcgcccacgcgtccggtctggctttcgatctatttgtagaccgcatctgcggtttcgttgggagctactacgtctcgcttaaaggcgatgtggacgcaatcgtgtttgccggtggaattggagagaggagtgctcgtcttcgcagcgctgtggttgagcaggccgggtgcttgggtttcgctattgacgaggcgcttaacgatgccgaggcagctggagatgcaactgttcgggagctgagcagcaaggattctaaacataaggtcctcgtgtgtcagacggatgaacagtttgagatggctagagcatgtacagagatggaagcactttggacgtaaaagggaggggggagataaagcgcggttatttagatagtagatgtgtgtatgtagaatatatatattgc

SEQ ID NO: 107 - DNA, 626 bp, Trichoderma harzianum
agcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatgaaagaa

SEQ ID NO: 108 - DNA, 340 bp, Trichoderma harzianum
tccgcaaaacggttccaatggcgaaatgtttgcaagactgaacagaagcccaccgactagaaaaacgtggcggcacgatcgaacaagaagtgacggtgggcaaaaggggggggggaagcatttacctaggatccgagaacctgcgggggtttgggtcgtcgagatgcatgtaacgctggccctgtgaggcgagccgtcgggaaaaggaaacttttttttttctgggggaggcccttttctttagatattaccattcatctcgaagctaacacggacgtgtttcttcaactacccgttgatgttatcaaaggactatcttacaagctgttgattgtcaaat

SEQ ID NO: 109 - DNA, 620 bp, Trichoderma harzianum
gcaaggctgaaaacgccctgcacgcctttgccaacggtgcttggctcggaatcaagattggtggcaccatcattgcatcgctgctctgcattctcgctgccgtcggtctcatcaacggcctccttacctggtggggtcactacatcaacatcaatcaccctaccctgactctccagaccattctgtcctacgtcttctacccggttgctttcttgcttggtgttcctcgagacggcgatctcctcaaggttgccaagctcattgctgagaaggtcatcaccaacgagtacaatgccttcaacgccatggccaccgacccatactacgccgacatgtctcctcgctcccagctcatcgccacctacgctctctgcggcttcggcaacattggctccctgggtatccagattggtattctgagccagctggccccgtcccgtggtggtgacgtctcccgacttgccctttctgccctcatctctggtgttttctcgaccttgacctcagcctccgtcgctggtcttgtcgttaccacccagctctcccactttacccgacctccggcgtctggttaagtggagttttgtgcgtgttttttcatgtgaaagatttgtgccatg

SEQ ID NO: 110 - DNA, 587 bp, Trichoderma harzianum
ggaacaacaggagttgtccaagtattcaatcaagtacatcaaacacaatccaggagacgagtacgacctggaccatgtcgttcgcaccatcacggatcccgagtaccgcgccgagattaaagagtatctcaagaactccccagagggtggcatgttttactttttccgcaagaactttcccgcgccgccgtatggccaaaacattgacacttcgggcatgcactacaagatgccctgtgtggtgatctgggggatgcaagagccgtacttttcggacaagatgctggatggattctacaaatggtttgatcaatcggttcgagttgttacgctgccccaggctggacactggccttggagggaagatgcgccaaaagtgaaccgagagctgcggtcgtggcttgatgcgctggaaagcgggcaactttgatggaatgtatgagaaaaatgataatgcatggcgtaaaataattgggatctttatgaggaacatgacaagaaagtttgaggcaacacaggggaacaggggaacagtttgggagaaaagcatcgatttaacgaagaataatatatgacaaaattattta

SEQ ID NO: 111 - DNA, 407 bp, Trichoderma harzianum
cccacgcgtccgacacaactcaaccacactttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattcg

SEQ ID NO: 112 - DNA, 166 bp, Trichoderma harzianum
agaacggaaagcaagagacagaaaaaaaatcgacaatgacgcccttcgttgcgaccgaggagcccgcctcggctgccccgccaaaccacagtctcaatcaccagctgcagcgacagcggcataatgagcacgaggccgacgacgacgagcagaagcgcatagccaa

SEQ ID NO: 113 - DNA, 635 bp, Trichoderma harzianum
tcttcttcaaccagtcttgcagctcacatcagccatgtctgtaacattcaccgtcttcaaagggtctccttccaagaagatcactgagagccagaccacgatcccggccttgctcagtgaccaggttttaattaagaatacacattctggggtgtgtggtactgatgcgcactatcttcacgcagacatggtcttgggccatgaaggtgttggaatagttcaagccgtgggcgacggtgttagtcttgtgaaagtcggcgaccgagttggattcggatacgtcaaggatggatgcaaaaagtgtcagtactgcttggaaggctacaactggcactgtgttgagggcatccgcggattcggtttcaccaactttgatcagggatcgttcgcgacccatagtgtgtggccacagacacggctggcaataattcctgatgagatccccagcgtcaacgcaggcccattcatgtgcgccgggcagaccgttttcatcccatttttgcgacaaggcataaagccctcagattgtgttggcattgttggcattggcggcttgggccatcttgccattcaatttgcagcagcctggggctgcaccgttgttgtcttctccagttctgacaacaaaaaacaag

SEQ ID NO: 114 - DNA, 644 bp, Trichoderma harzianum
cccacgcgtccggtcatcttcggcagacaggcaacgagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatggtatttggaaaatgcgccagcttctatgccccgccacagagagttcctaacacaaattgcagaaaaaaaagcaaaaggaggctgaaaatgccgaaggtcaggctgctggagggaagaggaagaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaattcacattcgactttgccatcaaccagaacttcacgcacgagcctcctaaggtgctgtgcagggagaagatatatcatcccaacattgatctcgagggcaaggtctg

SEQ ID NO: 115 - DNA, 512 bp, Trichoderma harzianum
aaacaacgaaacaaccgcccaatcgccaagtcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctggtgtcgctctaccacgacggcatcctctcgcaggca

SEQ ID NO: 116 - DNA, 515 bp, Trichoderma harzianum
tctccatatggttaatggagatatttacggtcttcctcccatgctgggaagtcttgtgccatcaaagcctctgccaagagacactaaacacaattgaacagtgggagaacaacaagacaggcctcggcaaggccatcagatcattcaagtccaaatcgacaatcatcgactccatcaagaccggatggaggtcgaccaacagctcgatccaaacatcttccgtcgagtcgattctgacgctgagtgctctcgaatacgtcctggagaggaatcccgagcctctacaacaattctcagccctgcgggatttttccggcgagaacattgcgtttttaacaagcgtaggagagtggaagtcatcgtttcccgcttcggtccgcagccgcagcggcattatgtctgacgatacgaagcgggagctggtgcgagagcgattcaaccgcgcgcttcggatctatactgagtacatcagcgctagcgatgcggcatttcccatcaatatctcatcagtacag

SEQ ID NO: 117 - DNA, 499 bp, Trichoderma harzianum
tcgagtcttggcagccttgctcatcacgatactcccgcttggagcttcattttgcatttccatacttggtgtttgatcgtctgtttaattgtttatccattcgctcatcatgccgggaaacgtcaccactcaccacgatgactccacgcccgagtcgagcgacagtggccatcatgaacatgaacatcaccatgaagaacacgaagaacacgaacacaaaggccctcccggtggctttgacaagactccacttcctgatgcgccgcaaggatacactgttcgcttcgtttttcatggcgcgactaacatcccgattgcggattttcacaccggatcttcagatcctttcttggtagcaactctcaagggaacgcagccgaagcgtcacaaggaggatcccgacttaaagtacaggacacgaactctgcacacaaccacggagccgaaatgggaagaggaatgggttgtctccaatgtgccccctaccggcttcaccctc

SEQ ID NO: 118 - DNA, 538 bp, Trichoderma harzianum
actttcccggcctcatcactttgccgatacgaagatcgtcccctttcaatccaattataacgatccgttcgagtcgtgaagccgttcaaaatgtcttaccagaagaacgacaaggatgttcaggagccggctaagagccacaagatccgcatcaccctttcttctcgcaaggtccaggtcctcgagaaggtctgctccgagatcatcgaccgtgccaagaacaaggacctccgcgccaagggccctgtccgtctgcctaccaagtgcctgaccgtcactccccgcaagaccccttgcggtgagggttccaagacctgggaccgcttcgagatgcgcattcacaagcgtctcatcgacctccacgcccccactgaggtcgtcaagcagatcattgtcaacatcgacgctggtgtcgaggttgaggtcaccatcgctgcttaagcgaatctccaatttcgtaaagatgttggagtggccgagaccctgacgtcgagggagatgaaaacagccctcgcagcagataagcacaaaataaact

SEQ ID NO: 119 - DNA, 620 bp, Trichoderma harzianum
atcgttcctcggacagcaatttaaccatcctcccacaatcgcagtagagacggaaacagtggcggaaattactgcgatgattattgcggcgacgttaatcattttcccagagcgttcgaactctccagaccttgaactgggacagacagagagatcgttctttcgaagggccattgctttaattgtgcgatgtttaggactgcaccatgctgatgtggccaaaaatgatccgtgcttcggtcatgcgatgctcatcagagctttgcatcaatgtggcttcgaaatgcgatgagctctcttctgttgcttcgtatccctttatatcatggctacgtacggctagaaaagaaccgtgttgggcagtcccgaccccaaacaggctgctggggctgagacctcgacacgaattacgccatgcttggatgttatgctcacgccgctcatgcaaacaaacaaataaacaaacaatccagtgaactcatctgatttttgcttcagttgcataccggtaaactgatctgatttttgctttcgctgcattatagtgtaaatgtactgtaaatattactactgtatgtgtaaagtattgggagtcaaaagctcaaacaaagctgttataa

SEQ ID NO: 120 - DNA, 488 bp, Trichoderma harzianum
tcttgcccgccacagcaaagggctgggcggatgtgctggtagacgatcgagcatgggtagctttgccggcgaagatgagctggatggcggcattgacggggacgaagctgtcatgacgggcattgcgtacgagaaccccgaagaacaagaactgaggcgacaaagcttgcccagcatgactgcccagcacatatcaggcggtcagccggatcagtacggcggtcattcacggacgtaccctccggctggagtaagaactgccgcaaccgccggcctatatgcacccagtagtggtcagggtcaggccgttggtaacggcagctcgagcgtgtcaaccagtattgggggcagccacacacccaacaccagcatctcttcggtggcagttggcgggccaaatgcaggtctctatgcgcaggctggtgtgccggaaaccgggaagcccctgagccctggtggtgtccaaggccacgacggctctggtgtcg

SEQ ID NO: 121 - DNA, 533 bp, Trichoderma harzianum
tgtgaactctgctcggaatcgtcaatcgagccatccaattctgtatgttctcacaatttctaattattgtatttgccaacatgcactcaacttcatctgcatttccgtttcctcgaccgtgtatcctcgatagtgacgagcccagtacatttctgaggggagcgaggattggccttgtctgtatgagcaatggtatctattgtgctctcactcgtggcttggggagatgttcactttactaaacgggtggtattggaaggaatcatgttgaattggtgcttttaacaggtatatgatgttttgaagaaacaaagctgcctgtgaaagcatcagctccatgttccactacaaattgcatacaacagcaaaaaatacccgccaatgatggaaggcccatcgacggaagcgcctgtcgtggtcttcttgttcagaagcgatattccgatcaccactccggcgacatacttccgccgctaatctccaacgatgctgacgagtataactagctgaaagctttctttcttgcttaaaag

SEQ ID NO: 122 - DNA, 339 bp, Trichoderma harzianum
aaaagaatggattatagttccagctggtggggacgagacagtcgtgggagctgtggaaggatggagcacgcgctggagcgtgagtgaaacatgcagatggtcgctgtatttgggcgtaggctgggctgcgtgtaattcagaacattatgtgcccacgccatgctggtgggaaacctgtaccacggcaccgttgacatcgaatcgtctctgggtggaattaccccgagaagcaagatgtcgtacaaggagaactatagaaattggagtctggactcagtgtgtcttgtcctaggtagttgcacgtgctcgtaaggattgaccatttctggtagatgaaca

SEQ ID NO: 123 - DNA, 486 bp, Trichoderma harzianum
cggacgcgtgggtgccaccaattcgacaagcaaggtagccagaaatggccccgaccaacgacaatgaacggcctaatgcgaacgaaaaagtgctgcacgtgtggtcgaagccgatagcagagggcgatcaggttcccggtctccaagggccggacaagaatccagatgggactccgagaggttcaaggtctgcctttgcagaggcagtctcaatgatcaagaaggatgattttacgaacgtggcaaacacgccctgcgcacggcaaggactgctgacgggaattggggcgggagctggcttgggcggcttgaaatttgtgattcaaggtaatgctgtcaaatctgccaactgggcggttggcttcttcctcttgggtagtatagcatcgtacgagtactgccagtatcaacggcgggccgagaagattcagatgaagaggcacatcgaagtggtcacgcagaacagaaaagagcacgcaaagaaac

SEQ ID NO: 124 - DNA, 577 bp, Trichoderma harzianum
gattttgttggcagatggccttttttttcaccctgccttgacggcggttggcgtgatactttctcgaggcgggtgtcaatacggatacaaaagggacggccgagggattgttcctttacaaaaaggtacatccaacaacgcacaacgggggctggatgcggcaggtgatggccgcggtgcagcaagtaccaggcaggttgcttaattgatcatccggtggcgggaggtaccttgcccgactaatcacaaaaaagagacgacacaaaaaagggtgcgtgcgagcgagcgactagccccgtgcgcgggtttagcacgagcatgtgctgagaagcgctcggagcaagcgagggaacgaggaatggaaagtttgggcaaaaagaaggtgagagaagccgctctgccagtttttatgtgtgtattctgttcgggacgttgagatgctgtaatgtggcttgtcagaagtcaacatgcaacaccactagtgccgctgaggccattgaatggtgggtgccaaacaatgtggtgtggcaagtgatgtgcgcaataaaaggcagaaaaagaaaacaaaattctcctt

SEQ ID NO: 125 - DNA, 566 bp, Trichoderma harzianum
aagttgtgaaaggggttgcagatccaataatgccacgccgatccatatcgagcaatgtatttatacccaaatcgtccctttaccgaaaattccgagcctctctagcgctcgaatttatcaatttttgacgagtatccatgagctccgtgaaaatcaacaagagatttcaggacatatagaagggagggcttaacatatatggatataaatttttctattgcttcatccagcaacaaacccttactggagctcctgtcagccaccgtcgagatattcctggaggcgtcacaaaactctatgtcgatctcataagatcaatcgtcgttggcgcccatactgtactctgagctacaagtttgagaaaaatacttgggtcaacatacatttactacgtatcttgaattctcaccagcatgattgatggaatacagcaccacgttgagacataatagcttggtagtactgtacggggccgcctcaactatggagacgtctaaccgatcgcgagtttagctctcccggtacgagtagccgtcttccgggccggtatttggtgctcggacctg

SEQ ID NO: 126 - DNA, 304 bp, Trichoderma harzianum
ggcagagctacaacggccctagcacacaattggccacaattcacgcctcacaatcgccaagattgctctaattctcgggcagtcaagtcttgtcaagtcttgtcaagtctcgaactcgtatccttgagcatatgcaggtggcgtctgtgtctcgagacaagagagggtgaacatgtgcacagaacaaggcaccgaagccgaaagggacaaaccgaagccgaggtgggaaaaaggcgccacgaaccagtatccaagagtttagccactgtgtcctaatagaatccccccttcttttttttccttc

SEQ ID NO: 127 - DNA, 230 bp, Trichoderma harzianum
gttgggatttacggtgtataattgagctgaacggcgacaatttgctgggcttgtgcgtagagcttccgatgggtccggctgcttagcagtatagagaatggaagctgtcattaaaggcgctgttgtccgttgttccgtggttgacagctggatatgattgaacataaagagttgggccgttggaccgggcgatatcatcagtcgatttgaagcaggttcgcagatacttc

SEQ ID NO: 128 - DNA, 516 bp, Trichoderma harzianum
atcgtgtgtcaaatcgtgcagcaatctggggcaaaaaattggggagcagggcgtgtctgactttagactttgaagctgtttccttggggtctaaaagacttggcttcgacagcaatcgttgcgcttgagcaaagtatccagatacccgaagcggcgaggggtggggagagagaagattacgctgagcggcgctggaaagcagcaagtacctgtactgctgcctgttcgcttgtttttggtgatgtgagctgggcttgtttaaggtagtggagttgctgagggtagctccatcttagacaaagttttcccctaggcgttgggattttcgtgtcccgtgagtggttgtgagatgactgagaggaatggggagcggcctcagaaaaagcgatatcggaaaatcgatgtggcagttggtgatttcgcttgaggtgtttgatagaaatgccattctttttccaatatctaatagagacgcaggcacggctgccaatgtagttgaattcattggtagacatg

SEQ ID NO: 129 - DNA, 383 bp, Trichoderma harzianum
  misc_feature (381)..(381): The residue at this position can be any nucleotide.
cgccaatctcgaacgcctgtcaaaatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggttcggcgccggctactgggccttcatggccaccggcttcttcgctccctttggcattgccgtctaccaaacctacaagacccagtaaacggatgcttcgattacaaaaggcttatatgggctggacgcttggtgctatgaatgggtggtggactgttgcgacagagtaaatagctcgaattagacgtgggaccaattcacaagtcacatacatcanag

SEQ ID NO: 130 - DNA, 505 bp, Trichoderma harzianum
gcagcacaacgtatcatcatgccgtcagcttctgaaaaggcgagagcaaagctcgatgcggtgttgaacgacccgggacgatttgactgtacccaacggtcgaatcgcatagcgacgacacgatatgctacaggctgtggcgtagtcaactctgttccgcgtcgccccagccagagtagcatagaaagcgattcaggcggcgtcaggaacagactgaaacgcctcatgtccttacccgcgtactaaagcgaaaaaaaaaagtgactggagaaatattcttgatatggataacaacctcgatggttgtgaacagtttcatatgtcctagtgtcccatcgagcaaaggttgcctgtctattggcacgctcgtactttatctcgtgcctccttggcaagattggaagatgtacacatctcttaacctgaatttctctccgaagagcattgaggatctgttgtagtccatctctgtagcagacatgttagatgcaatgaatttttatcc

SEQ ID NO: 131 - DNA, 574 bp, Trichoderma harzianum
gcaggagatcttcggccccgtgctggtgtgcctcaacgtcgagaccatcgacgacgccattgagctcatcaacaagaacgagtacggcaacggcgttgccatcttcacaaagtcgggcgccaccgccgagacgttccgcaagaacatcgaggccggccaggtgggcatcaacgtgcccatccccgtgccgctgcccatgttctccttcaccggcaacaagaagtcgattgccggaggcggtgccaacaccttctacggccgacctggtatcaacttttacacgcagctcaagacggtgacggcgttatggcagagcgccgatgccgtggccaaaaaggccgcggtgcacatgcccacgctgcagtagaagatgaaattgggttgagcggtttaggattgtttgtgtgcggaatatgacggaatggtgggaaaaattgatgatgccttgatgaaatgaagggtggttgtctcacagaacatgcatgtactgtacataatatagccacgagcagatgggctggacagcatgggaattgctttttttaagcagaatgaaataaatctacgttaaatc

SEQ ID NO: 132 - DNA, 599 bp, Trichoderma harzianum
aaagcacaaagcacggcgtatcggaggtagatcaatgtttcgcaaccacgacaatgcagtaatggccaccttgaccttggctcgctgtcaacaaaccaacaggcaatgctcgacaggagttcgggtccgcaaggatgaaatacgcttgttgtgagccaatcaagacaaacagcgatacgcctggcgagggcttgattgagccaacgagattctcttgtgaaacactgccaccgccaatctccatctgctgcttgcaagcgagagcgagagcagcatcacgtgatgagaaagatgggtgactcagcagctcggagaccgaggagcccatccatccatcaggattgaagctctgatgctttggagaagatggaatggtgtgcacagccaccacttgtggggagatggtctcgcgagcagttggagggacttggatggtacatgaactagtgggagagttacgtgggcatgttgaggcgaatgggagtaccggtcaagtagcgtctctggaggaatgattacgaaccgtcgggctcttgagcaacccgaaggagcggaacgaatcttgttcgctgatgatcagggcctaaaagccaaactat

SEQ ID NO: 133 - DNA, 593 bp, Trichoderma harzianum
cgaactgaagcacaacggggtgaagttatacctgaatgatactgcaagaagaatcgaagactctcatgtcgtcttggctagtaatggaagagagatccctgccgaattggtcattctagctgtgggagtaagggcaagaacatcactggcaaagatggcgggcctcgaagtgggaacacagggagtcaaggttgaatcacacatggaaacatccgacgaagacatctacgctgtaggtgatatggttgagacgaagcatgtcattcaacaacagccaagggtagttgctttagggggcccagcaaatcgacagggtcgactcgccgcagatgatatagccggcagaccagtgcactatcgcggcaacatcggcacaatcatctgtcaggtcttcgatttaaccgtcggtttagctggcctgtccgtctcggcgctgcgtgacttgggacaggagccgctctgggttacagtgcatcctccacaccatgcgaggtattatcctaacgctcgtccaatcacgatcaagaccgcgttcgaaaagggcacaggccgtattctgggggtgcaggcagtgggaatggctggcgtggaca

SEQ ID NO: 134 - DNA, 478 bp, Trichoderma harzianum
cacgcatgtgattgattgattgatgcaagtgctatcacaagcagccggccggtcgcactttgtcggaacgaggaccatcaaaccagttctgttgcgccccaactccttcatgttccatcatattactacccattaatacccaaacaaaacaaggggaaaatcttggaagtcgcaatccaatttagctaccccatcgtgtgtcctttttgctccatccaaaaccaccaaaaacaagctccgaaatatctccacaatctaagccatccatctacgagtaggtcgaacaatcccccccgtcggctgtcggcgaaccttccaatctctctctcacatctttccggcctgtcaactccagagcccccgtcggcgtcttgatcaaatgtccggtaacaacttcctcccacacccttcctcaccggaactcgtaccctccgtaaacggcacctcaaacggggtaatcataacaccaagttcgacg

SEQ ID NO: 135 - DNA, 531 bp, Trichoderma harzianum
aaagaccaagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtccccgtgaacctgcggcatcagttcttcctgacccaggccttgctgccggggcttctccttgctgctggaaacgcttcggtgattaacatggggagca

SEQ ID NO: 136 - DNA, 302 bp, Trichoderma harzianum
gttcgatgcactgccaccatcctcggagaaaggtgtgtgtagtggacaatgtatgtgtgtcattgaagaaagtaggagtaggtggcggctccttggcaaagtggcaatgttgcttggtattatggatcggtgggttgtgcccagctggaatggcttgtcttggcgatagggggaatatggagtcgttttgatgggaacggcctttttggtttaccgaggaggggtcaacatgtgcgagcatgtatgttcaaagatgggagagggagagaagaagagagaaaaatcaagaatcagtcgtgcct

SEQ ID NO: 137 - DNA, 357 bp, Trichoderma harzianum
agagcatcttcctgacatgccggggttgatgcaacgctttgactgtatggaaacatccgtattgctgacatacatgtcttccatgttgtcttacactgcactcaggaggagcagtcatccaccgagttgattcacatggcagcaaaattgtgctggatctactgcagcgcagatcctctatttgggcatttcttctcggagacagacacagatcggctcggcgaacccgagagcaagtgatagcaagacaagcacagatatgcttggcgaggctgtcctcaccaggaaacgaaagaggaggtttcaccagcaactccattcccagcagaggtcagcctgtcctacctgtcacattag

SEQ ID NO: 138 - DNA, 580 bp, Trichoderma harzianum
gacaaaatggtatgccaccaccaccgacgccaccgaccatgatgaaatggacgtcgctatgcagatgctgatcttttaaaattcacaggcgcctgcagctggagcaaagaagcaaaagaagaagtggtccaagggcaaggtcaaggacaaggcccagcacgccgtcctgctcgacaagaccatctccgagaagctctacaaggatgtccagtcttaccgcctcgtcaccgtcgccgtcctggtcgaccgaatgaagatcaacggctccctcgcccgccagtgcatccgcgacctcgaggagaagggcatgatcaagccggtcatcactcatagcaagatgaagatctacagtacgactcaccaacccgttccccttgtgtgcgcgttttgaaagagaataagagacactgacaattgcgcagcccgtgccatcggcgagtaaatttaccaccatgtttgaaagttaaagcattgagatttggcgcctggttggtctgaaaggaagaaaatgggaccatgagtgaagaggatgatacgaggtatataaagccttagttgggacgcttttcatgctcggtgt

SEQ ID NO: 139 - DNA, 436 bp, Trichoderma harzianum
cctgtaacaagcgaggggcgcattcgccattccgtgatgtgtaacccgaattatatcgatactttactcagcatggcctcttccatcacggacgcgagtaacggactaactcatttcaagcaaatcatcggaataacaagtcaatcgactaacttgtttcaagattatccatcggaatgcaactatgtaacaccactgctaatcaccgcatcatacgataacgaggtccaaggttttgataggccgaccccgccttttttttttgttctcctcgggtaacggtggtggcgatattttattagttgtgacggatcttgggaaagctcgattttgaggggttgcattgggggttatatattccgggtcgatccaatcttgtttatttttgtttttttttaaaatcacatctcaacaaaaaaaccttgatttaccctag

SEQ ID NO: 140 - DNA, 592 bp, Trichoderma harzianum
actcgagaggagccagatgctacgcctgcccctgttgctgctccgaacccctcagcaccaactccgccttcgggatcaaacacaggatcaggtggtcgcctttcactctctggacttctcaacattctggatggagtcgcctcacaggagggccgtcttcttgtcatgactaccaaccacattgagaaattggacaaggcgctgatccgacccggccgtgtggacatgattgtccccttcagccttgccgataagactatgactgagtccatcttccgtgccatctatgctccctttgagagcgagatctcctcaaacgagctggcactcggctccaagagcggtaccagcacgcccaagcgcattgaaccggatgaggaggccaagcaacggtgggccagacagcatgctgagatttctgagcgcattgaggttctctctctacagtttgctaccaagatccccgagtttgaattcagccccgcggagatccagggactgctcctcaagtataagcgatctcccgaggatgccattgaggctgcggacgcttgggtgattcagactcgcaaggataagaaggagaaggagc

SEQ ID NO: 141 - DNA, 517 bp, Trichoderma harzianum
cccacgcgtccgcatccatcgtctttgattcatcaaacagctcttggatccgttctgatccagccaaccaaccatcgccatgtctgaacctctcaccaaggtcgactccgccgttcaaggcctgtcatcatcaccgcccaaagagaagggccataggagaacaagctctagcgcggctggtgttatgaccattgcggaaatcaatgaaagccatgctcctctagaactcgcaatagagacacagcagacagcgtggaaaataaatcagcggcccaaggatctcgacaatgatcagctgctacaggttcccctcaccaagcctcccatcaagagcataacattgaggttccctcatggcaaagaagtcgtggctcgcaacctgaagggcctgacaataggtgacgccctgtcggccattcacaaggcaaacaagaaccgagctgatgatgagcttgataatccatacctcaagggcttcgcatgggatcagggcgagaactactttgaagtacatctc

SEQ ID NO: 142 - DNA, 349 bp, Trichoderma harzianum
gatgatatgggtgtttattgtgagacatgcataggggctgagaaggctataagccggcttctccttggaaccatggcggtattcggcgatgatgcgccagtctatacggatattacaacgtaacacgagctattacagtgaattcctccgggtaaaaggcgagagagagagagagaggctgcagacatgtgaatgtggttgtggtggatggaccggggatgcccgaccaagaggatgcaagaatagcgatagcgatacctagggactggcttgtgaaagaaaaggttgaccgaggagaagactacaaagtgagacatcggggcattgatgggcgacgaataggaagcgc

SEQ ID NO: 143 - DNA, 282 bp, Trichoderma harzianum
tgatgatgaatagaatgatggaccaagggaatggttggtaagatgttctgggaggaatctgtgtttttctcagggtgagagtgtataaatgtgtagcgtgtacatgtgttgaggctcgtcgatacccggcaacatgatgactgtgcgccaccggccattgatttgtgctgatctctgcttgatgaacactgccctgtttacactgtcgtgtactgttagtatgtccatcgtgaaatggtggtgtgcgatgtttgtcgcgggctatgaagataaagcaatgag

SEQ ID NO: 144 - DNA, 332 bp, Trichoderma harzianum
aggtgcttgttgtctgtttctgtctagaggtattggatgtaaataagatcagcacgagatgagatgagatgagcagacagacgatcagatggcgagattgagaggcaaattgcaagtgaatttaaattgcttcgctggcgcctaaattggaagcatccatggctcgccttttgcctccccacgtgtggaaagtagagccgagagcgatccctagcggctattctattctggcggtttggagtcaatctggccccccggagattgagatggtggctgtcgaggtgccggatgggatgggatgggcttgtctttggatacttcatcttttcatc

SEQ ID NO: 145 - DNA, 546 bp, Trichoderma harzianum
tctcctcttgtcagaggctttgggttgattgccttgcaccctttccaacctcttgcgtgttttctcctttttcttttccttgttacgattgaacctcccttcgcctgttgctcggaacatgcggattgccggctgagcagttcaagcgaccaagccagagccgagcctctgaatttcatgcatcaatctgacgtctttgaccgctgagcctctggatttccgcaaaccgcagcagcaatataacaatccttcttcttcttgttcaattacgactgtaccaatattcacaatggttctcacgcactccaccaatcacacctactcccaccctttcccgaccgtcaccctcgcctacttcctgcgatactcttcgcctcagctcaatcccttcgccgcccatgtcctcagcaccgacaccatctctagccatgtcgacccggaaacccagcgcctctacaccacccgcatccacctgaagaagagccgcatgcctagcgcagtctacaaactgctgcccgcaagcgtttcaggtggcaactctggcga

SEQ ID NO: 146 - DNA, 596 bp, Trichoderma harzianum
gggaatttgaatgcccataacttgccggaggcaacaacacgccaagtcaccagcatacaatgtctttagtccgcaccttacggggtgacttaccgcagcaggcgcgatcactgtatcgacagctactgaggcaaagcaacgaattcggctcttacaatttccgcgagtatgcgaagcgacggacccgagatgctttccgagaaaacgctgcggtagaagactcgcgcaagatccaggagctgattcagaagggactgaaggagcttcagacgatgaagcggcaaacggttattggacagttttacaagatggatcgattagtggtcgagggaggacagtcgggcaaagaaacaaaatcaggagagatagtacggcaaagggagcaaggctacgactgagttaatgaaaagcatgcgaaaacgacaatgataaacacggagggattgatgactgtatagtagggtggcaatggggcttgtacatcatacatatatcacaggagcatcgagagaccggcttttcggctcggcttgggagtaatgcgggatcgttacgggacaaactttagactacacaatctcaacaccgattgcgaa

SEQ ID NO: 147 - DNA, 598 bp, Trichoderma harzianum
gggcgatacgtcgagatgattcgtccgcagcttcagtccgtgagatgctggtgctatcagatgctagcagatgttatcccaagttacccgatgctacagaccatccacgctgcagatcaacggccgcttcgtgatgcaagtctcacgcaaactttaccctctttcagttcttacgagatgcaagggattgatccactggagtcagagaatctgaaccgcgaccgcgaccgcgacggctacgcgcaaagtttgggccagtgactgacgcggccgttgtttgtcatcaagagtcacagagttcaatggccctcaggacagcggcatttgctgaatacgaagcgctgtgctcatggcatggggcaatgttcctgcagtagcgcgtgatatgcaaaacctctgtgcgtgcagcttgcatgatgctaggatgcaagagccactgcggttcactgggctgagcccccagactcctgacatggcttacaatacaatatggatgctgtgctcgtaagcaaaaggcttctccagtaggtaccttgctgcccgtttggaaaagcgccgagagcccatgagatatcgcaacaccgggcgattagtcgtt

SEQ ID NO: 148 - DNA, 509 bp, Trichoderma harzianum
  misc_feature (495)..(495): The residue at this position can be any nucleotide.
  misc_feature (497)..(497): The residue at this position can be any nucleotide.
gggatcatcgtacatgatactattggcgacttggatttctaagagggtgtccaggcagggctcatttgtaagccgagccgatttgggatgacatgttgcagtgcatatgcatttgacagcgaggttagtaagtttctgttcaagtttagggcgtgtactatttgatgttgtgagatgtgaatttgatttccaagcactgcgacctgggcctcctgcgcgatcagaggtctctatgaggagatgagctattgattgcactcagcgctagatgtttgatgaaccctcaggacacagcattggaagtattattgatcagagaaaggctctgggctattcactccagagttgcgagaactatgattcacgttgacatacgtgtcgggcctgcaagaccgctggagcagccaacgtaaactgcagcatttcatccaacgaagaagagtcatattttgtagtaagagtagccaatgatggcccatctatcaagtacttgcnanaaaaaaaaaaaa

SEQ ID NO: 149 - DNA, 452 bp, Trichoderma harzianum
agcacatgtcagatatgagtgtgtaacctgacgctagacgccatgataattacggagctgccaacctgcccacctgcttcttggaccaccagaaatacgcatgaatctattcttgtacacacggttatatcttttccccttaaactgcttcgtcaggtctttgtgaggactcgcaaagcggtacgttttaggtactgaccctcttgtacaccgtatttgtactcagctggcaatctaggtagttccacacataatgtaacattcaaggctccgtcacttgagacaaccaacaaccactcctgatggaaatttccagcggcagatcctcattgcaaatacgacataattttgccgcaatgctgcttcactggatggggatgccataatacgtctgtgtcagtcctagtaatacagattgtgtatatttcaatcaagggaaacaaataggtccc

SEQ ID NO: 150 - DNA, 255 bp, Trichoderma harzianum
aaagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcat

SEQ ID NO: 151 - DNA, 323 bp, Trichoderma harzianum
gcctactaccaccttcgctgctcagatgggcactggtgagtacattgagaaggctgtcgttgaggtctaagcgtttcctgcgtcgatttggataaaggaggtgttcttttttcttttttcttccctttttactatttcctttataacgtggtggggtggatagctgcaggtaatggtctacctctgcagttttgtgatgaaatcatacccggggcacggcggatgtgtcctaagagatgtgtttgacgacggagatgcttttgtaatgcggtagatgtggatataactattactactagttaaaaaatgttatcccaagatcc

SEQ ID NO: 152 - DNA, 531 bp, Trichoderma harzianum
gccgctagcatgcactccgcacgcggctgatttgctgcttgtggttgctccgttaccccgtacgagagtccggaggagattctatccagctgcatcgcaacccgctcctccagcacggctacagctcgaagcttaaacacttggtataggtcgtgactttgcacaagcgtctcaagctcatcagcccggtccgtaacatcttcgtcttgccaaaatagcaccaattggcgctcccctgacatgtcttgcgctatgcggaaagcaagaccatcttcctcattgagaactagcaaatacagaaaagggctgttccactggacaccttgctctgtcaaagatagccgaaccgtgggaggtccattgtaaacgcggagtttagctgctcctagagggtcgtcgggtagcggagcgacgtgtagtgctagctctttgacagaggagtcatggtcgatgaagccgtagctaaacagcatctcggctggtgactttgcctgtccgtatgagatagtaatctctccacctgatgatacc

SEQ ID NO: 153 - DNA, 515 bp, Trichoderma harzianum
atcgacctcggctccggctcgtctccaccacgcgacgagattgattgattgcccgcaagcggctcagcttcctgggggcggaacagacagtcgcctgcaacccgtacttcagctctgccggccgttatcttgagtgcgggaagcaagaagcacgaaagagcatcgatttggatcccatctttcccctcgggtgccgggcgctgagaggtcacgtgtggcgcggctttatgcttggtgcaggagcgtgccacaaagtccgaacggcctctctataccttttttttccttcttctactcgtactccccttgtggccctcacatgaagtgaagggaaaagggcgacatggagcagattgagacgcaggcatcggacctgcgctacctgacggcgccagtcgccgctttgagcgactcggccagtgtctcgtacgagacgccgcagccacggacacacatgagcccaggttccgccatgtacggagacaattccgcgctgcacgacgacgcttcgcctg

SEQ ID NO: 154 - DNA, 513 bp, Trichoderma harzianum
tcgacccacgcgtccgcaaggaaaagggcgggatggagggtaccgtgacaggcgctggatgccggtccagaatagcctcatcggcaagcaccgtgtgattggatccgtggtcccgtccaaccagctgggacacgcgttcattcgcccaagggacggacaggaagcccgcaggcccttgcgaacacgggacagcgatggggcccgtggtgatgatgatgagatgatgatatcgcccgggagaagacgaagggaggaagcagatggacggcgaggggggaaagagggtgtgagcagagcagagcagaggcacagcagaagcacagatcacttacatcggagtcaagccacgctcggggacagagcaagcaagaagaatccaatcacacggccaaactgtctcgttcacgacaagcccattcttcctcacgcccctcctctttgtaaggtcctcgtaagtgttgaatgacaccatgttaccggaaccacacaaagagggccctttggaggagaagc

SEQ ID NO: 155 - DNA, 133 bp, Trichoderma harzianum
ggatatcgcgatggaggggtggcactatggacatactctgcagcccagagagtgaaggttggcgagcgattgattttttaagaatgatggaattccagcattctgtatatatgtataagtatatacttgtgag

SEQ ID NO: 156 - DNA, 581 bp, Trichoderma harzianum
cgacctgtaactgggtacgtgcctacatgtatatccggcatgccctcatgtaggtgacatctaaaccatgttcatgcggagcatctcgacggcgcctatctgctcctatgaacggccaaccctatacacatcgtactctgtacacagtacatgtacgcaactacagtaaaacgacatggtagtatcccgtggtggccatccatgggctactctctgtatgctttataggcccggaataggatcccgcggagccggaaaccgtggggatggaaggctgtgcaaagactacatgtatagtttacggctcagaattgttggccggaagcttgttgtcgttacgggagagagaccgatgtgacaagctcccctcgagtcaagacctcttcatttcatattcaccaacgctggataaggtactgtaaatgaactcaggtgtgctctcaggttcacatttacaggaatcatgccctccacactctcggggcatttacacggcccgaagagaatgaagaaggagtgtgtgctctcctatctggataacggggtttcattgtgggcatcttatgcccgcatggatagca

SEQ ID NO: 157 - DNA, 198 bp, Trichoderma harzianum
gcagaggccaattcattcgtaggtgcgagatggtgtgggagaagcccgtcatccattgctggattgggataggatgggaaaggaacgcggccaaaaaagattttgattgaggcatccatgatgattgttactagtagctgtagaatcacgatgctgctttgctttggcctccactgactcgaccaaaaaaaaaaaaca

SEQ ID NO: 158 - DNA, 325 bp, Trichoderma harzianum
gcaataggctcgtccggaccgacttgcgctgaggcgcaggtttcacacgctgcaatatgacatcaaccttgtctggtacatgacaaagtcctccgtatccgtataagctactgctattataaccgtagaagccgtagcgagactcgcgggactcccgacccccgcaaccccggggcggaacgggtggatgtcaggatcgggagtgggaggattcaaaggggggttccggcacacccggctaccgaagtctgggaggattccgtagtgccgagagtattcccacccaagtattgctgctccatcttgtaatttgtgcctgtaaacg

SEQ ID NO: 159 - DNA, 81 bp, Trichoderma harzianum
actggggaggtgatatgacgtccttgtgcaggtgggcgtaagaattacaaactctctgattgccacataatccggacatca

SEQ ID NO: 160 - DNA, 226 bp, Trichoderma harzianum
ggaggggagagaaacctaacattaataaagcggacacttatttcggccgctactgtactctacggataatcaatacctatcgcatgagaaaccgtaaagagataggacattaacagaggagagccggaactagatcgtggcaatatatgggctactatgaggaaaagtcataacttgagggccatttatgtaacacagatggcaagtccaaccgaaataagaaatc

SEQ ID NO: 161 - DNA, 418 bp, Trichoderma harzianum
agactgtgaccaatgtttaagtagtcaaaagtgggcgctttgtgcatagggtcaacattatcctgcaattctcatagaggcaggtgtgagccacaagcggtttgtaatagtacaggaaccgcaaaatgtatttaaggtcatgtggttatgtgcagattgtctgtttctgttgctggtcatttcttgatctctctcttctttaagccccttggccgcatgagctgtactatgcagacttgacattgatgcaaaagtccaaaggaactcataacccccctcagtacgaggctgtgttgggtgctatcgcgtctattagcatgtaaacttaggacaggtagcttttaagcagtatcattggttgataggtgtttattaataatgtgacctcaactacctgacggctggtcttcatatcccc

SEQ ID NO: 162 - DNA, 382 bp, Trichoderma harzianum
atcgaagggtcgatggacgttgttgggacaatgggttgcattttctgactgcgctgcgctcgacctgcatcccccgtcaggccccgtacatcggccagccctcaactggacggacggcctatgtgggtaatgcgagtacggcggtcgggctaaaatgtcgcgatgctgggttagggttcaaatttcttcagccagcgagcctcacgttgcggtgattgcacagggaatgttctcccatctgccggagcagccagtcgctagcatcgttcccgtacaagtactagaaggcaaacccttggtgagctagcacacacaggtactccgtgccagcaaatggacatggtcatggattagtagatcaacattggaacagagtcataag

SEQ ID NO: 163 - DNA, 203 bp, Trichoderma harzianum
ggatggatacttgcagtaatatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagcccaatgcacagcctaagtccaaagaaaacaaacc

SEQ ID NO: 164 - DNA, 328 bp, Trichoderma harzianum
gggggcggtgattcgactgatacgtgttgaatcgtgaattacttcgtagtaaccaatcgatgccatccaaagggaaatgagatgattagtactaatgaagcaatgccctcctcacttcactccaagggtacggtagcatttgtgctacagcatagccttttggatgctagacttgattggatcaggtgtgtatgatgttgtgtgtgtgagtgattgggtggtgactcaactcagggccaggctgcaggcagacacaccgcacttccaatatgccaggaacttagttcatcaccatacaccatcaatacaatcacccaggtatgactct

SEQ ID NO: 165 - DNA, 283 bp, Trichoderma harzianum
gtttgttagcctttgtgatgcaatagcatgttgtaagattgtttgtgtaagtgaagtctatagcaatgcctggaatgtgatggaacataggaatacaggatggatgacagagttggtgatggatatgtacacttaccctcgctgatacggcacgtcgtcaacggtctggtattcttgtggctggacgatagacattgttgcggttttcgaacggtttgttatgtgcttcaatggtttcttggctttgtaagttgtcacacgatccaaataacccaaaatcacc

SEQ ID NO: 166 - DNA, 668 bp, Trichoderma harzianum
attgagtccctaggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcg

SEQ ID NO: 167 - DNA, 589 bp, Trichoderma harzianum
agaaggagtatatccgcgctgccgacatcatctactgctgcactccgtctcaggaggatcttttcgaagcctccatcctcacaagccatgaagggagaaaaaagggcaggctcattgtcgccgtaggaagctatacgcctgagatgagagagctgcccgagggtcttctccagctcgtcacgaagccccgtgaaaagggccataggcattttcacaagcatgccgacgaaggcggtgtcatcgtggtagacacattggatggggcgttaacggaagccggagagattatccatgcaaagatcccacccacccaactcgttgagcttggcgagcttgtgatgcttcaccggatggccgtggacgagtcagagtctgaagcctccgatgtcatgtcccagacttcctccttctcagagctggacctctcggagagaacccaatctatgagcacagtctacagcgatctgccacctagcccttcaagcaccacatcttcgggccatagatcgcccttttcaaagcacttccggaaaacctcgagcaatttgtccgacaaggacaaggagaagcaaaaggacgatgcccctgt

SEQ ID NO: 168 - DNA, 639 bp, Trichoderma harzianum
aacgagcagcacggcaacgtcccatacagttgcccagcatgtcgctcgtcacgggagagaagacgaactttcagttcattctccgtcttctgaacaccaacgtcgatggaaagcagaaggttatgtacgccttgaccaagatcaagggtgtcggtcgccgatactccaacttggtctgcaagaaggccgatgtcgacctgaacaagcgcgccggtgagcttacctccgaagagctcgagcgtatcgtcaccatcatccaaaaccctacccagtacaagatccccgcctggttcttgaacagacaacgcgatattgttgacggcaaggactctcacatcctggccaacggtgtcgactccaagctccgtgaggatctggagcgcctcaagaagatccgtgcccaccgtggtctccgacactactggggtctccgtgtccgtggtcagcacaccaagactaccggtcgtcgtggccgaactgtcggtgtctccaagaagaagggtggctaatggttttactgttttcggtctggggtggacaggcgtgacggctgggtttttcatcactgtgatgagcatttccatgggactgctttctggcatacgcagctggagctgtactctagatcagagtcaaatg

SEQ ID NO: 169 - DNA, 625 bp, Trichoderma harzianum
tggatggggtccggactggtctcactggattttcttcttcttctttggctgtcctccggttctttcgggctcgggctctggcggtcttcgcggcaaagggagataagagcccacgtgcgaatttacgaaagccctagcgctgatcgggtttaaagcaagtgacgtgatgaatccgagttcatttgcataaaaaaaaaacataaaaataatagagccagagatttgccgaccagggcagggggcgcaaccatcttcatcgtccatcttcgagtgtgtgccacccggagcagcaaagacggtgcctcggccaagagtcaaatgtcaaaagatggagatgcaatatcacggaagccgagctccacttgatgctcgggcggcaagtattacacaatggcaagagatccggggtaaacaccgcagtcccggccgatcctcgaggcctattggatgagcgttccggcacccaaagggatttttcggaaccgatggtcggggattcccacccccagcttgctttctcccatgtgtctgtgggccagaaccagaatgcggggagtagatacatagatctagaattgccttgagatctcctgatatttgaagaataggaaattttttaaccttt

SEQ ID NO: 170 - DNA, 386 bp, Trichoderma harzianum
gaagcatatcgggctgaaacccccacaacgggaagacgggacgatacgaggcaatgaggcaattcagcggccggtagctgtcgggatgttttttccccggggaatttcgcggtggctgacacttggcgtctcgggaaatgatttgacggatggatgcctaagaaatgatccgactgatcaggtacggcttatcggctgttaatgacgcagcataaacaagttgcatgtgtatcctaagagcatgctcgccagatgtagatggacagagggcacaaggattggaagaatacattgccaatagtggttcatatagggagtaactacatgtatcttacgcttgagcgcctgcttttaagtagctatgtagtacagatggaggaagcacc

SEQ ID NO: 171 - DNA, 293 bp, Trichoderma harzianum
aaaccggcaaagaaataccctgcagtcctcgagactcgcgatagagcagaagtacatcagtcttatttactagcgagcaagacagtcaaaatgtcgtgggcgggtacggagcttgcggatgccccgctgagagagagggagaggggctgacgggattctaggattcaagaagaatgtgaaccgcgcgacgacgcaggtgatgatgaagacgggtgagcagcgttggtattcattcggttgggatagcattctgatcttgtggttgcagggcatgtggaaaagacaaacgatcg

SEQ ID NO: 172 - DNA, 679 bp, Trichoderma harzianum
gacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcag

SEQ ID NO: 173 - DNA, 636 bp, Trichoderma harzianum
tgaagaactgatgctgctttgctgtagtcgaaaggaacagcttggtacgagcctgcttgcggttgctgattcttccgctgctctttacgggcatgcttttctccttgtcgcttcgtacgaagttccaagcgttgccgctcctcggccatcttggcttcgtctctctttctcttcttctctagtttcttcgccctcttggcggccccggggggtacgtcttcatcctctatctcaatgacggcgttgtcatccataacatcatcttgcatctcctcgccttcactagatgacggctcgtcgttttcaatggcgtcggattttctctttcttcctctgcgcagggtgaattcttcgtccttctcatcttcagcggcgcgaacggctgctggttttgtaggcgcttcagttgccgctggggtttcttggacaggctgggctccgacaacgaagtctgtagcatcttcaacaaaccgttgccaaggaaaagggaagtagtcttcttgcacagcagctgctccttttgtttcatcccatcttgagctgacagcaacatctccaaataactgcgagcgttgcagctttgtggccgtggcagctccttccaattttgcggtttggctttgggtctttgttacc

SEQ ID NO: 174 - DNA, 668 bp, Trichoderma harzianum
gaaccaacaaccagccagcaagccagcagcaagccagcccgccgagacacggaccagcgcgagaggcgcctcgtcagattggattggcttccagcctgcgtgaatctgaatcatccccaggacaatcccatccaatgctcagcggcgccgactcggcccagggccgtccccgcaagttcaccatccagagccagttcggccgggctcgactgccgcggagccgcaagaaccggccctgcgacgcctgccggaggcgaaagacggcgtgtgtgatcccttcggagcctccttgtctcttctgcaagagcaggggactgacgtgcaagtcttcgcctactcctgatgagatatcatctcaacaagagagtgccgccgacagtaccactgagaatggagcctccgacgctgagcttgtcacacctccagccatagactcttcgccgagtctagcacggcgtagcgtctcgcactccagtccggcagacacgatccagtcgtctgcaggcttgagcgccgctggagatttgagtctggaacagcagtcctctggttccgccgccgtggtacatcaaggcctggttcgccagaattcagatggcttggaccaaccctcatatggtgtatctcctccggtacctattctatcaaacggtcctctccacactcta

SEQ ID NO: 175 - DNA, 640 bp, Trichoderma harzianum
cccacgcgtccgcccacgcgtccggaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatg

SEQ ID NO: 176 - DNA, 641 bp, Trichoderma harzianum
tgtttcataatttgacattcaccgtagaggtgaagggtttaacaaagtaaaacctataagttggctgccgtcaagcattctcgagccaagccgaaacgaacatgtaatcgattctcaccaacgagtgcgggcgctccggtcgagggaaacaaccacaaagtcaagatgcgttcgcccatgacggctatcaaacactcgccgacgctgcagagcctgcggagcgacagctggcgtagcgagaaacgcggcgacgtcttctccgccgagcactttaagcgcaagaaccagttcaagcggctgtttctcgcgtgcctcgtgcgatgggtgatgacggtgctgctggttgtcgggacgtatctcgtgctgtggagatattcggtgaaggaggccatgttgagcaaaaagaagaaggagtttaacacgttgattattgccatttcgattgcgttgggtctgaacattgcgagttcgatgaagcacatggtgagggagttgagatggtgggttttgagctggtacgagtggacgccgagagaggtaaacaaaggcttcaatttatgcgagacaattcgtaatggctaatgtgttggtgatgatacaggccgattgtattctacagagcgaaaactttagcagtctct

SEQ ID NO: 177 - DNA, 363 bp, Trichoderma harzianum
gcccgccgaatcccagacgcggagccccggaggccccaggcagctggatcctgatggaaagcttcggtcgggatccgggctttttggtgctgaggagatgggccgatgtttttatggaggtactttgatattagtggcgtagttggtgggaaggggatgtattttggggtttcgtgagatgacctgatggaagcataatttgatgctgaatcggatgaggggattggggttgtagatatggatggctacatatctgagatgctgggggaatcaatcaagataagcaaggactaatgtgaattagtcgtagtgagttgcgagcttgtcagttcttagtaactttgcctctcttgtgatttcatc

SEQ ID NO: 178 - DNA, 439 bp, Trichoderma harzianum
atagaagcatttgaagcctcctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctac

SEQ ID NO: 179 - DNA, 659 bp, Trichoderma harzianum
aagactccccctcaaggccccagaaaagacgaattcaaatctacgccgactgtctctctgcaatcgaaagctattcgtgcaaccattacacgtcaacaagccatcgatctcttaacaaacctttatagaacttgcgacaactttctaccgccatcatgggtgtctgtgccgcagtactaattgtcatcgtcaccatcttcttccctccgctcggcgcgtgggctgtggcaggatgtggaatggacctactcatcaacgtatgcttgacgatacttgggtatttcccgggtcacatacatgcgttctatctcgaatacgtgtattacgaccgtcggcaacaagcccgcgagggccattatccgccgcgtcgtgctcccggcatctactctgacaaggtgcaaacgggtggacaaggccgtcgacaaggctatggaacgatggcaccgccgcctgctgggcagcctgctggtgctggtgcgcctgtcgctggccctccctatgatagccaaggttataacaacaaccaaggctatgtaaatcagggctatgtcaaccaaggttatagcaaccaaggtcaaaaccagggatacgcctaagtgccgttgtttcagcatagggcattgagtggtcatgcacctacaaggaagagaaaagatgat

SEQ ID NO: 180 - DNA, 532 bp, Trichoderma harzianum
aacaggccaatacccagaggcaaatatgtgcccatgatccagaattgcgtatctccaggatatagcggccccaggacatatcccagttgcacggatatccaaaagaggtggagcagagagatggcagagagcgacaatccgattccccttatcctcagcatcggcatatggcgctggtagatgagaaagcccatgccccagagcagcagcaacgtccatcctatagtccagcaaacccaccatatgccgatcccgttgagcctagccgcgggcttggagtcagccgtgaggcccagttcagagcccatggcggcgagaaccctttgagaaggacttgaagagctcgcgacgagaagagagcacaaacgatgctctgcctgtcgattgtgggccgcgggtatttgtgggcgaaatgagagaaggaaaagcccagggcagcaactggtcaagatcaaagaaaagagcaggacgggaggaagatttttaatctcggtcgatgccgtggggtgacgatgtgctcttccgcttttct

SEQ ID NO: 181 - DNA, 263 bp, Trichoderma harzianum
aaaaaaggtaccgaaaacctcggatggaggcgttgcaaacccaacagcattcgtatcaaggcacggagatgatgccgttgaggtatccattttgcgccatcaccggaagttggccttgctggacaaaactttgcaacacgagggggaaaccccctcacgtacaaagcgacgctgattgtcggtcgtccagataatttcatgtgaatcgagatgtgagccgtcttggacttctagtattctgacatcatgtatttggtttggcg

SEQ ID NO: 182 - DNA, 650 bp, Trichoderma harzianum
taattctatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtcgatagcggctaccggtctggcatgtcggtgcagtcgtccctcgtcatgggcggcatccacgagttcggcaccgaggagcagaaggagagattcctccccgagatggccaggggcaagctcattggcgcctttggtctgacggagcccaatcacggcagcgacccgggcagcatggagagcgtcgcgaagccgcatccgaccaagaagggatactactcactgagcggagccaagacgtggatcaccaacagcccaattgccgacgtgctgt

SEQ ID NO: 183 - DNA, 620 bp, Trichoderma harzianum
tgtattctgtgttagggagagttgattgaatttcgcaacgatttgttaatagttttcaagggaaagagaagagagaaaagacatagtcagtttgaatctcgtgcaaataaacacaacccccaccatgccgcgagttctcactttacaacaaatcgaaggcggtaagcctggagaagtctactatcccatccaaatcaaagaggttcccaagcctactccagggcctggtcagctcctcgtccacatctccgccgcggccctcaaccacagagacctcttcatccgccgccaccaataccctgccatctccttcacctcaccactatttgccgacggctatggaaccgtcgtcgaggccggccccaacgtcactcgcaaggaattgctccacaagcctgtgctgttgacgcccatgcgaggatgggaatccagccctgcaggacccgaagacccccgcaagtttgccgtcattggcagcagcaagatcacagaagctggaaccgggcaggactacatcgtcgtgcccgaagacgaggttgagccggctccggagcacctttcgccgggcgaaggtgccgcgttgccgttggtaggactgacgggatggagagcactggtga

SEQ ID NO: 184 - DNA, 476 bp, Trichoderma harzianum
gccctgaattggttgagcagggcggcttggtgagcactcaccgctacttgcatgcccagtagcattgttcgctggtgctacagaattttcgctgttcgccacaagatgtcgaggatgcagctcaatgacctgcatacctgactgttcatcccttcactatttctacttctttcgctctcttttcattttctttgtagggtttctcatcatgtttggagttggagtacagagaaagaaagccttccatcgtggggttataaacaggacggctatgggaacggcgcaatttgcaattttgccatgttttggaacatcctctcttgatggatcgagaatcctctctcttgatagattgagatcttctctcttgatagattgacaatcttctctcttgatagatcgagaatcttctcttctggcctttgccttgattgctcaatacccttggtggccactcagtcccgatcaacaacatt

SEQ ID NO: 185 - DNA, 644 bp, Trichoderma harzianum
agaaacccaaaccaaaggcaaaggtcagacccatcttctccgttgtcctcagctgaagcttccagatctgggggatgggcagaaacaggatggcgagatcggtaaagatggttgacgaggcgttggcgatccaagtgccgacctggttgatgcagtgaccagggagatcagggtaccacagcttctgaacgggcacgcagatgaagatgaaaaggaacgtgatgcaaacgacccaagccatgacgaatccaccaaccgcccaggccatcttcttgaaatacggcacatggaaaatacggtagtacatgagtaacagactgatcttggtccagccaaggttccaggcgtagaggatttcggccaccagcagccattttgccatcatgacaatcctcgcaggctcaaccttgtcagcatggaggcccatgccattgtcgtacatggcaaagatgaagccaacgacaacgagataccatccctatcaaagttttgcaactttagctattttggccgtgtgtggaggcaaagcttgtctggtcaaacaagcttcctcgtttgagtaaacctaccagataacacaaaccaccgccagaacagtcatggacgctgttacttgcacggtccatggctgaaggttgtcggcg

SEQ ID NO: 186 - DNA, 341 bp, Trichoderma harzianum
tctcgcctcaaaattcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagact

SEQ ID NO: 187 - DNA, 384 bp, Trichoderma harzianum
gcgagggagaaacgggtatgggctgggggggccgcactagattctttgacgtgtcttgtacggaattccagcgcggtggaagggtgtggctgctgcacgttttcgggggccaggttctttacactattcccacggacaaggttcccaagtgaggctgatggagggtccgcgggccttttggggggggagggtccaatcgagtgttgtttgtgtgttcaccaagttcaagtacatgggtatgcgtatatttcggccatgtatgcgcgatggattcctgctgttcggcagcgagcatgagaaaaaagggaaaatagactgcgagagagagagcgacaaaaagaaggaaatgctccgatcacgattaggggcggaattggaaatccg

SEQ ID NO: 188 - DNA, 270 bp, Trichoderma harzianum
gccgcatgagccaggctcctctgcccgaccccgttcacatggctgctaccatgggcaccaagtccaatggaaccaccactggtgccaagaccaacggtgccaccgcccgatcccgcaaggcttaagctgcctgcgcgcgatgtcatggggatgtctgattgacatgtcaatggctacaaagctccgacgcccgaatgggtgacgagcattcttttttatacatattacgaatccaaagggccagttaccacgaggccaattacaattttc

SEQ ID NO: 189 - DNA, 642 bp, Trichoderma harzianum
acaatcaacccaatcatggaaccagatcaagacggaaacaccccaaccacagagcctatccgcttccgcgccgggaaaaaaagaaaagcatatcgccaacgacctaccgaagaagaagagggccatgatgtagcgaccgtgattccagctccatccgtcttgccaggcgcgtcaaaggttgaggatggcgagcatggacgagatgcaaacgacgacgccaacgccaacgccaacgcagaaagactactaagagaactcgaaggggaggaaggcaatgtcgatgatggagacgatcgaatggatggggaatcagcagtggcagctgcgttgcgccttcgcaatgcgcgccgggcaggtcgtcgaggaggcgtgggcttccgctcagagggacggaaccaagacgacgaagacgcagacacagagcagcacgcgctggttctccgagacgcagacaaagacgccgcgcacgatcgcatcgtcggcggcatcaccaaccgcttcatgcaccagaccggcctccttaccatcctcgacgacaaacacatgaatgaatacatagaatcccgcctcgctagccgctccgccgacccccacggcgcttctccctcatcacagcccgcatcccactccgcgacgacgaac

SEQ ID NO: 190 - DNA, 522 bp, Trichoderma harzianum
aaaacaccaaagaacccaaagagcgtccacgcttctttctgcctttgtccggcgtctgctccactcgctccccatcctcgaaccctttgcaagtcgaacaggtgacaacgattccattgaccgactgtggctatttgcatcacaacgcatcacaatatcttcggctttgtgggggggatcatatacatccaccgcgacgtaacaccaaagtactctggagttgaaaagctaccccgcacccggtcgcatgcctacagcgcttccttctgctctagccctccaaacctcttttctacctcttttcccgcttcggcagacacaaaccacacaaactcttcaacaaccgcagacatggccgacaaccacggagtattcgtggaagcccacgacattgacactttccagactcctcagaagatgtacgcaagtatgttggccgctagtcgctcctcgaaatctccgatagacagccacccctaccctttttagtcgcgtttggcaccagatccagctgacatcctt

SEQ ID NO: 191 - DNA, 515 bp, Trichoderma harzianum
ttggagagcatgtcaactggagggcccctgcccaaggacttcaatgccgacgatgcgggcaacatggaggatatggagaagcaatttgccgtcaaagttgtgcaacacatggcaacctactgggccattctcgaaaaggtcaagggctccggcctgcgactgacgaagatcgacgacgagatctacgaccacctcaaggaggcctttcccgagtttgaccccgccgccacgatcgacgaggaccagatgaagagcaagaccggcaaggagaggtggcgcgccttcatgatgaagtacgagaagaaggtggacgactacaactttggcaccatggtgcggaacaacgccaaggccgagtacgagcaggacacaaccattttcgtccccaggatgcagttttatgccattgagatcgcccgaaaccgaagcggcctcaacgactggatatacgaaaaggctcaggaagagaagaatagctccaaataaataccccaatacacaagccaattcaagga

SEQ ID NO: 192 - DNA, 385 bp, Trichoderma harzianum
gcacccagacaccgaactaactcaagaaaagggaaaaggacaaagggaacgttcggccttcttccccggccttggcttaagccccagagaagagccgcacgtggtgcgacgttgacgccatcagatctcacatcaccatctagcagatagtatgtgcggatgcagcctatacaatgccaagattcccacgcatgcctttggcaatggaattgctggtgttttaccagtgtgcctgtgatatgagtcgggcgactccgatgctttcggggtgcgtcatcgctgggctcggtggagggaggcagccgagttacgaacaagaatgatgctgtatataatcaccctgttgtaagatgcttcatgataaaaaaacaaccacaaagaaacc

SEQ ID NO: 193 - DNA, 444 bp, Trichoderma harzianum
gagttcctgcgcagcttcctgcagaacctgggcagcgaaatcgcgcccgtcacggccatcctcggcggccagctggcgcaagacgtcatcaacgtgctgggccagaagcagcagcccatccaaaacatggtcatcttcgacggcaccaccatggaggccctcatgtaccccctgcacccggagggcatcctcggcgcaaacctgctctccctcggcggccccgtcgaccccatggctcccaacggcggcatgatgatgcctcccgacatgcccctcggcctcgacgccagcatggtcatgccaccgctggatgccaccgccctagcccactcgcacggcatgcccatgggcattcttcccgccgttacaggcgccgatctagccggtcacgtggccattcctcagcctgatgccgggcaagtacctgtatcagcagtgggaacc

SEQ ID NO: 194 - DNA, 135 bp, Trichoderma harzianum
gactctcagaaggctaaaatggcaccgaatgtacaagacaaggaagggaagccgattaaacaaggcgacgaagtctggactccaattccaggcggaaaacgacaaggagaggtggaaaatattgttaacacggaa

SEQ ID NO: 195 - DNA, 186 bp, Trichoderma harzianum
acttaattaaattggaccaggggggggggcaggcttggtacaggattcgttggccgactggtggaatactaccaagtgccgggcgaggtgatgaatcgaactattcttgtcacatgtgagaaaaacacattttgcgatacatagtattcggattggaactctgatttataacgcatttgatacccg

SEQ ID NO: 196 - DNA, 548 bp, Trichoderma harzianum
atgaaatcatgaacatccgtacaccacatcataaggtatcctttagatactaatgtataagtacccagcagggacagagtgattgaaagtcgcagtggtaaccacgccaccaatggcgctaacgggactctagacctgagtacaggtacccgcatctatgcgcaatcacagactacaggtgcctatacagaaaacccaactaccatgagagcagtagtggaccaaccccctaaaaagtagacgtcttggagatacccatcatgggcctggcaaggctgtctgggaactgcagccaagaaggaagatattgttactctgactgtatggatctcaactttctcctgcattgtagggaacgagaccgccaacacggacatagaagggatgctcaatagagtgaaagctgctgcataaggcctacctgtgaggataagcaggcagatattaaaccagtgaagaacgattgatcggctgtgcagtctgactcatggcgtgggctggaatatgatgcattgtaggagacagccatacgatgaatacggggttat

SEQ ID NO: 197 - DNA, 511 bp, Trichoderma harzianum
aaccgcaaccatgtcgaccctccccaggactctgggcaacctgcgcaagattggcatcaaggaatacttccgccagatgctgtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaataga

SEQ ID NO: 198 - DNA, 608 bp, Trichoderma harzianum
atctccaatctcccgcctaaagctggcctttgcttctcaggcccctttactctcacaacaatttgttactgcctgtgtatctctgctgcgatatcaacttgaccaaactcaccacttttctctctcttcttcctggcacccggcagaccttcctttgcccgtgctcttcatcggcaaatatattccatcgctaccagcatctagtcttgctcgatcgagattcccttgagcctcatattcttgcatgatcattctgcagattgacatcgctgcacactacttttgatacagctctgcgagcccaagagaatttcttgctttcgcatcatccaacttcatcagcatttgttcgtcgactcaaacacacaatacatacccagtcaaataccgacaacatgtcaagcggtcaaattgctgcgccttttgctattaagccttcccagcgggctaacatccggctggcaacggctcaggacctttactccacgctgagcagttgtctcagcccgctaaaaggacatcagcaaccagctattccttttgataccaagcaaggcgacggctcctcaactcctgctcatcgcatccttgaggatgactacaccgtt

SEQ ID NO: 199 - DNA, 548 bp, Trichoderma harzianum
gccaaacaacgcatcttacggcttcacaacagcttggaaagctctctattcgcaatggctatcgcaccgatcactggaatgctgcggcgacagctcatccttgacctcggcgttggtcttggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctcgattggcttattatatgtttttgccatgccgactcccctttgtttattgctgaaaatagtgctggtggtttctttccaattatgtacaaattatgtgcta

SEQ ID NO: 200 - DNA, 631 bp, Trichoderma harzianum
cccacgcgtccgaaggtagtgccgatgatggacgggccgccgccgcgaaagggccacaagaagggctacacgactggctcgcatccgttggcgcgcgaggtcatccagccagacgagcttcccagtgccaactacaagaggtacacggtctggcgcaaacagccgatgcggattgtgggaatgagcgaaagggtgctggtgattgatggcgagtacattcacattgtgccggcctctgggggcaaagccgttcaagaaggcggaggcaagacgacgacggtgcatttcagcaacgtaataggatgcaaggtgcctcggaagcatcccaccaacgtcaaactcgtcgtctacaaagccacagagagcaaacgctacgatttcgaggctcgaggagctgatgaggctgccgagattgtggcagagctgaaaaagggcatctcgccttatcgggaggtttgattgattgcgtgttgcttgggggcgtttggagactggagttatgtttggattatgaggggacgtacgagttattacgcggccaatggcttacttactacgggtagcggcagcgtcttatttcctccatcttgttgttgctgcacacaatgtgtatatgggggttgaaattttt

SEQ ID NO: 201 - DNA, 591 bp, Trichoderma harzianum
gaatcaaacaaagcattactacctaccaacaactatatatcaactactgctactgctactactcttctctatcctctcttgactatcattgttataccaaactcactcttagagttccacctctccatcaatcatcaacaacaccaaccaaccaaccaaccagcaagcaaacaaacagaccaacaactgtgacaatgtccagccaacgcagcgtctatgttcaccaaaccagctctggcccttctaccgccagctcttccagccgctcctccagctcatctgcccattatgcggcatccaactcccgctctgtctccaatgcccgcgagtatgatgccgcaggccgttctgctcaagtggtccgaggcagtgcctctgtcgtcatcaaccaccacagacgagactacgagacggactctccttctcctcgctaccgtggtggctaccagtgatgcgacatccgtcacgcagcttgcaactacttacacaacttcacaaccacatattgggacacaacccgcttctggggagccagccgggggctagcggggataccctctgctaccgtggctcctctacacacccactcat

SEQ ID NO: 202 - DNA, 480 bp, Trichoderma harzianum
  misc_feature (467)..(467): The residue at this position can be any nucleotide.
gcaaaagaagaagtggtccaagggcaaggtcaaggacaaggcccagcacgccgtcctgctcgacaagaccatctccgagaagctctacaaggatgtccagtcttaccgcctcgtcaccgtcgccgtcctggtcgaccgaatgaagatcaacggctccctcgcccgccagtgcatccgcgacctcgaggagaagggcatgatcaagccggtcatcactcatagcaagatgaagatctacacccgtgccatcggcgagtaaatttaccaccatgtttgaaagttaaagcattgagatttggcgcctggttggtctgaaaggaagaaaatgggaccatgagtgaagaggatgatacgaggtatataaagccttagttgggacgcttttcatgctcggtgtagcatttcatgggaaccggaaacgctttagcaaatggcaacggaatgaagaacttcaaaaaatgacctanaaaaaaaaaaaca

SEQ ID NO: 203 - DNA, 366 bp, Trichoderma harzianum
ggaggatcaggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtat

SEQ ID NO: 204 - DNA, 619 bp, Trichoderma harzianum
acatcttcggccttctctctagcgaaggcgaagctctggatgacggcaccatggacgtcgttttatcccgtcttggcactcagctgctcacgcccaatacagacgagctgctgtttcgggaacctcccgcctttctaagtcgcctcggcatcgatacctctgagactgaatggataggccgcgtctctgagtttgctcggtctgaactccgtgccaactaccaggtccaaggcatcgtcgatcaaatggccatacgaaattgtgtcgcaagccgcccgcatcgcttcgctggtctttttgacagtggccctgatcaaggggagagtgcatctgctcaacgttgttgccattgcctacgcttttgtcctcggcttgatacgacccattagccatgacctcgcctggcgtcatctggttcttcatcaaatcaactatgtcctgactgccacgtttttcgttctagcagccgcacagctgctgccttgtattgagattggcacggatcaatgtgttggggatgttggcatcgttggctgcctgtcgtcgttgggtgcggcagttattgtcgcattgattactccacgagaatgggtcccgcctaccatcaagcatgatattc

SEQ ID NO: 205 - DNA, 480 bp, Trichoderma harzianum
agaagatgaagccggcgttactgcaacggcagtttggtaagatcaagtatgctaatacggtgtttagggtgtgatagtagaggcatccggcgaggcggctgagacatatgagggcgaaacaggagtagaggagacagtggcagcagcagcagcgttaatggcaataacaatagatggcagagaacggccgggccctcggattccctcttgagagcgaaggcgaaggtgaaggttcagctgatggataaaaccgggagacagccgagcgacgcagaggatgtcaggcgtaggttgcgtgagggtggctgcagaggccgagagcaggttcaatcaatgggcgagagacggctaatcgagcagagcgtgacgaggagcgcggcaatggcgagtgcgtgaaggggtgttgattcaagactgcgcgcgtgagggtgtgggagagatgaggcagaggccagaggcagctcaaaagggttcaaagtt

SEQ ID NO: 206 - DNA, 629 bp, Trichoderma harzianum
ttcttctctctctttctccaagattctccctcttcacctcttgtcctcttggagctcccaaacttctcctcgttcatcaccaccgttctcaagcacaaaataaacgtcaagctctcctggtcgcctcgccatcgccaatcgttgtttgcgtcgtctctcgttgcatttctgtatctcccagaactcaagtcgacttttttgacaacgtcaccgccaagatgaagtccgtcgttatcgccctttgcaccctggttgcggttactgccgctcaaggctctgccaaccttgcagcctgcggccaaacctgcgccaccaacatgttgagcgccgacaaggctgaggagctcggttgcaaacagaatgacttgaggtgtctctgtgccaacaagaacttcctttatggcctccgagactgctccgcggctatttgcccggctgaggatgccagaaaggttgttgactatggtatcagtatctgtgctggagctggtgtttcgatccaaacatctggaggtagcagcggtggtgctagtcacactggaagttctcccggaagtgccactggcagtgctactgacggcgagtcgacggctgccactgcttctgcttctaaccctgccactggaact

SEQ ID NO: 207 - DNA, 206 bp, Trichoderma harzianum
gccggatatggagatagctacgacgactaacactgccgattcacgttagtaccagctggccattgccctggtaatgagggcatccgggtacttgtatcgctaacagcacggcaacagcactttgttcttctgttgctgtgctcgtacttgtagcgggtactttcgtcatgtattattcatggtttggtttgccgggcagcccagcg

SEQ ID NO: 208 - DNA, 575 bp, Trichoderma harzianum
gattcctcctttcttcccctccatactatttatcctgcctcttcctcgtcttccatctgttgccggtgtgactcttgcaattcattccctgcccggcttcctcgcttgattgaatagccgttgctacttccaactgcaaatcattatagctatacctccctagcttcatataagctcggctcttctaggaacgcgcaagcaaacatcctcggcagtgacccacgagccttgtctggagattttaaataggaaagctcatcaacggcacctgagcagcgtccaattgctctgttcagctcaattaagctttcaagatgcctagagacggcagtaaacaaccgccctcagcggcgacaaacctcatcgctggtggtggcgccggtatgatggaagccctcgcctgccaccctctagacacaatcaaagtgcgaatgcagctctctcgccgtgcacgaatgcccggcgccccccgccgcggcttcatcaagactggtgtagaggttgtgaaaaaggaaactcctctcgctctatacaagggcctcggcgccgtcttgacgggcattgtccctaaaatg

SEQ ID NO: 209 - DNA, 567 bp, Trichoderma harzianum
aagtttcagcattagcattacaccagtaaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcactgccgtgggtatcagcaaggcgcaatggcgaattgcaggtgggcagcgagaaaaattcgaagggatagccttttaccagcgctgcgtcgatgatgaaaatgggctgatttctt

SEQ ID NO: 210 - DNA, 442 bp, Trichoderma harzianum
accgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatacca

SEQ ID NO: 211 - DNA, 351 bp, Trichoderma harzianum
gcagctgcttgcagtgagaaaaaatggttcgctttttatgcgagcatagcatgatgtgagcgagagggatgggacgccatggctggattgggttaccccgaggccgggattccgaggcattgggagatggcaagcatgctgagctgcgagggatggggatctggaaccccctgtgcattgggagctgtctacagtacctaaccttgtgaatgcatgtacgagtatgtgtatgtatgtgagatggagggctgtatgttatgtgtgagagcacgtctgtgtgctgcagggggtttcaatgcggacgaggggaacagagtcaaaagtgaagagtgacgagataagcggggtatt

SEQ ID NO: 212 - DNA, 637 bp, Trichoderma harzianum
ggaacgtcaagtgcgaaacgcactggtgtcgcctgacgaagcaggacaagagtcaatcaattccaaaccagccgatagatctcgaactctgttcaagaccaataccaagatggaaacgaaaataggagaagagcctatacgacataccgattttgccatgacagatgctcagggagggcgaggcccgctgcagcaaccagccaccacggcacgcaccggcttggcgatgggacgcaggttacaaaaattagctcgcccaaaacgctcggcaagtcatgaacagcagtacataggtgacgagctccgtggccaaactactaggcccagatcatcttacgacccgttggtctcaacagaatatagtctaagacgtccaaagcaacatgcgacacacaactcgactgcagaacctacggtaaatactgtcattaagcctactttacggcgacgaggatccgactctagtgagagcagtttcgtacgtagtaggtccatcggcagtcctcgaagtggatttaggtcatcgatgcgaagcagctctttcgatccgaggccatcatcatctggtaataagggtagaaacaggttgactctacgctcgttatcacccacaacgtcacatcagaggcaccattct

SEQ ID NO: 213 - DNA, 317 bp, Trichoderma harzianum
ggcattcgtattagagtctcggaataagcgttcaatgcttgttcaggtcctatgaggatctcttgcgtgctcaacgatcgcctagaaaaatcgctcctcattaagttgcctgaaattctctacactggttgacacaccatacgatgagcgtacatatcttcctctcgcctctcctgccttttatatggtacatggtacatttctatctaggtatcttgtaagatgttacgcgtgtctaaatgcgtcgtagaagcagtctgttgtcgcgaagcctgcgagttttgccctgctgtgtcctcatttgcctcccttctgct

SEQ ID NO: 214 - DNA, 249 bp, Trichoderma harzianum
gaataaagctgtgctgtgctgtgatttttgaacggatattacaaggctggtccgagttcttggagtttgaagcgctggcgttgtttcttcaagatcgcgacgtcgatcaactaaagccagagcttatacgtccgggtgcatatgcatatgcggacatgagcctgtaagcttcaactgcttcgctgccaagccaaagcgcgcatccgaacttcaatttctcaacgccctgcatacggattcgatttcgcg

SEQ ID NO: 215 - DNA, 600 bp, Trichoderma harzianum
gctcgcttggctggctcgagactcctaggtgcagcgctcaggatggattttgctggcggaagcacaaaggcggaccacctctgcgtcctggttcacggactatggggtaatccgaaccacatgaacaatatcgcaaagacgctacgagcccaacattcccctgacgacctctacctcctgctggccaagcgaaacagcggcagcttcacctacgacggcatcgagcttggcggcgagcgagtctgcgccgagattatagaggagctcaagacgatagaacagaatggcggcaagattagaaagctgagcgttgtgggatactctctcggcggcctggtatcgcggtatgccgttggtctgctgtatgcaaagggcatcctggactcggttgaatgcatgaactttgcgacctttgcctcgccgcatctgggcgtacggacccccctcaaaggatggcacaaccatatgtggaacgtgttgggcgcgaggacgttgtccatgtccgggagccaattgttcacgattgataatttccgagataccggccggcccctcctatctgtcatggccgatccccagtcgattttcatgctgggactg

SEQ ID NO: 216 - DNA, 116 bp, Trichoderma harzianum
ggctgacagatgctctatgacggagaggcgaagctgggtcgaagcagacgggcaaagcgatttgaaatggtgaacaggggagaatttgctcgctggccaagggggaagaaatgatg

SEQ ID NO: 217 - DNA, 538 bp, Trichoderma harzianum
agctatatcgttcttcaccagtagcagtatcaccccactgtcgctatcatggcccgcggaaatcagcgtgatttggcgcgcgcaaaaaatcagaagaatgcgtccaaacataaaggcggcaataccgagaacggatatgagcaagcaaaatccaagttgagtaacgccgagattatgaggcagaagcaagccaaagccaatgccgagagagacctagcggcagcaaaggcattacaagagaaaagggacgcaaaggcgaagaaaccgactgaattgggcgcttcagctgtggaggttactggacatgcaaataacccaagaggatagcaagagatgggagaaaacacggcacggcgaaatcaggcgctccttgagactttcacaatacggcgcaaatttgggacaatctaggtgaagagggggaagcgttttttggcttaataccaggtatagccatggataatagcgaaatggatattttgttgcggtattgctattattattctaccaaaaaaagttcgacctttgtgaaaaaaaa

SEQ ID NO: 218 - DNA, 634 bp, Trichoderma harzianum
gatactattcgccgcgctaccaagaggggtttgcgctcgagtgtcgagccatcaagcgtttgcgcgaggagattggcctctctaacgcgatagtcatgattcccttctgtcgtacagttaaagaggcacgaaaggttctggatgtcatggctcgccacgggcttagacgaggagagaatggcctacaggtatatgtcatgtgtgaaatcccctcgaatgtgattttggcggcagatttcaccgagtactttgatgggttttccatcggctccaacgacctgacacaattgacacttggggtcgaccgcgactccggcgagctgggtgacttgtttgacgagcaagatgaggcagtcaagtggatgatttcgcgagtcatttccatagcgcgcgcgagaggctgtaagattggcatctgtggacaggctccaagcgaccacccagagtttgccagatttctcgttgacgcaggcattgattccatctccgtcagccctgacagctttttagctgcaaagaagcaagttgtggccgccgaaaaggcattgggaaaatcgcgcggctaatctaatcaaatctggtctatatttgtagttgactttcacgaaaatcaggctgaaatctttgaacagag

SEQ ID NO: 219 - DNA, 374 bp, Trichoderma harzianum
acctggcatcgctatgctaccatgtgcccaaggcgttgatcttgttggactcggaacatccgtgatgcgtggacttgcatggaacgtgcttgggctacaagcgctctggaatgtttggtctggaacgttgcatgcaacctattgagttttgctgaagcttgatctgcgctctcaactgatgctccacatatatcggcagtcagtatccatggacaataagggcggatgatctgaagataagctcttcatgcagctttgacattcctgcggacaaagttgtctcttaagcatcgtgcaacttaaaaatacattgcattggctttccactcaatttttgcctcaactttttagagaaatgaccaaccttaacacac

SEQ ID NO: 220 - DNA, 146 bp, Trichoderma harzianum
agcttgtcgcggatgttgtcgacctgtttgcttctgactggtcttggtacacaccatgctatttatacccgagggattatcgggtatcacccctagggtattgagtatcaccctaaccggggccctgtggctgtataccctacaac

SEQ ID NO: 221 - DNA, 543 bp, Trichoderma harzianum
tcaatctgcaagcaacctctccgcagaggagcgcctcaaggcccgcaagcccgtcccgaagcctgtcccggcctatctcccaactgccggctcccccctgagcgtcgacaagaacctctacgaggccatccagcaggccccaagggtcctcattgaggaattcaccattcctatccgatcaggcagggcttgggaggcaccagcaggatcaattgtgagcatcagcacgcccgaggggcctcaagtcggcgacctcaacatctggaaccgccacaacccccgcgagcgcttctgggcctcccgcacccgccagcttcactccacccacgtgtccacccatgaccgcctctggtccaacctcccctacatgcggcccctcgtcaccatcatctccgacagcctcgcgtggtacggccaggacgaaaacggggggcgcgtccacgacctgctgggcacccgctgcgacccgtacatcaacaccgtgctgtccgactcgcagtacgattttcactgccactcgaacctgagccgcgccgtgggcaa

SEQ ID NO: 222 - DNA, 333 bp, Trichoderma harzianum
aggttgctgtgctggggtaggggagaataaaagaagcagggcggaaggcgggaatatggggaaccaagcgccaggggggaccattgagaagagcaaggatgaaccagggtcaaactctcatccgcaaaagtaaacatatatcgtactactcctcccttctctcctccacccagacacccaagccatttgtactctttcgtagaagaaaagaaacggaaaaaagaacaagtatctatacataaaaaacaacccagcacatcatatccaagaaagcaaaaaagacacacaagacagcaagcaaccatgggctctctcgtttccacaatgggttcc

SEQ ID NO: 223 - DNA, 470 bp, Trichoderma harzianum
gtttcgggctcggagactcatgcacaagtacaacacctatttccccgacgacgccacgaatgacaccctagtggccgagagggagaggctcctcaacgagatgctgggcaagatcggcacgaaccccttcatcgagacgcccttcaacgtcgactatgggtgtaacacgtcgattggagacaacttttatgccaatttcaatctggtgattcttgactgcggaatggtcacaatcggtaaccgcgttctgttcggccccaatgtgtcaatattcggtgcaacacacgagaccggaatccaatcgcgccgcagcggaatcgagtacggcggcagcgtcaccattggggatgattgttggatcggaggcaacaccacgatcatgccgggcttgacgattggaaagggatgcacaataggagcaggcagtgtcgtcaccagatcgatccccgacttttctattgcgattggtt

SEQ ID NO: 224 - DNA, 416 bp, Trichoderma harzianum
acgcgtcgggcggatagttgtgctatcgttgtcttcatgttttcatgtttgcacatagatacgagaagagttgtgggagttggttgcgtcatgacataagttgtaattatagtatttgctgattatagctgattacgcagggtgtgtttcctagttgtgtggatggatgtgtgttgatctggccccctgcatatttcggagtaaatcatcctcccgatggctatagtcgagaggttaatgggctctactcgagttctgtcgtgtaacagcatccataaagacagtcataaagaagttcttgagtcatttctgattctccctgtcaacatcatgattcatccaactgaggaaccataatgagcttgtataaacactcactaacctcattctagagcatccttaagagggtctctaag

SEQ ID NO: 225 - DNA, 595 bp, Trichoderma harzianum
  misc_feature (562)..(562): The residue at this position can be any nucleotide.
gcgcaaacaagcacgccagaggcgggattactggtaccgacgagcggttctgctgcgggatgccgaaatcagcgagaaaagagctaagctgagagcctctctggcatcgggaaagccattggacccgacaatcgccaacgacaagtcactgaggaaagattaccaatatgatgaatcacgagaccttactacgaacgagcagttggacttggacgacgagtatgcgcagctgtccggtatcgtcgaccctcgagttctcgtaacgacctctcgcgacccctcggccagattatctgcttttgcaaaggaaatcaggcttcttctaccaacttcaatccgaatgaaccgtggtaaccttatcttgcccgatctcgtcaagtctgcacagtctgcaggcctatccgacatgcttctgcttcacgagcatcgtggtacaccaacggctttaacaatctcccacttcccccacggaccgacagtttcattctctctgcacaacgttgtgctccgccacgatatccctggtagcgttcgaggaaccgtgtcagagtcataccctcanctcatcttcgatggcttcactactcgcttggga

SEQ ID NO: 226 - DNA, 692 bp, Trichoderma harzianum
cgtgtcttgtcattattactcgacacgcgtcgcactcacacggcagactattgtctcagctgttactcctcctgcagcctcaatcgttaccatcgccaaaacctgccattttcgcggctatgggctggggggccgcctcgttggcctctgcatggcaacaggcttttccgagtgtgaccttcccacccttggaatggcgctgatagcattgccgcatgctgtctgctacttcacaaatatacatgacatatctattgaactgcatggactccaagttatccattatccatcacacaaacgatttgtttacagtattgatgctgtacattagctcgtacaagccgagccaacagcatagacatactgcaatatgactctgcatgcagaaggtttgacgagtacctgatcacatacaggagatatactttgtacatcctccgagacagggcaccgggcttacaccaaacttgcagtgccttaattacggaaactccgttgttacatgcagccttgcacatcccacgcagatactcaatcccacgactcaaaaactggaatactgatacccgtggcctgcttgtacgcacagatacagaagatgtcgacccctggtcaagagtctgattccacatctgcgtacgattactttggcaaagatggcattctttctctctcttccatttcctaatttc

SEQ ID NO: 227 - DNA, 672 bp, Trichoderma harzianum
gaaagaaaaaaaaaaaaccatcaccaactcgtcctatctcggcattttccaactcctcataaaatttcctcgaatcccctccagaaatctccgactaaacctctccatttccaaaaccgcaatcatgtccaaccgccaactcgcccgcgacatgcaagtcgaattccaggcgcgcttccaggcgaaacaggcccggcgcgaggcccaaaaggccgccaagcaggacccgatcctcaagaagcagatccaggacctgctcaagaagggcgagacgcaaaaggcctaccaaaaggcaaagatgctgctctccaagcaggcgctcgccgcccagatggaccagatggccgacatggccgagctgtcgagcgcccagatccaggccaacaacgccatgaacaggatgacgcacatgatggcctcgtcgtcgcgcaccatgaacctggcccagaagaacaccaatcccgaaaagaccctcgttaccctggaacagttcaagcagcaaaacgaagaatacgccatgacaaacggcatctatcaggacgccatcacacaatccacctcggtccaagtcggcgaggacgccgtccacgaactgctcggaaagctcgccgacgacgccggcctggaactcagcttcgagctcaacaaggcgaagccccagaccggcgagcc

SEQ ID NO: 228 - DNA, 651 bp, Trichoderma harzianum
gccggggcgagaagtaaagggccggagccaagcgaaagaaagaggtcatcaacagatgctcatcttacaccatgtcttctaccgataatactgagctgattcttgccattgtggcacttatcatttctattctagcctttgttatcgccatcttacaggctctccagcagtatttcgcgtcggctacaggatattcttcttgcagcgaagctgtaatagggaaatggtcgcgattctccaggcgcagtatgctttggtctgagttccgcatcgaagtacatttcgaaacacccgtcttatttgtcgcaaggcccgagaacacgagagggcctctcggaaatgatgaggatttccgtacagaggataggaaaattatacgccttgacggcagcccctcaaatctcaaatacacatcaagcactgaagagttcaacgcgcagcaaaagaagaacaagcaagaagcaatccgcacagcagacaacgaaaacgcaacatggtgtcacttgctgatgaccatctatcaaatggagaatgagtcgcgttcttggcagcaggaatcgctaggctaccagcctcccttagatccatcgcctcctcactcgttggtcgtctgcatgcagagaaagcagcgagtctgggatagcattcccc

SEQ ID NO: 229 - DNA, 249 bp, Trichoderma harzianum
ttcgacccacgtccgggtgcatccaaagcaaagcaaaacacgtcaagttcgggcgccaggaaagctccgtccgatcttgggacacaaaggaaaaagcaaatcgaggctttgtcgcgatcggggttagctgtccgagatcctgtcacgacgcttctttgaggtcgcgatactgctggtagagaatctaaaggacaaccttgtaaacatacccaaatggagaagggtgaaacggcggattagaagcaaaac

SEQ ID NO: 230 - DNA, 173 bp, Trichoderma harzianum
aatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcc

SEQ ID NO: 231 - DNA, 655 bp, Trichoderma harzianum
gccatttccaccatgaatgagcattgcaaactttacagcggctacatgtatgcttgacgtagccatgagttgtctgtctgcaaacatgtcctctattctgcacatccatttacccttcacactgaaggcttggctctctccctttcttttgatagaccccttcttttacccatctctttctccattaaatcgcgctcattgttctttgctccattatacatcgagtgaccccgccgcaagcctcgccaaactcatgcagctggagtgagatttcgctgaaactagcttcactcggttaccgcgttaatctgagcattctctaatataagccttaggctgattggcacaggagtaattgcgccgtgtatgacacaaggcaatagaaatcacacctgattcccgtcatgacagattcaagatatcggaacccccaccaccgtcttcggatgaaggaatcatgcatgattgcggagtgcattcatagcctggaatattggctccttcgtattactaaaccaacaaacggcggactgaaccccgaagtgcagtataactcaaagtagaaataggtgcacattagcattgcctactatctgtgactgtgactcgcgaaaagttgcccgacatttccaatagaaccgacagatggtggact

SEQ ID NO: 232 - DNA, 184 bp, Trichoderma harzianum
gtctgtcattattatcgacccacgcgtcgcgaatgtcgccaatccgattagacgcccatgtaaacccagaccagcatacgacacggagcaatacaccgcgaatcaaatatcccatgtcgaagctacgcgacttctcgccataccaatgcctatctgtatagagtgccggtatcctgtcaaaact

SEQ ID NO: 233 - DNA, 659 bp, Trichoderma harzianum
gagagacttgcgcttcggcccggcatttgcacattttgagaaccgaaacgaagaagaaaaaggataaaaaaaacatggcttctaatcagtttgattcccaggcctcgaccaactacaaggaggcttttgccctgttcgacaagcgcggcaacggtcgctgtgccgtcgactcgctgggcgacctgctgcgagcatgcggccagaaccccacgctggctgagatccaggaactggagaagggccttggaggcgaatttgatttcgaggccttccagcccatcctgaaccgacccggcggattccgcgaccctggcgagcccgaagaatactgccgtggcttccaagtgtttgataaagacatgacgggctttatcggcgtcggccagctcaagtacatcttgaccaacctgggcgagaagatgacggaggaggaggtcgacgagctgctcaaggccgtggacaccagctctggccagatcaactacacagatcttgtccgaactatcctcgccaactaagattccccttgtacgaagaacctaacccccggtggtatctaagtgcatctgcgaacgggatggcgttgctatgtgtttgttttgattatggcagtgaaattgggcacgcttgggattgatgaatttttcttttgtacggga

SEQ ID NO: 234 - DNA, 188 bp, Trichoderma harzianum
gtgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactgg

SEQ ID NO: 235 - DNA, 303 bp, Trichoderma harzianum
accggaatcggcggaaattgggcacatgctagtgactcgggatacgtaattgaatgaaattatcgagcttaggatgtaaagtttggactgatgagtgcatagatgtgagggaggttagtctcaactatgcaaaatacggtgtcatgatacaacttcttctcgctataaagtgccacagatttagcaccttactacgtgtacatgcatgagaaaaaagtggacggcgattgtgtgtgaataaaataaatagcttgagaatttagactgtaagaacccatgataccagatcttgtcatggtattc

SEQ ID NO: 236 - DNA, 649 bp, Trichoderma harzianum
atcgctgattgctctctgtcatctgccaagatgttcaagagcggcgtttcgtccctcgcaagggctgcccgcccatcaattgccgctcgacgagctatccgaccagccttcccccgatcccccatcgtcaggcttgcaagcactcagagcgttggagatggcaagatccaccaggtcattggtgccgtcgtcgacgtcaagttcgacactgccaagctgcctcctatcctgaacgccctggagaccaccaacaacaaccagaagctggtccttgaggtcgctcaacacttgggcgagaatgtcgttcgctgcattgccatggacggtactgagggtcttgttcgtggtgccaaggcttccgacactggtgctcccatcaccattcccgtcggccccgccactctcggtcgtatcctgaacgtcactggtgaccccattgatgagcgtggacctgtcaagaccgacaagttcctgcctatccacgctgatcccccctctttcactgaccagtccacctctgccgagattctggttactggtatcaaggtcgtcgatctgctcgctccctacgctcgtggtggaaagattggtctcttcggtggtgctggtgtcggcaagaccgtcttcattcaggagctgatcaacaaca

SEQ ID NO: 237 - DNA, 493 bp, Trichoderma harzianum
gactatgatacccttgccaagtgtatggtccctctcggagcccaggcagatctcaccatggagggacgagttgagttcctgaagcgtttgacacgcaagttttccgaagaagatatccggaagaagtttacgaagcaggcgtaaaatttgactcctgttttgacggagacagcacggcagagtctagttcaatcttcgctgccctaactacacctggttcttctcgctcccggcagcataatgattgtttgacggaggatgctcgatgacgaagactattaacatggaggagggttctccacagagctggcatatctggtttcggtatttttggttgaagcattggttgttcatggcatatgattgcatgtgattgcagacgttgatggcgttttggaataagggcgggtggaaaattgaccttgggtcgaatcagcacatagaattctcatggctagaagaattatgggaataggatcaataagaaatgcat

SEQ ID NO: 238 - DNA, 435 bp, Trichoderma harzianum
gctcggcgattcaatatctttctctcgacgtggttcgatttcgattcgacgtatcggtgggggggcatgaataaggtaatggttgtgtttagttgggctcgaaactaatgttacccatcagtagtatcacctattgctgacgtcggcttgaggaagtgggttcaatcgtgatacattcggctcgtacagtgcaatacagataagatgatgcgatcagagaggcaattgttaggtcatgattgacggaggattcgagccgatgatgacaaggcgacaagagctgggcaatcgaccccaattggatgattctggcaccccaagctgtgaattcggcttgacctttgaacatcaacttgctgtagggtagtgcaaccttggacgtaaagagaaggcagcgtcagcatttgttagcgcacagtacctacctgtatgtat

SEQ ID NO: 239 - DNA, 520 bp, Trichoderma harzianum
gccctcatatattgaaggcatcgccaacccgatcacaaaccttcttgtccagacttgcaaaccactcaatcgattccttgataccccttgggacaactctacttgttctctccaaacttacccctccaaataccatcatcaccatcaccatgaccaacgacgtctctaccaacggctcttctgccgctcctgcgaccacctttgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacga

SEQ ID NO: 240 - DNA, 561 bp, Trichoderma harzianum
agcaattcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaaccgaaagaactttgcgaagactgccattaccttcatgaaggattggggtttcgatggcattgacgtcgattgggagtaccctgcagacgccacccaggcctccaacatgg

SEQ ID NO: 241 - DNA, 112 bp, Trichoderma harzianum
acgagaaaaaggaacaagccgcgggttctcaaagtcttccggtgccgccggccgtttggctgcggaccgaaagtgtggacaggaatcaactcgtgatgagatccgggaaatg

SEQ ID NO: 242 - DNA, 477 bp, Trichoderma harzianum
gatgctccaccattgcttgccttatcgcattcaaggccaggtaacgacacttgctgctgagtcgaacgcaacaccgccttcaacagctcctctgcaagtctcccgcaaaaggacaggctcagtcttgtgtgggcagcatgcgcgtcattgcccttttctcggccctgtgtgccgcagctctggtccaggccgatttccacacggcgcaaatctatgtgcagcccgtcgaaaactccgagtcgcccagcctcctcgccgaagtggcatacgatcctagcatcagcgggtcgtcctctatcatctcctacgaagctcctgaaatcccggagtctacacagctggtccgcgtcgggttgtacgacgtcaagtctgcgcgatggatatctggcacaactgttgcctcggtggacaactttggcaacggctactcgcccaatttgatactctcagtcgatgaaaagggagagcttctcagtg

SEQ ID NO: 243 - DNA, 219 bp, Trichoderma harzianum
gagccctgttgcgatggagacgagagatatgagtgtatcatctccaggtggaccagacaaaccaaagcaggcttttccgtcttctcttttgataccacggcgccgcacttggtgggcctggaccatgcctgcccggtgcagtgatttacacatcacacgccgtaatgtactcgtactcggtgatattgacctaccagctatttagtacgagatatgatg

SEQ ID NO: 244 - DNA, 656 bp, Trichoderma harzianum
gatagcatccgcaacggccgtggtcagcgacccgacaagtcgtagcttgctgtacatggttggaatgcgcacatcaccctctccatcgttggcgactttcctgacatctccatctccatcgcgtctgaagctcttcgctgacccgctatggcggggtcggtgtcagcgaagcctcgcctctgtagcctcgcaacaatcgcaatcaccatcgcagtatgggaaaccgccctttcgctttgagacgggcattgggctgtttgcaaagcggtcgcctcggccgttcccgccgcccttcttgtcccctccatctgtatccttctcagatcccctaagcacccatcaccagagtcgggaccgtcgagctcgcgcctttgtgaatggagaactcattaaaggacttacgaatggtgacgatgccgtgtatgctagcgactatttcatatgtgcaaacgatggcgtaggcgcgtgggcagctcgccccagaggtcatgctgggttgtggtcgcgactgatattgcacttctgggcgacggccatcgaagaagagtcggcgcagaacctattccagcaaaaggcctaccagcctgaccccgttgcgtctctgcagacggcatttgagcaaacacaagaagcaaccggtgctcatgactggcagg

SEQ ID NO: 245 - DNA, 347 bp, Trichoderma harzianum
atcaatttcacttcatctcatcttaccattgcagctaccacatggcaattaccgtcagacttgaacgaatcagctaatacgcgtactcttaccttcaattccgcctttggtacgggtatctgtacaagtacgaaaggtacaagatcggggggactctccgcctcgacgaggctaaaagaatgtggaatcgggccaactcgacgatgacggactgacgaatctttccaccgcaaaagcttctttcaatggaataaaacggtccagtctacgaaagcttctactaagcacctaattaattatagcagtagcagtgcaatagtagtgaatttcaagtatccatgacgtct

SEQ ID NO: 246 - DNA, 237 bp, Trichoderma harzianum
acgcggcttcgcagtacagcggtgtcgtgctccgagttctctttgatgctggaaatcaatggtttgctgcagatgcaagccatctttttttttttgcccactttggctcaccgcaggtaaaatatgggaacgaagaagagaaaaaaccgtaagttccttagccactaggcagctctgccactttagatggaaatcgctccgagaaattggccgcgttgataagcttgtgaataacct

SEQ ID NO: 247 - DNA, 422 bp, Trichoderma harzianum
gaccattaccatcatacagccaacctctacataagcacaaataccattcaaaatgtcttacggcggtgacaacaacgacaactctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 248 - DNA, 591 bp, Trichoderma harzianum
agactctttgcttgattcaccctgtataagttgggttatcaagttttcttgttgtgaactttctggatatctaagagagcactcattgtgacttgggtttatacttggtaaactccttcatcatgcagcagcctgaaaacgaatccggccacgtgctggtcacccccctctgggtgttcatttgccgtattttccagattctcgtctctctcatcatccttgccttggctgctcgtttgatgcatgatgcctaccttgacgaggaaggtctcgctctggctattgctatcatcacatggctcgtctgcttgtacattatcctgagtgagaagctgccaactctgaaccaattctaccatgtcattgccgtcatcgtccttgacggtgtcatgatgatcctctggcttgcaaccttcgccgccgtggctgccaagcgcgcccagttccgcttcaatgtcagggtcgacggctgcttcgacgacggcagcttgtttaacagcaagacatgctacaagaagcgcgactttgtcaagaagcgtgacgttatcctcttcaagtctggtggtgacatgctttccgccatcgctggcc

SEQ ID NO: 249 - DNA, 648 bp, Trichoderma harzianum
ggacggccgcgtgcctgagctggcggacgatgccgacgacgacgaggctctgcgatacgcgatagcgctgtcgctgcaggatgaggcgaattcgccggtggtgattgtcgattcggatgatgacgatgatgggacaaaggcgggctcttcggggtcgacacagcagatgtggtcgcagagacagaaacagacacaaacacaaacacaatcatcacagacgcagacgacgcagtcttcacagtcacagcatcagtcccagttcggcagcctccttcttgaccgcaaggccatggagcaagaacgtctcaaccgtctcgccaaacgccaacgttcacccactgatgatgggaacgatgacgatgatgtggtcgaggtccctccgcccaagaagcaagccagaacagctccagaaaccacgagcaagaccacgagcaaagcaaaagcaatagagtcagttatgacgaacagcatcaaaagcagcatcacaagcagcaccaccagcagcaccaccaccagaagcaacttaccgtacccaaacggcaccgtcaaacggacatggtctcgcggctgcccacgaacaggcgacgaaatcaccatcgaggaagtcttccaaaaggaccagctggagctcgccgtgctatcatcttt

SEQ ID NO: 250 - DNA, 655 bp, Trichoderma harzianum
gacacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacgacttacccaaacctcctcctactggcaatactggtggccagataccagtcgctgcttaaagccatcgctatatttgagcttccctgggcgaatacttgatctattcggcagacacatcgagatactacactaattaggcccgcatagcgtacacagtgcctcaacggccgttctgaagaggcttctcagattgatccgtctaacatcggatgtattgatagacgcggacgagaagacgacgatgtaccagcgacagaccaaagtcatcccaagcatccaagctactgatgcaaaaatatgcgtgccttgggagtaccactctccgaggcaaaaattcagtcacttaaagagacaggcttcgggaatgccatgaagaattcaggctcacgtgggggacatttgatg

SEQ ID NO: 251 - DNA, 424 bp, Trichoderma harzianum
cccacgcgtccgcggacgcgtggggttccaggtaggcacatgtatggagagcctgtacaagccaccaatacgttgaaatgagctaaccagtgtgttactgttcctggtcacactaatactacagagtctatgtcgaagagatgacaacaattgttctgaaaacccagaaataactcttcaacgcattgaatgtttggtcgcgtttaagattatggtgccaatccccggccggtggctggtgttgttgccaagaatcgtcttcgtatagcccgcatagagtacaccgtacttatcgctataccagaatcaatacgtgtgttctcagcaatgtatttgcaccaacaatctctttctgatgtctttctggaatctataactcgtatttttacatgatcaatataaaccggcggcaatcgttccaatc

SEQ ID NO: 252 - DNA, 603 bp, Trichoderma harzianum
gaagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaacc

SEQ ID NO: 253 - DNA, 483 bp, Trichoderma harzianum
gtgctgagttcgcgggtcacggacctttgttgaggctgagacattggcttcaacaaacatcccggatccttgagagcggctcatagatatacataatatgagtgatgtaaccattggggtcgaatggtcattgtgagcttggtagagggtgagcgggagacggcgtcggcgaagaccgcaaagctattcctgacaatgaaaagatctcacagaagatcagacaattaaactttcttttgtttctccccaagcgaagaaaaagagaccagttcgtgatagggcccctcatagaccaataatggttctgcataggacggcagagtgaagcctcatggacgcggtggcgcggcgcttcttacctttacataagaatacatgagaagatgagagggactctactaagatcgtcaatgtcctacacgattgatagatgatggagtttttgtaaaaatcgttattctattattcaagctcatctttgtc

SEQ ID NO: 254 - DNA, 555 bp, Trichoderma harzianum
gcctccccccagcccattccctcccggcgactcgtcaacaccatcgcgagaattccaacgccaggaattgtctctgttggccgtctcattttttgggctccacgcaaaaccgcttcttctggccagtttgctcgtcatcctagcattgtttcgactcgactcaggctgccgtcgacccgtgctcgccccatttgtgctttggacaggggcccccgtaacattaattactagcactgctgtgcgacgacgacaagagtcaaccttggacattatcgtccgtcctctctgcgacccgcattgatcgctcgatccccacgaccgtgccgagtgccctaggcaccgtcgtcgcaagagccccagctatctcgtctagctcaagataaagaagctccagtcccagaatcaggcaccatggcgactccggcaaacaaggagcgccctctcccgtcgcctactcagcaggccttctcgtcgcagtcggcgcagcagcagcagcagaggcccaattcgcgacgatttagcttcttgtccgacaagtctcgcaagaacagcgtc

SEQ ID NO: 255 - DNA, 538 bp, Trichoderma harzianum
gcgtgatgcttgaccatgtcccatattcctaagccgatagcacccacgcgaggcgggcgtgattgattacgctttcgcaggagctgagcacgcaaaatggctttgtgaccttttgcctccttcagcatgctctactctctgtctctatatgggtattgtttgatgggttactgaatcggtgctgatagcagatatcgggcttgattcgcgattcggagaagaaaaagctggaggcaaggctcggcgagaccgatgtcggatactacgcatagacgattgcttgggatggcaaacacttgaagatcgaaatttctcgagctttcatgttcatggggctgtgatagtcttagggattttgacgaccaccgatgctgaccttccctgtatttgctcatttgataccctgccactgcgacgagccagcaacggtgaaatgagatacagactcatgatgcgaaaggatatataagaacccaaagtgtcgcttaatgtcgtttaattagatggctataccggacccgccaaaaaaaaaaaacaa

SEQ ID NO: 256 - DNA, 472 bp, Trichoderma harzianum
atcaatcgtcgcaagcacaaatcagctcgaatccatcaccatggcagacatcacagaagaaccccaggccctccctgtcgatgagacgcccatctcttccgtcaagaccaactccgctcgcaagaactctctttccaactacctcaagcaccgaaccgaacgctccgagctggtagagaagaacattctcccagactctacagccgcacccggcctcctcgctcagcaaaaagagcttcagaaacacatgctcggagacaagctcaacgacaagatttcacatcgtccctcccccgacgccctcctcaaggaaggtgtcttacacgaagaaccccggtccccagaggaaaagtacgccgaggccatcgaggaggagtacgctaagcgggagggcggcgcttaagcagcattagagctacatggcgaacacggatgctgggaaaatgcgaacttgttttttcttttttttttt

SEQ ID NO: 257 - DNA, 493 bp, Trichoderma harzianum
ggagtctcaaaaccaatactatgtgaaatgacgttcatgggcgaggggcggctcttgggctaggttgttttcgtacatacgtgtacgcatgcacgtacctgtaatgtgcagtgcagtggtcaagtgaggcatagttggaggccgcctgagtggaatagaggcaacgaaagaggaggagggatgagaatgggccagagtcggagggttggcgataaaggtcttaggatgcagggatagcgttgtttctctttttccgctttgtcgttttttgttgctgctttgcattgcttggtgtttctttgcatgggggagggggatatgcatgtgctgtccaacacggaaaggatgcggtggacgagtgcagactgattgatattcggctctattatttcttctatttggggtcatgcatgtaacaatccatgaagggaaaatgggagatttacactcgcatggagtctatcactacctatgtactgcaccgagtttagcg

SEQ ID NO: 258 - DNA, 117 bp, Trichoderma harzianum
tcgacccacgcgtcgggatggtggtccgccggaagccggaatagccggcccaagcaggtgaggtgatagattcgcccaggtagacagagacagtggattcgggttcctagcgcaaat

SEQ ID NO: 259 - DNA, 657 bp, Trichoderma harzianum
cgtgaaacgagccactctcactctcaccctcattctcactcccactctcactctcacatgtttttcttacagaatctccaccagttcaaaggtctgatccttctggccactgcactgcgcagactccacccggtcagcgccagcgaccaagcaagtcgtgttggtggccgaggcgggagtaaggatgatgttgttgtcgcccgccttgaaggggaacagctgcgaagtcgcggttttgccacctgttgaggttcatcgttagcatttgatctcttgtgaaactaaaacggtacaaacgcgataactcgcatgcccttggatcgggtggatcgagcagatcaccgagatggggtggggggaaatgatgtcaatgacttacttccatcggcgcgtccaccgcaagaaaacatgatgacctggtcgttggcggctctgcggccatcaaagttgatgcagccgttggtgagcacgctgacaagcagcgcctcgccggcctgagcgtcgtcgtggactcccttggtgacaacgtcaaacttctggctcgcgtcttcgctgcaggtagccagtccaacggggatcaggttctcgcggaaatcaccggccgtggggttgacaaagaagcagcgtccatcggcggctcggatgttgacactctcc

SEQ ID NO: 260 - DNA, 616 bp, Trichoderma harzianum
gcttctctttgttttatatgtcgtgcttcattcgcatcgattgatttctcaagctgcggttccgtcatcgctaatgcgcattcacatgtgcttgtgcttatcgcatcacacatgacccgcgcaaaatgtcatcctcaccaagccaaacccccggctctggcgacgccagcaaggccacgccctcgggagcagcagtaaacgcagatgacaagccgcggctcacagaggaagaaaagaagcagaaccacattgcatcagaacaaaagcgccgtcaggccattcgcgagggcttcgatcggctgactgaactcgtgcctggtttggaagggcaaggtcgctctgagggactggttctgaagcgtaccgtggattacatgcgcgaccagattgtgcagaggcaggccttgattgagcgtatcgagcaggcaggcggcagcgttgaccccaagtacaaaaaggtttcacaactgtcaagacaagggcttggccggtgagcggcttcccgatgtttgcgttgccctcagcttggggtgagagtcgaggatcgagcgagattgggccgcaaagtcatcatggagtcagtttgatctccccatgactgctgcagaaagcagaa

SEQ ID NO: 261 - DNA, 211 bp, Trichoderma harzianum
  misc_feature (167)..(167): The residue at this position can be any nucleotide.
gtaattcgcatgcaaacagcaattccaagccattgccaaatctcacaatgcttcgtcaagtaaaaccccgtaacgcccgctccaagagagccctcgagaagcgcgagcccaaggccgtcgagaaccccaagacatgcctcttcctccgcggcaacaactgctcccanggtcgtccaggacgccatgaacgacctcttctccatgcgccagc

SEQ ID NO: 262 - DNA, 694 bp, Trichoderma harzianum
ggacatgttcgtagcaacttggcgttgtggaatcatgacgtttgtatgacccgacgttcttcacacaagaaattggttggggctttttgcctttttgctcccccaaaggcgattgaattttcaccagctgggcgagcagccaggccgactgaggcgcggaacggctcgaagcatatttctgttttatttcattccttgttttacctggtttcctccattctttcctcttctttttttttggccgaaagctgcagtgtttcgtaacggtttctggtcagacatgtgcgtctgattggctgtgataagggcagagacgggtggtacgcgcaagccccgggtgtggaatgaggcccattcccatcctgtgagacttgcaatttcgaaggtttgcttacgggagaagaaattatggagtctacagcagacaaacaaaacacatgcagccaatacaatacagtcggaactttttagattaagaattgaattagggagccaatgcatagaagctgccaagggaaatggaagaagcaatagttgagggaaaaaatgagacaagtgacaaaaggtttcaaactccgccgtcaagttgtaagccgtcgctcgtatcccgaaacagccgtccgccacagcccgtcaagatcgactgccacccccctctgccacgtatacgaggagaatccacgcactacaggat

SEQ ID NO: 263 - DNA, 269 bp, Trichoderma harzianum
taatgaacgaggaaaagctcggccacagtaatcatgaggacattgtgcctccagaatcctctactggagatgaattacagacaccatctacggattccaagggcaaacagaaggcaggcctggagttagcagcatctcaacttggggcctctacaaagctggtcgtcaatgccatcacaacgtttcgggaaatgccagctttggcatcagaatcaaagtcctctcatggttcaagtagcatgggctcgttttcatctatcgctggcgag

SEQ ID NO: 264 - DNA, 443 bp, Trichoderma harzianum
tggagtgttgaatgaaatgatccgccatatgcacgcacgatccaatactactcataataggcccgtcgcatcgagcctagacgcacataacccatgtattattacacttgacgttacacacccgcatatagatcaaaaataccctcgcggcctctgtttattgcgcccttgattttgcttgttttcgcctctttcccctgcatcatgatagatcacgtcctgggacggccatcgtccaagtcgaggcgtctacaagtcctggctgtattgtcttttaggacgttttacctctacaaaggccacaaaccatggcccgtcgtttgcgcaaacaatatccaaattcttctctcgacgcttgacagcatggcagaccgtcatcatcaccatgctctacctttacgcagcccgcaacttcagcgcactcgtcggcctggctagtcccg

SEQ ID NO: 265 - DNA, 655 bp, Trichoderma harzianum
agaggaaatccggtcgattcaacgccctggacaatcattgcctctctggaactcgagctccagtgggggtctcgtctctggtggttctagaaattccaacggcgcaggtggaacgatccagcaccatcgagagtttctgcacccaacttggaagctttttagcgcacagacacctaaaaaccccccccaatcacagcatccatcgattgccgtcaattcattcatccatccgtcatcccatccgactaaagcttctgctgttgtttttgcttcatcccgcccgcgattatttatttctgcatttcactccacctctcgacatcggcattcaattatcagtcaagtgcattcccaaacgtcttttatcaatcagcttcattttgctatctattttcaacttctttcgtctgtttgcaggcctcaattcatcatgagcgggtcgcggccactgcggggcgggtgccaatgcggccggaatcgttacatcatcgtcatcccagagaatggcatcaaggacgctgaggtcctgtttaacactgagccacagcatcagatccctctcgcaacacctctagcagcgtacattcgtgtgccgctatcatggtaccacagctctacgtatgcctttttcccagatgaaacacacaccatgatc

SEQ ID NO: 266 - DNA, 440 bp, Trichoderma harzianum
actcgaccacgcgtccgtcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggatttcagccgaccgaaatgcggctttcaagaaactgcccagtgtccctagcactcaccacatgtttcaagaggccctgagcttatcgagcttcttctcactccac

SEQ ID NO: 267 - DNA, 253 bp, Trichoderma harzianum
ttcacactcaataactcaaatcaccatcaaaatgcagtccgctatcgccttcactgtctccctccttgcccttgttgcctcggcagctcccaccactcgcaccgttggcactgttcaagtccagtttgccaacgatgtcactggagcaaacggcaatgcccgtatccctcttgacggatccaacataaaccttggagaggcttatggcaacaccaacctagagaaggacggcaccctctttgtcaccagcctt

SEQ ID NO: 268 - DNA, 670 bp, Trichoderma harzianum
tctcatcttctctccaatccccaatcctcaataacctacgccgtgtcagtcaagcagctgtacatcatcgcatatcgaccgacgacgaccttgtcctgccgtcttccatctccaattctcacccaccacttacaccatcacacatcacaatgcctgctcctcaggttaacggcgaggtcaccagccatgtcaattccgccttcctccagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagcaggagggcgtcgtggcccaggccaaggctgccgtttccaccgccttcgtcattagcaacgaaacgctggcctggctgagcagctgggtcgctgtcaagaaggccgacgcctc

SEQ ID NO: 269 - DNA, 441 bp, Trichoderma harzianum
gtaccaaatggcgggatacttgctcgagtatacttgtaaaaaacacaccggtctggcaaaggtgcatccggaagcttgatggcgtttgtacgggtcctctggatgtcaccgccgccgcccttttcgctcttggagaaaccacgttgatgctgttggagagcatcatgtacgggatcgagacgatgggtaagcaagcccgcatgtgggaaaagagacatgagcctgggcgtagttggttgtcaccgtgaagagcgagcgatgccggcacagggccaggctccatgttaaagccaggttatgtccatgccacttgggttggccccagcgccctccgttcgaggcgaggcggaggagcctcccgctgctgtccccgaaattcgtcccccccgatttccccggggctcaagattctgcttgctctggatgactgctttgcttgac

SEQ ID NO: 270 - DNA, 386 bp, Trichoderma harzianum
gaacaagccacatcggggagacgggaagatggtgacacggatgcgtttgtggaggtgggtaagctttgcgcaacatgtgccagccttatcttgatattggacgcggcgacggcgaaatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggccaaaaaaaaaaacaa

SEQ ID NO: 271 - DNA, 548 bp, Trichoderma harzianum
agcatctttatgatacaatgatgaacgtgtccttctctaccggccgcgctgcgctgcgcctcagccgctcgtccttccgccacctgtgcgcatccagagtcgccggctttgcttaccactcctatccgctgccgtccaaaatccccgagcctcccacaagcgacaacctctccaagtcatcccttgcccagccagaggcccttcctcgcgtccacgagacacggccgcctcctcaacacgatgccgtacccaagccgatggccccaccgcaggttgaagctcagtcgccttctccaacaacctcctcagttcctccatctcccaaagccgccgagaccgatgcgcaaaagacacagcctgctcccgctgctcgacctcgttccaagcttcgcgcgcgcaaggccgcaatgaagctcacacccgccgccgtggagcagctgcgcgcactgctcaaccagcccgacccgaagctcatcaaggtcggtgtgcggaaccgaggctgcagtgggctcgcataccagctggaatacgtcgataagccgggcgct

SEQ ID NO: 272 - DNA, 588 bp, Trichoderma harzianum
tcgactcgagctccgtcaatcgcaaatccctacaagatgctgcgctctatggttctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccgcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgttgttcagtctcctcccaaaaactaaaataaaacacgataatatcgcttcaagcttcgcacaattggggcgggcatg

SEQ ID NO: 273 - DNA, 367 bp, Trichoderma harzianum
gcccccgccgccgaggacgacgatgatgtcgacctgtttggctctgacgacgaggaggaggatgccgaggctgcccgtgtccgtgaagagcgtctggctgcctaccgcgagaagaaggctgccaagcccaaggttggcgccaagtctgttgtcaccctcaacgttaagccttgggatgaccagactgacctggctggcatggaggctgccgtccgtggcattgatcaggatggtctggtgtggggtgcttccaagctggtcgctgtcggcttcggtatcaagaatctgcagatcaaactggttgttgaggatgataaggtctccctggatgagctcctagatcaaatccaggaatttgaggactggg

SEQ ID NO: 274 - DNA, 552 bp, Trichoderma harzianum
gtattccccctaacaccctctccatcaaggctcgactgagctctcattcgcctccatcgtcatcccgaacatggccagcgcatggctagcccgcgtgcggcgcctcaacgcccataacctgacgacatttcgagatgcgcccctggccgagatatccggctctttgggcgatttgggcaccctggttcccctgatgatcgccctcgcggccaaggggtacatcgacctgggctcgacgctcgtcttttccggcgtcttcaacgtcctcaccggagttgtctttggcatccccttgcccgtgcagccaatgaaggtatgtcatgtccaagtactactgctattactacagtagcttgctgtactcgtacgaatatgtatgctgtgtggagcactctttaccccctggatttagacctcggtactcgatacgatactccgtatacatgcctacatacaactacacacatacatgactgtcttcttatctgcccaaggagccttacttttttgctaatcctcttcccgcctcatgtgggtacttaggccatcgcc

SEQ ID NO: 275 - DNA, 363 bp, Trichoderma harzianum
agaaaaccaaggtcgacgagtacgaaagcggcgttccccttgtcgagaagctgtatgaataccccgtcggtggggccaatctcgaacacattgtcgaattccctcccagagaagaggtggtccctatcaagcccatcttcctcgacgttgcgtggaactatatccactatccaggaaaggagccccgggtggcggtgggcgggcaagccgtcgaaggcgcccaggaacccgaggagcctgctcagccgaccaagagaggctggtttggctttgggaggtgatgatgccagtgcacacgtgttgtatattgcactaaaatctaaacaacaaaatactctttttaatgaaaaaaaaaaggaaaag

SEQ ID NO: 276 - DNA, 545 bp, Trichoderma harzianum
gcagaaactggccagctagccaattcaacatctgttgggccagaactcgcagtcgaaaaacatattcgtccctgctcgtcccttgaggaattctgcccgtcgaaacgaatcaagacgagcgaatacgaataagcccgacagccgtctctgcccgccatggagtcattcgtgatcaagactccgtgctccagcgccaacattggccctggcttcgacgtcatcggcctcgcattgtccatgtatctcgagctgcacgtcaccatcgaccgctcaaagacaaagtcggagcatcccctcaactgcagggtgacgtacgaaggccagggtgaagagtctggcgatattagcctggatccgcagagcaacctcatcaccagggttgcgctctatgtcctgcgatgtcacgatcagcgcagcttcccgatcgagagccatgtccacatcaagaaccctattccgctgggcaggggattgggaagctctggagcacctgttgtggctggcgtgatgctgggcaaggaagttggtggtctgcatcacttgga

SEQ ID NO: 277 - DNA, 588 bp, Trichoderma harzianum
ctcacagagccgatcaaataccgccaaaatgcccaaggaagtcgctgacatcaagaagttcatcgagatctgccgtcggaaggacgcttcctccgcgcggatcaagaagaacaagaaggcccacaacatcaagttcaaggtccgatgccagaagaacctctacactctggtgctgaaggacaatgacaaggccgagaagctcaagcagagcctgcctcccaacctgcaaatcgcagaggtccccaagaagaactaaggaaatgaattggtggtaaaataggggtggctttgggcgtgggaagggtttacatgcacaactgggcgtctcgggataccttgcatttcatgtgctcagaacgcacgctcgcaatagagctcaaaaaataacgatttgagacacaaaaagcaacaatcgcacaccaaaatctggtgagcccgatgtctttcttgtgccggctatgctacctgaagaaagggagcccccccggttactcggtgatgcctatttacacgacgtgcctgaagcggcgatgatctttcttgagggcgaggctcgccaatccttccagtcgtttcttcggaacatcg

SEQ ID NO: 278 - DNA, 568 bp, Trichoderma harzianum
atcaaacaaacctcaagtacagtcaacgaaacaccgacaaaatggctcgccgtcctgctcgttgctaccgatactgcaagaacaagccgtatcccaagtctcggttcaaccgtggtgtccccgaccccaagatccgcatcttcgatctgggccgaaagcgcgccaacgtcgacgacttccctctctgcatccacctcgtctccaacgagtatgagcagctgagctccgaggccctcgaggccgcccgtatttgcgccaacaagtacctcgtcaagcacaccggtaaggagggtttccacctccgtgtccgcgcccaccccttccacgtcgtccgtatcaacaagatgttgtcttgcgctggtgccgatagactgcagactggtatgcgtggtgcctggggcaagcccaacggcactgttgcccgtgtcaacattggtcagatcatcatgagcgtccgcactcgtgactctaaccgtgctctggctcttgaggctctccgacgatcccagtacaagttccccggccgacagaagatcatcatctccaagaactggggtttcactcctct

SEQ ID NO: 279 - DNA, 473 bp, Trichoderma harzianum
catacgctggtaaggaatcatggctgggggaaagaacaagagactctccaagggcaagaagggccttaagaagaagaccgtggaccctttcacccgaaaggactggtactctatcaaggctcctaaccctttcaacatccgagatgttggcaagactcttgtgaaccgaacaaccggtctcaagaacgcgaacgatgctctgaagggccgcatcgtcgaggtctccctggctgacctccagaaggatgaggaccactcattccgcaaagttcgtctccgcgtcgacgaggtccagggcaagagctgcctgaccaacttccacggacttgacttcacatccgacaagctccgatccctcgtccgcaagtggcagactctcatcgaggccaacatcaccgtcaagaccaccgatgagtacctcatccgcctcttcgccattgccttcaccaagcgacgccccaaccagatcaaga

SEQ ID NO: 280 - DNA, 582 bp, Trichoderma harzianum
aacacttctcacatctcttccaccctaaggaatatccgttaacagcgcatcttcttgcactctctacgaatctcccagcggccaacgcttaatccgccaccatgcaaatcttcgtcaagaccctcaccggcaagaccatcaccctcgaggtcgagtcttccgataccatcgacaatgtgaagtccaagatccaggataaggaaggcattcctcctgaccagcagcgtctgattttcgctggcaagcaactcgaggatggccgaactctgtccgactacaacatccagaaggagtccaccctccacctggtcctccgccttcgtggtggtatgcagatcttcgtcaagaccctcactggaaagaccatcaccctcgaggtggagtcatctgataccatcgacaacgtcaagtccaagatccaggacaaggagggtatccctcctgaccagcagcgactgatcttcgctggtaagcagcttgaggatggccgaaccctctccgactacaacatccagaaggagtccactctccaccttggtcttcgtctccgtggtggtatgcagatcttcgtcaagacgttga

SEQ ID NO: 281 - DNA, 389 bp, Trichoderma harzianum
aaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattatacatgtcactaacgattttctttcaatagcgcatgcaactcctgtggatgcaaggacaactgctccagctggtcctgcaccagctgcagccactaaatcatcgtgctctttttccttcgctggatctatactctctcggaatgacagcttgagggctcggatgtgcttaagacgccatgg

SEQ ID NO: 282 - DNA, 415 bp, Trichoderma harzianum
  misc_feature (74)..(74): The residue at this position can be any nucleotide.
cagggtgtttcacaatgccgattgcacctataatcacattcaagggcggccagtgtgacgtcgacacatcgtcnaagccatacaaggtcacgccacagcctgaacctggttatatctatctatactccgaagatgatctggtgcatttctgctggcgacgacgggaccagcctctggatgaccccgaactcgacctcgtcatggttcccacagacggtagcttcctcccatacgaatacaagaccacccctcagcccacagcgaagaccaacgggcgcatattcgccctgaaatttggctcttcctctcagcgccacctcttctggatgcagtctaagccccagggacgaagtggcgacgcgagctacttcagcccccgggatcgcaagatcggcgacattgttcacagactctt

SEQ ID NO: 283 - DNA, 513 bp, Trichoderma harzianum
taaattccatcgattggtttctttgggagggttaatcgacctttctcattcttcataccatcggcgtcgttggcatttatacggcatctcgtcttgtttccttcgtactcgagacatcatgggtgggtggcagtcctggaaccccttcagtaagagggagacgcacagcaatggctccatcgtcgcatacaagattttaaccttggtctcatggcttttgtccgtcgtcgtcactgtctactatgccgttgacgagcctcacgatgggttccacatccgccggcgcatatgggatcagaactatctgtatcccagcgcctttaccatgaaccacatcctcgctgatatctactggattgttctcttcatcctccagtttggatacgtcacatcgctcttctccagcagtgccgacgtcgttgccgcagctgctggtgtcgggagccacttcatcctcaacaacttggttcactctgcattcgtcatgctctttgtgaactcgcacttccacat

SEQ ID NO: 284 - DNA, 566 bp, Trichoderma harzianum
atctgcatctctttttggtatctcaaaactccccaaacaacccacatcaatcatcatgactggacgcggcaaaggtggcaagggcctcggcaagggtggtgccaagcgtcaccgcaagattcttcgtgacaacatccagggtattaccaagcccgctatccgacgtctcgctcgtcgtggtggtgtcaagcgtatctctgccatgatctacgaggagacccgtggtgtcctcaagtccttcctcgagggtgtcatccgtgatgccgtcacatacactgagcacgccaagcgcaagaccgtcacatcactagacgttgtctatgctctgaaacgacagggccgcaccctgtacggtttcggtggttaagcgatctgccactaggtcgggtcgacataatgtgttattcgcgtgtttgttacgattgggcttttcactatgggcgcgggtcattgctttttgagattttgtactgtacaacgtactgggaaatgggtgacccccgaaagggggtaattgagacttattcagtggtgaccttgaaataaagcatcacatatactctaaa

SEQ ID NO: 285 - DNA, 548 bp, Trichoderma harzianum
gtccaacgtttaatcctgtgcttcctccggggtccactatttcacgtgggccttgcccttattctcagagtccagctgagaaaagaagaagaatttctttttgttttggaaatagggagacgctcatcgttcaattcgtcctccaacacagaccgcagcaatggacgaaaagcacagcggctcgggtcgcaactcgaccgatgtccgtgacaccgaagtgccattcgctgccgaccaggttgtttgcccgccgcacacaactgagcggcgcctgatggcaaagatcgacatgcgagtcgtgccgtttctctgcatcatgtacctgcttgcattcctggatcgtgtcaatattgccaacgcaaagctatttggtctcgctggtgatctggatctcggcactggcgacaagtacaacacggccctggtcatcttcttcgtgccctactgcatcttcgaggtgccctccaacatcctgctcaagaaattcaagccccatgtctggctgtccatcaacatgttcctctttggctttaccaccatgatgcaag

SEQ ID NO: 286 - DNA, 647 bp, Trichoderma harzianum
ttcgctggtaagcagcttgaggatggcggaaccctctccgactacaacatccagaaggagtccactctccaccttgtccttcgtctccgtggtggtatgcagatcttcgtcaagacgttgaccggcaagaccatcacattggaggttgaatcatcagacaccatcgacaatgtcaaatcaaagattcaggacaaggagggtattcccccggatcagcagcgtcttatctttgctggcaagcagcttgaggacggtcgcaccttgagcgactacaacattcagaaggagagcacacttcaccttgtcctccgtcttcgtggtggtatgcagattttcgtcaagactctgaccggcaagacaatcaccctcgaggtggaatcttccgacaccatcgacaacgttaagtccaagattcaggacaaggagggcattcctcctgaccagcagcgcttgatctttgctggtaagcagctggaagacggtcgcaccttgagcgactacaacatccagaaggagagcacactgcacttggtcctgcgtctgcgtggtggccagtaaatgtgtcttttgcttacgaccgcactgttacgactgaattggacggttgggcgtttttgggaactttttttcaaagcagatatgggaac

SEQ ID NO: 287 - DNA, 629 bp, Trichoderma harzianum
gatgcccggaagacaagacgcttattccgggtccatgcccacaaactctcctcctcccccacagagcatctccagctactctcgcttcatccacgaccacacaaaacgccaaatgcaggcctttggagctgctctatcgcctacaagttccggtgcttcgggtcgatcatcagtcggtacatccatgaccaacggcacagcacctgccatgtaaccatcttgcatttccgcgggtgtccaaaagcgaaaactcgctgcttgaatttgcgcatgtttagctttagcggtgcttctcttttttccagtagcttgccattatggcagctacattggtaatctggacgggacttggaaaaaaatgaatttcgggacagtctaatatggaataacgcccccggtgtaacatggcgaatccaagattggaacgcctgcatagagacaaagcagcttctttttaccgatcacgcatttacactacagcaaaagcaactcttgcgtcacatcgaaaacgagccgacttggtgccactcgctaatttgtcgcttcgtttctatttattattgattttatgactatatgatacacgcacggggttttgggggggatctttatggcaggatactaatcgg

SEQ ID NO: 288 - DNA, 575 bp, Trichoderma harzianum
tggggtcgcaaatctacagcaaaaatggggtcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacgggcaagtactatcagcaggccgagagggaactgga

SEQ ID NO: 289 - DNA, 512 bp, Trichoderma harzianum
cgacaagtcgattgccctggtgagcaccattatcatcagaaaccgcaatcatgggtatctctcgtgactctcgccacaagcgctccgcctccggtgccaagcgcgcctactaccggaagaagcgcgctttcgaggctggccgccagggtgccaacaccaagattggcgccaagcgaatccacaccgtccgcactcgtggtggtaaccacaagtaccgtgccctgcgtctcgactccggcaacttcgcctgggcctccgagggctgcacccgcaagacccgtgtcattgccgtcgcctaccacccttccaacaacgagctggtccgaaccaacaccctgacccgtagcgccatcgtccagatcgacgctgctcctttccgacagtggtacgagtcccactacggccagcccatcggccgtagacgccagaaggcccaggccgccaaggagggcaaggaggtcgaggaggtcaagaagagcaagtccgtcgagaagaagcaggctgctcgctac

SEQ ID NO: 290 - DNA, 613 bp, Trichoderma harzianum
tcaacgccccgacaacccccaagtcacgggagccatgaggtacattcactctcaggagatcctggaaattccagagggcggtacgtttcaccattttccttttttttgatttcggccttgcagattcgatcgattgcactggaggaaaacatgtcttggatgacgatggaaaggaagaggtggaacttaatctctgctgttggagatgagggattggactggaacaatgggagggaactacgatcgaacgaaaatctgcttgctggcttggattacgcacttcttgaggaaaacgaagctgacattgaatttttttctccgaatagtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctg

SEQ ID NO: 291 - DNA, 452 bp, Trichoderma harzianum
gaaaaaggattaatcgcaactccgagatcgtggtgaatcacaatgagacctactcaggttcgtctgggcggcggcgcccctcaacccaagactggccactggctcggtgactggggctcctttgaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactttaaaaaaaaaaaataa

SEQ ID NO: 292 - DNA, 421 bp, Trichoderma harzianum
attctgcgcgggagaccatggcctctgtgggatcggctgtgacagcattgccccgcaaaacggcagcaggataccagtccagctattacccctccatccccagacccagatctctgtcttcattttcatctttgtctttgtcttcatctttgcatcgttcgggccctccgtccttttctccgagtcacgcacagagacaccagctagccacgatgtctacgcaagccgcgcacccgggcctggtcatcccagggcccattgagtttgacgatgctgtgctccagtccatgagccacttcagcgagtctcatgttgggcctggcttcgtgggcacctttggcgagactctgagcatgctccggcaggtcttccagaccaccgatcctggctctcagcccttcatcctcagcgggttccggga

SEQ ID NO: 293 - DNA, 619 bp, Trichoderma harzianum
  misc_feature (434)..(434): The residue at this position can be any nucleotide.
gtcgcctcggttccacgggttcggattggaacacgcgcccacagacagaacgctccgtttcccattgagcgtcaacctctactgagctttcatcaatcagtacgaggccatcttcgacaattttcagaaaaagaaaaaagcctttcgagaacatcaattcggaaagaagagccacttcttcaccatggctgatgatgagaagcacgttgcggagcctgccatttcggacgtcgcccccgtcgactcctatgcggctgcccagaacgagtttcatgaccggcctcccggatggatttacaagggccacaagatcttcggtagggagatctactatgcctcacccagagtccagctcgtgctggttgctctcgtgtgtttcctctgccccggcatgtacaactccttgactggtctgggaggtggtggtcaggtcnaccccacggcccaggaccactccagtgtcgccctctacagcaccttcgccgtcgttggtttcttctctggtacttttgccaaccgtcttggtctccgtctcactctcggctttggtggtctcggatactgcatctacagcgcctctttcctcagctacaaccacaacaagaacatcggcttcgtc

SEQ ID NO: 294 - DNA, 615 bp, Trichoderma harzianum
acacatcaagatggcctcttccgcccgtcagtttgcccgcgtggcaacccgcacaaccacccgctccttcgctgccgtcccccgacaggctttccgccagcagggtcgccgcttctactcttctgagcccgagaagaagtcatcctcctctctcctgtaccttggtgctgccgccgccgccggtggtctcggtatctggttcttcacctctggtgcctctgcctcttccaagacctttgtccccacccaggccgattaccagaaggtctacaacgacatcgccgagcgtctcgatgccgattatgatgatggcagctacggccccgtcctggtccgtcttgcatggcactgcagcggtacctacgacaaggagaccaagactggtggcagtaacggtgctaccatgcgattcgctcccgagagcggccacggtgccaacgccggtctgattgctgctcgtgacttcctcgagcctatcaaggccaagtatccctggatctcctactctgatctctggatcctcggtggtgtttgcgccatccaggagatgcacggtcccattgtcccttaccgacctggccgccgtgatggtgacgctgctgcttgcacccccga

SEQ ID NO: 295 - DNA, 668 bp, Trichoderma harzianum
cccacgcgtccgtcatatgcgctcgtcgataccctgcgcgtcgataggcgaatccttggaatcaacacacaaccgcgatcatggctgacgaatacaacgccgaggaggccgctgagatcaagaagagaagaaccttccgcaagttctcttaccgaggaatcgaccttgacaacctcctcgacctctcctctgaccagctccgagatgtcgtccacgcccgtgcccgcagaaggatcaaccgcggcctgaagcgccgccccatgggcctcatcaagaagctccgaaaggccaagcaggaggccaagcccaacgagaagcccgacctcgtcaagacccacctccgagacatgattgtcgtccccgagatgattggaagcgtcattggtatctactccggcaaggagttcaaccaggtcgagatcaagcctgaaatggttggccactacctgggtgaattctctatctcatacaagcctgtcaagcacggtcgacctggtatcggtgccactcactcttctcgtttcattcccctcaaataagaaggttgtggtcttgggtggtttctgcattcacggacatttttgggcgaaaaggactggttttagtagacggaggaaagccgctactgaagttgttgatggcaatgatttctatgatagtacaatgag

SEQ ID NO: 296 - DNA, 674 bp, Trichoderma harzianum
aaaacaaccgcagcaatggccgccgaaaggtccagcaaccccatgcgggagcttaagattcagaagctcgttctgaacatctccgtcggtgaatctggtgacagactcactcgtgccgccaaggtgcttgagcagctgtctggtcaaacccccgtctacagcaagggccgttacaccgtccgtacctttggtatccgccgtaacgaaaagattgctgtccacgtcaccgtccgcggccccaaggctgaggagattctcgagcgtggcctcaaggtcaaggagtacgagcttcgcaagcgcaacttctccgagactggcaacttcggcttcggtatcagcgagcacatcgatcttggtatcaagtacgacccttccatcggtatctacggcatggacttctactgctgcatgacccgccccggtgagcgtgtcacccgccgccgccgcatgaagagcagaatcggtgcttctcaccgcatcaagcgcgatgagaccgtcaagtggttcaagggccgcttcgatggcattgtccgataaacggtttaaaatccaaaccgaataaaatactttttttttcttgtcttgaaggaaatgggcatggcgaacatttgggggtaaaaaggatcatatggtcatgtattcttccgcttgatttttacatcagctcgtaccaa

SEQ ID NO: 297 - DNA, 555 bp, Trichoderma harzianum
cccacgcgtccgcctcactccatccaacccttccagtccaaccttccaatccctcctcaaaccatcaaaatggcctcccgtgtcttcgcctcccgcctggcctcccagatggccaccaaggctgctcgccctgccatgcgtgctcctctcgccgctaccaagcgcaccatcaccactggcagccccatgcaggccatgaagcgccagaccatccaggctggtggacgcaacgccttccaggctcagcgccgcgcctactcttccgagatcgcccaggccatggttgaggtctccaagaacttgggtatgggttcttctgccatcggtctgaccggtgctggtgttggtatcggtgtcgttttcgctgcccttatcaacggtgttgcccgcaaccccgctctccgtggccagctcttctcctacgccattctgggtttcgctttcgttgaggctatcgctcttttcgacctcatgattgccctgatggccaagttcacctaaattgcctctcgagagattggaaaagctccggccagtggatggagcaattaatat

SEQ ID NO: 298 - DNA, 559 bp, Trichoderma harzianum
accgaccggctcgggcagcttcatcaatggattgcccatcgactgcgagctacttacccgcagcttggaatagcttgagctttgcccgtcgccggaggacccgcttcgcagatatatataccttcgttatatatgcacacatgtcgctaacccgagtgctcgcgcaggcactgatgcccgtttccccaacgtgaatcagaccaagcactgctggcaaaactacgtcgactaccacaagtgcattctcgccaagggagaggactttgcgccttgccgtcaggtacggagaccggaaggagctgtgacttatgcgcgcatctgagtatactgaaccattgtgtagttctggttggcctaccgatcactgtgcccttctggatggtaccagcgatgggacgagcagcgcgagtctggtaacttccctgtgaagctcgatgcttaaattccatatttgaggtggcggggtacataagcaagggtgttcacatagattaagcagccaggcggcgcatgtgctgccagaaaatgtagtagtagtcaatcacaagcaaacaggctt

SEQ ID NO: 299 - DNA, 569 bp, Trichoderma harzianum
tgcttctgaacattcgagggtcggcccacgctcagctggcaatgtaccccccagttgccctggtggcaaagtgttcgcaggtctagttccatccggctccgatcaacattcaaaaacgcgcggcccaagagaagagatgcgattcgcagcgtgtaggcatgaacggtggatcgtggtgataatcgtgtgcggatgaggataataccatgagcatctcaggaacaactggacgtctaaggattcgggtccaggcccaggcccgggctcgggaggcgctgtgtgaggagagcttcggggcgctatacccatctttcacgccacgatggctgcatggccagctcgactcctcgctacggtcacactatgcgcccagtaaatgataatgtcggcaaaatctcttcatccctactttccgacattcatccctactccatgcgcctagtgccaaatcatccatcgatgcatgacttctattggaccatcacctgctgcgccttacgactgcgatgctgggataacgggtgcacaagctgcaaatccatggatatacgtgcatatcaggttgaatg

SEQ ID NO: 300 - DNA, 341 bp, Trichoderma harzianum
ttctcatcacattccaaccatcttcatccagtcgtcttggattcatcaaacagctcttggatccgttctgatccagccaaccaaccatcgccatgtctgaacctctcaccaaggtcgaatccggcggtcaagggctgtcatcatcaccggccaaagagaaaggccataggaaaacaacctctagcgcgggtggtgttatgaccattggggaaatcaatgaaagccatgctcctctaaaactcgcaatagagacacagcagacagcgtggaaaataaatcatcggcccaaggatctcgacaatgatcatctgctacaggttcccctcagcaagcctcccatc

SEQ ID NO: 301 - DNA, 441 bp, Trichoderma harzianum
aaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactggtgttcagaatggctctactagctgtgtcattgctgcttgtggcgtttctgtcgccattaaccaagttctgcctggcacccaggctctttgtgccaaccagtgaactcatccatcgagagggagaaaatgacatgggagaaaatcaggtactcttgtacattgacaaacaagtacatagctgaatggtgtgaatgaataaaacgcatt

SEQ ID NO: 302 - DNA, 387 bp, Trichoderma harzianum
agccgattctcgttctcgtcctattcacaggatgctttcgcaatggggccctccgtcgtaatgatagacacctcggacgacttcttcgctgccccggtggcaacatcacagacgaagcgaactctcctcctggcgccggcgtctctcgcctctcacccaactgcgctcaccaacgtcgtgtctcaatatgatcgctctgctacagatcttcagatgatcgaccggttgtcagccggtctcgtcaagctgccgtctgctacatacgacctcgttctcgtcctcgccgatgcgtcttcctctctcaacgagaccctacccctcttgactagaagcatcctcggtcccatcgcagagtcgctcaagcccaagggtcgattgcagtcgcag

SEQ ID NO: 303 - DNA, 507 bp, Trichoderma harzianum
ttcctccccccgcaagcaaacacagtcttttcagctctctctgggcttttatatacgcatagactcttccatcgttctttgtcaaattcatcctcctcttcaaccacaacaagccttcgttacaccgctttacgaagccccttcttctctcctctcctccattcttctaccttttccacacaacaaacacacacacagtcacaatggccttctctactcgaagcgtactgcgcgcctctcgcgccgtcaacttctcagctgcctcccgtgttgctgctcccagcaacgccgtccgcttcttctcggcctcccgtgccgtccgcgtgtctgacactgccaacaagaagagcgttgttcgcgagaaggaggttcccgtcaccgtctatggcgctggccagggtgacaagcagacactgcaggttcctgatggcgcctccaaggtcccctacgacagccccgtccccgctgagcgtgaggaggtcgagcctcttaacaagaaggtctacg

SEQ ID NO: 304 - DNA, 530 bp, Trichoderma harzianum
tcgttcccaatcaactccgtctgcctctctcgcccgcatcaacaacattgcgagccacatctctcccacaatggcttccaccaccagtttcccggcagaaacggtgccccaggcgcctgaagatcccctctttggcctggcccgcgcctacaaggctgacaacagcccgctaaaggtcgacctgggaatcggcgcctaccgagataacaatgcgaagccatgggttcttcctgtggtaaagaaggctgatgagattctccgaaacaaccccgaactgaaccacgagtatgccccgattgcaggtatcgagagcttcaccagcaaggctgcggagctgatgctcggcgccgattcgcccgctctcgcggagcgccgcactacgtctatgcagaccatctcgggaaccggtgccgttcacttgggagctctgttcctcgccaagttttacaaaggcagccagaccgtctatgtgtcaaatcccacatgggcaaaccaccatcagatcttttccaatgtcggcatcaaggtcg

SEQ ID NO: 305 - DNA, 572 bp, Trichoderma harzianum
acgacttccgaacaacgaccaccggagcccacgttgatcgcaagcagacacaatggcgatcaagcacaaccagacgatcatcagcaaccatttccgcaaggattggcagcgccgggttcgcacccactttgaccagcccggtcgcaagacacggagacgcactgctcgtcaggccaaggctgctgctctcgctcctcgtcccgtcgacaagctgcgacccatcgtccgatgccctaccgttaagtacaaccgacgggttcgtgccggtcgaggtttcaccctcaccgagctcaaggaggccggtatctccaagtccctggctcccaccatcggtatctccgtcgatttccgccgacagaacctgagcgaggagagccttgccgccaacgttgcccgcctcaaggcctacaaggagcgcctcatcctcctgccccgcaagtccaacgcccccaagaagggtgacaccaagaccgacgtcgcctccctcgacaaggtcgcctccatcgccgctgccctgcccatcgcctccgtctctgctggcttctccgagatcaagaagagcgagatccccg

SEQ ID NO: 306 - DNA, 338 bp, Trichoderma harzianum
tcgttctgcgcaccaactcgcccatcatggtgtctcgaagcatagccgtcgtctctcgcatggcgcccatgcgccatttgcgcccttctcctgtcttccgccagggacttcccagccttgtccggtactatgcagacaagatcatccaggtgccggtcatggctgagtccatatctgagggcactctcaagcagttctccaaatccattggcgactacgtcgagcaggacgaggagattgccaccattgaaaccgacaagatcgatgtcgccgtcaacgcaacagaagctggtgttatcaaggagtttttcgtcagcgaggaggacaccgtgacggtc

SEQ ID NO: 307 - DNA, 382 bp, Trichoderma harzianum
cccacgcgtccgtcacaggcttgccttggcaaatagacaacagaaaccctgtttcaagcccgttgactctgtgaagccagatctggatttggcttccatgcgtgcgtcttatactttcaggagaacgccgcagtagactacttaaagacttactctccccacgtcaagacgttcctcttcatccatcttttccaagcacgacaccatgactacccgctcccttcctagcaatggcagctctgcctttgactacatcatcgttggtggaggcaccgcaggctgtgtgattgcctcgagactctccagctatctggccgagctccgcgttcttctcatcgaggctggtccctccgactttaacctcaaccacgtcctcaatctg

SEQ ID NO: 308 - DNA, 535 bp, Trichoderma harzianum
ttctaccactttgctctcctttcaaggcatcgcgaagactcttgtcaactctttttataatactctgactcttcgtccactctctgcttctgaaccacttcgactcatactacttgcacttgcatacactcgggactcttcccccgcctactctactcttctacacaaccaaccaccaacgcaatggctctcgacatgtggactcacgagttctgccttacttgcgaccgacaggtccaggtcgacggcgacgcctactgctctgaagcatgcagaatgtccgacttcgaaaagactccctctactcccagctcgcaggccagctcgcccggcttctctcccgtctcctacgctagatcaggcagcctctccagccgacctgctcccaccaagttcttcctgtctcccgcctacgacttcaaccaggcccagccctacggctcaactcctcggtcgtcatcgtcgtttggcagctacatgtcggacatgtcacctctctcctccaaccggggcctcaccccctcgagctcacaca

SEQ ID NO: 309 - DNA, 384 bp, Trichoderma harzianum
tacaataaaaacacaatcttcaattctttgaacctttttcaagtttcgccaacatgaagttcaccactactgccgttcttgccattgccgcattcgttgaatcggccactgctctgggcaaggcccgtgtcgtcaacaagtgccccttcagcgtcaccacctggtccgttggcagcgccatctccaacccaacaacccttgctcaaggcggttcctatggcgagaccttctcacgagaccccgtaaccggcggtcgtgccatcaaggtcaccgtccagcccgatggcctctacactggcaagccccagaccaacttcgccatcaaccttgaggggaacaccatctggtacgatctttcagatgtctttggcgatgccttcaacg

SEQ ID NO: 310 - DNA, 517 bp, Trichoderma harzianum
actggacagcacttccacaagatttgtttactttcatatctttttgcataggttcagcaacaagcatcaagctgtgttatcgtagctgctgcttctctcccaaagtgacctgattgtcaccttttccacttgcaattggcaccgcaaagctccaataccgcaaacatgtctgctgtcaacggcgctcacagcagcacttccaagggcaccgatcaagatgggtcttcggttcccggcttccagccccagaacaagatgacggtccagccgcccaggggagaagacctccaggtcagctatgccgctgaaattggaggcgaggccaaccccaagggctggtatggcagcatgatcaacaatcttggcgcatgcattggaacatgcggcgccattccctgctgtgtcatctggcccaacccttataagcacgtcaaccaagggcatgttggtctcgtcaccaagttcggtcgtttctacaaggctgtcgaccccggtctgatcaaggtcaaccccctca

SEQ ID NO: 311 - DNA, 593 bp, Trichoderma harzianum
tcgatcagtcgacaattcattcaagatgggtaaggaaacgcctgcaaagaccggtctggccgttggcctgaacaagggccacgtacgtcaatacaactcgcgatctcacctcgtggaggatctctgcccccaaccttgatctcggcagacgatggacgctgacgttttatggtttgtgtttgcctgaatatagaagaccactgctcgtgtcgtcaagccccgtgtttctcgcaccaagggccacctgagcaagcgaaccgctttcgtgcgtgaggtcgtcaaggaggttgctggcctcgccccctacgagcgtcgtgtcatcgaactgctccgaaacagcaaggacaagcgtgcccgtaagctggccaagaagaggctcggtacctttggccgtgccaagagaaaggtcgatgagctccagcgcgtcatcgccgagtctcgtcgtgctcactaaacgatttcttctttaagcgagcgggagagattcatcttggtaatggggaaaaacaaaaattatttcaacagggaaatgaatttaaaaaaacactacgggtttcgcatggatttggcgtggtcatgaattttgattgaat

SEQ ID NO: 312 - DNA, 441 bp, Trichoderma harzianum
attcatcacatagcacctgtcaacggctggccagcatgattgctagccgcctgataccccgaagtgccatccgcacgctgcccagcaggcaattgaccctgtcacgatggagtcgaggatttgcctctgcttctgaggagaaggacctgatcatcatcggtggtggtgttgccggatatgtggccggcatcaaggccggacaggagggcatgaaggtggcctgcattgagaagcgtggcaccctcggcggtacctggttgaacgttggctgcattccctcaaaatcgctggtcaacaactcccacctgtaccaccagattctccatgactcaaaaaaccggggtatcgaggtcggagaggttaaactcaagctcgagactttcatgaaggccaaggaaaccgccgttaccgggctgaccaagggtgtcgagttcctcctga

SEQ ID NO: 313 - DNA, 537 bp, Trichoderma harzianum
gaggaggaagagagaagaaactgcattacagagtgaagaagatgtgaaaacacagttatataccattatcgaaacaaatgcagcctcctatagagaaggttgtgtatggttagccaaacactttaaggaagccccaaatgccgattccgctaagcaccgggatcgtcaagttgtccaagcaaacagcttggatcaacagcctcattaattggcttcaatataccctcatacattaatatatataccccgacagcaccgccacctcgagctccttgaagcatcgtcatccccacaacacccattaataccctttagaagcaacttgcacttaataccgccaaaatgttcggcaacttggagcacgctaccctgcgatacatcgccttcgccaaccacttgatgattctcatctcctcgaccatcgtcactggccttgtttcttggttccttcacaagtacgactaccgcggtgttaacatcgtctaccaggaagtcatcgccaccatcactttgggcttctggctcgttggtaccatc

SEQ ID NO: 314 - DNA, 541 bp, Trichoderma harzianum
aaagttgattcatctcgccgcttctccaaccccattgacgttgctgagcgtgaataccgagaacgtttccgtcctcaacaacccgaagctactaccggtcttgaactagttcaagtccgtcgtcctcatcaccagaagtcaaagtcctctcacaaggtctctgacatcaccgtcgacgagcgtgtttctattgcccgtcccaacttccgtgaggatatcaagatcactgaggaaatccgcgagtctactccgtatccttccgaacaatcagccaagatgggttactacgacgacgaagagcacgttgaggttgatgttgtccgccacgatgctaattcttcgcgccgcccagctcctgccaccgagtcgcagcctaacactgtgtccatcccctgccaccacatccgtctgggtgatttcttgatgctccagggccgaccatgccaggtcatccgcatctcgacctcgtctgccactggccagtaccgctaccttggtgttgacctcttcaccaagcagctgcacgaggagtcttccttca

SEQ ID NO: 315 - DNA, 473 bp, Trichoderma harzianum
actggctcgctttcacagtccagctacattcgttgtctgaacactaaaccaaaaaactccaaaaaaacaacttaatacacacccccccaacaacacttaataccgacaagatgaaggccgctttcgttgctgttgctctcgccgctctggcccaggctcagacccgcgctgatatcccatcctgcgctctgccctgcctcgacgacgccgtcaaggccaacaccaagtgctccaccaccgactacgcctgtatctgcaaggacttcaacgctgttcagggcgctgccaccggctgtgtcgttgagaagtgcggtaccgacgttgccatcaacaaggtcctccccgccactcaggctctctgcgccgccaactctggatccggctctggctcttcttctgctgccaacaccactcccgcccagcagaccacctctgccggccagtcttcttctgctgcccagtcttcctctgct

SEQ ID NO: 316 - DNA, 455 bp, Trichoderma harzianum
gccaaggagattggctgcactcctgagcagctccagaagaccttccagacatacaatgctattgccgatggcaagcagaaggacccctggggcaagaagttcttccacaacctgcccgtcgacatcaacgacgacttccacgtcgctctcatggagcccgtcctccacttcaccatgggtggtgtcgagatcaacgacaaggcccaggtcctcaaccaggagaagcagcctttcgagggtctctacgcctgtggtgaactggctggtggtgtccacggtgccaaccgtctcggaggctcctcactgcttggctgcgtcgtctacggccgtgttgccggtgacagcgccagcagctacctcttccagcatgccctccagggcaccggcggcgctgctcagcgtctgggccaaatctccctggacctcgacccctctgctcccggcaagctgaccgt

SEQ ID NO: 317 - DNA, 392 bp, Trichoderma harzianum
actccacgcctcgccaatctcgaacgcctgtcaaaatgctctcccgcgccgccactcgcaccacctccgtggtcgcccgccgaggcttccacaccacccgccctcgcatgtcctctccttaccactaccccgagggtccttactccaacttgcccttcaaccctcgcagcaagtggttcggcgccggctactgggccttcatggccaccggcttcttcgctccctttggcattgccgtctaccaaacctacaagacccagtaaacggatgcttcgattacaaaaggcttatatgggctggacgcttggtgctatgaatgggtggtggactgttgcgacagagtaaatagctcgaattagacgtgggaccaattcacaagtcacatacatcac

SEQ ID NO: 318 - DNA, 347 bp, Trichoderma harzianum
aatcaaactcttaatctctattcttaaatacatctacctctcacaatggatttcgtcaacaaggctatgggcaaggaggagcgctccactcagggcaccgctcccgctgctccccaagcaggcggccaggtccagaaggacgattacgtcgacaaggctttcgccatgggtgccaaaaagagcggccacaacatggatcgcaacacacaggagaagattacggatgcaggccgtaacatgtacgagaaggtgacaggaaacaaggtcgaccccaagtggtctaattaatgaacggacgagttatgactcacaacaagactgtacaatagtaataataacatcttacc

SEQ ID NO: 319 - DNA, 360 bp, Trichoderma harzianum
ataaattcgaggtgttttagacgcaagcttctcttttacacactgaagctgctgctgcaaccatcaccaacataccacacgcaacaacacaacaccaccacgtaataacgagcagaacacccctcgcttgaacttgttgcaaaaaacactctcgcctctatttcataaatcaaattacacacgaacaaaacaatgaatccaacagtcagaggcttctcaaccgccgcaagagtgcacccgccctttttgccacatctccgcccatcgccgcgccgagccccgatccgacgctggtaagcactcaactctctctcacgtcccccatccataaggataccatagcagcaaaaagacacaacc

SEQ ID NO: 320 - DNA, 515 bp, Trichoderma harzianum
atctaacagttcaatccagacaccgccaaaatggtcaagaagagaaagaacaacggccgcaacaagaagggccgcggccacaccaagcccatccgctgcagcaactgctcgcgatgcactcccaaggataaggcgatcaagcgcttcaccatccgcaacatggtcgagtctgctgccatccgtgatatctccgatgcctctgtcttcgccgagtacactgtccccaagatgtacctgaagctgcagtactgcgtctcttgcgctatccacggcaagattgtccgtgtccgatctcgcgttggccgccgtaacagggctcccccccctcgtgtccgctacaacaaggacgggaagaagatcacccctaccgctgcccccaaggtttaaaaaatgggtatgacgggaatgggttggacggagtctggtttactttaacgccttcatgtaatttgcttagatgaatacccaggacaaagagaatcctggagcctaaatgaatcggactttttttcttg

SEQ ID NO: 321 - DNA, 558 bp, Trichoderma harzianum
agcaaacaacaatacaatccatagaggattacctctcaactcaaccacctttacgacaatcgcaactcaataagattctttcagtgtattatcactcaagatttgaatttcgattcgaccaagaaaactccaatcaaatttattacaccatataatattttcaacttcaaacatttttctcaatatgtctgctgctaccgtcacccgcgctgctgccagcactgttcgcaagcctatttccttctacactcaagtccgaagaatgggccgtgtctttgagagccacccatacgagagatttgcaaccaccatgaagcctgcaaagcccgactactacaagaacatttctttcactgctggcaaggttgtcacttatttccccatcatcggcgccatgcttggctggcccgtcctttgcaaatgggctttggacggacagatcggtcgcctggtaagaggtgatagaggcaatggtatagagtgggacagcaaaaagatatagagatgtccatctttcgactgtatatatacactttgggcgtttggatggactatggg

SEQ ID NO: 322 - DNA, 495 bp, Trichoderma harzianum
atcaccaattgcaccccgccatggcttcaccaatggctgcctctcgccatgtccagcgcgtggctacacagatccgtctgcgctcagcgcgggttcccagaggccaattgaccttcaatcgatgggcatcgtccgcttcgggcagtcggcgagctcccgccagcttcggaacttcatcctcggcagccgtttggcttgcagccgccgccattggcatcacggctcccttggcctacagcttgacaacagcagaacctgcaaagctcgacgtcacatcccttgccgaaaaggatgagcagaagaagagagaggcggttgtcaccgaagagtcgcccatgcgcctgcggatggaaaagttcatcaaggagcagcagcaaataattgtcaaggaactcgagcgcatcgacggcaagaagtttcgcaaagacgagtggacgcgacccaatggcggcggcggcataacctgtgtgctgcaggagggcaacgtattcgaaa

SEQ ID NO: 323 - DNA, 602 bp, Trichoderma harzianum
  misc_feature (520)..(520): The residue at this position can be any nucleotide.
gtctccatagagctccggcccaggctcttatagaagtcagaattttttgcattccagtcttcatgagtcgcacctactctatgccaacgatgtcttgtacgtatttaccagcagtacagaggtaggacgtcaactcgccagcaaaaatagggatgaactcactctgaagctgcgtcatgtcaatatatattgatctctttgcatatcttcttgtcgaccgttttcttttgatagatcgttgatctggccaactttctgctatctttcaatccgccaccgttggaatcccaatgatattgaggccctcttctataaatgtacgtatgattcaagtaccagatctcgaatcctcgaatatatcgactttaatgtgttctgtttttcctctcagattctgagtcatatagatggtgtaccaagcaatcgacccatctaacaataactcgtatagaaaagaggtgctacttcttcatccaagcaatattttattgtttactagagtccttgcctcgctcattanaataaacggtggagcgttgtagcgtaaataaatgaaagcggaggggttgccacgaggtcgacaactcaactcaagtcactcc

SEQ ID NO: 324 - DNA, 142 bp, Trichoderma harzianum
ggttgataccaaacaaaggtggaagtggatcttggggagagggagaaagatgattgcttgacatgtatgatacccaagatacccaggagaatgatggccgataagcaaaacattagtttaatagcagctacttttgaatttt

SEQ ID NO: 325 - DNA, 586 bp, Trichoderma harzianum
  misc_feature (353)..(353): The residue at this position can be any nucleotide.
  misc_feature (354)..(354): The residue at this position can be any nucleotide.
  misc_feature (367)..(367): The residue at this position can be any nucleotide.
  misc_feature (368)..(368): The residue at this position can be any nucleotide.
  misc_feature (377)..(377): The residue at this position can be any nucleotide.
  misc_feature (378)..(378): The residue at this position can be any nucleotide.
tcgacccacgcgtcgacccggccaggccaattgttgggccttttgagatccggagtgcggtttgcacacacgggccggccacgaggggctgcggcaggatcccaagacgccgagagccatggagagaatatctgggtgtttgcccacagaagatcagaacaggtcatttacagcttcaccaagcaattggatgggttccatggcctgaaacagctgccgttcaacggcaagaagaccaagcctgcaaagcttcgcaaagactactggtcaccgctcgcccacattcgattccagcccggccaaggatccgtcggccgctcggtattccagaagctgcgagagctgaagcaccnnttcaccgaggttnngcatggacnnagacgagttgcgacataagcggccggaacagtacaccagccaggacaagaagaagattgccgaggagaaggaagggattcgattaccaaccaatccggagcaagcaggagcgtggaatcgctctcaacgcccagaagcaaaatgcgattgccgatatggcatccgttttggcgggcgaaggccgtggcaacaaggtcttgaccgcgga

SEQ ID NO: 326 - DNA, 372 bp, Trichoderma harzianum
caaaaacaaataattcaatcttctacagctgcttcaactacaccacatcaagcatatcctcactttttgtctcacttcaaaacaccaaccatctcaacttattcaccatgtgtggcggaaactgcggctgctcttctacctctgcctgcagctgcggctccaactgctcctgctccagctgccactaagaacattgttttaaactcttgcacatggcttgcatcacttgatgcttgagagaaatacggccaactgcatctacagcactggctcactcttctcaaattatactacacgacgacatatcaccaaatgcaattcaatgatggctagctagggcactttataatcaatgtatttttattgaactac

SEQ ID NO: 327 - DNA, 552 bp, Trichoderma harzianum
acatcaccagagaaacccagctgagcgcacatcgcaagcatagaagccgtcatcagtcctccatttctcgatacctccagcgagttgatttcatcgcaacagcttactgcgttgtctgcctttttttctccgcttactcctgaaccccaacaaccaagatggcgaaccctctcgataccgatgctggctccgaacttttcagctcgtatgaggcggagctcaagctcgtacaggccgatctggcgcaaaagctggaccagatccccgaactgagtggtgaaccgcgcaaggctgccgtcagccaggctgaacgtgccctggaagaggcagatgaactgcttggtcaaatgcgccttgaaaagcaaaacatccctacatctgcacgagccaaagtcaaccagcgcttccgcaactacgagtccgacatcgattcaaaccgccgaaagcttacgggtctcgccactaaccgagcggccatgttcggttcacgctacaccgacgaaccatccggatcaacggatatcaatctggaacagcgacagcagttgctgt

SEQ ID NO: 328 - DNA, 258 bp, Trichoderma harzianum
gcccccgccactgcccaaagagcgcgattctgcgggggtagcagttttatcagaatgaatgcggattggaattgagcgagcgatgtacattattttgtcttttatttgattgagaaattctttcaattttttacgcatttatcatttgccaatgttgttgttgctgttgttttcacggttaggcgttgtgagtgagctgtcaagagttccttgatctaatcagtatagcttcaatattaatcactttggcaacttccc

SEQ ID NO: 329 - DNA, 423 bp, Trichoderma harzianum
gtcatcatgtcgcacccagagtcccccgaatttctccaggcgcagcaggccactgaggctttcaccacgaagcctaccaacgacgagctccttcgcctctacgctcttttcaagatcggcaagggcttcgatttggagtcggcccccaagcctggaatgttcgatatttttaacaaggccaagtacaacgcgtggaaggccgctgtagaggaggagaacatcaccgaccccgaggaggcacagaagaagtatgttgagtttgtcgaggggctcaagtccaaatacgcctaatctcgacaagactcgaggattgaattagaagggggcacgctgcgagtgtaatacatggtactagagacgcatggcttttgggatagaatgccagttagcatgaagaaataaagtaaacaaattgttcaagat

SEQ ID NO: 330 - DNA, 543 bp, Trichoderma harzianum
gccaaacaacgcatcttacggcttcacaacagcttggaaagctctctattcgcaatggctatcgcaccgatcactggagtacgtccctattccggccaatggcgcagcgtcgcactgggaatcgttgcaggtcctgctataaattcattggagtagctaacacaggatgcagatgctgcggcgacatttcatccttgcacctcggcgttggtcttggatccggattcatcatggccaactggtactggtacggctaccacatgccccgaaccaacggccgagacgcctactacgccaagaaggaggccgaccgtgccgccgcggcatcacagtaaggggggcacttgtatactcgatggaccgagagggaatgcggcatgaacaactgctggtcgaatagaaggggaatgactgggccaacgggctgttcatgcctgcaggagcatagttgctggacagatgtcgaatatcactgaagaaaggcaaccgggcgaacctctacttagaccaataagtcgcggggcaatacgattcaattatctc

SEQ ID NO: 331 - DNA, 199 bp, Trichoderma harzianum
gcgtcgggtttgggcagaggttgcccccaccccgccgtaaggtcccgtcgtgtgggtggttgatgggttgagtttggatagcaggaatctagcttgggagccgcctgcgtcgcaaatgatgaatctaggcagtttggaatcgatctgtgatgaggtcctaaagagtaatgttagccgttactacaaaaaaaaaattatt

SEQ ID NO: 332 - DNA, 617 bp, Trichoderma harzianum
gcctcaccaaaaaggacacaaaataacgacattcactctctctctctctctctcttcctcttttctccattctctcgcggggtcatccgcccaccatggcccaatccaccgcccaccgccgcctccttcaagaataccgcgccctcacaaacaaaccggccgaaggcatcaccgccggccccgtctccgaggacgacctgctgcactgggaatgcctcatccaggggcctgagggaactccctttgagggcggcgtctttcccgcagagctcaagtttcccaaggactatccgctggcgccgccgacgatgaagtttctcgctgacatgtggcatccgaacgtctaccccagcggcctcgtctgcatctccatcctccaccctcccggcgaacgaccccaaccactacgagcacgcctccgagcgctggtcccccatccagtccgtcgaaaagatcctcatctctgttatgagcatgctagctgagcccaacgacgagagccccgccaacgtcgaggccgccaagatgtggcgcgagcgtcgggatgagtacgaaaagacggtccgcgacggtgttcggcgcatgttgggtttgtaacagcgcatgttgggtttgtg

SEQ ID NO: 333 - DNA, 691 bp, Trichoderma harzianum
cgcgtcgcccgctcagcatggaggatatggaccacctcagcctcaatacggcggccaccagaaccaatatcctcctcccggcggccctcccccgagccactacgcacctcctgcgcaccatcctcctccgggtctagatgcttacggctatcctctcaaccctccgactgccatgcacgcaaaggccggccccccgtctccctcggcccctcagcagtttggccacggtgctccgggcggctacaccttccagtactccaactgcacaggaaagcgaaaggcgctgttgattggaatcaactattttggcacaaaggccgagctcaagggatgcatcaacgatgtccacaacgtgtcggcattcttggttgagcgatatggctataagcgcgaggacatggtcatcctgacagatgaccaaagcaaccctgtcatgcgcccaaccaaggccaacatcgtccgtgccatgggatggcttgttaatggcgcccagcccaacgatgccttgttccttcactattctggccacggcggccagaccgaggacaaggacggcgacgaagacgacggctacgatgaagttatataccccgttgactttgaacaagctggacatcttgtagatgatgagatccacttccatgttgtcaagcctctgcagcagggagtgcgcctcacagccattttcgat

SEQ ID NO: 334 - DNA, 683 bp, Trichoderma harzianum
tgtctgtcattattactcgaccacgcgtcgtcctcttcgcagctacccgtaacatcgcagccagcgacgtcgagtcaccatgggtagagttattcgcaaccagagaaaaggccgtggctccatcttcacggccaacacccgcctgaacaaggctcccgccaagttccgcaccctcgattacgccgagcgccatggctacgtccgtggaatcgtgaaggacatcatccacgaccctggtcgtggtgctcctctcgccaaggtccagttccgccacccttataagtataagcaggtcaccgagaccttcatcgccaacgagggcatgtacaccggccagttcatctatgccggaaagcgcgctgctctgaccgtcggcaacgtcctgcccgtcggtgagatgcccgagggtaccgttgtctccaacgtcgaggagaagattggcgaccgtggcactctcggccgtaactctggtggctacatcaccattgttggccacaaccccgatgagggcaagacccgtatcaagcttccctctggtgccaagaaggtcgtccactcccgatctcgtggcatgatcggcatcgttgccggtggtggccgtaccgacaagcctctgttgaaggcttctcgtgccaagcacaagttcgctgtcaagcgtaacagctgggccaagactcgtggtg

SEQ ID NO: 335 - DNA, 617 bp, Trichoderma harzianum
ggttgcatgtgatgcttggcataggcttctgcggtgtcatgtcgatattctcgtccttacactcgtgcctcgacgcccccaatcgagagagccatttgggatgggcgctggcgtttttgccatttggcctgttctttgacttccttgacggcaaggttgcccgatggaggaagaagagcagcctcatgggccaggagctggattcccttgccgacttgatctcgtttggtgtcgcccccgccatggtggccttttcaattggtcttcgaactactgtcgataccgtcggcctcaccttcttcgtcctgtgcggcctgacccgactggcccgcttcaacgttaccgtcgcggttttgccaaaggacgccagtggcaagagcaaatatttcgagggcacccccattccgacgtcgctgggcctggatgccatcatgggctactggctgaagcagggcttgatattggacaacattccgtttggcaccttgcttgagggcactccgctcgagttccaccccgccgtgctcttgttcatgattcacggctgcatgatgaccagcaagacaattcgcattccaaagccctaaatcaggcgactgcatcagccgtagcaagtt

SEQ ID NO: 336 - DNA, 650 bp, Trichoderma harzianum
  misc_feature (192)..(192): The residue at this position can be any nucleotide.
  misc_feature (198)..(198): The residue at this position can be any nucleotide.
cggacggagcagcgagtacttcacaagggatcgtccccggattctcgtgcccttttttttttttggatcctgttcggtcgcagatcaaaagttcagacgacacagtctttgtttctttttcttttacaattgtacaaaagagaaaagatcttctatttaaagggatcaattggtgttgggacgcgaatctanttttangcgcatataatacaaaaggggcttccaacatccagccatgaagttcacgactctcctcttccttctaccagccgtcctcgctcttccaaccgagcaggcgcaagactccaatgccatcgatgcgagccgcagtttccactgccccgacaaagtccagggcttctgctccgcgtccaacatcaaatcgggatgcagctcagacggaaagtttcattccgaggccatggatacatgcagcgagtgttcatgtgattgagtggtggtggttacggtgatttggtggtataatcatagtacatggacgggtttcacgtgcttcttgttttgtcaatgctgcgagtttgatgcgagttccttgctagctgcttagattgttctaattactgtcagtggaaaatgtaaattgagcatcagtctattataattgtctaatagcatgtgaacaacgaaaa

SEQ ID NO: 337 - DNA, 282 bp, Trichoderma harzianum
cgatccagtaagacatcacgcacgcgaaaagttaaacgtttgggcgcaaatgtatggattgtattactaaaaaattgcagtatcttcttgcatgtccctgcatgggagaataaaccttcatccctttgagcgcgcttcatctagtggggaaccgggcagaggtcggagaagagatggaagtggaagtgggctttaactttgaggagcagaatgtatatcagttaggctgtcacagtcacatgcgacaaaaaaatgatgacgggactttttcacggttaaaag

SEQ ID NO: 338 - DNA, 575 bp, Trichoderma harzianum
gcaagatggcgaccgagttgaccgtccagtcgtagcgtgctttccagaagcagcctcacatcttcttgaactccaagaccaagaccaagagcgcccgaccgggtaagggaggacgacgatggtacaaggatgttggtctgggtttccgtacccccaagaccgccattgagggcagctacatcgacaagaagtgccctttcaccgttttcgtctctatccgtggccgtatcctgaccggcaccgttgtttccaccaagatgcaccgaaccgtcatcatccgaagagagtaccttcactacatccccaagtactctcgttacgagaagcgacacaagaaccttgccgcccacgtctctcctgctttccgtgttgaggagggtgaccaggttaccgttggccagtgcaggcctctctccaagactgtccgcttcaacgtcctccgcgttctgccccgaactggcaaggcggtcaagtccttctccaagttctaaattgggtttctctactggcatttttggcgtgataaacatcgggggggaacgaatcatccccgctggagggtcggcatgggaagt

SEQ ID NO: 339 - DNA, 623 bp, Trichoderma harzianum
tacctaatagtattttacataggagcgtttctcgttcgcgtccattttcattttgcgtctacagcgaagcgatactcttccagcactacgcgatacccccttttgtctatactcacaccaccaaacgtagcgacaagcacagcgacgcaacatttacaatgagcgcaagaagcggagcgaaacgactcatcaaggatcttgagagctggcgccaaggggagcggcaaggacgaaaagggcgtggagaggctgggtccgatcaatgaggatgatttattcgagtgggaggccgtcatcaacgggagggagattggatcgggctatgatgagggccgctggctcatacacatccaaatccccgcgcagtatcccttgcagccgcccaagatgcgcttcgtgacgaccattgtgcaccccaacattgcgctgcagtcgggcgagatctgcctcgacctgctcaaggacaagtggacgccgacgtacagcgtgctgcagtgcgtgcgcgccgtgcgcatgctgctgagctatcccgagacggacagcccgctcaacgtcgatgtcgcggcgctgcttagaggaggcgatgttttggggacgcgaaagctggtgcaatattggtgctc

SEQ ID NO: 340 - DNA, 626 bp, Trichoderma harzianum
gctactgggctctgcaacaaccaaggacaactcgcaagagagaatatggcgaccaagcgtgatgccgccgcaacaccggcagcaccggtacgagggccggccgacgtcggtgtcctagccgtgacggtagctatgggttctttcttgtccggtgccatgatgagcctgtcggcattcgcggtgcccgtcatcctcgacacaaacccggtcgacggcgtgcacacgctgcggcagtgggtgcgcgtctaccactacggacacatttacctgccggccctgtgcgtggccacgacggggctgtacgcctttgaagccctgcggaagcgctctcagggcaaataccagtgggtgcggtacgcactggcggcggtttcgaccctggtcatggtgccctttacctggatcttcatgacgccgaccaataatacgctgttcgcgctcgaggccgccgccgccgcgtcggatccgggagctctggcagacaccccgggcgccgtggtacgctcgctggtcgtccggtgggcatggctgcacgtgacgaggtcgctgacgcctctcttcggggcatatctaggctttacggggcttctgtgcgaaatgcgatcgtcggcctaaacagctagtgc

SEQ ID NO: 341 - DNA, 345 bp, Trichoderma harzianum
aatcattcatccatcctccatcccatcccatcccatcttccaaaccacatcatcaatctctaagcgttgcccattatgaagagcgctttgatcgccgccgcggcgcttgttggctccgcccaagctggcgtccacaagatgaagctgcagaaggtctccctcgagcagcagctggagggttcaaccatcgagttccaggtccagcagctcggccagaagtacatgggcatccgccctactagccgtgccgatgtcatgttcaatgacaaggtgcccaaggtccagggcggtcacccagtgcccgtcaccaacttcatgaacgcccaatacttctccgagattacc

SEQ ID NO: 342 - DNA, 633 bp, Trichoderma harzianum
agctggataaatttctcctgtcatcctcatttcgctgccctgcgccacgacaccggctgctgcagtcccttttctaggcgatacccagcatctgcactctgcccttttttatattctctcctttgaaactcttattctcgtcgcgatagctattccagcggttgccctaactttctatttgcatcacataacctttttaaatgggtgaatccagacaagagctcctcaattggctgaacagcctccttcagcttaacatgaccaaggtcgagcagtgcggaactggcgctgcgctctgccaggtctttgacagcatatacatggacgtgcctatgtccaaggtcaagttcaacgtcagcggcgattacgcctacatccaaaacttcaaagttttgcagaacacgttcctcaagcaccaggtcgataagcccatccccgtcgaatcgttggtgaaatgtaagatgcaagacaacctagagttcttgcaatggacgaagaagttctgggacctcaacttccccgaccacgattacgacgctgttgcacgaagaaaggctggcggtgcgcccgcagccagttcaggaccggcgcccagggctgctgtttctagcgccgctgcccgacgagttggcg

SEQ ID NO: 343 - DNA, 703 bp, Trichoderma harzianum
gcacggagcaccaccatggcttcaaggttgaagatctggggtgcctgcaggactctggcggtccggacgcagcccgtccgccttgcggctcagccattccgaaaccaggtttcagcgactcgattctatgccgtcgatgcgaccaacaaaccctccaattctccgagcggtgcaaagagagaagcttctagatcattttctaaatcagaaccaacaagttccagggttactgagggcacctctggagaattgacccagaaagccgcacaagagacatcttcatcacaagcctcacccattgaagcgctagacgatgcgaccttggaacaaatactatatggcggtcgacccgtaacaagtcagcgggagggcggcttgacagaggcgcaagaggaggctctatatcgcgagggtgtcattcccccaccagagcaggcggaagctatcgttgctgccgggtcacagtcaatagtccctgttggctcagaagtgcaaaacgccggccataagtttggtcttcctcagaagccctatccggacgggttccatgtcaagaagcgataccaccccgtgctggagcaaatcactaggctcctgatgcgacatggagaactcagtgttgcgcaaagaaacatggctgctgtcatgaacttcttacgaacgtcgcccgcccctatctacagcccgaaattccccctattac

SEQ ID NO: 344 - DNA, 557 bp, Trichoderma harzianum
gcaagaatctgcacctcactcgataataaaaagaaatcggtactcaaggtttataactcattcaaaatgcgttatactgctgtcctcgctgtcctcggcttctccggagtcatggccaacaaaaacttcggacccttcggatttttcggaccctggttcgatggcgacttaactatcgatgacctcgctgactttctgtttcctgagaacccttgtgagttcattggtggtacttgcgagatcgccacttcccttacattctgcgctggtcggggcgacttcagcgttgatttgccttgtggcgttggcctcggctgctgctggcaccaggacaccagcaatgtttggtttgagcaatggaaggagtggctcgagctacacagccgcatcaactaaagccgctttaatgtcttgacgctttgatggcttgacgcttctatggcttgacgcttctatggcttgatgctttaatggcttgacggagtcttcaattggcacggtagtgggtgatggagaaattagccgtactgaactcaatgagagattgttaacccctg

SEQ ID NO: 345 - DNA, 316 bp, Trichoderma harzianum
ggagatgtgtgagtgagtctctacatatgcagcagaccttgacagaatcatgttgagtcgccaggcaggtcacagcggtagtgggaattagtgggatagattatagcgggatagcgggccaagcgctgtgggaagtacatgtacaagtacgggtaccaggtgctaggcatgtatttgcggatgctgagtggctggagcggtgcacgatagctgggacggcggggcgcgagatggcccagaagtggctctgcagtactgggagatacatggatgggcatcgggaggtacaagctggagatggatctctccaaacctt

SEQ ID NO: 346 - DNA, 179 bp, Trichoderma harzianum
gcgcatcattatgccggcatgggcccggggtctgaccctcaccatttccgagaccagagcgtgccgcatttcgacaaggcgggccatacgcggacgcacgagcgggaggatcaccggcggtggcagcggcagagaagggctgtgggggatgatggcatagagtttgagccgcagacgag

SEQ ID NO: 347 - DNA, 271 bp, Trichoderma harzianum
catcatcagaagcatgcacatatgcgagtgatacatggacaagagggtccagagcttacgctgtaatcattctctgcagattggagttgtgtctgtcttttataatctcgatccccgatatccgtaccccgatcccaatatcccaatacaagtacacgataatagtacaaagttcgagtcatactaataatacaacgcccccttttcctttctctctctcagtgattagggggaaaagggaggcgaatgaaagaccaaaaaaaaaaaacac

SEQ ID NO: 348 - DNA, 129 bp, Trichoderma harzianum
aagatcaggacaagacaattcgagagtgccaaaaacagcaaaagggcagagagacgtcatcatggctcatgccaagttcgccgtttatcccagcctcgtcgaccgcaccgtcgtcatcacaggtggtgc

SEQ ID NO: 349 - DNA, 138 bp, Trichoderma harzianum
aatcccctaatgattttggtaaaaatcattaagttaggtggatacacatcttggtcatatgatcaaatggtttcgcgaaaaatcaataatcagacaacaagatgtgcgaactcgatattttacacgactctctttacc

SEQ ID NO: 350 - DNA, 379 bp, Trichoderma harzianum
gcgcgaagctgcttacgttcaccgaggtgtttggctttctctccatgactctttggactgtaggctgtagaggagtatggagccgttgtgtgcctctgtctgacattggaggattctggatccattgtgtgcctctatctggcattggaggagtctggagttgctgtgtgcccctgtctggcagtggaggagtgcggtgttgctgtgtgctcttgtctcgtcggcgaagcatcagtgtagcctgagcaggtgccgtaaagaccggtgctacgggcaactgtgggagcttgggaggaaggacaaacggttttgccgcctctggatgcttttccaagaacgcttgttcatatttgaccaaccccgaagaactcgtccaagt

SEQ ID NO: 351 - DNA, 426 bp, Trichoderma harzianum
cagtcgtgtcttgtcattattactcgaccactcgagcaaaggcaagattgatcaacgtccggctcatctccatggccatgaccggcttcttctacaccttcaagcggcctagaacatcgcccatgatgggaatgctgaaatacgacccgatagtccgcaaaaaggtcttgttcctagaaacgaaaaagcgatccaaatagagacatttccgagcaatgtaaaatttcaaactatacacctcacggacgggaaaataatgattgggttgcgggcggtctggttgttcgaacctgcggccacctatgtacatgtatcaatacgaagagcatttctggagttttagggatgggctggcattgcgctcgatgcgctgacaggtcacgatatctggtctgattggaatataaattcactcccaaatattcc

SEQ ID NO: 352 - DNA, 215 bp, Trichoderma harzianum
aagtaacgacaccgcacaccgtcgtcaaaatggtcaacattcccaagacccgtaacacctactgcaagggcaaggagtgccgcaagcacacccagcacaaggtcactcagtacaaggccggcaatgcttccctgttcgcccagtgtaagagacgttatgaccggaagcagagcggttatggtggtcagaccaagcccgtctttccacaagaaggc

SEQ ID NO: 353 - DNA, 275 bp, Trichoderma harzianum
gaacattcagccttgtgcagggaagcagaaatcatatagagcatttatcaagcgaataacagaccctgagacactgaatcagagaagcttagaagctcttcttctctctgtctccgcgcctcttatcgcaaacagcccctctactgctgctgctgcctttgtcaggcctgtcttttcagtgtcgcatgccccgcctcatctttctaccttgcacaactcagcctttgcgctaatcaacgacatctgcgatctgtgtcggcagcagaagagtccca

SEQ ID NO: 354 - DNA, 179 bp, Trichoderma harzianum
tgccggaagccaggtcaagaactgcggtgcggataaggatgtgactttgactctgtgtgcttagagttaagggaggacggaatcatgtcaagggaaaggtttaaatcaagtttatgatagaatttcaagtcctagctatgtttaagacttatgacagtatgaattgatgagtttacttc

SEQ ID NO: 355 - DNA, 570 bp, Trichoderma harzianum
tattatctcgacccacgcggcgaagatgaagttgaacatctcttaccctgccaatggcagccagaagctcatcgacattgaggatgagcgtaagctcgccgtcttcatggagaagcgcatgggcgctgaggtccccggtgactctgtcggcgacgagttcaagggctacatcttccgcatcaccggtggaaacgacaagcagggtttccccatgaatcagggtgtcatgcaccccagccgtgtccgcctcctgctctccgacggccactcctgctaccgcccccgccgaaccggtgagcgcaagcgaaagtccgtccgcggctgcatcgtcgccatggacctgtccgtcctcgccctctccatcgtcaagcagggtgatgccgacatccccggcctgaccgacgtcgtccagcccaagcgcctcggacccaagcgcgccaccaagatccgcaagttcttcaacctcaccaaggatgacgatgtccgcaagtacgtcatccgacgagaggtccagcccaagggcgagggcaagaagccttacaccaaggctcccaagatccagagactggt

SEQ ID NO: 356 - DNA, 102 bp, Trichoderma harzianum
ggatattcttatgtgtgttcgttcaagagtgtaatgataatactgtttggtaaaatggtggaattttggtggtgtgtagatgtgataaccgtaaggtggacg

SEQ ID NO: 357 - DNA, 481 bp, Trichoderma harzianum
ctctccctgacattcattccaccatggcgcgccgccagcatctcacagcgtccatcctgttggtcgtcgtcctgttcttcagcttctcgtatttcctgtccggctcgtccagccacgatgtggaccgaatccatgagcctgcgggagagcccaagtcggaattcaaagtggacctgggtggcatgccagctagtctgcttgacggagagtctatagcccccaagctggagaatgcaacactcaaggccgagctgggtcgtgcaacatggaagtttatgcacacaatggtcgccagattccccgagcagccctcaaaggaagagcgtaagactctcgagacgttcatctacctcttcagccgcctatatccctgcggtgactgtgcgaggcacttccgggggctgctgtcaaaataccctccccagacgagcagtaggaatgcggcggctggatggctgtgctttgtgcataaccaggttaa

SEQ ID NO: 358 - DNA, 564 bp, Trichoderma harzianum
ccgagttgaagagcttcccgacgacgagaccaagaccaagcccacggtcgaggaacaggattccagcgatgagtccgatgctgaagagctcggcgatggatctctccccgccggttctactggtgtagtccactctcgctacgagaagaaagctcgcaagggcctggtggagaagggcaacttggtccgagtccctggcatcacccgagtcactctccgccggcccaagaacatcctctttgtcatcaacaaccccgaagtctacaagtcccccaacagcaacacctacattgtctttggtgaggctaagatcgaggacatcaacgccaccgctcagcaggctggcggcgctcagcttgcccaggccaacgccgaggctgagcacgctggccacaaccacgagcacgagcacgatcacgatcacgatcacgaccacgatcacggcaaggagggcgaggctgaagccaaaaaggaagaggaagaacaggatgacggtgaggaggtcgatgccgagggtctggaggacaaggatatcgagctcgtcatgacccaagccaacgtcag

SEQ ID NO: 359 - DNA, 604 bp, Trichoderma harzianum
aaacaaccatgcctcacaaacacaagtcaaggaagggcgaatttgaagcagaattcgatctcgcccctacagagaaagcgcgatctcttccagtaaacaaacgaaaagcggcatcaagttctggagagcaagtcacaaagaagcgtgccagaagctcattaagaggcaatgacactccgcgagcattcaagagaatcatggctgtggcaggggggaagaaaattagatcaggcttggatgatggtcaactcgacaaaacgactacgaaggctaccgatgtaacgagcgagaaacttcaaattcgtcccggtgaaaatttaggggcctttgccagccgggttgatgcggctctaccagtatcagggcttgcgaagaaaaccagcacgaatgcagagggcaaagacgcattaggattgaaagtgtatcgcactcgcaaagagcgcaaaatgcacaaactctacgatcagtggagggcagaggaatccaagatacgagaaaagagggaggaggagctagagcgcatagcagaacgcgacttggaagacgatgctgccggcattcttacttcagctgccttcgaaaacgacaatagccacacgaaaaa

SEQ ID NO: 360 - DNA, 459 bp, Trichoderma harzianum
gaagcctgcatcgcccgccatggccattacgccgacccaattcgccaagaagacggcgcagtcgaccagctggtcggatgcgaagcgtcgagtcctttcttcgtaccgcgaatggatccgagctgcgcctgagatccagaccatgtacaatgtccctctccccatttctaccctccgaacacggatgcgacaagagttcgagcgacaccgatacacgaaccagctgtccatagttgacgtgcttctcttcaagtcccatgcagagtaccaggaaacaatgaacttctggaagcagcagactcacatcttgtcttatttcggcgaaaactttagaggtgacaagaggcttccgtccagcttcatggctggtttccttgagggtcgaaattagaaagacaatgcaagaaagtttgttttgtaaatatctctgtataaagattttgtgccgaaaccctccaa

SEQ ID NO: 361 - DNA, 557 bp, Trichoderma harzianum
gtatcatcatcatcatcagccttctcagaccactcgaatttctacccccctcctaaaaagaccgccccaaagagaaacttcaatggctaccttgaagcaacgaaaggtcgccatcgtgggcagtcgatccgttggcaaatcatcgctcgccgtgcagttcgtcgatggtcacttcgtcgacagctactaccccacgatcgagaacaccttcagcaagaccatccagtataagggccaggattacgtcactgagatcgtcgataccgcgggacaggatgaatacagcattctcaactcgaagcacttcatcggcatccatggctacatgctagtctactccgtgtcgtccctgccctcctttgaaatggtccaggttgtccgcgagaaaatccttaatcatctaggtaccgagtccgttcccatcgtcatagtaggtaacaagagcgacctccgaccagagcagcgccaagtcagccccgaagaaggcaagaagctgtcagaaaagttcgactgcggctggaccgaggccagtgcaaggtacaaccagaacgtcggca

SEQ ID NO: 362 - DNA, 458 bp, Trichoderma harzianum
atttatcgagtttcacagggcttagcaactcctgtccggggggattggcagatcttgacaactgaggaggaccggatgccgtgacgtgtagctgctaggatgaatcttggattggagatttgccagtcgatttggatggtgcctttcgggatggaggggtggagggtggagagatatgactagtgtggaggtatcacagcgtcggggggctgtggagagttcagggtaagccatttgcggctttcacgctcagtaacactcgggggtttaaaactgactgatggcccatctataccttgcagaaaaaatttaggtcctcgcaagactctccctagagccgcgtcccgtcactactgctgctttggcatcaaatagtgctcaatggctaggccgagggatttgaagacgatagcaatgtaacccatacgatctgactgaacgacaaaacaaaacgatac

SEQ ID NO: 363 - DNA, 503 bp, Trichoderma harzianum
caatcatcagtcaaactccaaacgaggtatgtatggccttggtcaccgctgacggcgattcggacctggcaggatgacgccttttatcgtggctggggacagcaatcgaagacgccggccccgatgagcgacaatgaacgcgcgatgatgcatcacatcacatcatgcggttttctgtttggcacacaacggctttggctggcgtttctcgatacgctgcttccccttcggcaatgagcgggctgaaccctcgtcgacggatcgctgagggcactctccacgcttctgggccactcctagtctaacatgtgtttcccttctggcagatacctcatttccaactccgacttgagaatctccttttcatcaataccgccaagatggtccgcacttccgttctccacgatgccctcaacagcatcaacaacgccgagaaggccggcaagcgtcaggtcctgatccgacctagctccaaggtcattgtcaagttcctccaggtcatg

SEQ ID NO: 364 - DNA, 601 bp, Trichoderma harzianum
gagcgcgggtatgagtaaaagattcaaaatagcccttatcagggcgacgcggtgtttttcgtctccatcttctcaaacacccgcagcacctaaaatgcctccagcacccattctcaagctcaaaaactgcctggtgcgggcttacgatgaaggagacgtgaagtccctcgccagagcagcaaacaatcccaagatatcgcgatggatgcgtaacacattcccacaaccatacacgaccgatgatgccaagaagtggatctctatcgccaactctgcatctccgatccgtgacttcgccatctgccagctggacagttcagtggttatcggcggtattggtctcaaagcacgagacgacatccactaccgaacgatggatatcggctactggctgagtgaacatcgctggcatcaaggtatagccacagaagtcgtcattgccttctccgactgggctttcgaaaacttcaagcagctattaagactagaggccgaagtcttggaggggaacgtaggaagctgccgggttctagagaaagcgggcttcgtgtttgaagcaaggcagaaaaacgcggttgagaaaatgggcgcagtcatggat

SEQ ID NO: 365 - DNA, 592 bp, Trichoderma harzianum
gacactatacgtcaaaccaacagcctaagaagtgggtcaaggagttcaagaacgccggttgcgacctgtactggttccactacgaggctgccttttcctctgccgcagagtctcccgaacaaacgaccgataagaagaccaaccccaaggaattgatccgatatatccacgaccagggactgcttgcaggcattgccattaagcctgacacatccgtcgacgtgctttgggacattctcgagacttcggatcccaaggaaaaacctgatatggttctagtcatgacagtctaccccggctttggaggacagaaattcatggcctcggagctgcccaaggtgcaggagctacgaaagcgataccccgaactgaacatcgaggttgacggaggactcggccccagcaccattgaccaggccgccgacgcgggagccaatgtcattgttgcgggcagcgccgtctttggagccaaggacccggccgaagtcatttcgctgctacggaggtccgtcgacaccaagggaggcaagctgtaagtgtggagagttggatatagaagaacaaatagctgcatgaaatagaaatagcgatt

SEQ ID NO: 366 - DNA, 599 bp, Trichoderma harzianum
tgtgatcacaactcggcattctattgggcttcgaggcaatacacacaccgaaaatgagttcggaagcacacgacaaagcaccgggtgatcttttccccaaagaggacactgtgctttcgagtgcggcatccttcacacaggactttaagccggttaagaatatatgtgctcatcttaacgctttccacgcttatgcgaatgatcctatgcgatccgtggaagcgaatcattactgcagccaattggacgacgaggttcggcaatgtgtgttatacgactctccggaacccaatgcacggatcataggcatagaatacatgatcacaccgaaacgctacgaatctctacccgctgatgagcgccgcctgtggcattcccacgtatacgaggtgaaatcggggatgctggtgatgcctaaccgcatggtacccaaagcagcatgggaattagcagagaagagggagatggaaaagattatcacgctatatgggaaggcgtatcatttgtggcagacggacagaggggatgagcttccgctgggggagccacagctcatgatgagttatacgagtgatgggcatttggactttgggagggtg

SEQ ID NO: 367 - DNA, 547 bp, Trichoderma harzianum
acagcctgaaaccgcgagtacaagcatcttgttgtaagctcgacgtgtgagctctcctttcgtctgccgtcaaaaagtcgatgccaaggagggtattgcagatgtgttgttggccatcagcttaccactgcagagatccaagcagtcatcccgtgtgcaggcacaagcccagtaagccgctgctcccaatatggaccacgtcagccatgccgccaaccgagtccctcaccgtcttccaagatggagatgctgtagggctcacccagcggtcgaaacataccgcctgtctgaggccccctccagggcatttgctagccgacctactgtactcgtgtctcgtacacggcagtcgaattggtatacctcctccgaagctggttcgtcatgcgcatgaaaaggctgtagcgagcaagactcagccgcccaatcacgaatatctcgggcatccttgtccgtccaggaataggcacaccactcgaaattaagctgccatgcaagacgtggcatgcggggagggtcccaaagatccttccaaacattccagaca

SEQ ID NO: 368 - DNA, 582 bp, Trichoderma harzianum
  misc_feature (541)..(541): The residue at this position can be any nucleotide.
tctgcacaaccctgttaataccgccttgttggactcggtaccccacgcatcacgagcgtttcctccatccacttgtcacccgtgcttgtacgagtatggagtgcctttatcttgaacaacactgaacgcaacataaatgcctctcccggcggctggcacagattccccagcttcggcctgggctgcactcgttgcaaacggctgaatatctttgcactcctccaaacgagcaaggagccggatatctttgcgcaggctccaacagccagcactgaaccgggggcttcgtttccaccgatgaaatgtgcactgtcgaatgctgctcacgattgtcatatgttatccgttcatgtgtgtctacttgcatctcatctgtgcactgtagtgctgtcctcctcgtatcaaacgtccacttgtctggattgcgtaatccgagacggcaagcgaattttcggatgaatggtggtattttgtatcggatggttctggtataggttacctcgctttgaaagcgtataaattcatctcctctctgcatgtnggttatcggtacgaggttttatgtgatagatgacacctaca

SEQ ID NO: 369 - DNA, 114 bp, Trichoderma harzianum
gttggaagtatataacttatccggctacaaggttgaatagcgttgcccaaaatgaatccctatccattccaattcaacagcacatcctcttcaaaagatgaatcaaccagggat

SEQ ID NO: 370 - DNA, 249 bp, Trichoderma harzianum
agagaacgcagataccttcaacaggctcgaggctcccgtgtctcgtgttgctggatggagtatccacaacgctctgatattcgaaaagtttcacgtcccagatgttgcaagaatttacgacagtattaaaaagacggttcagtactaagaatgtggggagcgagtaacgtgtgactttatctttgaatttctagagcttcttcctagcataagtgtaaataatagagaataaagctttctgtaacacac

SEQ ID NO: 371 - DNA, 596 bp, Trichoderma harzianum
gacacacagacgcactcacacactcagcttaagcgagcgagcgagtgaacgagagagagagacagagatggcgagtgttgcctccttcccggtgatcaacatggagaacctggagaccgaggagaggggcgcagcaatggaggtcatccgcgacgcctgcgagaactggggcttcttcgagatgctgaaccatggcatcgcgcacgagctgatggacgaggtggagcgggtgagcaaggcgcactacgccaactgccgggaggagaagttcaaggagttcgcgcggcggatgctggaggccggcgagaagggcgccgacgtgaagggcatcgactgggagagcaccttcttcgtccgccaccgccccgtctccaacctcgccgacctccccgacgtcgacgaccactacaggcaggtgatgaagcaatttgcgtcggagatcgagaagctctcggagagggtgctggacctgctgtgcgagaatctgggcctggagaagggttacctgaagaaggccttcgccgggtcgaacggcccaacgttcggcaccaaggtgagcagctacccgccgtgcccgcgccccgatctcgtcgacg

SEQ ID NO: 372 - DNA, 537 bp, Trichoderma harzianum
  misc_feature (525)..(525): The residue at this position can be any nucleotide.
acaacatttttctgctattcaaacccgtcgcccgacgacctccagattcaaaatgtttgccctttcagaagagtccaaggagcgcattgccaagctcattgacatttctcgagtcgccattcactatggctaccttcctctgattctctacctcggctacacccgcagcgacccccgaccttcagtcatccgccttctctctcctctttcctaaacgcaaacacagacggacatgcgatgttgtacgatatacgattataatacggctcaagggcacgggaaaaggcatgcaacaagaagaggcgaacagtcagagagaagctcaacgtccagcattcatcatggcgtttgggtaatatgcacatgtcttggaagaaggcaggacagggcacgggacgggtgatacaatatgacgacaaggtcgccgagaggacgcagaggaggacaccaaatgctgccatgtaccaataagaatgtattatctactgctccgtactgtaattggaccaagtaaccactccgaanaaaaaaaaaaaa

SEQ ID NO: 373 - DNA, 160 bp, Trichoderma harzianum
ggacaggggaagggggtgttacttgcgataggcgatgtctgcatgtgaaggccactactttaccaaaagaggatgctgggatggctgtcgccggtcgagtaattaatatgcataatagtatccgcaggtgatgaggtgatttcaatgtataattgctaaa

SEQ ID NO: 374 - DNA, 538 bp, Trichoderma harzianum
ggcgctgtaatcttctcttcttcactccggtttctctggcttgcagatacagagtcgctgtaaaagaaaagaggaaagggagaaaggaggagcatgccttcacacagcttcaccacgtccaggtggcttgcgccgcccatccagttcgcgtccttcaagtcgctcctcgttattcccatcatcctctccgtcggcacctttgtcgctctcttcgcccattccgacgtcgacatcgctttactgtggtcgcaatgccactcccgcgcccgcatccccggcctcagccacatcccgctcatcggcacgccgagctgcttcctcgtcagcttcttccagtgcgcgctggactcgctgcggtccaaggccgtcatggccgtgattctgtcgtatgttggcgcgctggcgactgtatgcaccgtggagtcggccaggcgctgcaacaagcctaattcgctgattgcgaagcccacgctgtggtggctgttgttcaacttgctgggaggcgccatggtctggcagttggtgattgtgccggcgt

SEQ ID NO: 375 - DNA, 637 bp, Trichoderma harzianum
aaaccaccgtcatcatgcctccagcaaggtactcgcgcccgccacaacacgactcgtggttcgcgcctctatccgtcgacctgatcctcaaggttctcaacgtcaccatcttccatcccttcatctgctggctgatcccgctgtgcctgcgcgcccagacgaccaaatgggaggcgccgcccatggtgggcgccattgcctgggccatcttcatctcggccatgtggatcgcgagcgcggtcaaccagcgcattgccaacggcgcgccgcgcgaggtggacctgggcgaggaggtgattgtggtgacgggcggcgcgagcgggctgggcatgctggtggccgaggtgtacggcatgaggggcgccagcgtggccgtgctggatgtgaacgagatggagaatggcgaggcgaggggcgtgacgttttacaagtgcgatgtgagcgacaaggagcaggtggccaaggttgccgttgagattgagaaggatctcggtacgcctactgtgctcattaacaacgctgctattgtcgtgggcaagccgctgctggacctctccatcgatgagatcgagaccagcatcggcaccaacctcctcggccccttctactgcctcaagacattcctcccagccatcat

SEQ ID NO: 376 - DNA, 564 bp, Trichoderma harzianum
gtctatcgttaatacagcaagatgtatgaggtggtatcgaaacaaggacaagaacaaagagaagaagaagtcgtaaagagactgaagtgctgtttgagctggtatcgttgactggttgtatgtagtgtagcaaagttgtgacatatgaagagatgaagcagagaagggttccgttgttgctcaagacgttcggggggtggcagctttgatgagtggccgcccgcccaattacagctacagctaccaagtacgaagtaccagaccttacagcatcgacacgacatgaatgcatgtacctgctggtacagcgacggccctggcgctggttgtcagtgactcgataacgcggggggaggaacagaaggttccaggtccgctggccgggccttgcagtggcagctgttggggggcgtgattccgccaaggggggccgaaggggggtcgcatcccagcctgcgaggtcagagggggagggggcgtgccgcgtacagtgacggcgaggtactgggctggcagaggtgacggaacagtggtcagcggccacaggggcaaacagcgctcgcg

SEQ ID NO: 377 - DNA, 425 bp, Trichoderma harzianum
gatcgggatcgagtggggaaataagatggagagtcgagagtgccttatgtaaaaacctgaccaccggcaggatggaatcaccagaatcaccagacttgtctccgggtctttcctctatcctgcattttcctgcaggacagggagagctgcctgcacctgcacaccgaggtacctggatactccgcgtggtgaggggcaggcagcgtgcgtccgaggtactgccaggctgccaggtacttgggacggcagtgcacaagctccgtacttggcgcgccctgccctttggtccagctttgggaagagatctccgttccggctgcctatcctccgctttcgtgcagctggggggagggttaaagacggctttcggtcaagagtcgaatcggtcctgattcagaaaagaaaacacgaacaaaaaaaaaaaa

SEQ ID NO: 378 - DNA, 577 bp, Trichoderma harzianum
gggcggacgcgtgggcgaccaccagcgccgccagaatgttcgccgcacgatcaagggcagtctgcgccgcccgccagctgcagcggacaacccgaacctacgcctccgagtcccacggccaccactcgcccgctccggtcaacgagtcctttggggccggatctgttattgccctgggcgctttcctgggcaccgtcctagtctaccagttccgccccacggagagcgacaactggacgccctctgccctgctcaacaagtatcgatcaaaggccgaggactgggaggccgtcaacactctgcacacaaaggccatggagcaggccggctatgacaggaatctgttcgagaacggctccaacaagcaccgatttgtcgacgtcgcataccccgaagctctccaatcccacgccgcgcgaaacatccaggccggccaccttgccaacattgaccatgctgtggaacactaccgacagcagcacctgaagatggaggagaagaaggcggccaagctggcggctgccaaggcagagtagttgcagttgctacagtatatccaatttatagaacaaagttt

SEQ ID NO: 379 - DNA, 594 bp, Trichoderma harzianum
acgggacgagcgatcgatcaagtcagagacaacaaataccgagtggcgatgccttcatccgatagtcttgggaggcgggcctcacacggcgctgccagcctggcgacgtcggcatcttctatacacggcgcagcagttgggtttcgagaaggcctgggcttggctggagttgcgaggaggacgttgggaatctgctttctgctattgacggtgtttctatggacgctgtccaactttctcgccagctttatcttttccgatgcaacctacgataagcccttcttcctcgtctacttcaacacctccatgttcgccatctctttaatacccatgtttgtacgatatctgctccagaaaggattccatggcctacgaagcgacgtcaggcgcatgtgggcggagcatcgataccaagccgccccaggcagtcccgcgatagatgaagaagatcacctagctcaagaacgcttgctagtagacgaacgagaccccatggcaccaacctcgactccttcaaaagagaagctcagcttccgagaaaccgcagtactgagcctggagttctgcatgttgtggttcctcgcaaactatttt

SEQ ID NO: 380 - DNA, 551 bp, Trichoderma harzianum
tgtttcaatccaagcaaaacataacgggtggggatggagtcgtcaacaatacagtgacgacgggtagagaagctgaaatcattctcaaccattggctggattccatggacaccttcgaaaactggtacggccacaatgaggaatttgtgcataagccgaaagcacttcctcaacagaagcctccagagataaataaagttttcacgattaagaaggaggactggtatctggctattaaagaatacctactagttgcttatacttggtattactagaaagaaaacgaaggaggcgaatgttgttagctgcccttatataaggcttattataagcggcttcctaatgttctaaagccagttaaacagtactttacttatctcagtattatctctggtttacctgcggtatgacttaacctttggggtctggtagttatagtatacttaaatagtgcctggagctagtttacagaaggtagtgatagaggatatagagtaatattactggctaagaactttattttaactattagctaggggagtatcaatgct

SEQ ID NO: 381 - DNA, 420 bp, Trichoderma harzianum
gaagctctattccagagctgcaagtgcacgcttggatacgagctctggtggttggactcgttttcacgatgtccaggaagtagggctaataacccctcgatccacccacgattctctccattttcaaaaggtaattctacattctctcatacctcaacctatcccacatgatgaaaatttgaacgaacgggcggacatatcgagccttgctactcttcatccctgagaaagcgaggacgtacaatccttgtggtgaaggggagtgagaactcaggatgagatctcgtcacctgatcgtggttcataggaatcggttccttgttcaagctgggattgcgcatgtcagctaacatgtacaatgataggtacttattatacaaagctttcttcttaaaaaaaaaaaagaaaacaaaaaaaaaa

SEQ ID NO: 382 - DNA, 603 bp, Trichoderma harzianum
cttgcatctcgccataagtttcatctcaaacatagcgggttgcttcctagtctgatagcggcaaaatctcacactcaaggttttactgcgtatccagcatactgcctccgctctctcacaccatctcacaagacaacgtcaaaaagggcatcttttcacagcacagcaataatgagcgctctcgaggaagacgactcaagcatctccgctcagattgctatcgaggataagctcgcgggcggaaggaagccaagagggggtggtagaggaggcagaggaggcggcggtggtagccagagcagagaagtgcaggtgtcaaagacgctgtcgaagctgttgagacatcaggctgggaatgccggcatcaagcttgacgcggagggttttgcagctcttgacgaggtgctgaattatggtcccatccggtctctcaacgtcactcttgctgaagtcaaggaggtcgttgcctcaaacgaaaaacaacgcttcaccatgaaactaaactcatcactctccgccgaacttgttccttcagatgacagcgcaaccccctctcaatacctcatccgcgccaaccaaggccactccatcaagattgaatcc

SEQ ID NO: 383 - DNA, 628 bp, Trichoderma harzianum
agagcatctgaggctgtactgcaaaacacgatccgccatatggtttatcgaggcaaaccgtcaccagcctgcgcgctatgtaggaagaggaagattaagtgcgatctccagagaccaagatgttcacaatgcagacgagcgaaagaaacgtgtacagggtatcgtgatcttattgatgtgatattccacgatgaaaccaactcgaccaaatccaaagctcttgccaggatctgtcgcgctcaagccgaagcccatgcggataatagtattgcaatcaacaatgccatttctttgtgtttcctgccatacaatattgacgaacaaaccaaatcgtattttgtccatagctatgtccttatccaagaaggcactgctggctatctatccggcgtggctcgactgctagttcgaccaggcctcaacagcgccttggaggcggctatggttgcagttggttcagcggggatggcgtgcaaagaatcatcaccacttctggagctgaaggcaaggcaaagttacggcattgctataaattacatcaatgaagcgatccacaacacggccaagataaaagaggctgggacgctcgccgccattctggcacttgggctttatgaagtcagtgaca

SEQ ID NO: 384 - DNA, 585 bp, Trichoderma harzianum
atcaatctaatcgcaagatcgcagctcgggcccaaaatcagtcaaaatggcccctcagaagaagagcaagaaggatgccaacagcatcaactccaagttggcgcttgttatgaagtccggaaaggtcactctcggctacaagtctactctcaagtctctgcgatccggcaaggccaagctgatcatcattgctggcaacactcctcccctgagaaagagtgaactcgagtactacagcatgctgtccaaggctcccatccaccacttcgctggtaacaacattgagctcggcactgcctgcggaaagctcttccgctgctccacccttgccatcctggatgctggtgactctgatatcctcagcgaccagcaggcttaaatagccgaaatctagtgcattcaaaacggcgttgggggtaaaacggttcaagggcaatatggataccatacactttcacattatgtgcgagacgaaaacttttgatgcgagacatcatctactaggaaggcaaatcctttggggatggaaaaaagccccagaaatttccaagtgatagttatctcaatggaataatacagccatga

SEQ ID NO: 385 - DNA, 451 bp, Trichoderma harzianum
agccgagttaagcggcgatagaagcaacagaggtgaagttgtgccggtctggtggtttattggaaagaaacgaagagaagaatgttccggtcaagggaagcggcctttggtcagtagccaaagggcagatcaagcgccgccttggaggattaaaagggcggctgcaggggtcccaaggctggtgcgcctcatggaattgtatcgaagaaagtcgatggtgtggcggtgcccgataacgcaaaaagctggcaacctttgtgctgccatgcgggctatcagcgggtaccgccgagtatttgtttgtcactgtacagaggcgagacgtgaggccgagattcgcattggttcggagtctggagtagggaggacaatatggtagcacgattgtcattgtgattgctttgtttattagtacttaaaaaacaaataaaaaacgaaaaaaaacaaccac

SEQ ID NO: 386 - DNA, 132 bp, Trichoderma harzianum
gccaataggtggcctgcaggctgtttctgatacaaatcctcgtaatgcacagacgtgaatagtgctggcacaagtcacattgctgctgccttgaagggttccatttacattttggtgcagctctaccaaccg

SEQ ID NO: 387 - DNA, 626 bp, Trichoderma harzianum
gccgttctcaccacagcctgcgcgctctgtcgcggaccgggcgcgccttgggagtgcggatagacagccctttgtcgcaacaaaccgttcggcggaaatcaggtccgtacggctacactcaggccaaggctcttgtcttctccaagaatggagagccatcagatgtactacagttgcacacgttttctatttcgccctcgatttcgtccaaatcccttttgttgcggtctcttgcggctcccattaaccctgcggatataaacaccattcaagggacttatggctctcagcctagcttcacatctttaatagggacgtctagcccgtccgccatcccaggaaatgaaggtgtcttcgaagttgtttcaacgggcgatccggcatcacctattcgcaagggggattgggtcatcccggcagttgcgcaattcggcacatggaggacgcatgccgttgcagagctggatcaggtcttgaagatcgacaaggagggactgcgcgcgactcaggcggcaaccatctctgtcaatcccagcacagcatatcgcattctgagggcatatggccccagcactggactgggaggcattggaatgcgaccgctggaggtgggcagtggcgaatgg

SEQ ID NO: 388 - DNA, 342 bp, Trichoderma harzianum
gaacaatgcagctggtgacaggtttgtcaagtggcaggggagaatcgtattcgtgtggcgatggtgatgtcgaatttcgaatgagggagccttggcgcgaagaaaaaagaagagagagagagagcggagaggagaggagaggagagtgaaagaaggagaagtagagaggagagaggagagagacgctgtggtgctaagcaaccacgagagaggaagatgaatgcggtttacaaggttgacattggcgaacgagcttggaccgctttgacaatgtgatgtgatgcaggctgggtactccaaatgtttccaattgaacgaatatccaatcagacaagtagagat

SEQ ID NO: 389 - DNA, 226 bp, Trichoderma harzianum
gctgtacatacgtaattgcagcagggaaacgggggggaaggacagccgtcggtgatgggactgtcaggttcacggccactccccggtctggcttcgcctgggctggactctttcaccctgtcctctgtctaatgcaatgccagccaacggccaccgaagtgctgcatgtgcttgcatacgttgatgtctcagggcacacacggcatgcatacgagtaggtagatcc

SEQ ID NO: 390 - DNA, 689 bp, Trichoderma harzianum
gtggatgcggtcgtctcagtttacctgtcccatttctactcatgccattcttgtttaccatctgcattgctctgtcgaaaaccacaactgcctcgtgccaaaagtcatgactcagcagggaacaattcgaaaggcagaacctcagctagaacgccaggctttcctcctatcgggtccatcagcttgattcggcagcctgcaattgaattggccatcatgtggggttccgatgtgcaaaaacccgcaattgggggaccttgtgcgaagctcccgctctgtacaggcacgggtacaggtagaggtacacgttacatgtgtcacggaatacgggggcacaagagacaggcggagaagccgtcccgaacgagtacctggcggcgaacagatgggcagagacaagtgtcggaatagccgaccttgcatcagtccttacagtagcgagcgtttgcacaacgctcttggtattgctcgggaataaaacgtcgaaggaggatgtcatcaacttgttggctcaggcaaggtatgtacgagtaccaaaaggttaagcataaggcactcgcagtgctgctaccggtttgtatgtacagcccgcaggcatggaggtccaggttggtgggttcgcgggctgtgtgtgtacatgtactcgtaccttgcaagtacctcgacgttgtacccatggcaggccaatg

SEQ ID NO: 391 - DNA, 630 bp, Trichoderma harzianum
  misc_feature (52)..(52): The residue at this position can be any nucleotide.
atgggattgaatcgtctttgagccatggttgaaaagtgcttggggagaggtnatggggatgtggattatagaggggttcatcgtattagcaatttagcctaaatagagcttttgtctctgctactttgaggcgttgctagcaagcggtatcttggctcgggatcgatgtatacagtacttgagccaaagatgatattgctcttggccatccacaaaactccgtacgagtactcatacttgatacttctcatctcaagtaatagatgccatgccatagaggtaagcaagtcaacttgaggaacagggtatatacagattgccatcgttcatctaaattctcttcgtgcacctctttacctttacatgcaccaatttgagcactacctcctcccactacccctggccacgaaccatcaacatcatcagacagccaagataacggcctgactgcggagccggaaccagacccggagcaatgccggagcaagggactacggaatattcgcatgagagatcggagccggggctttgcgggccttggcgaagcaatagccgtgtgtaaatcaagtctagtactaccttgaccctatctaccttgtctaggatttatacagaaaatggaaaatcaat

SEQ ID NO: 392 - DNA, 426 bp, Trichoderma harzianum
cccacgcgtccgcccaggcgtccgctctactctacatcaaaagaccagcatacaaacattcaccatgcttctcaagtctgtcctcctcactctcgccatctctctcgcctcagcgcagagcgaattcggccggccctgcggcttcaaaattgctccctgccccttcgacatgaaatgcgtcgccgacaacccgtactgccctgatcgcaacaaatgccccggccactgcgagttcaagaacaagtacgcctcgtgcggaggcttcaccccgagaccgcacaactgcgacggcaatcacgtgtgccaggacgaccctcggctgcctccaaactgcgggatggcttgcgatattccgggaatctgcgttccgaagactgctgagttttgtggaggatttgcgggttttgcttgtcctgcgggaaagta

SEQ ID NO: 393 - DNA, 337 bp, Trichoderma harzianum
aagccgcgtgtgtttgatggaacccctcatcttgcggcatgggggattgtcctcaagaggccattggttgggacgggcagaacaagaggccattggttggacgataggcagaggaagagattattggttggacgataggcagaggaagaaagacgccaagtactctgtactacctcacaaggtagcagtcccaaacacgccattccaaggttctgggatcacccagaactgccgaacgcaaccgcgcccttgccctggagatggcgggagacgaactggtgttggttgtgagcgccgccccacacgatgccccgtgccgatacggaggggatagatt

SEQ ID NO: 394 - DNA, 615 bp, Trichoderma harzianum
attaggcattgacagcaaaccaattccctccataactgggcctcttcacacccgtactcagaatgaccgacagaatattccgcatctttaacccgggagaaccaaagggtgatcccgttgagaagaggcgcgctcagctgcgacgtgcccaacaatcttatcgagatcgcaaggacaagtacaccaaggcgctcgaggctgaactagcacggtctcggaagagcgaggcgggcttgacgttccagatcgagcagcttcgtgtcaaagttcagaaactggccagtctcttgtcccaaaatggcatctcacttcctccagattttgacaatgaggaacaacttcatgatgatgtaccgcgtatagattcatctccgctcacaacgcgtggacaaccacaaaccgctgaaggcttcctatcaagtacagattcaacctctcctgagtcggtgacggaccaaggagctatcttaaatagtggaaaccgcactctacggcagtacagttcgagaatcttttcccgacatcatgaaccgcaggttccagcgccgacgaggaccgtccaagatgagcccggtgacaggactcgccttgctgaacttgatcccacacaggtcg

SEQ ID NO: 395 - DNA, 317 bp, Trichoderma harzianum
cgaaaccaaggagtggctctctgaggttgctgagcatgcgcaggcgctcaaggtcgatggtggcttcgatgagggtgccgatctgggccccgtcatctccccccagagcaaggagcgcatcttgagcatcattgacagcgccgagaaggagggtgctacgatcctgctcgacgggcgtggcttcaagtctgaaaagtaccccaacggcaacttcatcggacccaccatcatctccaacgtcactcccgacatgacctgctacaagcaggaggatcttcggccccgtgctggtgtgcctcaacgtcgaaaccatcgac

SEQ ID NO: 396 - DNA, 75 bp, Trichoderma harzianum
gactcattgttggcatatggagcatcccaatcttattcgtactcatgtgatcgtcatcgctcatcatgctgacca

SEQ ID NO: 397 - DNA, 513 bp, Trichoderma harzianum
gagacgagcaagttcgtgagcggattatcaccccgactcattccttattccattgggccgtggaaaaggtacagaacaggcgaatactggtacagataggtggcggcgaggcaattttcttgctacctgatgtatacatgtctccctggggaataaatcccgtgcatgtaggtacaggtaccggtactggcactcttcgaagttcttttgcctctctaacacagcatgacgcttctcacaagtgattctccagctgtctcacatccagcatccatgttctctgcagaactacagacagccaaccaactgagaaatcctcaatgcaatcatctgcccatcccaagcaaaaagtctcacaaggcacgtcccgcaacactcaacttgtctctcctctgagtctcttcctcccccacatctgttgggaattttgttgaggggccacataaacccgcccagccccagcgccaagggtcccctttccctggcccgtcgatctggcgtggggcaccccga

SEQ ID NO: 398 - DNA, 252 bp, Trichoderma harzianum
cgagcaaacagaaagcagcccgtcatccttcgggaacccgcatgatcagcgcctggccgtctgggggggctgagaggtcgctgggtcgcgggttaatgaaacacgggctctgcgtttatttggtggtgatcgacacttttgccctcgcagcgtgaggactttttggggtgagccaatggagaaatgtgtcgagcatctccatcaacgcgccccagatttcatcaccgctctaacgttagcaagaaaaagggt

SEQ ID NO: 399 - DNA, 345 bp, Trichoderma harzianum
gtgtggtacagacgcccccgaggccgccgctggtcccgtgtccaacgggtcgcatgccagcaaggccaacccagccagctctccgtatcagaacgtcaacgacttcatctccaatgtcgcccgattcaagatcatcgagagcactcttcgtgagggcgagcagtttgccaatgccttctttgacactgaaaccaagattaagatcgccaaagctctgtaagcccgaaccacctcgcaactcacttggttctgttgttcctctccacactcgtctcatatgctaacatccctacggtgacgagtttggtgtcgactacatagagctcacaagtcctgtgtcttctc

SEQ ID NO: 400 - DNA, 414 bp, Trichoderma harzianum
atcgcatctaccgaactccggggttctcgcaaaaggttcgcacattgtattttcgaaagcgaagatacacatatacacaaacaactacaatatgtcggagaaccctacgacaaacgggcacgacgcccttgaagagaagctcggccgcctggctaggaaacccggcatcaaggccagcctcgttttggaccgagcaaccggcgcaatcctcaagacgagcggccagatcgacgcgctccagacggcgaaatcgcgaaacgcgtcaacggcggcctcattctccaacgacgctcccgcaacggaggagggcgaggcgcagggcgtcgaacagtttgcggaaatgatctggaactttgtcaacagctccgggcagctagtcggggacattgacacagaggacgaattgaaattact

SEQ ID NO: 401 - DNA, 499 bp, Trichoderma harzianum
ggctcgtcaacatcgtccgccataccaagaagaggctgagaataaatctggtgcatgcaaagaatgatagggatatcccctggacggaggataacaagctgtttcgcgctgccgcaagcgagacgattggcactttagatgacgatgaattcgacacttggaaagagtcttgcacagttcgaacgagcaatgattcgtttgtgactacattgaaaacaggcgatgacattatcattcgtcaagagctatttccctatggcggacacaatgaaattctgggctttgcaccggtcagcttggccattatgaggtcgtttgatcttgaaggcaccgcctacgattaatagcgatgccacatagaaggtatagcacgcacatgactgaatattcggtgcgagttgcgagctgtatactcgtacgaaccacgtcgagtctaatggctgaatcattcaaaccaaatctaaacatcaaggaattgagcagttgttttgcaggaatg

SEQ ID NO: 402 - DNA, 130 bp, Nicotiana benthamiana
gccattaccggccggggttttgattagggtttgtagatgtaaagaattgtccaattagggttgcatttgacatttgtggcatgtaatggacatctatattatgaatgaagagttttctgttttctctgtt

SEQ ID NO: 403 - DNA, 623 bp, Nicotiana benthamiana
gccattacggccggggatgactatattgagaacatgggcgaaaaccagaaggccatttactatttggctactgatagcttacagagtgctagaactgctcctttcttggagaagttggttcagaaaggtattgaggtgttgtatcttgtcgaaccaatagatgaggtggctatccagaatctacaaacatacaaggaaaagaagttcgttgacataagcaaagaggacctagagcttgatgatgacgatgaggtgaaagaaagggaagccaagcaagaatataatcttctatgtgattggataaagcaacagttgggtgacaaggtggctaaggtacaggtttccaagcgtttaagctcatcaccatgcgtgcttgtatctggaaagttcggttggtctgccaacatggaaaggttgatgagagcgcaaaccttgggagacacttcaaccctggagtttatgagagggagaagaatattggaggttaatcctgatcatccaatcgtcaaagacctaaatgctgcatgcaagaatgcacccgacagttctgatgccaagcgagctgtacaactattgtacgacactgcattgatctcaagtggatttactcctgatagtccagc

SEQ ID NO: 404 - DNA, 349 bp, Nicotiana benthamiana
gccattacggccgggggcaagagtttgagtgggcttttctttgatagcattggcactgaactctctcatttccccactggacctgctctcacttctcagttctggctatggttggtgtgctggcacttgggcttgttcatctgcctaacttttggacaaattggattcaagggacggactgaggactatttctcaaagtaaaatattcccttctgaaaatttgtgtataaataagaaatacgctatttcagttccttaatattggtattttcccttcatttcagcatgttatgagcgtcagaaatcccttctactttaatgtcataataacatatgacattgtgttatt

SEQ ID NO: 405 - DNA, 223 bp, Nicotiana benthamiana
gccattacggccggggcagagatggcctattataaggcaatgggaattgatccccctaattctacaactacttaggtgggacgctcacacgatttagaatgtttgtaggacgccaaacgttgtgtgcaaatatctaatgatggtttagagttccaagtgggtagaaagaaatttctgtattctccttgttatttgttattagtaatatatatcattttgtgtc

SEQ ID NO: 406 - DNA, 410 bp, Nicotiana benthamiana
gccattacggccggggcggaagaagcaaagacaagagaaagaagcggaagaagcaaagacaagagacagtagtgtgctagcttcgttggaaccaccaagcattacaccaagcctttccttgatgattattggtgcaacttgtagttaacattgagtgtcatttgcttattgcatcaaattaggatagaggcctcggcaggatgatgaggagggcctaaatacgaggctgatctccacgtagatctggtgacaccagaaatcccacaaaagtgcgaagggtgtaatcacttatagctcctaattcattttgtcattctacttttccttttcaatcttattaactcttctgtaacttgcatatgcttctaagctccaaattttgattctaattcatcgttagttccgagatc

SEQ ID NO: 407 - DNA, 562 bp, Nicotiana benthamiana
gccattacggccgggtgatgaaaaagatgagccctttgtccttgaaaaagatcaatgttgggtgctggctgacaatgaaaatgtgaagcctaagcaggaagccaaggatagcagaacttttggccctgtttccttgacggacatagttggcagagctatatattgcttgaggacagcagtggaccatggtcctgttaacaacagtcactttagcgtccagaaggattcaccagtccttgaagttgaactggatgttgatgagatggcacgaagtcacaaagcataggttgtgtgcgctctttgaggaaaagatttcataggattactgatttggttgtaccatctttttcttgtttcctcttttttatccgagcgaaattcattggaaaaataaaagttgtgtattagtgattttggtacacattttccttcgaccagatgctgtcatcccaagtctttcctctcaattgaggcaccgaaccaactgtaaacctttgaggtcttcagttctaatttgaacttatttcaaggctgaacctgtagtacggatggaagtttgcaa

SEQ ID NO: 408 - DNA, 678 bp, Artificial
  Synthetic
ttcacattcaatcaattggagcaaaaaagggtatcgttggatctaacaagcaagaagaaaagatatgggtcgtggagtcagcagtggaggaggtcagagctcattaggatacttgtttgggagtggtgaggctccaaaatcaaccccaacaaatccccaggctgttcaaagtgaagctcagccaataaataaagagccatctccaaagcctgttgctgctgctcctcctgctgatgctgctaagcagattcccgcaggtattcagagtatcagggcagatggtcaaaacacgggcaactttatcacggaccgaccatctaccaaaatccatgctgcccctggtggtggatcttctctgggatatctctttggtggtggcagcagctgataaagacatcccaatcacccatcacggttttattatttctgaacgttatctttcaactatgttgtaagtgtgattgtgagtattgcagaatgtcagtgttattttatgttgctacctagtgggtgagggagttttctgtgtcaaggataagtggtgtaattgcacaaacttatgtccataatctcagttgaaagctttgatctaagttgctctttttgttgttacatggggcttttttgtgactagtggtcgaacatcttgtttcataaatttcatattctttgattaac

SEQ ID NO: 409 - DNA, 639 bp, Artificial
  Synthetic
caacaatcaactataatatcaattctttttcaccaatcacaactttgctctttctcatttccaaatggatactgccgggaaagcaaaaaagggtgccggcggcagaaaggctggtggccaatcgaagaagccggtttctcggtccgtcaaagccggtcttcaattcccggtcggtagaattggtcgttatctgaagaagggtcgttacgctcaacgcgttggaagtggtgctccggtttatttggctgctgttctggaatatttggccgctgaagtgttggaattggctggaaatgcagcgcgtgacaacaagaagaacagaattattccaaggcatgttctgttggctgtgaggaacgatgaagagttaggaaagcttcttgctggtgtcaccattgctcatggtggtgtgcttccaaatatcaacccgattttgttgcctaagaaaactggcggagctgaaaaggaaccgaaatctcctgctaaggccacaaaatctcccaggaaagctgcagcttagagtttttttgtgactgttgaatctgaaacttcttttgctttttgttcgtgttgtatgtatttctggttttagatctagttcttgttttagcgagggaatttgagaagaatatagctgta

SEQ ID NO: 410 - DNA, 823 bp, Artificial
  Synthetic
ccaaaatcacagcacaacacaacacttctcctaattatttcgagttttgtagaggttagaaatggagaagaagggagctggaggaagaaagggtggtccaaagaagaaggctgtttcccgttccgttaaggccggtttgcagtttccggtaggtagaattgggcgttacttgaaaaagggtcgatatgctcagcgtgttgggagtggtgctcctgtttatctttctgctgttcttgagtaccttgctgctgaggttttagagttggctggaaatgcagcgagggacaacaagaagactaggataataccgaggcatgttttgttagctgtaaggaatgacgaagagcttggaaaacttctagctggtgtaacaattgctcatggaggtgttcttcctaacatcaatccagttcttctgcctaataaatccgacaaagttggaaaagaacctactaaatcgccaacgaaggctaccaagtcacccaagaaggcctaatttgtgacgatgcaggctcgtgtgatggcacagtgttctacttgaatccatgttgtatggacattgtattgtagctttgcaattaggagctttaatggtggtcgtgaaataatctctacttgtatgtagttttggtatctatgggttgcattgcatgtaggcaaagtatgttgaaaactaggaatgtttgatttctgttattatgatgtgaaactaatgaaattggttctgtttctcaagatctttaatggtggttacatgtgagaattaaaagcttttattgtcttatgagcttttaatttgaattaaattggcaaatgtttatgg

SEQ ID NO: 411 - DNA, 703 bp, Artificial
  Synthetic
gccattacggccggggactcaacactcaaattacaatccaaaagcttatattttttctgttacttctctgtactcaagctttgttaacagttcgttcacaacaatggaagcagcaaccaagacgaccaaaggtgccggaggaaggaaaggcggaggcccaagaaagaaggctgtaaccaaatctgtcaaggctggtcttcagttcccagttggtcgtattgctcgtttcctgaagaagggtcgttatgctcagcgtgttggaagtggtgctccaatttacctcgctgctgttcttgaataccttgctgctgaggtgttggagttggctggaaatgcagcgagagataataagaaaagtaggattgttcctaggcatgtacttttggcagtaaggaatgatgaagagttggggaaattgctgagtggagttaccattgcaagtggaggtgttcttccaaacattaacccagtcttgttgccaaagaaatctgctgcagccgaggagaaggcatcaacgcccaggtccaccaagtcgccaaagaaggcgtaggactatcaattacaattgatcttttggtaaaatatggcgggccactcttttgtctagtttattggtactacttcttgtagtaggacgtagattattagttttctaaattcagtgtaatggtgcttggaaatataatagaaagtaactcttttt

SEQ ID NO: 412 - DNA, 699 bp, Artificial
  Synthetic
cggacgcgtgggcaagttttccttcaaatcattcatcatttttgtctaaattctattatctgcaaatggataccagcggaaaagctaagaaaggcgcggccggaagaagaggcggcggtccaaagaagaagccggttacccggtccgtgagagccggtcttcagttcccagtcggtagaattggtcgttacctgaaaaaaggccgatacgcccagcgcgttggtactggtgctcccgtttacttggctgctgtgcttgaatacttggccgctgaagtgttggaattggctggaaatgcggcacgtgacaacaagaagaacaggattatcccacggcatgtgcttttagctgtgaggaatgatgaagagttagggaagttgcttgctggtgtgacaattgcacatggtggtgttcttcccaacattaacccaattttgttgcctaagaagaccggaagtgacaaggcgggcaaagatcctaaatctccttccaaagctaccaaatctcctaagaaggcttagatttaatgtctgttacaagccttttgtttttctatgtttacttggatcttcactgtatgtaattcttgttttagaatgtgtttgattttcctgttgaaaagggaattagttggaattgctagatcttattaggttgtcctctattatcaatcaatgaaaccccttgtttcgaatttaa

SEQ ID NO: 413 - DNA, 672 bp, Artificial
  Synthetic
tcgcaatccaaaagcttcaatttttcctaatacttctctgtattcaagcttcgtaaactttcattcacatcaatggacgcagcaacaaagacaaccaaaggtgccgctggaaggaaaggaggaggcccaagaaagaaggctgtaaccaaatcaatcaaagctggtcttcagttcccagttggtcgtattgctcgtttcttgaagaaaggtcgttatgctcagcgtgttggatctggtgctccaatttacctcgcagctgttcttgaataccttgctgctgaggtgttggagttggctggaaatgcggccagagataacaagaagagtaggattattcctaggcatgtgcttttggcagtgaggaatgatgaagagttggggaaattgctgagtggagttaccattgcaagtggaggtgttcttcctaacattaacccagtcttgttgcctaagaaaactgctgcagtcgaggagaaggcatctaaacccaaggccactaagtcaccaaagaaggcctaggactatctattagaaatgatcttttcgttaaacatggtgaaccagtcttttgtctaatttattggtactacttcttgtagtaggacgtagattattagttttctaattttggtgtagtggtgcttggaaatataatagaaagcaactcttttt

SEQ ID NO: 414 - DNA, 636 bp, Artificial
  Synthetic
gaattcaggaggaaaggttggaaggggaggaagaaaaggtggtgatagaaagaaagcagtaacaaaatcagtcaaagctggactacaattcccagttggtagaatcactcgtttcttgaagaaaggtcgttatgctcaacgtgttggttccggtgctcctgtttatctcgcggccgttcttgaatatctagctgccgaggttttggaattggctggaaatgctgctagggataacaagaaatcaaggattgtaccaaggcatttacttttagcagtaaggaacgatgaagaattaggaaagttgcttgctggtgttactattgctagtggtggtgttcttccaaatatcaactctgttttgttgccaaagaagggtcttgagaaggaatctacacccaaatctcctgccggaaaatctccaaggaaagctgctgcctaaatgatagatctagtttgctttaacttgtccgagtacagtctattatgtaatgtaatgaaatctagggactcttggatcatgttagtgtttgaatgatctgttttttttggggttagttttatgattgaaatcagtttcgggtttcaatgttcatatggtttgttggaatatagctaatcaatggaatcaaaaaaaaa

SEQ ID NO: 415 - DNA, 474 bp, Artificial
  Synthetic
ttcctctgtctgcagtataacaacaatcaaatggcaggtagaggaaaaaccctaggatctggagcagcaaagaaggctacatcaccgtagtagcaaagccggccttcaattccccgacggtcgtctcgcccgttttctcaaagtctggaagtatgccgagcgtgttggtgccggagcccctgtttaccttgctgccgtcctcgaataccttgctgctgaggtgcttgaattggctggaaatgctgcgagggacaacaagaagactaggatagtaccaaggcatatacagttggcactcagaaatgatgaggaattgagcaagttgcttggagatgtaactattgccaatggtggagttatgcccaatattcataaccttctgctgcctaagaaagctgctggctcctcaaagccatctgctgatgaagattacattggaaggacaataggcagtttcaagtgttaagccttaaa

SEQ ID NO: 416 - DNA, 663 bp, Artificial
  Synthetic
cactatccacgctgcacgtttaccattccgacatttgccgcatctcgcaccttacatctactttcgagtaatttttcgttaacccaaaaaccaacttcaaaatgactggcggcggcaaatctggcggcaaggcctctggctccaagaacgctcaatcccgatcctccaaggcgggtcttgcgttccccgttggtcgtgtccaccgtcttctccgaaagggcaactacgctcagcgtgtcggtgccggtgctcccgtctacctcgctgccgttctcgagtacctcgctgccgaaatcctcgagttggctggtaacgccgctcgtgacaacaagaagacccgtatcatccctcgtcacctccagctcgccatccgaaacgatgaggagttgaacaagctgctgggacacgtcaccatcgctcagggtggtgttctgcccaacatccaccagaacctcctccccaagaagacgactggcaagactggcaagggttccagccaagaattgtaattttttcgttggtcgtttgcgctttctttcgaggtcgttttggttgtcataaaggggtcaagggataaggtttacggttgcttttgtacgtctgggttgtacattaatcccccacggctatgatcatgaatcaattagggtttttttcaaatgc

SEQ ID NO: 417 - DNA, 687 bp, Artificial
  Synthetic
ccccggcgcactcgcattcgacgacccaagaaaaggaaaaaaaaagaaaaacaatcctccacgccttcgagcgcagcaggaaccagcttagctagactagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaac

SEQ ID NO: 418 - DNA, 583 bp, Artificial
  Synthetic
gccattacggccggggataccgggaaaacaattcaaatttgaacacgtcaacatgccttcaacaacagcaaccaaatcggtgggtggtagaggaaaactccaaaaagctacaaaatccatctccagatctcaaaaggcgggtctccaattccctgttggccgagttgctcggtttttgaaaaagggtcgttatgctcagcgagttggctccggttcaccggtttatctctcagcggttcttgagtaccttactgctgagttgttggaacttgctgggaatgctgcaagagacaacaagaagaacagaattgttcctaggcatatacagcttgctgtgaggaacgatgaggaattgagcaagttgttggggtctgcaacaattgctaatggtggggttctgcccaatattcaccagaatttgcttcctaagaagattggcaaagggaaacctgaaattagctctgtttctcaggaattttagatatgtaggtgttgtattaagggattgggtagtgaacttttatttgttcataatggttcatgtgaatgacaagtttgtaccctaatcctattaagttgacgt

SEQ ID NO: 419 - DNA, 404 bp, Artificial
  Synthetic
gcagcatggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttggagatgtgacaattgctaatggaggagtgatgcctaacatccacaatctccttctccccaagaaggctggttcatctaagcctactgaagaagattagtaa

SEQ ID NO: 420 - DNA, 494 bp, Artificial
  Synthetic
gatcaacatgagttctaccggagaaataaaatctgtagggggtagaggaaaggccaaaggttcaaaaaaatccgtctcgagatctctaaaagcaggtcttcaattcccagttggtcgtattgctcgttatctgaaaaagggtcgttacgctcagcgtcttggctctggttcaccaatttacctctctgctgttcttgaatatcttgctgctgaggtgttagagcttgctggaaatgctgctagagataataagaagactaggatagttccaaggcatatacagcttgcggtgaggaatgacgaggaactcagtaagttgttggggaaggtgacaattgctaatggtggagttttgcccaaaattcatccaaatttgttgcctaataagaatggcaaggggaaactagaagctggaacccagtcacaggaattttagattatggggttaaatcagtttgttgggtagacaggtttaatgtgttttttgtggatta

SEQ ID NO: 421 - DNA, 630 bp, Artificial
  Synthetic
caattctttcaagcacaaagcaaagattgttgttttacagtaacaaaatagtattaatggctggtagaggaaaaaccctaggttccggtgctgcaaagaaagctacgtcccgtagtagcaaagccggtctccaattccccgttggtcgtatcgcccgtttcctcaaagccggcaagtatgccgagcgtgtcggcgccggcgctcccgtttaccttgctgccgtccttgagtaccttgcagctgaggtacttgaattggctggaaatgcggcgagggataacaagaagacgaggattgtaccaaggcatattcagttggctgtgagaaacgatgaggaattgagcaagttgcttggagatgtgacaattgctaatggtggtgttatgcccaacattcacaaccttttgctgcctaagaagactggtggatcctcaaagccctctgctgatgaggattaaatagatggccaatttggaattgagagctatatgatgtttttgttagtctatagagagatttagatcatgaaattaagcccccacccccaaatgtggaatgttatttccttagttctgctagttgtcaaggtttatgttagtatgtgaatacaaattaagggatgtatgaaaa

SEQ ID NO: 422 - DNA, 749 bp, Artificial
  Synthetic
cgttatttattatgcatcttgactacccctcgaccacgcgtccgcaattttttccttcaaaatcattcatcatcctgctctaaattcttctatcttcaaatggatactagcggcaaagcgaagaaaggtgcagccggaagaagaggcggtggtccaaagaagaagccggttacccggtccgtgagagccggtcttcagttcccggtcggtagaatcggtcggtacctgaaaaaaggccgttacgctcaacgtgttggtactggtgctcccgtttacttggctgctgttctcgaatatttggctgctgaagtgttggagttggctggaaatgcggcacgtgacaacaagaagaacaggattatcccaaggcatgtgcttttggctgtgaggaatgatgaagagttagggaagttgcttgctggcgtgacaattgcacatggtggcgttcttcccaacattaacccaattttattgcctaagaagactggaggtgataaggctggaaaagaacctaaatctccttccaaaactaccaaatctcctaagaaggcttagatttagtggttgtaatagccttttgtttttctatctttatttaaatatttactgtatctaactgtgctgttagaatgtgttcaatcgttcttcggggatgaaaaaatggaattagttggaacttggaactgttggaccttattaagaggttgtgttctattgtcaatcaatgaagccccgtgtttcgaatttac

SEQ ID NO: 423 - DNA, 559 bp, Artificial
  Synthetic
ggggaagaggcagtggcggcggggcgaagggcgggagccggaagaagtccgtgacgaagaccacgaaggccggcttgcagttcccggtcggccgggtcgcccgctacctcaagaagggccggtatgcgcagcgtattgggtccggtgcccccgtctacctcgccgctgtcatggagtacctcactgccgaggtcctggagctctctgggaacgccgccagggacaacaagaagtcgcgcatcgtcccgcgccacatccagctcgccgtcaggaacgacgacgagttgtcgaagcttctcggcggggtgaccattgctcacggcggcgtcctccccaacatccattctgctctcctccccaagaagagctcctcctcctcggccgcccccggccccgaggagaagcccaagaagacccccaaatctccctctaagccgaagcctgccaaggagtagagagagagagagagagcggagctgagctgagcaggatcagatttgtgccaccttttccttcttcctcaaggtgtctctcaatgtcatctgtatatgcatgctct

SEQ ID NO: 424 - DNA, 542 bp, Artificial
  Synthetic
gggaaaaatgtcggggtgcgggaggaaggaaggggaagaagaaggcgacgtccaaatcgaccagggctggtgctacagttcccggttggaagattggctcgctacctcaagaatgggaggtatgccaagcgcgtcggcagtggagcgcccgtctatctcgccgcggttctcgagtacctcgccgcagaggttttggagctggccggcaatgctgctcgggacaacaagaagtctagaataatcccgagacacatccagctcgcgatccggaacgacgacgagttggggaagcttctccagggcgtgacgatcgcgtatgggggcgtgattccacacattcatgccgtgcttctccccaagaaatccagctcctcttccaccgccgccgccgattccaaggccgcggagaagagccctaaggccgagaaggccgagaaggcggccaagtagcattcttcctgaagaagagagaggaaactactctttgactctttgtattatatctaatcacaacgactttattgaaaaacaaaaaacacaac

SEQ ID NO: 425 - DNA, 673 bp, Artificial
  Synthetic
cacgcgtcgcgaatcacgccgcgccgcctcttgacctagcgccgccgccgctgccgctgccccttctcgccgccggcttcttcttcttcttccttgtgtagcgcgtgcgcctctcctctcctctcgtcggcgagtgatatggcgggacgtgggaaggcgatcggcgcgggggccgcgaagaaggcgacgtcgaggagctccaaggccgggctgcagttccccgtgggcaggatcgcgaggttcctcaaggccgggaagtacgccgagcgcgtcggcgccggggcccccgtctacctcgccgccgtcctcgagtacctcgccgctgaggtgctcgagctcgccgggaacgcggcgagggacaacaagaagacccgcatcgtgccgcgccacatccagctcgcggtgcgcaacgacgaggagttgaccaagctgctcggcggcgccaccatcgccagcggcggcgtgatgcccaacatccaccagcacctcctccccaagaaggccgggtcatccaaggcatccaccgtcgacgacgacgacaactaggccgcccgggcgccttctgcattagtaggatcttttgctagctgttcgtctggatttgcattgtgttgttgcgctgagcagtaggaaggggaaaaagagagagagaagttcttggttggtggtttgg

SEQ ID NO: 426 - DNA, 498 bp, Artificial
  Synthetic
cccacgcgtccgagctcgtcaaagatgctttccaaaactagcctttttctttgcctttctttggctattttgctaatagtaatatcctcacaagctgatgcaagggagatgtctaaggcgcctgctacaataacccaagcaatgaagatgggtgcaggaatcaacggcgtcggcaaaggcgttggcaaagccgttggcaaagctgttggcaaagtagccggcaaagcttgtaaaatttgctcatgtaaatacaaaatttgcagcaaatgtcctaaatgtcatgattaaagttaggcctcagagactatgtacttgtgctggtgtgagtttagttttgagaataaagggaaagctatgaatagcctaatataattctattcactttgttttgttagtagttgcaacttgcaacaagtctttgggtcaaaatgtacctcgtcttgtagtctttcaactgtataacattgtactgtactgtattttgtctttagccacttg

SEQ ID NO: 427 - DNA, 450 bp, Artificial
  Synthetic
gccattacggccggggacaaaaaaaattgaagctcgaaatagctcatcaaaatgttttggaaaactaatctttttatttgtgtttctttggctattttgctaatagtaatactccaactagctgatgcaagggagatgtctaaggcggctgctccaattacccaaggaatggattcaaacaacattagtgatcaagcgggttatgctcgggttttacgttgtttggcttgcagatgttgtgtcggttaaattttatatattttttacgatcaaatattatacaatgtttttgtatgtgctaaaagtaataatactccaaaataaggcacaacattgtggtagtattagtttgtgttgttatacatgtcttgtccggttgtctttcaactttgtggtactgtaattttaattctggtcaataaatagtactactaattagtgtttatggtt

SEQ ID NO: 428 - DNA, 817 bp, Artificial
  Synthetic
  misc_feature (240)..(240): The residue at this position can be any nucleotide.
cacgcgtcggcttcacacttactctagagtgtgcttgcaaactcatccaaacattactttgattggagaagaggtatttgcaaagaaactgactcttaagaatgttaccgactacattgctgatgtgatctgcaagcgtgcagagtcaggttacaattatggagtgatcctcattcctgaaggacttatagatttcattcctgagattcagcaactcattgcggaactaaacgaaatatnggctcatgatgtcgtggatgaagctggtgtttggaaaaagaagcttactccccagtgtcttgagctctttgagttgctgcccctagcaattcaggaacaactgctgcttgagagagatccacacggaaatgtccaggtagctaaaattgaaactgagaaaatgcttattcaaatggttgaaactgaattaggtcagaggaagcagaagggtggatataatgctcaatttaaaggacaatcccactttttcggttatgaaggaaggtgtggcttgccatccaattttgattccacatactgttacgcgttgggatacggtgcaggagcactgctgcaaagtgggaagacagggctgatatcatcggttggcaacttggctgctccagttgaagaatggaccgttggtggaacagcactcactgcattgatggacgtggagaggagacatggcaagttcaagccagttatcaagaaggctatggtggagcttgaaggtgctccattcaagaaatttgcttcaaagcgggaagagtgggctcttaacaaccgatacattaacccaggtcccattcaattt

SEQ ID NO: 429 - DNA, 528 bp, Artificial
  Synthetic
cggacgcgtggaaaaacacacagaaaaaatatggcgagcaggaatgaagttgtgtccgttgagcttcctgctccagctggctggaagaagacgtttctgcccaagaaaggaggaggagggactccaaagaaaaaagagatcgtatttactgcgccaacgggggaggagatcactacaaagagacagttggagcagtacctgaagtcacaccctggcagtccgccaatcacggagtttgactggggagctggtgaaactccgagaagatcctcaagactcagtggaaaggcaaaggcagcttcaccttcagcggaaagtgagactccaaaaaagcgaagcagaaaatcttcagcttctaagaaggctgtgaaagacaatgaagtccatgaagaaacagaagcggcaaaggatgaaaaggatgttgacatgcaagaagctgaaaaacatgaaaaggatactctgtctatggaagctgagaaggaggtcgaacagaaacaggatgagggaaaagatgaaaacaaggatatg

SEQ ID NO: 430 - DNA, 639 bp, Artificial
  Synthetic
taaattttctctgtgggttttgctcaaaacaaagctgagactggctgattttgacttttaagaatggcaagtcctatggagaaggagagtcataacgtaattaatgatgaaattgtgtcggtggagcttcctgcacctccttcctggaaaaagttgttcattccaaagcaagggagtacaccaaagaggaatgaggttgtatttattgctccaactggagaggagttcaagaaccgcaaacagttggagcagtatctcaaatcacaccctggtaaccctgcaatatcagaatttgattggagtaccggcgagactccaaggagatcaacaaggatcagtgagaaggcaaaggcaatgagaccacaatcactacttgaatcaccaatgaaaagacgccgaacatcatctggtgtaaagaaagatagcaaggaagcggaagctgcaaaagttgaccaggaaagttctgaaacgaaagagatggaatctgccaaagaagaaaatgagaacttggagaagaaagatggaggagcagaagctgaaatgaacaaggggaagaaagaggtggaagctgcggatgaagaggcagagggcatgaagggtgctgaactacacccggaggagaagccagaaatggatgac

SEQ ID NO: 431 - DNA, 572 bp, Artificial
  Synthetic
aagagtttctcatctactttctataatggcagctgctacaatggctctctcttcctcttcatttgccggaaaggcggtaaaactctcaccatcttcctctaaaatcactggaaatggaaaagttaccatgaggaagacggttaccaaggccaagcctgtttctgctggtagcccgtggtatggtcctgaccgtgtcaagtacttggtaccattctctggtgagtctcccagctatttgactggtgagtttcctggtgactatggatgggacactgctggactttcagccgatcctgaaactttcgccaaaaaccgtgagctagaggttatccactgcagatgggcgatgcttggagctcttggttgcgtcttccccgagctcttggcacgtagcggtgtcaaattcggtgaagctgtatggttcaaggctggatcccaaattttcagcgagggtggacttgactacttgggcaacccaagtttggttcacgcacaaagcatcttagccatatgggcttgccaagttgtgttgatgggagctgttgagggttatcgtgttgctggtgggcctc

SEQ ID NO: 432 - DNA, 730 bp, Artificial
  Synthetic
gccattacggccggggggacacagccggtttatctgctgagcctgaggcctttgccaagaacagagctcttgaggtcatccatgggagatgggccatgcttggggcactgggttgcattactccagaagttctcgagaaatgggtgaaagtggacttcaaggaaccagtatggttcaaagctggagcccaaatcttcagtgaaggaggactcgactatttgggcaacccaaaccttgtccatgctcagagcattctagcagtgttgggcttccaagtagttctaatgggccttgtagaaggttttagaattaatgggcttcctggagttggtgatggcaacaatctctacccaggtggtcagtactttgacccacttggcctagctgatgacccaactacttttgccgagctcaaggttaaggagatcaagaatggaagattggctatgttctccatgtttggattctttgttcaagctattgtcactggcaaaggtcctcttgagaaccttttggatcaccttgacaaccctgttgctaacaatgcatgggtttatgcaactaagtttgttcctggatcttaaattttacattttgacttcctccacaagaggcttgtaccactgagtcattcagaatgcaaatatttggcagatgaaaactattttgccatgtgataaatactcttttagccactaacatttcattaactcttgtggtaaggactatg

SEQ ID NO: 433 - DNA, 811 bp, Artificial
  Synthetic
ccccccgacagctaacttctctattacttcagccatcaaaaaacacttatttttccttattaaaccatggctgcttctacaatggctctctcttccacttcttttgccggaaaggcagtaaaactctcaccatcttcctctgaaatcaccggaaatgggaaagttatcatgaggaagactgctagcaagcccaagcctgtctcttctggcagcccatggtacggtcctgaccgtgtcaaatatttgggtccattctccggtgaatctccaagttacttaactggtgagtttcctggtgactatggatgggataccgctggactttcagctgatccagaaacttttgccaagaatcgtgagttggaggtaatccactgcagatgggctatgcttggagctcttggttgtgtcttccctgagctcttggctcgtaacggtgtcaagttcggtgaagctgtatggttcaaggctggatcccagattttcagcgagggtggtcttgactacttgggcaacccaagtttggtccatgctcaaagcatcttggctatttgggcttgccaagttattttgatgggagctgttgaaggttaccgtgttgccggtggacctcttggcgaggttgttgatccactttaccctggtggcagtttcgacccgttaggccttgctgaagacccagaagcttttgctgagctaaaggtaaaggagatcaagaacggcagacttgccatgttttccatgtttggattctttgtccaggctatcgttaccggaaagggtccattaaataacctcgccgaccaccttg

SEQ ID NO: 434 - DNA, 504 bp, Artificial
  Synthetic
cccacgcgtccgggcaggctctcagattttctcagaaggaggtcttgattacctcggaaaccctaacttgatccacgcgcaaagcatcttagccatctgggctgttcaagttgtgctcatggggttcattgaaggctacagaatcggaggtggaccactcggagaaggacttgacccgctttatcccggaggtgcgttcgacccattgaacttggctgaggatccagaggctttctctgagctgaaggtgaaggagctcaagaacggtcgtcttgccatgttctctatgtttggattctttgtccaagccattgttactggtaaaggtcccattgagaacttatttgatcatttggctgatcctgtggctaacaacgcctggtcttacgctactaactttgtccccggaaagtaattatcttatgtatttgcttcataatctctctgctttgtaaactcgtgaatgtacttattggtgttttatgtgaatttggcacttaatgc

SEQ ID NO: 435 - DNA, 754 bp, Artificial
  Synthetic
agctacctcactggagagttccccggtgattacgggtgggacactgccggtctatccgccgatcccgagaccttcgctaggaaccgtgagctagaagttatccacagcagatgggccatgctcggagccctaggctgcgttttccctgagctattggctaggaacggagtgaagttcggagaagcggtttggttcaaggctggttcacagatcttcagcgacggaggattggactacttgggcaacccgagcttggtccacgctcagagcatcttagccatttgggctactcaagttatcctcatgggagctgttgagggctacagagtcgccggagatggtccattgggagaagcagaggacttgctttacccaggtgggagcttcgacccattgggcctcgctactgaccccgaggctttcgcggagttgaaggtgaaggagctcaagaacggaaggttggctatgttctctatgtttggattcttcgttcaggccattgtcaccggaaagggaccgttggagaacctcgcggaccacttggctgatccagtcaacaacaatgcatgggccttcgctaccaacttcgtccccggaaagtgagtttaatttgtgatcgagttgtgtgtatccggtttgttgcatcttggaaatgtgatgcagatttcatatcttgtaaattactttgtatgtgtgtgaaatatttaagaagctttatgataaaaaaaaaaaccaaaaaaggcggacgcgtggg

SEQ ID NO: 436 - DNA, 750 bp, Artificial
  Synthetic
tcgactcagcaagagctagacatggcttcgctctcttcctcattggccgggcaagtagtgttgaaggcacagagctcactcgcagcgaaggtgggcaacaatgtattgggcgaggcaagagttagcatgaggaaaactgcctccagagtgtcggtaccggacagcccatggtacggcccagagcgggtcaagtacctaggcccattctccggcgactcgccctcatacttgactggggagttccccggtgactacggctgggacactgctggcctctctgccgaccccgagacctttgcccgcaacagggagctagaggtcatccactgccgatgggccatgttgggcgcactgggctgtgtcttccctgagctcctctcaaagaacggtgtcaagtttggcgaagctgtctggttcaaggctgggtctcagatctttgccgagggtgggcttgactacctgggtaaccctagcctggtccatgcccagtctatccttgccatctgggcttgccaggtcatcttgatgggtgctgttgaaggctaccgtgttgctggtgggccccttggcgatgtaactgaccccatctaccctggtggcagcttcgaccccctagggctagctgatgaccccgaggccttctctgagctgaaagtgaaggagataaagaatggacggctggctatgttctccatgtttggattcttcgtgcaggccatcgtgactggtaagggcccagttgagaacttg

SEQ ID NO: 437 - DNA, 707 bp, Artificial
  Synthetic
gatttctctgagattcgtcctcggttttgagtggtgttgctacaaggtctcgaactatggctaccgctactgtctgcgcatctctgagcagctccaccttcgctgggcaaacggctctcaaaccccagtctgagctttccaggaaggtcaacaatgtcgaggccagggtaagcatgaggaggacagtcaaaactgccccagaaagcatctggtatggttcggaccgccctaagttccttggcccgttctcggagagtaccccctcgtaccttactggcgagttccccggtgactatggctgggacaccgccggactctctgccgaccccgaaacctttgcccgtaaccgcgagctcgaggtcatccactcgcgctgggccatgcttggcgccctgggatgcgtcacccctgagctcctcgccaagaatggcgttaagttcggggaggctgtctggttcaaggccggctcgcagatcttctccgagggtgggctcgactacctcgggaacccgaacctgatccatgcacagagcattctggcgatttgggcatgccaggtggtgctgatgggagctgtggaagggtacagagttggtggcggcccgctaggagaagggctcgacccaatataccccgggggtgcattcgacccactcgggctggccgacgaccccgagtcgtttgccgagttgaaagtgaaggagatt

SEQ ID NO: 438 - DNA, 1096 bp, Artificial
  Synthetic
cgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgcgaagcccaagccggcggcgtcgtcggggagcccgtggtacggcgccgaccgcgtgctctacctcggcccgctctccggcgagccgccgagctacctgaccggcgagttccccggcgactacgggtgggacaccgcggggctctccgccgacccggagacgttcgccaagaaccgggagctggaggtgatccactccaggtgggcgatgctgggcgcgctgggctgcgtgttcccggagctcctcgcccggaacggcgtcaagttcggcgaggcggtgtggttcaaggcggggtcgcagatcttcagcgagggcgggctcgactacctcggcaacccgagcctgatccacgcgcagagcatcctcgccatctgggcggtccaggtggtgctcatgggcgccgtcgaggggtaccgcatcgccggcgggccgctcggcgaggtcgtcgacccgctctaccccggcggcagcttcgacccgctcggcctcgccgacgacccggaggccttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgtgcgtgtgtgtacgcggtgcagtagatgtacgtacgtgtaccgtatagatgtacgtattcgtgtggaccgcgtggatggatgtacgagtattggagagaaggtgagatctgtaccggtagcccgtatttctgtgcaggttctgaacctgatcaatgaaatatggtgttgtgaa

SEQ ID NO: 439 - DNA, 810 bp, Artificial
  Synthetic
gccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctcaaggtgaaggagatcaagaacggccgcctcgccatgttctccatgttcggcttcttcgtccaggccatcgtcaccggcaagggccccctcgagaacctcgccgaccacctcgccgaccccgtcaacaacaacgcctgggcgtacgccaccaacttcgtccccggcaagtgaagtgggggaccgtagcttagcagtggttaattgtggttggatggatttgtggccagcgagttcgttgtctttgggttggggaagatgggtttagtgcgacgagatgatgatcgagttggtgttgtgtacactaagaagatgaagaagaagatgatgtttttgcaataatgattttattcgtttcccaactaatggtctaggtacttatccgtggtgttattctggttagcggatttctcatctctattagatcggaaacaaatacttccctcgatcccaaaatat

SEQ ID NO: 440 - DNA, 712 bp, Artificial
  Synthetic
gcgcgccgggggatacagatttggttggctttgctggcttccccccaaatctgtatcctccggcagcccatggtacggtgccgaccgtgttaagtacttgggtcccttctccggtgagtctccatcttacctcactggtgaattcccaggtgattacggttgggacacagctgggctttcagctgaccctgaaaccttctccaagaaccgtgagctagaagtcattcactgcagatgggcaatgcttgaagctgtatggttcaaagccggttcccaaattttcagcgaaggtggattggactacttgggtaactcaagcttggttcatgctcagagtattctagctatctgggctacacaagttatcttgatgggtgcagttgaaggttaccgtgttgctggtggtccactaggagaggttgtcgacccactttacccaggtggtagctttgaccctcttggccttgctgacgatccagaggcttttgctgaattgaaggtgaaagaaatcaagaatgggagattggcaatgttctcaatgtttgggttctttgttcaagctattgtgactggtaagggacctttggaaaatttggctgatcacctagctgatcccgttagcaacaatgcttggaactacgccactaacttcgcacccggaaagtgaagaaattttgtttgagattgtcagattagattattggaaactgat

SEQ ID NO: 441 - DNA, 870 bp, Artificial
  Synthetic
gaattcagaactggtgaacaacaaagaagcagtagaaaaagagagtcatggccacctctgccattcaaaggtctgcattcgctggtcaaactgctttgaagcaacaaaatgagttcatccgcaaagttggcaatgtggaaggtggtcgtatctccatgcgccgcactgtaaaaagcattcagtcaagcatgtggtatggaccagacagacctaagtacttgggaccattctcagaacagaccccatcttacctcactggtgaatttccaggtgactacggttgggacacagccgggttatctgctgacccagagacatttgcaaagaaccgtgaactcgaagtgatccactgcaggtgggctatgttgggtgccctaggatgtgtcttccctgaggttctctcaaagaacggtatcaactttggcgaggcagtatggttcaaagctggatcacagatcttctctgagggaggtttggactaccttggaaaccctaacttggtacatgcccaaagcattcttgcaatctgggctactcaggttgtgctaatggggtttgttgagggatacagagttggtggtggtccacttggagaaggactagacaaactttaccccggtggatcttttgaccctctaggattagctgatgacccagagtcattctctgaattgaaggtaaaggaaatcaagaatggaagacttgctatgttctctatgtttgggtatttcgttcaggctattgttaccggaaagggtccaattgaaaacctttatgaccacgtcgccgatcctgttgcaaataacgcatgggcttacgctactaactttgctcctggaaaatgaatgtaaattttcctagggtgtatca

SEQ ID NO: 442 - DNA, 972 bp, Artificial
  Synthetic
cgtccgaaaattctttctgtgtgtagtagctgcattttaaagtatttctttttatttctacaatggcagctgctacaatggctctctcttcctctacttttgttggaaaggcagtgaaactctcaccattttcctctgaaatcactggaaatgggaaagttaccatgaggaagacggctagcaaggccaagccagtttcttctggtagcccatggtacggtcctgaccgtgtcaagtacttgggaccattttctggtgagtccccaagttacttgactggtgaatttcccggtgattatgggtgggacactgccggactttcagctgatccagaaacttttgctaagaaccgtgagttggaggtgatccactgtagatgggctatgcttggagctcttggttgtgtcttccctgagctcttggcccgtaacggtgtcaaattcggtgaagctgtatggtttaaggctggatcccaaatttttagtgagggtggacttgactacttgggcaatccaagtttggtccatgcacaaagcatcttggccatttgggcttgtcaagtcatgttgatgggagctgttgagggttaccgcattgctggtgggcctcttggtgaagttgttgacccactttaccccggtggcagcttcgacccattaggtcttgctgaagacccagaggcttttgctgagctcaaggtaaaagagatcaagaatggcagacttgctatgttctccatgtttggattcttcgttcaagctattgtcaccggaaagggtccattggagaaccttgctgaccaccttgccgacccaattaacaataacgcatggtcctacgctacaaactttgttcccggaaaatgaagttctttagaaacaaaaagcacctcctctgttatcacattttttgtctttgtaaagctaatgtaaactttagtgaatattatatgtgaattttgtttgattgtgt

SEQ ID NO: 443 - DNA, 1091 bp, Artificial
  Synthetic
cggacgcgtgggaaaaaccaacccaaccgccgccgcatcgccctcgttagaacgatggccgcgtcggcgctgcaccagaccaccagcttcctcggcaccgcccctcgccgggatgagctcgtccgccgcgtcggcgactccggtggccgcatcaccatgcgccgcaccgtcaagagcgcgccccagagcatctggtatggacctgaccgtcccaagtacctgggcccgttctcggagcagacgccatcgtacctgaccggagagttcccgggagactacgggtgggacacggcggggctatcggccgacccggagacgttcgcgaggaacagggagctggaggtgatccactcgcggtgggcgatgctgggggcgctgggctgcgtcttcccggagatcctgtccaagaacggggtgaagttcggggaggcggtgtggttcaaggccggcgcgcagatcttctccgagggggggctcgactacctggggaaccccaacctggtgcacgcgcagagcatcctcgccatctgggcggtccaggtggtgctcatgggattcgtcgagggctaccgcgtcggcggcggcccgctcggcgagggcctcgacaaggtgtacccaggcggcgccttcgacccgctcggcctcgccgacgaccctgacaccttcgccgagctcaaggtgaaggagctcaagaacggccgcctcgccatgttctccatgttcggcttcttcgtccaggccatcgtcaccggcaagggccccatcgagaacctcttcgaccacgtcgccgaccccgtcgccaacaacgcctgggcatacgccaccaacttcgtccccggcaagtgagcacaacgacacgatcgagatggtgccaaccaacgtaccatgtgtacacttgtagtagccacgcaccgaccctgcagttgcagttgcagcagtgcatgtatgtatgtaccttaattgtgtgtgtgtgtgtgatcgatcgaggagatttctagcttaattaatttctgtctgtcatcatctttgcttctttggatcgagatttaatgtaagccgcaggccgcatccaagggatgatcgaattaatg

SEQ ID NO: 444 - DNA, 648 bp, Artificial
  Synthetic
gaattcactcaaaacatttcgcaatggctgctggaactatggctctctcttctccctctcttgctgggaaggcagtgaagctttcaccagatgtcattggtgaaggaaggatcactatgctcttccaaaagaagacagcagcaaagacagcaaagccaaccaaatctgtatcctccggcagcccatggtacggtgccgaccgtgttaagtacttgggtcccttctccggtgagtctccatcttacctcactggtgaattcccaggtgattacggttgggacacagctgggctttcagctgaccctgaaaccttctccaagaaccgtgagctagaagtcattcactgcagatgggcaatgcttggagctcttggttgtgtcttccctgaattgctttcccgtaacggtgttaaattcggcgaagctgtatggttcaaagtcggttcccaaattttcagcgaaggtggattggactacttgggtaactcaagcttggttcatgctcagagtattctagctatctgggctacacaagttatcttgatgggtgcagttgaaggttaccgtgttgctggtggtccactaggagaggttgtcgacccactttacccaggtggtagctttgaccctcttggtcttgctgatgatc

SEQ ID NO: 445 - DNA, 582 bp, Artificial
  Synthetic
ttttgtgcattcaagagttatcattttacttctacaatggctgcttctacaatggccctctcctcttcttttgccggaaaggcagtaaaactctcattatcttcctctgaaatcaccgaaaaaggaaagttaccatgaggaaaaccactagcaaggccaagcctgtctcttcgggtagcccatggtatggtcctaaccgtgtcaagtacttgagcccattctctggtgagtctccaagctacttgactggtgaatttccgagcgattatggataggatactgctggactttcagctgatccagaaacttttgccaagaatcgtgagttggaggtgatccattgtagatgggccatgcttggagctcttggttgtgtcttccccgagctcttggcccgtaacggtgtcaagttcggtgaggcggtatggttcaaggctggatcccaaatttttagcgagggtggacttgactacttgggcaacccgagtttggtacatgcacaaagcatcttggccatttgggcttgccaagttgtattgatgggagctgttgagggttaccgtattgctggtgggcctctcg

SEQ ID NO: 446 - DNA, 1019 bp, Artificial
  Synthetic
ttttttttttttgttttttaaaaaatcacatgttcttcattaatccaaaccaatttacaccacaataacaatccctttactgaacccatagcccaaaatgcaacaaaaagaccactttttggggttcattactacgtacagggtcacactacttgaaaattagagatcaactattgttaaattcactttccgggaacaaagtttggggcataagcccaggcattgttgttaactgggtctgcaagggggtccgcaaggttttccaacggaccctttccggcgacgatagcttggacgaaaaatccaaacatggagaacatagcaagtctaccattcttgatctcctttaccttgagctcagcaaaagcctctggatcttcagcaagacctaatgggtcgaaactaccaccagggtaaagggggtcaacaacctcaccgagaggtccaccagcaacacggtaaccctcaacggctcccatcaacacaacttggcaagcccagatggctaagatgctttgtgcgtggaccaaacttgggttacccaagtagtcaagtccaccctcgctgaaaatttgggatccagccttgaaccatacagcttcaccgaacttgacaccattacgtgccaagagctcagggaagacgcaaccaagagctccaagcatagcccatctacagtgaatcacctccaactctcggttcttggcaaaagtttctggatcagctgaaagtccagcagtgtcccatccatagtcaccaggaaattcaccagtcaagtagctcggagactcaccggagaatggtcctaagtacttgacacggtcaggaccgtaccatgggctgcctgaagagactggcttagccttggtaaccgccttcctcatgataactttcccatttccaatgatttcagaggaagatgatgagagttttaccgcctttccggcaaatgaagaggaagagagagccattgtagaagctgccattatagaaagaagatgaaaaactcttgaatgcag

SEQ ID NO: 447 - DNA, 958 bp, Artificial
  Synthetic
cccccccgagctcataacaactaactttgacatctcaaactagcaacctctcactttcctcttgataaaccatggctgcttctacaatggctctttcttccccttctttcgctggacaggcagtgaaactctccccatctgcctcagaaatcactggaaatggaagggtctccatgagaaagactgtcgccaaacccgtcgcatctagcagcccatggtacggtccagaccgtgttaagtacttgggcccattctccggtgaggccccaagctacttgaccggtgaattcccaggtgattacgggtgggatactgctggactttcagcagatccagaaacatttgccaagaaccgtgaactcgaggtgatccactgcagatgggctatgcttggtgctcttggatgtgtcttccctgagcttttggctcgtaacggtgtcaagtttggtgaggctgtgtggttcaaggctggatcacaaatctttagtgagggtggacttgactacttgggcaacccaagcttggtccatgcacaaagcatcttggcaatctgggcttgccaagttatcttgatgggagctgttgagggttaccgtgttgctggtgggccccttggtgaggttgtcgacccactctaccctggtggcagctttgacccattaggccttgctgatgacccagaggcatttgccgagctcaaggtaaaggagatcaagaatggcagacttgccatgttttctatgttcggattctttgttcaggccattgttaccggaaaaggtccattggagaaccttgctgaccaccttgcagaccccgttaacaacaatgcgtgggcctacgccacaaactttgttcccggaaagtgaatcttaaaacattctcaaaattctgattgtttgatggccttgtaaagctgttgtgagttacctgacaatataatgcgattttgtttgtg

SEQ ID NO: 448 - DNA, 710 bp, Artificial
  Synthetic
gccattacggccggggaggaagaccgctagcaaagccgagccagcctcttctggtagcccatggtcctaaccgtgtcaagtacttgggcccattctccggtgagtcctcaagctacttgactggtgagtttcctggtgattactgatgggacactgctgtactttcagcttatccagaaacatttgctaagaatcgtgagttggaggtgatccattgtagatgggccatgcttggagctcttggttgtgttttcctgagctcttggcttgtaacggtgtcaagttcgttgaagctgtattgttcaaggctggatcacagattttcagcgagggagggcttgactactcaagtttggtccacgcacaaagcatcttggccatttgggcttgccaagttgtgttgatgggagccgttgagggttaccgtgttgctggtggacctctcggtgaggttgttgacccactttacccaggtggcagcttcgacccattaggccttgccgaagacccagaggcttttgccgaactcaaagtaaaagagatcaagaacggcagacttgctatgttctccatgtttggattctttgttcaggctatcgttaccagaaagggtccattggagaaccttgccgaccaccttgaaagtgaagttcttaactaagaatctcttctagtagttgattggttgatagcccgtaaagctagctaat

SEQ ID NO: 449 - DNA, 1035 bp, Artificial
  Synthetic
tttctttatcacttcagccatcagaaaactcttcattctccttattaagccatggctgcttctacaatggctctttcctcttcttttgccgggaaggcactaaaactctcgccatcttcctctgaaatcaccggaaatgggaaagttaccatgaggaagactgctagcaagcccaagcctgtctcttctggcagtccatggtatggccctgaccgtgtcaagtacttgggtccattctctggtgagtccccaagctacttgactggtgagttccctggtgactacgggtgggacactgctggactttcagctgatccagaaacttttgccaagaaccgtgagttggaggtgatccactgcagatgggcaatgcttggagctcttggttgtgtcttccccgagctcttggcccgtaacggtgtcaagtttggtgaggctgtatggttcaaggctggatcccagatttttagtgagggtggacttgactacttgggcaacccaagtttggtccatgcacaaagcatcttggccatttgggcttgccaagttgtattgatgggagccgttgagggttaccgtgttgctggtgggcctcttggggaggttgttgatccactttaccccggtggcagcttcgacccattgggcctcgctgaagacccagaagcttttgctgagctcaaggtaaaagagatcaagaatggtagacttgccatgttttctatgtttggattctttgttcaggctatcgtaactggaaagggtccattggagaaccttgccgatcaccttgcagatccagtaaacaacaatgcttgggcctacgctacaaactttgtccccggaaagtgatttaacaaaagttcataatctctaatcttcaagtagctagtgtttgatatgtagcttgtgagtgatgaacccaaagaagggtcaggtttattttgagcattctgggttatgggttcattaaagagattttaatgtggtgtaaattggtttggattaattaatgaagaacatgtgaatcttttc

SEQ ID NO: 450 - DNA, 907 bp, Artificial
  Synthetic
cccacgcgtccgtgtttagaagaagcaatggccacttcagcaatccaacactcttctttcgctggccaaacgaccctaaagccatccaacgatctcctccgcaaaatcggagcctccaatggcggtggccgcatcatcatgcgtcgtaccgtcaagtctactcctcagagcatctggtacggaccagaccgtcccaaatacctaggaccattttccgaaaacacaccatcatacctaaccggagaataccctggagactacggttgggacaccgctggtctctcagccgatccagaaacattcgcaaagaatcgtgagctcgaagtgatccacagtagatgggcaatgttgggagctttaggctgcaccttccctgaaattctctcaaaaaacggagtcaaattcggtgaagccgtgtggttcaaggcaggatctcaaatcttctcagaaggagggcttgactacctcggaaaccctaacttgatccacgcgcaaagcatattagctatatgggcgtgtcaagttgtgctaatgggattcattgaagggtacagaatcggaggtggtcctcttggggaagggcttgacccgctttacccgggcggggccttcgacccgttgaacttagcggaggatccagaagcgttttcagagttgaaagtgaaggagcttaaaaacggtcgtcttgctatgttctcaatgtttggattctttgtccaagccatagttaccggtaaaggtccgatcgaaaatctgttcgatcacattgcagaccctgtggctaacaatgcttgggcttacgccaccaacttcgtccccggaaaatagagtttgatcggataatttatgtaaattatatcttttaaacatttatcaatgcattaaagttatccctatatttgataca

SEQ ID NO: 451 - DNA, 858 bp, Artificial
  Synthetic
aacaaatggccacttctgcaattcaagaatctgcatttgttggccggacagtggctaaatcacaaaatgagcttgttaggaaaattggcagctttggcggaggccgtgctaccatgagacgtactgttaaaagcgctcctcaaagcatctggtatggagaagaccgtccaaaatatttgggcccattctctgagcaaactccatcttaccttactggtgaatttcccggtgattacggatgggatactgctggactctcagctgacccaaagacatttgccaaaaaccgtgaacttgaggtgatccattgccgttgggccatgcttggtgctttgggttgtgtcttccctgaaattctatcaaagaatggtgttaaattcggtgaagctgtttggttcaaggcaggagcccaaatctttttagaaggtggacttgactacctcggcaacccaaaccttgtccacgcccagagcatccttgccatttgggcttgccaagttgtcctagtgggcttgattgaaggatacagagttggtggaggcccacttggtgaaggtcttgacaagatctatccaggaggtgccttcgacccacttggcctagctgatgatcccgaggcttttgctgagttgaaggttaaggaaatcaagaatggacgattggctatgttttcaatgttcggattctttgttcaggctattgttacaggaaaaggcccaatcgagaacctttacgaccacattaatgacccagtagccaacaatgcttgggcttttgctaccaactttgtacccggaaagtgaaatgttttgtctgtgttatatgtaaaaatttgggctaatgaagttttctgcttgt

SEQ ID NO: 452 - DNA, 942 bp, Artificial
  Synthetic
tgcagtcaagaatactttcttatctcttccttctacaatggcaactgctacaatgtctctctcttccccttcttttgccggaaaggcaataaaactctcaccatcttcctctgaaattactggaaatggaaaagtcaccatgaggaagactgttaccaaggctaagcctgtctcctctggcagcccatggtacggtcctgatcgtgtcaagtatttgggcccattttctggtgagtccccaagttatttgactggtgaatttcctggtgattacggttgggatactgctggactttcagctgatccggaaacctttgccaaaaaccgtgagctagaggttattcactgcagatgggctatgcttggagctcttggttgcgtctttcctgagctcttggcccgtaacggtgtcaagttcggcgaagctgtatggttcaaagctggatcgcagattttcagtgagggtggacttgactacttgggcaacccaagcttggtccacgcgcaaagcatcttggctatttgggcttgccaagttgtgttgatgggagccgtcgagggttatcgtattgctggtggacctcttggtgaggttgttgacccactttatcctggtggtagttttgacccattgggtcttgcagatgacccggaagcttttgctgagcttaaagtaaaggaaatcaagaatggcagacttgctatgttttccatgtttggattctttgttcaagctatcgtcaccggaaagggtccattggagaatcttgcagaccatcttgcagaccccgttaacaataatgcttgggcatatgccacaaacttcgtccctggaaaatgaagttcataaaagagtcttgttctattgccttgttgtttgatggttctgtaaagttattgtgaattacaaaaaaatgacaatatgaaatttgttcggtctcc

SEQ ID NO: 453 - DNA, 905 bp, Artificial
  Synthetic
gaattcgttagccatggcagcttctacaatggctctatcttcacccgcattggctggtaaggcacttgttccttccagctctgaagttttcggtgaaggcagaatctccatgagaaaaaccgttgcaaagccaaaaaccgtttcatctagcccatggtacggacctgaccgtgttaagtacttgggaccattctctggtgaatctccatcgtacttaaccggtgagtttgccggtgattacggttgggacactgccgggctttctgctgacccagaaaccttcgccaagaaccgtgagctggaggtcattcactgcagatgggctatgttgggagctcttggatgtgtcttccccgaattgttgtctcgcaatggtgttaaatttggtgaagccgtttggttcaaggccggttcacaaattttcagtgaaggtggtttggactacttgggtaacccaagtttggttcatgctcagagcatccttgccatttgggcaacacaagttatcttgatgggagcagttgaaggttacagagttgcaggaggaccattgggtgagattgttgacccactttaccccggtggaagcttcgacccattaggcttagctgatgacccagaagcttttgctgaattgaaggtgaaagagatcaagaacgggagattggctatgttctccatgtttggattctttgttcaagcaatcgtcaccggaaagggtcctttggaaaacttggctgaccacttagctgatccagtcgccaacaacgcctggaactacgccagtaactttgctcccggaaaatgatctgattaatcggtaatcagatgaaatggacgtgttactccccgaatttgcattttggagaattgtttgacgtgcgtttgtatgtacattttaaccc

SEQ ID NO: 454 - DNA, 693 bp, Artificial
  Synthetic
gaattcagggctgcttcaacaatggctctctcttctccttctcttgctggaaaggcagtgaagctaactccatccattccagaacgcgaaggaagaattaccatgctcttccagaaaaagacaccggcaaaagcagctaaatcatccaaacccgcagtttcatctaacagcccatggtatggtcctgacagagttaagtacttgggacctttctccggtgaggcaccatcatatctcaatggtgaatttcctggtgactatggttgggataccgctgggttatctgctgatcctgaaactttcgccaagaaccgtgagcttgaagtgatccattgcagatgggctatgctcggagctctaggatgcatcttccctgaattgctctcgcgcaatggagttaaattcggtgaagccgtttggttcaaagccggagcacagattttcagcgagggaggattggactacttaggtaactcaagcttagtacatgctcaaagcattttagctatttgggcgacacaagttatcctgatgggtgcagtggaaggttaccgtgtcgccggtggacctcttggtgagattgtcgacccactgtaccccggtggcagcttcgaccctcttggacttgctgatgacccagaggcttttgctgaatggaaggtgaaggagattaagaacggaagattggcgatg

SEQ ID NO: 455 - DNA, 940 bp, Artificial
  Synthetic
gaattcaggtaagaatggcaaccatggctctgtcttctccatcatttgcaggcaaagctgtgactctaaacccgggaacagaattcccaaccaatgtaagatctggcagcaacagcaagatctcgatgaggaagacatccgcaaagaagcctgctgcttcttcaggaagtccatggtatggtccagaccgtgtcaagtacctcggtcccttctctggtgagtctccatcctacttaactggtgaattcgctggtgactatggttgggacactgctggactatcagctgatccagagacctttgccaagaaccgcgaacttgaggtgatccattcaaggtgggcgatgcttggcgctttgggctgtgtcttccctgaactcctctcgagaaatggagtcaaattcggcgaagcagtttggttcaaagccggctctcagatattcagtgaaggaggacttgactatttgggaaattccagcttggttcatgcacagagcatcctggctatatgggccactcaagtcatccttatgggcgccgtcgaaggctacagagttgctggcggtccactaggtgaggttgttgatcccctttacccaggtggaagcttcgatccattaggcctcgcagaggacccagaggcatttgccgagctaaaggtaaaagaactaaagaacgggcgacttgctatgttctccatgtttgggttcttcgttcaggctattgtgacgggcaaaggtcctctagagaacctggcagaccaccttgccgacccagtgaacaacaatgcctggtcatatgctacgaacttcgctcccgggaagtgagcataagcatagcaaaggcaaaatggagtttgatttcctactttttttctgtaatatcctctgtacattcatttagcttgtaaaattgtgtagaatgtagctgcggttggtct

SEQ ID NO: 456 - DNA, 591 bp, Artificial
  Synthetic
cacactcgctcgctcatcgccatctctctcagctctcacagctcactgcatcaatggccgcggccaccatggcgctctcctccccggtgatggcccgcgcggcgccgtcgacctcctccgcgctcttcggcgaggcgcggatcaccatgcgcaagaccgccgagctacctcaccggcgagttcccgggcgactacgggtgggacaccgcggggctctccgccgacccggagacgttcgccaagaaccgggagctggaggtgatccactcccggtgggcgatgctgggcgcgctcggctgcgtcttcccggagctcctcgcccggaacggcgtcaagttcggcgaggccgtgtggttcaaggcgggctcgcagatcttcagcgagggcgggctcgactacctcggcaacccgagcctgatccacgcgcagagcatcctcgccatctgggcggtgcaggtggtgctcatgggcgccgtcgaggggtaccgcatcgccggcgggccgctcggcgaggtcgtcgacccgctctaccccggcggcgccttcgacccgctcggcctcgccgatgaccccgaggcgttcgcggagctc

SEQ ID NO: 457 - DNA, 1060 bp, Artificial
  Synthetic
aggactttggtcctacctagttatttatatacagttgctgcaaggccattaaactcaagccataaatcaaatattctttctgtgtagtagctgcattttcaagagcatttcactttatttctgcaacaatggcagcttctacaatggctctctcttcctcttcttttgccggaaaggcgctgaaactctcaccatcttcctctgagatcaccggaaatggaaaagtcaccatgaggaagacagttaccaaggcgaagccagtctcttctggcagcccatggtatggtcctgatcgcgtcaagtatttgggcccattctctggtgagtctccaagctacttgactggtgagttccctggtgactacggatgggatactgctggactttcagctgatccagaaacttttgctaagaaccgtgagctagaggtgatccactgtagatgggccatgcttggagctcttggttgtgtcttccccgagctcttggcccgtaatggtgtcaaattcggtgaggctgtatggttcaaggctggatcccagatttttagcgatggtggacttgactacttgggcaacccaagtttggtccatgcacaaagtatcttggccatttgggcttgccaagtcgtgttgatgggagctgttgagggttaccgtgttgctggtgggcctcttggtgaggttgtcgacccactctatcctggtggtagctttgacccattaggtcttgctgatgatccagaggcttttgctgagctcaaggtgaaggagatcaagaacggtagacttgccatgttctcaatgtttggattcttcgttcaggctatcgtcacaggtaaaggtccattggagaaccttgctgaccaccttgccgatccagttaacaacaacgcctgggcttatgccacaaactttgttcccggaaagtgaagtacttaacaatttttgtctactctggtatcatatttttatggagcttgtaaagtaaattagtgaagattatatgttaattttgtttaattgtgtagttttcagttaaattttatgtgcttttcatg

SEQ ID NO: 458 - DNA, 1004 bp, Artificial
  Synthetic
catttatatacagttgatgcgggctcattaaactcaagccataaatcaaatattttttctgtatagtagctgcattttcaagagcatttcactttatttctacaacaatggcagctactacaatggttctttcttcctcttcttttgtgggaaaggcggtgaaactctcaccatcttcctctgagatcaccggaaatggaaaagttaccatgaggaagactgttaccaaggcgaagccagtctcttctggcagcccatggtatggtcctgatcgtgtcaagtacttgggcccattctccggtgagtccccaagttacttgactggtgagttccctggtgattatgggtgggacactgctggactttcagctgatcccgaaacttttgcaaagaatcgtgagctagaggtgatccactgcagatgggccatgcttggagctcttggttgtgtcttccctgagctcttggcccgtaatggtgtcaaattcggtgaggctgtatggttcaaggctggatctcaaattttcagcgagggtggacttgattacttgggcaacccaagtttggtccatgcacaaagtatcttggccatctgggcttgccaagtcgtgttgatgggagccgttgagggttatcgtgttgctggtggacctcttggtgaggttgttgacccactctaccctggtggtagctttgacccattaggccttgctgatgaccccgaggcttttgccgagctcaaggtgaaggagattaagaacggtagacttgctatgttctccatgtttggattcttcgttcaggctatcgtcaccggaaaaggtccattggagaaccttgccgatcaccttactgacccagttaacaacaacgcctgggcctatgccacaaactttgttcccggaaagtgaagttcttaaaaaatatgtctcctctggtatcacttttgtatggagcttgtaaagctatggtagtttagtgaagattatatgtgaattttgttt

SEQ ID NO: 459 - DNA, 674 bp, Artificial
  Synthetic
tggtatcaacgcagagtggccattacggccgggggggattgatccagtcacacaccagccaattactgttaaccaaccaaacatagaacagccaacaaaaaatcaaccaattattcaacaagaaaaacaaacaacaatgccaatttccccatctcatgttgtcccagaaataatggatattcttgatcacaacaaggagctggttgaaactcctatattatcaacaatcacagatatcaaattagacgacgacaacaacaataacagcaatatcaacaataataagaatacggggacaagcttctgtactgacgaagtccccgtaattaaaccacatgaaattttattccattctgaatcaaccacttcaacatcatcatcttcttcaccaacatccattattcttgaagatacgcagtttgatttcaattggggagatgatttcagcagaacattggattatttacttaatgatgatattgacatgaataatgtcatttcccaagattggtcaaaggtgttggaagtttgagcaaattttacttgtgattaattttcaaaggggggctgaattaagctttgttcttttgattggcaagtcacttttttcttttttttggtctatagaagtttagatggtagttgttactaaagtaaatggacaataaaagtct

SEQ ID NO: 460 - DNA, 640 bp, Artificial
  Synthetic
gcagcatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatga

SEQ ID NO: 461 - DNA, 668 bp, Artificial
  Synthetic
gcagcatggggagacaaccatgctgtgacaaagtagggttgaagaaaggaccatggactgcagaagaggataggaagctcataaacttcatccttaccaatggacaatgttgttggagagctgttcctaagctttctggtcttcttaggtgtggcaagagttgcagacttcgttggactaactatcttagaccagaccttaagagaggtcttctctctgattacgaagagaagatggtcattgatctccattcccagcttggaaacaggtggtcaaagatagcttctcatttaccaggaagaacagacaacgaaatcaagaatcattggaacactcacatcaagaagaagttgaggaaaatggggattgatcctcttacacataaaccactctctatcgtcgaaaaagaagacggagaacccttaaagaagctacagaataatacagttccttttcaagaaacaatggagcgtcctttagagaacaacatcaagaacatatcaagacttgaagagtctttaggtgatgatcaattcatggagataaatcttgagtatggtgtcgaagatgtccctcttattgaaacagagtctttagaccttatctgcagcaattcaacaatgtcttcatccacgtccacatcttcgcattcttctaatgattcgagt

SEQ ID NO: 462 - DNA, 444 bp, Artificial
  Synthetic
cggacgcgtgggcggacgcgtgggctcagagaaagcaatctgaaatccttgcatgggagaacagcaagaaagcaagcttggaggctgagctcaaaaagattgaggagcaattgttgaaaaagaaggcagagtacattgagaaaatgaaaaacaagattgctctactccacaagtcagcagaagaaaagagagcgataattgaagctaaacgtggagaagatcttcttatggcagaggaaacagcagcaaaacaccgtgccactgaaacttctccaaagaaacctctccttggatgtttttgaagtggcaaaatatcatatactcctatacaattattggttacaaacattgtatagtgaagtgtgcggactgggaatttctttgcattagaaacaacattgtgagattatgctcctggagataattatctgtcaatttttattg

SEQ ID NO: 463 - DNA, 567 bp, Artificial
  Synthetic
atcatatggcagaagcaactccagtatctcaagaagcagctgttgataattctcctgctgccatggctaccaaagctgatgattctaaagctctcgccactgttcctccaccaaagactgattcttcaacaaagaagagttcaaagggatccctcgatagagacattgctctcgcacaccttgaaacagagagaaggaattcttatattaaggcatgggaagaaagtgaaaaaagcaaggtggaaaacaaggccgaaaagaagctctctgcagttgggacatgggagaacaccaagaaagcaaatcttgaagctaaactgaagaaacttgaggagcaactagaagaaaagaaagcagaatatgcggagaagattaaaaatagagtagccgcagttcacaaggaggctgacgaaaagagagctatggttgaagccagaaagggagaagaacttcttaaagcagatgagatggctgccaagtatcgcgccaccggacaagcccctaagaagttgcttggatgccttggatgctaaagctgtgaaaagtttgtttctcttttgtaaattt

SEQ ID NO: 464 - DNA, 613 bp, Artificial
  Synthetic
gcagcatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaat

SEQ ID NO: 465 - DNA, 740 bp, Artificial
  Synthetic
gggcggacgcgtgggcggacgcgtgggaaaagatctttcatctttcatttctgagactctgattctgttccaaatcctagaattcttcttttttctgaattctgtttgtagccatggcagaagtagaagctacgaaagtggagactgagaaagttgtggaccctactccccctgcacctgaggctcctgcacctgttaaagaagcagaacctgttgttgaaactcctaaagaagtggctgatgagaaagctatagttgcaccagctctgcctcctcctgaacaagtcaaagaaaaatccgatgattctaaagcactagttgtcgttgaagataaacctgctgaggagaaaaaggagggatctattgacagagatgctgtgcttgctcgagttgcaacagagaagagactgtcactaatcaaagcatgggaggaaagtgagaaatcaaaagccgaaaacaaagctcagaaaaatgtatcagcaattgctgcatgggagaatagtaagaaagcaaacctggaggctgagctaaaaaagatggaggagcaggtggagaaaaagaaggcagaatatattgagaaaatgaaaaacaaaatcgctctactccacaaggaagcagaggaaaagagagcgatgattgaagctaaacgtggagaagatcttcttaaggcagaggaattggcagcaaaataccgcgccactggaactgctcccaagaaactccttggatgtttttgaagc

SEQ ID NO: 466 - DNA, 602 bp, Artificial
  Synthetic
cccgaacactcgagcgatccgtccgtccggccgcccgtcgtcgtcgcgcgccatggctgaggaggaggccaagaaggtggaggtggaggtcaccgaggcgccacccgccgctgccgctgccgcggagacggagccggctgccaaggacgtcgccgaggagaaggccgtcatccccgcccccgcgccgccggccgaggaggagaagcctcccgtcgacgactccaaggcgctggccatcgtcgagaaggttgcagatgaacctcctgccgagaaacctgctcaagggggctctaatgacagagatgttgctcttgcaagggtggaaactgagaagaggaactcattgatcaaagcatgggaggaaaatgagaagacaaaagctgagaacaaggcttcgaagaagctatctgctattctttcctgggagaacacaaagaaagcaaacatagaagctcaactgaagaagattgaggagcaactggaaaagaagaaggctgaatatgcagagaagatgaagaacaaagtcgcgatcgtccacaaggaagctgaggagaagagagcaatggtcgaggcaaagcgcggcgaggaagtcctaaaggccg

SEQ ID NO: 467 - DNA, 608 bp, Artificial
  Synthetic
gctgtttgttttggcgataccatttgcatggcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgac

SEQ ID NO: 468 - DNA, 686 bp, Artificial
  Synthetic
agatcaaaagcaagaggtatccacactccgatcaattgccagcccacactctgaattctgaaaatagttttgttagtttggagtgaaaagccatggcatctttggcaacctttgctgcagtgcagcccactaccaatgtcaagggcctagctggaagctccattactggaactaagcttcatctcaaatcatctcgcctcaatttgaagaccactaaatccagggccggccctgtggttgccaaatatggtgacaagagtgtatactttgatttggaggatttgggcaacaccactggccagtgggacctgtatggatcagatgcaccttcaccatacaactctcttcagagcaagttctttgagacatttgctgctccattcaccaagagaggtcttttgctcaaattcttgatattgggaggtggctccacccttgcttacttcagttcgacagcatcaggggatatcctaccaatcaagaaaggtccacaacttccacccaagctcggcccacgcggcaagatctaattgctttcggtccaaaattcaaccttcaatttgtaattgatgtatgtttccccagtttgtgtaagtataattgaagactttccattataacaagttatatcttatggaaaatttgtagcattgctttcttacttggtggcttctgatattctactc

SEQ ID NO: 469 - DNA, 705 bp, Artificial
  Synthetic
gccattacggccggggagttttgttagttttaacttgaagtgaagactatggcatctttggcaactcttgctgcagtacaacccacaactgccgtcaatgggctagctggaagctccattattggaactaagctacatgttaaatcatctcgctttaatttgaagtctactaaatccagggctggttctgtggtagcaaagtatggagacaagagtgtatactttgatttagaggacttgggcaacaccactgggcagtgggacttgtatggttcagatgcaccttcaccatacaatccccttcagagcaagtttttcgagacttttgctgctcctttcactaagagaggtctgttgctcaaattcctgatattgggaggtggctcaactcttgcatacttcagttcaacagcatcagcggatatattaccaatcaagaaaggacctcaacttccacccaagcttgggccacgcggaaagatctaatttcttttcaatccaactttctcaaccttcattttgtaattgatgtatctgtcaccagcttgtaagtattcttgaagcctacctgagacctttgttacagaagttaaatcttattgcaaagttggagcattgctttctagcttgtcgtcttgtgatatcgagtgttgagatgttactttaattggttcaggtaggtgtcaatgaataatgattttaatt

SEQ ID NO: 470 - DNA, 645 bp, Artificial
  Synthetic
gccattacggccggggagtaaaccacataattaattagggacagctttcctagtttggacagaaaactatggcgtctttggcaactcttactgcagttcagcccaccaccacaatcaaaggactagctggaagctccattgctggaacaaagcttcatgttaaatcatctcgtctcaatttgaagctctctaaatccagggctggtgctgtggtagcaaaatatggtgacaagagtgtatattttgacttggaggatttgggcaacactactggtcagtgggacttgtatggctcagatgcaccttcaccctacaactcccttcagagcaagttctttgagacatttgctgctcctttcacaaagagaggtttgttgctcaagttcttgattttgggaggtggctcaactctcgcttacttcagttcaactgcatcaggggatatcctaccaatcaagaaagggcctcaacttccaccaaagctcgggccacgtggcaagatctaattgcttttcgatccaaatttcttgaccttcatttcataattgatgtactatctatcacagcttgtaagtataaattaaagcctttctcagacctcttttcaacaagtaaatcttctagaaaatttgatgcattgctttc

SEQ ID NO: 471 - DNA, 563 bp, Artificial
  Synthetic
gcaaggatagcagagagagagagagagagagccatggcaggattagcatcgacatcttccgccgtagcatgcggtgtgacctcgtcttctctctctggccagaagcttgctattgcgcactccaacctctctcttcccagggctagcccaagagcgggagtagctgtcgctaaatatggtgagaagagtatgtactttgaccttgaagatatcggtagcactaccggttcttgggacctctatggagccgatggaccttccccctataatggattgcagagcaagttctttgagacaactgcaggagcatttacccgtcgaggcattcttttgaagttcttggtcttgggtggaggcggcactcttgcctacgttagctccactgcaggaaaagttgtcctgcccatcaacaaaggacctcaggagccccctaaggttggaccccgaggcaagatctgagtattaactctatgtatcaaatctatctctcatgtggattccaaaagaactgataaatccagataagttggcttttctgtgtagaaaaaacaaacaaacacaac

SEQ ID NO: 472 - DNA, 794 bp, Artificial
  Synthetic
gaattcatgaagaacaaatctcagtataaacgagaaaaatctactacgtagagccgttctaaagctcggttaagaatacaaatggaaaatcaaaccctatgcttaaaaatattcttccttttgttacataaattttaggaagaaaatgaagaacaagagccatacaaattctcatgtgtcctctatgaatggcttctcttgcaaccttagctgttgtacaacctaccgtcgttaaaggcctcggaggaagctccatcaccggaaccaagctttcggttaagactactgctcgtcgtagtctgagacaaactaaaatcaggactggtgccgtggttgccaaatacggtgacaaaagtgtgtacttcgacttggaagacatcggtaacactaccggacaatgggacttgtacggttctgatgcaccatctccctacaactctctccagagcaaattctttgagacatttgcagctccattcaccaagagaggtttgttgctcaagttcttgataattggaggaggttcaacacttgcatacttgagttcaacagtctcaggtgacatcttaccaatcaagaagggtcctcaattgcctcctaagatgggtccacgtggaaagatctaaatgctgaaaatggaaactcgacatcctttgtggttgagttacagtttatcttaattttcagaatttgtaactatgacattggtttataactagtcttgttttcgtgtgtacatcataaacgattcggttcgaaggcaatttaagatcattttatgataaaaaaaaaaa

SEQ ID NO: 473 - DNA, 657 bp, Artificial
  Synthetic
cccccccccaaaaaagccaaggtatccacactggaaaccaattgccagcccacagttataattctgaaagtagttttgttagtttggagtgaaagccatggcatctttggcaacccttgctgcagtgcaacctacgaccaatgtcaagggcctagctggaagctccattactggaactaaacttcatctcaaatcatctcgcctcaatttgaagcccactaaatccagggctggctctgtggtcgccaaatatggtgacaagagtgtatactttgatttggaggatttgggcaacaccactggccagtgggacctgtatggatcagatgcaccttcaccatacaactctcttcagagcaagttctttgagacatttgctgctccattcaccaagagaggtcttttgctcaaattcttgatattgggaggtggctccacccttgcctacttcagttcgacagcatcaggggatatcctaccaatcaagaaaggtccacaacttccacccaagctcggaccacgtggcaagatctaattaatttttgatccaattatcaaccttctatttgtaattgatgtatgtttcccagtttgtgtaagtatgtataattggagactttccattataacaagttatatcttaagctgaatttgtgg

SEQ ID NO: 474 - DNA, 702 bp, Artificial
  Synthetic
cgtgcacgtacgtgtagccgccgccgcagatagtacaccggctatctatccatctatctactcagctttgcgtcctcccgcgaattcaccgcagcaatggcgtccctcgtcgccgtccagccggtcgccgtgaagggcctcgccggcagctccatctccggcaggaagctcgccgtcaggccgtcgccccgggcgctctgccgcaccacccgcaggccgcgcgccgccgtggtggccaagtacggcgagaagagcgtctacttcgacctcgaggacatcggcaacaccaccgggcagtgggacctgtacggctccgacgcgccgtcgccgtacaaccctctccagagcaagttcttcgagacgttcgcggggcccttcaccaagagggggctcctgctcaagttcctgctgctcggcggcggatcgctggtggcctacgtcagcgcgtcggcgtcgccagacctgcttccgatcaagaagggcccgcagctgccgccgacgcccggcccacgcggcaagatctaaattaaattcctcgtctctgcctcaccttcttcttgatccgatccatccatgcaaatcctctgtactgtactgctagtcccccatggccggatcgccatggattaattccccctgtttatgatgttgatataattgtactattcctatggctatataagttgtaaaggatccaattcg

SEQ ID NO: 475 - DNA, 357 bp, Artificial
  Synthetic
gccattacggccgggggcctacaacaaatctcagaacgttgacctatgtggctcatgctatggcttcaatggccggcctaataggctcttctcaaactgtgtaggatggtcaggtctgtggttcaacccgtttgatcactgttagcaccaccataatagccttggctataccacttctcaggattacagcccaacaggggtctgctgacactgaaactacccgtaaagccgtcatcggtcttgatgctgctggccttgctggatcctttgctcaagcaccctttgctgcaactaaatcaatcaggattggaggctgctcctcctccctgcggaggattacctgaaactttgaactct

SEQ ID NO: 476 - DNA, 626 bp, Artificial
  Synthetic
gaattcaagaggagtaacggcaagcaaagtagtaggggcgcaagctatagcatcagtatctggcttaagcagcttctcgcaaggtacaaacagattgaatgtggctactaccaacagccgaacggccagaagtcgtgttggtttcagcgttagatctgagaagaagtcggaatcggagactgctcagagtagccgtagagcactattgggtgtcttagctgtgggactgaccactggatctttcgtaaagaatgtgcttgctgatgctaggcctattgtaatcgggccacctcccgctccttccggtggtttaccggggactctaaattctgatgaagcaagggacttagatctacccctaaaaacaaggtttttcctacagcctaagactccagaagaagcagctcagagagtaaaagaatcagcgcaagcgatcctaggtgccaaggcacagatagacaaaaaggcatggccgtatgtccagaatgaactacgatccagcgccgaatatcttcgttacgatctcagaactatcatctctgcaaagcccaaggatgagaagaaaccactcaaagaactgtctgacaagctcatccaaaacctcaatagtctggactatgctgcaa

SEQ ID NO: 477 - DNA, 852 bp, Artificial
  Synthetic
gtaccacaacattaacttataatttcccccacgctacttctatcaccctgcctaaaacaaatttcagaaggttcaccaaaatggctcatgctatggcttcaatgggtggcctaattggttcttctcaaactgtgttggatggtcagctctgtggttcagcccgtttgagcactgttagcaccagcagaattgccttggctagaccaggtctcagcattagagcccaacaggggtctgctgacactgaaactagccgtagagccgtcatcggtcttgttgctgctggccttgctggttcctttgctcaagcagcctttgctgcagctaaatcaatcaagattgggggcgctcctcctccctctggtggattacctggaactttgaactcggatgaggcaagggactttggtctaccattgaagaagaggttttaccttcaaccattgactccagctgaagcagcccagagagttaaggattcagccaaggagattgttagcgtcaagaatttcatcgacaagaaggcctggccatatgtccagaatgaccttcgtctcagagcagaataccttcgctatgaccttaaaaccgtcatctctgctaagccaaaagaagaaaagggaaaactccaggacctgactggaaagctcttcaagaccattagtgatctggaccatgcagcaaagaccaagaacagccctgaagcagagaagtactatgctgaaactgtatctaccttaaatgatgttttggccaaacttggttaaaaagcttttctgaactagtatgttattacttcctgtaacttatcgaatacttcttgaatccaattgtgaagaatgattttggatg

SEQ ID NO: 478 - DNA, 723 bp, Artificial
  Synthetic
gaagaggagacagaagaagaagaagaagaagaaaagaagaaagagagatggcggcaatctcgtcgtctctgggcctcagcaaggcacagctcgtcggctcattcgatgctagcgatgcggcgagaggctcttcttctcgcgttggaatcgcgagatcgaagtgtgtgatccgcgcgatgcagcaagaacacgatccatcgagacgagcagcagtctttggcctggtcgcagtggccgcgggcgtactggcagtggaggaatcgcgagcagtgagtggaatcaagatcaatgggccacctccaccatccggaggacttcctgggacggagaacgccgatcagccgcgcgacttggatctgccactcaaagagcgatttttcatccagccgctgtcgccagccgaggcagtggatagaatcaaggacgcgtcgaaggacattgtgggagtaaaggagctgatcgagaagaagagctggccgtatgtccgcaacgatcttcgcagcaaggcgacttacttgaggtatgacatcaaaaccatcctggatgccaagcccaaggcccagcgcaaagagctcaagaaatacacggacagtctcttcgacacaattgacaagcttgactatgcagctcgagcaaaggatcccgcagccgcgagcaagtgctacagcgacaccgtagctgcattggacactgttattgccaaaatctcggcataaatatata

SEQ ID NO: 479 - DNA, 634 bp, Artificial
  Synthetic
ggaagatggctcagcagtagcgatggccgggcttgctcatccctctcctcggccgcttcctcgctcgacggggccggctctcgcctcttggcctcctccccttcttcctctgccccctctaaaccatcccttcgcctccctttaatccgcgctagctcgtcgaatccctcagaagacgcttctgctaaatctagtactagacgccaaatcttgtccctcgttgctgtctctgctttgcttgtctctaaacaagccctcgccgaccctagccctatcaagctctttggccctcccgccccttctggtggcctccctgggactgaaaatgccgacgaagctcgagatctagacttgccattgaagaatagattttacctgcaacctcttcctcccgtggaagcgatcgccagggcgaaggaatctgccaaagagattgtgaatgtgaaggcattgatcgacaagaaggcttggccctatgtccagaacgggctccgatcacaggcttcctacctgcgctttgacctcaacactgttatcgcttccaagccgaaggatgaaaagaaagctctcaaaagccttagcactaagctctttaacactatcaataatctggactatgctgctagaagcaaaa

SEQ ID NO: 480 - DNA, 414 bp, Artificial
  Synthetic
cggacgcgtgggtgccaccaacagattctgcagctagagttttaagaatctgcaaaggatatcataaatgtgaagccattgatcgacaggaaagcttggccatatgttcaaaacgatcttcgttccaaggcttcttatcttcgttatgatcttaacacaatcatttcctccaaacccaaggatgagaagaagtcactcaaggatctcaccaccaagctcttcgataccatcgacaatctggattatgcggcgaagaagaagagtccttcgcaggctgagaagtactatgctgagatagtctctgctttgaacgaagttcttgccaagcttggttaagcattttaatttctgcatttttcttgtaaattattattcttggtttttggtcttgagtactttagactcaaattcgtg

SEQ ID NO: 481 - DNA, 760 bp, Artificial
  Synthetic
cccacgcgtccgaaaaaaaatggctcaagcagtgacttcgatggctggcttacgtggagcatctcaggctgtccttgaaggaagtttacagatcaacggctcaaaccgtttgaacatctcaagagtctcggttgggtctcagagaaccggacttgtgatcagggctcagcagaacgtgtcagtaccagaaagtagtcgccggtcagtgattggactcgtggcggctggtttagccggtggttcattcgttaaagctgttttcgccgaagctattccgatcaaagttggtggtcctccacttccttccggtggcctacctggaacagataactcagaccaagcaagagacttttcattggcattgaaagatagattttacatacaaccattgtcaccaacagaagctgcagctagagccaaagattctgctaaagagatcatcaacgttaagtcatttatcgacaaaaaagcttggccctatgttcagaacgatctccgtttaagagcatcgtacctccgttacgatctcaacaccgttatctccgctaagcctaaggaagagaagcaaagccttaaagatctcaccgcaaagcttttccaaaccattgacaacttggactatgcggcgagatcaaagagtagcccagatgctgagaagtattactcagaaactgtctcgagtttgaacaatgttcttgccaagctcggttaatgaagaaagacttgcgttgtaatctgttgatgtcgatgttattataat

SEQ ID NO: 482 - DNA, 614 bp, Artificial
  Synthetic
atttccatcccacagcaaaaaacctgccgccgccgctccggtggtaaaacccccaaagttttatcccgccgatgacgtagcaaaaccgcttgtgaacaaacacaagccaaaacctacaaaactcagagcaagcattacacctggaaccgttttgattatcctagctggtaagtttaaggggaaaagagttgtgttcttgaaacagcttgcgtctgggcttctgcttgttactggaccgtttaagcttaatggagttcctttaagacgtgtgaatcaagcttatgttattggtacctcgactaaggttgatgtttcgggtgtgaatgtggagaagtttgatgataagtattttgctaagcaggttgagaagaagcagaagaagggagaagaggagttttttgaagacaagaaagaggagaagaatgtgcttccacaagtaaagaaagatgaccagaaaaccgtagatgcagctttgctcaaggccattgatggagttcctgaattgaaggcttatttgtccgcgaggttctcactcaaggcagacatgaaaccacatgaacttgtcttttagaggaacaacatctacaacacttttttttggataaattgatttt

SEQ ID NO: 483 - DNA, 560 bp, Artificial
  Synthetic
ccggctctcgccctctccgcaccagctccccgccgagagcgccgcgagctgatccaatggcgccgacgtcgaagctgtcgcagggcatcaagaaggcgtcgcggtcgcacacgtaccaccgccgcgggctgtgggccatcaaggccaagcacggcggcgccttccccaaggccgagaagcccgccgccgcagccgccgccgccgcgcccaagttctaccccgccgacgacgtcaagccccgccagcccagcacccgcaagcccaaccctaccaagctcaggtcgtccatcacgcctgggacagtgctgatcctgctcgccgggaggttcatggggaagcgcgtcgtgttcctcaagcagctcaaatccggcctgcttctcgtcaccggaccttttaagatcaatggagttccgatccgccgtgtgaaccagccctacgtcattgctacgtccacaaaggttgatatctctggtgttaatgtggagaagtttgatgacaagtacttctctagtgacaagaagcagaaggcgaagaagaccgagggtgaactttttgagact

SEQ ID NO: 484 - DNA, 670 bp, Artificial
  Synthetic
acaacaccctaaacatcaaaaatgtccaagcagatcggaggagccaagaacggcggtagccgaaccgtccccactgagaaggcccccaagtggtacgtcgctgagcccactcacgtcaagatccccaccgtccagaacaagtccaagctgcgaccttctcttgttcccggtgccgtactcattctccttgccggccgattccgaggcaagcgagttgttctcctcaagtctcttgaggatggcactctccttgtgaccggtcccttcaaggtcaacggtgtccctctccgacgagtcaacgcccgatacgtcattgccacctccactaaggtcgatgtctccggtgtcaaggctgacaagttcacccctgcctacttcgctcgatcttccgccgacaagaaggccgagaagcagttcttcgccgagggcaagcagaaggagctcaaggccgagcgagtcgccgaccagaaggacgtcgatgctgctctcattgccgagatcaagaagactcctcttctcaagcagtacctggcttcccagttctctctcaagtctggtgacaagccccacctgctcaagttttaaattataaaaacacaaaatggaacatgggggtggaaaatggtggacggtggtgaagccgtcgtctgtcaaaagctgtatagcaatg

SEQ ID NO: 485 - DNA, 721 bp, Artificial
  Synthetic
gacaccagcaattcgaaatggcggacaccaaccccacgacccagaagttctccaagggcgagaggtcgataccgcaccactcgcagaaggccagcaagtactaccctgctgaggacgtcgccgtccccaagaaggcccgtaagactgctcgcccggcgaagccccgtgcctccctccagcccggtagcgtcgtcatcctccttgctggtcgcttccgcggcaagcgtgtcgttctcctcaagcaccttccccagggtgttctcctcgtcaccggtccccttcaaggttaacggcgttcctctgcgacgagtcaacgcccgctatgtcatcgctacctccaccaccgttgacattaagggtattgatgagggtgtcctgaagaaggcctccgaggagggctacttcaccaaggacaaggccgcgcacaagcctggcgaggatgctttcttcaagcagggcgagaagcccgagaagaaaggagacctccaaggaccgcgttgaggaccagaaggccatcgacaaggccctttttgggcaacattaagaaggaggctcacctcgtcgactacctcgcctcgagcttcagccttcgcacctccgacaggccacaccagatgcagttctaagcgttgggtcagacgggatttggcgttcagtgcatgggatgaaagacgacctcgggtgctgcagccgtgacagcaggaagtaatccagcggcggt

SEQ ID NO: 486 - DNA, 594 bp, Artificial
  Synthetic
ttccccgcagcgatggtgaaggctggcgaaggatgctgcggctaagcccaagtccaagtactacccagccgacgatgctcctgtgccgcgggctgatcctggcgcaagatccgcccgacgaagctaatggcgagcatcacacctggaacggttctcatccttctcgccgggaagtacaatggcaagcgcgtatcttcctcaaacactcccgtcgggattattgctcgtcactggtcctcgctcgttcaatggcgtccggctcaagagggtgaaccaggcttacgtgatcgcaacatcgaccaagatcgacgtctcttccgtggacgtggccaagtacgacgacagcttcttcaagaagttgaagaaagacgaggaggtgaccccggagatgaagaaggtatggaagctgataaacacggctcggaaatctattttttcttttttcttttgcttgtcgtgcaggcaaagaaggaagctcaagaggccgtggacaaggtcgtgatcgaggtgataaagaagggagagccggagctagctcagtacatctccgccaggttcagcttgaagcgtggaatgaagcctcacgagctagtg

SEQ ID NO: 487 - DNA, 712 bp, Artificial
  Synthetic
tcctctccacacccacatatcagacacccgagagagtcaatatgtcggccaagcccacgaccaagcagttcgggaagtcgacccgggaggttcccgcctccgcggaccaggcgaagaagtggtaccctgccgacgacgagagcgccccgaagaaggttcgcaagtccgtccgaacttgggccccccgaaagaccctccagcctggtaccgtcctgatcctcctcgctggccgcttccgcggcaagcgtgtcgtcctcctcaagactcttgaccagggtgttctcctcgtcactggtcccttcaagatcaacggcgttcccctgcgaagagtcaacgcccgatacgtcatcgccacctcctacaaggtcgacatctccggccttgacgccgccaagattgaggagatctctcagcccaagtacttcaccgccgagaaggccaaggagaaggcttccgctgaggctttcttcaagcagggagagaagccccagaagaaggagatcaacagcagccgtgctgctgaccagaaggccgtcgacaaggctctgcttgctagcatcaagaaggtggatctgttggccagctacctcgccagcaccttcagcctgcggaagggtgacaagcctcacgagatggcgtggtaaatttgattcaaacacaaaatctctctggcaggtcgaaagcacggggtggagtttactggggtgttggt

SEQ ID NO: 488 - DNA, 796 bp, Artificial
  Synthetic
cccccccccccgaaaccttcactgctccatatatggatgcacattactaggtttagggttttattgaatcagcattctgcaaaagcaaaggagaacttctactttcagcaatggcggcaaagaagagtccccgtaatccagagctgattcgtggagtcggaaaactttcccgttccaagatgtatcacaaaaagggtctttgggcaatcaagaagaaaaacggcggctctttccccgtccacaaaaaagccgccgccgtcgcaccaccggccgtcaaaccacccaaaatttaccctgccgatgacgtggcaaaaccccttgtcaacaaacacaaaccaaaaccaacaaaactcagagcaagtattacacccggtactgttttaattatccttgcgggtaagtttaagggtaagagagttgtgtttttgaaacagcttaaatctgggcttttacttgttagtggaccatttaagcttaatggtgttcctttgaggcgtgtgaatcaagcttatgttattggtacttcaactaaagtggatgtttctggtgtgagtgttgagaagtttgacgataagtattttgcaaagcaagctgagaagaaacagaagaagggtgagggagagttctttgaagacaagaaagaggagaagaatgtggttcctcagggaaagaaggatgaccagaaagctgtggatgaagcattgatcaaggcggttgaatgtttcctgaattgaaggcttatttgtctgctaggttctccctcaagtcgggcatgaaaccccatgagcttgtcttt

SEQ ID NO: 489 - DNA, 618 bp, Artificial; identical to SEQ ID NO: 28
  Synthetic

SEQ ID NO: 490 - DNA, 924 bp, Artificial
  Synthetic
gaaaaaaaaggaaaagagagaaagagaaatctttctgtcttaagtgtaattaacaatggcttcctcagttctttcctcagcagcagttgccacccgcagcaatgttgctcaagctaacatggttgcacctttcactggtcttaagtcagctgcctcgttccctgtttcaaggaagcaaaaccttgacatcacttccattgccagcaacggcggaagagtgcaatgcatgcaggtgtggccaccaattaacaagaagaagtacgagactctctcataccttcctgatctgagcgtggagcaattgcttagcgaaattgagtacctcttgaaaaatggatgggttccttgcttggaattcgagactgaggtcaatatttgttctaaattttgcatactccttcaattttatgctcacattttttttccttctatttgttcctaaaaaaagagtgacatatttatacatttagaaaaaaattaacttttaactttaatatattatttcacatgttgcagcgcggatttgtctaccgtgaacaccacaagtcaccaggatactatgatggcagatactggaccatgtggaagctacctatgttcggatgcactgatgccacccaagtgttggctgaggtgggagaggcgaagaaggaatacccacaggcctgggtccgtatcattggatttgacaacgtgcgtcaagtgcagtgcatcagtttcattgcctccaagcctgacggctactgagtttcatattaggacaacttaccctattgtctgtctttaggggcagtttgtttgaaatgttacttagcttcttttttttccttcccataaaaactgtttatgttccttctttttattcggtgtatgtttttggattcctaccaagttatgagacctaataattatgatttaaaaaaa

SEQ ID NO: 491 - DNA, 639 bp, Artificial
  Synthetic
atctctcctaattagccatggcagtcactactagactcctcttagctttactcctctctgcttttctcttgtctgcaacaaatgcagtcagagattttcagggtcggcaagctggccagcggggtgagagaggcactcgtctgactgaagctcaacaatgccgtttaacaaggctcactgccactcagcccactaaccgaattgagtccgagggcggtgtcactgagctgtgggacgagaacgaggaacaattccagtgcgctggagttgctcccataaggagtgtcatccgccgcaactccctttctctgcctaatttccatcccatgccgcgcttagtttacattgagcgtggccagggaatgattggcattacttaccctggctgtgctgagactttccagtctcagtcccagaccttccaggctggccgagagccatgggaagagaggggccaaggccgcagaagtgaccaacaccagaaggttcaccgcattcgtcaaggtgatgtcgtggcacttccagctggcgcagctcattggtgctataatgatggtgaggaagagcttgttgccatctctgtcaacgacctcaaccatcgctccaaccaacttgatcagaacttgagggcattctact

SEQ ID NO: 492 - DNA, 759 bp, Artificial
  Synthetic
gggcggacgcgtgggaattagccatggcggtcactactagactcctcttagctttactcctctctgcttttctcttgtctgcaacaaatgcagttagagactatcagggccagcaaggccgtcaggagggtctgagaggcactcgtctcactgtagctcaacaatgccgtttaacaaggctcactgctagccaacccactaaccgaattgagtcagagggcggcgtcactgaactgtgggatgagaatgaggagcaattccagtgcgctggagttgctcccatgaggaatgtcatccgtcgcaactctctttctcttcccaatttccatcccatgcctcgcttggtttacattgagcgcggccagggattgattggcattacttaccctggctgtgctgagactttccagtctcagtcccagaccttccaggctggccgagagccaagggaagagaggggccaaggccgcagaagtgaccaacaccagaagatccaccgcattcgtcaaggagatgtcgtggcacttccagctggcgctgctcattggtgctataatgatggtgaggaagagcttgtcgccgtctctatcaacgacctcaaccaccggtccaaccagcttgatcagaacttgagggcattctacttggctggtggagtaccagaaagtggaaggcaacaaacccaagcaggtcaaagactacagagcaggcagaggttccagaacattttccgtgctttcgacacagaactgatggctg

SEQ ID NO: 493 - DNA, 785 bp, Artificial
  Synthetic
cttctctactcaataataataatcatgggttttagctggctctctttctccttgagtttccttctggtgttgcacggtacctttgctcagcagagataccaacagcagcaaggcgagtgccaactcaatagacttagtcctcaggaacccaccgtccgcattcaagccgaagctggagtcactgagttatgggatccaaataaccagcagttccaatgtgctggtgtctccctaattcgccacgtcatccagtctaggggaatgctgttgccttcctatgttaacacacccctacttgcctatgttgaacgaggtcagggattttatggcatcatgcaatctggatgcccggaaacattccagtcatcccagcaattgcagcaaggtgaaaggggtgccggttcaagatttcaagatcgccaccagaggattggacagtttaggcagggtgacattattgccttccctgctggagctgctcactgggtttataacgaaggaaatgaggagcttgttcttgttgttcttgaagatagcagtaacaatgccaaccagcttggtcgaacttcaaggaggttcttcatagctggaaacccacaacaaggacagcaacaacagcaacaaggacaatacggtggccgcagcttgcgcagggaacaattccaatctggaaatgttttcaatggctttgacgtacaggtcttggctgaggcatttggcgtagaccaggagacagccaggagacttcagggacaggaagaccagagaggccacattgtaaacat

SEQ ID NO: 494 - DNA, 587 bp, Artificial
  Synthetic
gttcgttagcccaacttcttagccaaaggagtagtcaatggcaaagttctcgccgtggaagtccaagagagtgcagatttgatcggttgcaagcatttgagccgattcgcactgtaaggtcccaagctggtacaactgagttttttgatgtctctaatgagttgtttcaatgtactggagtatttgttgtccgtcgagttatcgaacctagaggtcttctgttacctcactactccaatggagcaactttggtatatgtcatccaaggcagaggtataacaggaccaactttcccaggatgtcctgagacctatcaacaacagtttcagcaatccgagcaagaccaacaattggaaggccaaagccaaagccataaatttagagatgaacatcaaaagatccaccgttttcaacagggggatgtagttgcattgcctgctggtgttgctcattggtgctacaatgatggtgatgcaccaattgttgccatatatgtcactgatatatacaatagtgctaaccaacttgatcctagacacagggatttctttttagctggcaacaataagataggtcaacaattgtat

SEQ ID NO: 495 - DNA, 954 bp, Artificial
  Synthetic
ttttcttcttatttttttgctaacaattataatcatggctactacatggttttcttttttcttgagtttccttttgcttttgcatggtaattttgctcaacaaaggtctcagcagcaatatggccagcagtgtcaaattaacagactcaatccacaagagccttcctttagaatggaagcagaagctggagttactgagttttttgacagaaataatgagcaatttcaatgtgctggagtttcactatttcgccatgttattcagtccagaggccttctcttgccttcttatactaattctccactgcttgcctatgttgttcaaggtcgaggattttatgggatcatgaactcgggttgccccgagacattccaatcatctcaacaaactcaacagagaattagaggcagaagatttctagatcgtcatcaaaagattgaacaatttaggcagggtgatattatggcatttcctgcaggtgctgcacattggctctataatgaaggaaatgaagaagttgttcttgttgttcttgaagatgcctctaacaatgccaatcaattggatcaaacctctcggaggttctttattgctggaaacccgcaacaaggacaacaacagcaaggaagacaatatggtggcagcacaacgcggagggagcaatttcgatcaggcaatgttttcaatggctttgacttagaaattctatcagaaacatttggtgttgacagggaaacggcaaggaggctacaaggacaagatgacatgagaggtcacattgttagtgttcaagaagggcttagagtgattaggccacctttttcacaagaacaagaggaacaacaagaacaaggacaatatggtcgtggtcctatgactaatggaattgaagagacaatttgtactgctaaggttaaagaaaacattgacaatcccgctcgtgctgatatata

SEQ ID NO: 496 - DNA, 842 bp, Artificial
  Synthetic
caaacaatggctactttctcctcagtcctctctctcagcctttgcttcctcgttctctcccacagctgttttgctcagctcttagagcaacagcaacagaacgtatggcagagacttcaacagcagcaacaacaccgcgctctcaggtcaaaaaccgagtgccaaattgagcgtttgaacgctcaagaaccaacccggagatttgagtctgaggccggtgttattgagttctgggatgctacccaagagcagtttgagtgtgccggagttcaagccgttcgccatcaaattaggcgaaatggacttttgcttccttactataccaacactcctctgctcatgtacattattcaaggacgcggtattcactcgactgtgataccgggatgtgctgagacatacgaaacagaatctggagaatccagaaccggagaaagacgccggagtttcaatgataggcaccagaaactcagacgtttcagagccggtgatgttcttgctttgccggcgggagtcactttctggatgtacaatgatgctgaggaaccaattgtcactgtctcacttcttgacacttctaaccacgctaatcaacttgatctcactttcaggagcttcttcctagctggaaacccacagcgtggagtacaacaacaatctgtaggaagacaaggagaaacaacaatgcaagaaaggagatcagaacaagagagaacatctaaaggaggcaacattttcaacggtttcgacactgaaattttgtccgaagcattcaacgtggacgtcgaaactataagaagacttcaaggacagaacgaagagagaggtgtaattgttagagc

SEQ ID NO: 497 - DNA, 840 bp, Artificial
  Synthetic
aaaatggcttctaactcctctctcatttgttttagcctttgtttcctctttctttttcatggtacttttgctcagatctttgagcaccagcaagtttggcagaggatgcaacagcagcagcaacatcgggcgctcaggtccagaactgagtgccgaattgagcgcctgaatgctcaagagcctactcgtaggttcgagtctgaggctggtgtcaccgagttctgggatcacactcaggaacaatttgagtgcgccggagtccaagcagttaggcatgaaatccgacgaaatgggcttttgttgccttactacagcaacactccccagctcatctatataattcaaggaaatggagtgcattcggctgtgttcccgggttgtgctgagacattcgagacagagtcagcacaatcgaggaggggagaaaggggagaaagaggagaagcaggacaaagattcaatgaccgtcaccagaaagttagacgttttagagctggtgatattcttgctttgcctgctggtgttacacactggacttacaatgatggtgaagaaccaattatcagtgtctctcttattgacacttctaaccaggccaatcaacttgatctcaccttcaggaaatttttccttgctggaaatcctcaacgtggtgtacaacaacaaatgttaggaaggcaacaggagggagctcctggcctaggaagaagaggtagtgaacaagagagaggaagcaacatcttgagcggattcgacgctcaacttttgtcagatgctttcaatgtcgatcctgaaataattaggagactacaagaacaagtcccggaaaggggagtgatc

SEQ ID NO: 498 - DNA, 616 bp, Artificial
  Synthetic
gcttcatagaaataatttgaaggctagattagagcattttggtcctgacccggttctctatcctttgaagcggttcaagtggcttattgatttctgcgtagaccatgaatggtgtgcagtagttaagaaactgttgagcgttcttcttgatggaactgtgggcgcaggagacagtacttccttgaaatttgctcttactgagatgggtcttctgcatagagctgtgcgtaggaattcgaggcctctggttgaattgctattaacatataccccagagaaagtagcagatgaactaactttggaataccaatccctggttgagattcacggagaattcttgtttagacctgattgtgtagggcctgcaggtttgacaccacttcatgttgcagctggcatagatggatctgaagatgtactagatgcattgacagatgatcctagaaaggtggcaattgaagcgtggaagaatactcgtgatagcacaggtttcacaccagaagattatgcacgcctgcgaggacattattcttacattcacctggtgcagaggaagattagcaagaaagcaaccagcggacatatagtggttgatattcctattgttccatctatt

SEQ ID NO: 499 - DNA, 633 bp, Artificial
  Synthetic
caaccccaacccctcttcaaaccacttatcacgcgctctgctacctccccatacaacacacacacacacacacttaatttctctcgctaaacccacgaatccatactcccatttgctttccccgtgatcattttccggcgagatctctgatactccgtcggaaaatcctgatcggatccgctatctctgaactgcgattcactttgcgatttcgaaagatccgattagatatggctccagtttcggctcttgcgaagtacaagctcgtcttcttaggagatcaatctgtcggcaaaaccagtattatcacgcgattcatgtatgataaattcgataacacttatcaggctacaattggtattgactttctgtctaagactatgtaccttgaagatcgtacagtacgattgcagctatgggatactgcaggtcaagagagatttaggagtctcataccaagctatattagggactcctctgttgctgtcattgtgtttgatgttgctagcaggcagtccttcttaaatacttcaaagtggattgaggaggttcgaactgagaggggcagcgatgttattattgtccttgttggtaacaaaactgatctagttgacaaaaggcaagtttcaatcg

SEQ ID NO: 500 - DNA, 442 bp, Artificial
  Synthetic
acgtttttgcatctgaattctgccgcgaacaatcagattccgtacaattctcgccggtagatctctcaatattccggtgactttcgtgtgcttttaatcgccatgaatccagaatatgactacctgtacaagcttctgcttatcggtgattctggtgttgggaagtcatgtctccttttgagatttgctgatgacacatatcatgagagctacataagcacaactggagttgattttaaaatccggacagtggatcaagatgggaagaccattaagcttcagatttgggatactgctggacaagagcgtgttaggacgatcactagcagctactatcgcggagcccatggcataataattgtctatgatgtgacggatcacgagagcttcaataatgcgaagcaaaggctgaatgaaattgatcgttatgctaccccaaacg

SEQ ID NO: 501 - DNA, 633 bp, Artificial
  Synthetic
ggcggatcggtgggttgcgggcttgcacgtagtcgaggctcgagaggagggggggatggcggcggcggcggcggcggcggggtacagggcggaggaggagtacgactatctgttcaaggtggtgctgatcggggacagcggcgtggggaagtcgaacctgctgtcgcggttcgcgcgggacgagttcagcctggagaccaggtccaccatcggcgtcgagttcgccaccaagaccgtccgcgtcgacgacaggctcgtcaaggcccagatctgggacaccgccggccaagagaggtaccgcgccatcacgagcgcctactaccgcggcgcggtgggcgcgctggtggtgtacgacgtgacgcgccgcatcacgttcgagaacgcggagcggtggctcaaggagctccgcgaccacacggacgccaacatcgtcgtcatgctcgtgggcaacaaggccgacctgcgccacctccgcgccgtccccgcggaggacgccagggcgttcgccgaggcgcacgggaccttctccatggagacgtcggcgctggaggccaccaacgtggagggcgccttcaccgaggtgctcgcgcaaatctaccgcgtcgtcagccggaacgcgctcgacatcggcga

SEQ ID NO: 502 - DNA, 689 bp, Artificial
  Synthetic
ctctctctctctctccccctccctccgatctcgccgcgtccgtgtcccctcgccgccgcagccagggtcgagggctcggcgaccggaggaggagaggccggaacccgccgccgccgccgccgcctccgcctgtagcgagatcgctcgatccggttcgcctcccgcgcgccagtccgccagcccagttcgatccgttgagggggaggggacgctctagtgtggggattgggggaatcgatggcggcgccgccggcgagggctcgggccgactacgattacctcatcaagctgctcctcatcggcgacagcggtgttgggaaaagttgtctcctcctacggttctctgatggttccttcaccaccagttttattaccaccatcgggattgatttcaaaataagaacaatcgaactggatggtaaacggattaaacttcaaatctgggatacagctggtcaagaacgtttccgaactattacaactgcctactacaggggagcaatgggtattttgcttgtttatgatgtcaccgacgagtcatcatttaataatataagaaactggattaggaacatagagcaacatgcttccgataatgtgaacaagattttggtaggcaacaaagctgacatggatgaaagcaaaagggccgtaccaacttcaaaggggcaagcacttgctgatgaata

SEQ ID NO: 503 - DNA, 1028 bp, Artificial
  Synthetic
cccacgcgtccgctacaattcctctgtcgctctcaccagttaacagctacagcacaaaactgtaaccacgcttccgatctctaaaacctgagagagagagagagagagagagagacagagagaagtgtttcaatagtttggcgtgaagatggccggaggaggcggatacggcggcgcatcggggaaagttgattacgtcttcaaagttgttctaatcggagattcggctgttgggaaatcgcaactacttgctcgattcgctagagacgaattcagcatggattctaaagccaccatcggcgtcgagttccaaactcgtaccctctccattgaacaaaaaagcattaaggctcagatctgggataccgctggtcaggaaagatacagagccgttacaagcgcatactacagaggagcagttggcgcaatgctggtttatgatatgacgaaacgtgagacctttgagcatattccgcgttggcttgaagaactgagggcgcacgctgataagaacattgtcatcatccttattggaaacaagtctgatctagaagatcaaagagctgttcccactgaagacgctaaagagtttgctgagaaggaaggactctttttcctcgagacctctgctttaaacgcaaccaatgtcgaaaactccttcaacactctaatgactcagatatacaataccgtgaacaagaagaatcttgcatctgaaggcgactcaaataaccccggttcattggctggtaagaagattctcatcccaggttctggacaggagattcccgctaagaccagcacttgttgtacttcttcttgatctgtctcctactcaagcaagattcattttttttcctcctgaaatttgtgatagagaatgctactttcattgtatattctttttcgaatctggcttgtttgctagttcattaaacattggtgtgcaattggacaccgatagaaagtattggaacaaatagcttttgaatgaaatatgaaacaaacagtctttgagagttaaaaaa

SEQ ID NO: 504 - DNA, 643 bp, Artificial
  Synthetic
tctctctcttctctctctcttccaaccccgtccccatgaagagacatgctttctctctcttctctctctattcctcgaagctaagaatagcatcgttttacctacttttcttggtcattctgaaagttaaaagtctaaattgacacaataaaccctttaatacaattattatacaaacaagtcataaacacccgacacttaattacccgattgatttttctaggatatgggttgcgcatcttcagttgcagataggaattcaggacgggctgctggccttaatccggataatggtggagcacttgaccctaaaaatcttaaagtgaagctggtactcttgggtgattctggtgttggtaaaagctgtattgttttgcgctttgaccgtggctaatttgatccaacatctaaggtgactgtaggagcttcttttttgtctcaaacaatagcgttgcaggactcaactacagttaaatttgaaatatgggatacagcgggtcaggagaggtacgcagctcttgcacccctgtactaccgaggtgctgaagttgcatttgttgtgtatgatattactaatcccgagtcttttgccaaagcgcaatactgggtcaaggaattacaaaaacatggaagccctgatatt

SEQ ID NO: 505 - DNA, 612 bp, Artificial
  Synthetic
  misc_feature (3)..(3): The residue at this position can be any nucleotide.
ggngaaaaaagtagtgaatgatgccataagcattcacaatacttttactggcccccttctctctctctctgtatcgcattgtcactgttatatagtagtagtactttctggacaagcttttagagagagaaagtaaaagtacatatcggaggaatttttaggtagagaaagttgagaaggagtcgtcggagagttagccgatggcgacgacagggcagagtaatagcagttatgatctgtcatttaagatactgttgatcggagattctggagtaggcaaaagtagcttgctcgttagtttcatttctaatgtcgttgacgatcttgcccctaccattggtgttgattttaagattaagacgctcactgttggtgggaaaagactgaagcttaccatttgggacacagctggacaagagaggttcaggacactgacaagctcctactacagaggtgctcaggggatcattcttgtctatgatgttacgagaagagagaccttcacaaacctgtctgatgtgtgggcaaaagaggtggagttgtatagtaataatcaggattgtgtgaagatgcttgctcggaaataaagttgacaaagaatctgagagagct

SEQ ID NO: 506 - DNA, 720 bp, Artificial
  Synthetic
  misc_feature (660)..(660): The residue at this position can be any nucleotide.
aatatcaaaagggaaaaatacaaacctaaaaaagggttcaccttttgttaatttgattttttcaccatgtctatgcgtaggagaaccttgcttaaagtcatcgtcctcggcgatagtggggttggtaaaacgtcattaatgaatcaatatgttcacaagaagttcagccagcaatataaagctacaattggagctgatttcgtgacaaaggagcttcaaattgatgacaggcttgtaactctccaaatatgggatacagctggccaagagagatttcagagtcttggagttgcattctatagaggtgcagattgctgtgttttggtctatgatgtcaatgttatgagatcctttgataaccttgacaattggcatgaagaatttctcaaacaggctaatccaccagaccctaaaacatttcctttcatattactggggaacaagattgatatagatggtggaaatagcagagtggtttctgagaagaaagcaaaggaatggtgtgcttcaaaagggataccttactttgagacatcagcaaaagaggatataaacgttgatgctgcattcttgtctattgcaaaaactgctttggccaatgaacacgagcaagatatatacttccagggcattccggaggcagtttcagagacagagcanagaggtggttgtgcatgttaaggtgaatgaagcaatttcattgagtgctatatgtaatcg

SEQ ID NO: 507 - DNA, 958 bp, Artificial
  Synthetic
tccgatcccgtatggttggagatattccccttcatcattttttcctgagaaaattcaaatggccgttccacccgctagagctcgagccgattatgattacctaatcaagctcctcttgatcggcgacagcggtgtgggtaagagttgccttcttttacgtttctcagatggctccttcacgaccagttttattacaactattggcattgacttcaagataaggaccatagagcttgatagcaaacgaatcaaactacaaatctgggatactgctggtcaggagcggttccgaacaattacaactgcttactaccgtggagccatgggtatattgctggtgtatgacgtgactgatgagtcatcttttaacaacatcaggaactggataagaaacattgagcagcatgcttccgacaatgtcaacaaaattctggtcggcaacaaggctgacatggacgaaagcaaaagggctgttcctacatcaaaaggtcaagcactagccgacgaatatggcattaaattctttgagacaagtgccaagacaaatatgaatgtggaagaggttttcttttccatagctcgggatataaaacaaagacttgctgaatctgattcaaaggctgagcctcagactatcaggataaatcaaccagaccaggcagcaggagctgctcaaagcgctcaaaaatcagcttgctgtggctcttgaaatattgacagcaacgacgacaggatgatggggaatacatccttcaagttaccattttagtaggaagggtggaactaatctttgttataacattctgaccatcgattgtatttttctctttacagttatttcttcaatatctatttgtattgggtggcagctcttagtattgcaaaaatcagtatatgctcactactttttggcttaatataaatgaagggacactctgccttctcatgtttcttgttc

SEQ ID NO: 508 - DNA, 717 bp, Artificial
  Synthetic
agaatgaacctgtttgcgaatccacgaagaaagaagggaaagcggtgccatcgcgggcaggagcagggccagatctgagctgcgccgccatcgatcgacgacccaatccactgccgcagctaaggcgccgcgagatccggaggtcttttgcagggatttcggggattttcgctggtttttcttgatctcttcctcggttctgcgaagaagacgcatcggcagcaatgaatcccgagtatgactatctcttcaaactcctcctaattggcgactctggcgtcgggaaatcgtgcctgctgctacgattcgcggatgattcttaccttgagagctacatcagcaccatcggggtggacttcaaaatccgaacagtggagctggaagggaagactatcaagctccaaatctgggacactgctgggcaagagcgcttcaggactatcacgagcagttactatcgtggagctcatggcataatcgtcgtgtacgacgtgactgaccaggaaagcttcaacaacgtcaagcagtggctcaacgagattgatcgctacgcgagcgagaatgtgaacaagctcctcgtcgggaacaagtcggatctcactgccaagaaggtggtcgacactcagactgccaaggcttttgcagacgagataggaatcccgtttctagaaaccagtgccaagaacgcgaccaacgtagagcaggcattcatgacca

SEQ ID NO: 509 - DNA, 664 bp, Artificial
  Synthetic
gagctacttactaggcgagaatcaaatggcgctgtcttcctcctccgtcagcggcaacgagtttgatcacctcttcaagatactgctcgtcggggactcgggtgtcggcaagagcagcctgttgctgcgattcaccgccgacactttcgacgatctctcccccacaatcggtgtggatttcaagctcaagcttatgacgctggaaggcaagaggctcaagctcaccatctgggacacagccgggcaggaaaggtttagaacgcttacgagctcgtactaccgaggggcacaaggcgtcattcttgtttacgatgttacaagaagagatacgttcacgaatctctcggaagtttggctcaaggaggtcgagctctactccaccaaccaggactgcgtcaagctcttggtggggaacaaagtcgacagggattccgagcgtgcggtgacgaagcacgaaggcatggctttcgcccggaagtatggctgcctgttcctggagagcagtgccaagacgaagatcaacgtccaacaatgctttgaagagctggtcaggaagattctggaaactcccagcttggtggccgaggccaagtcggtgaagaaaaacatcatcagaccaagcaacgatgaggagccgcctgcggctgccgataactctggtagc

SEQ ID NO: 510 - DNA, 560 bp, Artificial
  Synthetic
aaattttcgaagggggaaaaaaaggtctatcgttcttgttcgcagcggcggcgttcgctttgatctggttctcgatcgatcgacccatcgattgtttcgcggcgatggcgacgacggggatccacatgcaggccaagcttgtgctgctgggcgacatgggagctggcaagtccagtctggttcttagattcgtcaagggccagttcttcgattaccaggaatcgacaattggagctgcattcttgacgcagacattggccgtgaacgagacgacggtaaagttcgagatttgggacactgcgggtcaagaacgctaccacagcttggctccaatgtactaccgcggcgctgccgccgccatcattgtttatgacatcactaacgcggactcttttgcaaaagcaaaaacatgggtacaggaactccaaaggcaaggaagtgccaacctcgtcatggctcttgcggggaaacaaagctgatttggctgcaaagcgcaagattgaaacacaggagggacaatcttatgcggatgaaaacgggctcttcttcatggagacttc

SEQ ID NO: 511 - DNA, 938 bp, Artificial
  Synthetic
aacgcgacagcttcgcctcgtctctcccccccgagtccccaacccctcctcctcctcctcttccccttccccgcgccgcggcgagatcgctccccccgggggcagcagctagatcccgatggcttcgcgccgccgcaccctcctcaaggtcatcatcctcggcgacagcggggttgggaagacgtccctgatgaaccaatatgtgaacaagaagttcagcaaccagtacaaggctacgattggcgcggatttcctcaccaaggaggttcagttcgaggataggctcttcactttgcaaatatgggatactgctggccaggaaaggtttcagagtcttggtgttgcattctaccgtggagcagattgctgtgttctagtttatgatgtcaattctatgaagtcatttgataatcttaacaactggcgtgaagaatttctaattcaggcaagcccatcagaccctgataacttcccttttgttcttttgggcaacaaagttgatgtagacggtggcaacagccgtgtggtctctgagaagaaggcaaaggcatggtgtgcctctaaagggaatatcccatactttgagacatctgccaaggatggtacaaacgtggaggaggctttccagtgcattgtaaagaatgctctgaagaatgaaccagaggaagaactgtatgtgccggacaccgtggatgtggtgggtggcaaccgggcccaaagatcatcaggctgctgctagaacatgatggaccatgagggctgagactgttggctatgcggtaacagaactacctttggacattgctgtgcctccatggtgactctcaaggacccattcgtaaccttttcaatcacctcatgtacccagttaagattgatgcgtctggcctgagttgtcaaatttgtggatgttgtgcagtttatcagtagcgtcatat

SEQ ID NO: 512 - DNA, 646 bp, Artificial
  Synthetic
gcaagatcccagcaaagactagccaagatctgcgtctcctctctctctctctctctctctctctctctctaactttcaactgctgattgagtgcacagaagcttagtgttctggtttaaaaaaagatggcgagtgggtatggggatgcgagccaaaatatagattatgtattcaaagtggtgttaatcggcgactcatctgtaggcaagtctcagatactggctcgatttgctcgtaatgaatttagcctggattctaaggccacgattggggttgagttccacacccgaaccctagtcattcaacacaagtctgttaaagctcatatctgggatactgctggtcaagaacgatatagagctgtcacaagtgcatactacaggggcgcagttggagctatgttggtttatgacataacgaaacggcaaacctttgatcacataccccgttggctggaagagttgcgcgcacatgccgataggaatatcgagatcatgctgatcggacacaaaacagatcttgaacaccaacgagctgtccctaccgaagatgctaaagaattcgcccagaaagaaagattattcttcttggacacttctgcaatggaagccacacacgtggaggatgcattcttgactgttttgac

SEQ ID NO: 513 - DNA, 665 bp, Artificial
  Synthetic
aaagccagccagccagccacctctgcatcatcccgcctgtctgcctgcgcgcgccggccaggcggccgccgcctcgtctgctccgccggtccaggttgggtccccctcttgacgaggggcgggagggagggagcgaatctgaggtggtggctatggggtcgccgggggcggggagcagcggcggcggtggaggtgggcatgagtgcagcttcaagatcctgctcatcggggactccggcgtcggcaagagcagcctcctcgtcagcttcgtcgtcgccgccgccgccgcccacctcgacgacgacatcgctcccaccatcggagtggattttaagatcaagttccttacgattggtggaaagaaattgaagctgacaatatgggatactgctggccaggagaggtttaggacaattactagttcttactacagaggtgctcaaggcattattctagtatatgacgtcacgaagagagaaagcttcacaaatctggctgaagtatggagtaaggaaatagagtcacactcatcaaacaaagactgcataaaaatgcttgttggaaacaaaattgacaaggaggatgaaagaactgtcacaagagaagaagggcttgcctttgcagaagaatctggatgcctatttcttgagagtagtgcgaaaaca

SEQ ID NO: 514 - DNA, 554 bp, Artificial
  Synthetic
aagaattttcaggttttcttctcgctttcaccggagaaggagaaggagaggaaggtgttgatcgaatcctcctccaatcgcgcgcgattcgatccccgttgctggctcgctcgctccgccgatccctcatccgatctgaatccccgatctgatggcggccaaccccggcaacaagatccgcaacgccaagctggttcttcttggagatgtgggcacgggcaagtcgagcctcgttctccggtttgtgaagggccagtttgttgaattccaggagtccaccatcggcgcggccttcttctcgcagaccttggcggttaacgacgagacggtgaagttcgaaatctgggatactgcagggcaggagaggtatcatagcttggctccgatgtactatcgtggtgcggctgccgcaatagttgtctacgacatcacaaatgcggcctctttcacacgtgcaaaaaaatgggttcaagaacttcaagcgcaaggaaacccaaacacgataatggctcttgctggtaacaaggctgatatggtacaggcgaggcaggtgc

SEQ ID NO: 515 - DNA, 596 bp, Artificial
  Synthetic
accttgctctccgtcattttccggcgacgatccctttttcggctatttccggccgtaaggaacagaaacatccccgttcccttcgccctttggatcagtcagcttcgcaaaatcatgaatcccgaatatgactacttgttcaaacttttgttaataggagattcaggtgttggaaagtcatgtcttctcctgagatttgctgatgattcttatttggacagctatatcagcacaattggtgttgactttaaaatacgtacagtggagcaagatgggaagactattaaacttcaaatttgggacactgccggacaagaacgtttcaggacaattacaagtagttactaccgtggagcacatggcattataataacttatgatataactgatcaagaaagcttcaacaatgttaagcaatggttgagtgaaattgatcgctatgcaagcgaaaacgtaaacaagcttctggttggaaataagtgtgacctaactgacaaccgagctgtgtcatatgatacagcaaaggcgtttgctgatgaaatcggcatcccgtttatggagactagtgcaaagagtgccactaatgttgagcaagc

SEQ ID NO: 516 - DNA, 679 bp, Artificial
  Synthetic
gaattcagattctggtgttgggaaatcatgcctgcgtgctgagatttgctgacgattcatatcttgaaagttacatcagcactattggcgttgactttaaaatacgcactgtggagcaggacgggaagactattaaacttcagatttgggacactgccgggcaagagcgtttcaggacaatcactagcagctactaccgcggagcacatgggattattattgtttatgatgtcacagaccaagaaagctttaacaacgtgaagcagtggttgagcgagattgatcgttatgcgagtgataatgttaacaagcttctggttgggaacaagagtgatctcaccgcaaataaagtcgtgtcaactgaaactgctaaggcatttgctgatgagatagggatcccattccttgaaaccagtgcaaaaaatgcgactaatgttgagcaagcctttatggccatggctgctgaaataaaaaacaggatggcaagccaacctgctatgaacagcgctaagcctccaaccgttcagatccgaggacaacccgttactcagaatagtggttgctgctcctcttcttaaggataagactttagctcggactttttatctctctgacaatctttgtccctccatccttgtaaaactagtctctctctggcacacttattcatcagccatct

SEQ ID NO: 517 - DNA, 648 bp, Artificial
  Synthetic
gttgcaacctgcgagcggaaacccacctccaccccgtcgccggcctgccgccgccgccgccgccgcttgccctcctccgccttactcggcctccggcgcctcctgaccccccggccatgggttgctcttcgtctctgccagctaataatgctggaggggtaggtactatcagcaacgagaattctggtactgatctgaagaacttgcgagtgaagttggtattgcttggagattcaggtgttgggaaaagttgcattgttcttcgctttgtccgtggtcagtttgaccccacttcaaaggtgactgttggtgcatcatttttgtcacaaacattggcgttggaggattccacaacagtaaagtttgaaatatgggatactgctggtcaggagaggtatgctgcattggcacctctttactaccggggagctggtgccgcaattgttgtgtatgacataacaagttcagaatcatttaacaaggcacaatactgggtgaaggaacttcagaaacacggtagtccagatatgatcatggctttggttggaaataaggctgatctacatgacaatcgtagtgtatcctctcaggatgcacaagagtatgcagagaggaacactatgtttttcatcgagacatcagcgaaaa

SEQ ID NO: 518 - DNA, 738 bp, Artificial
  Synthetic
cacgcgtccgaaaagcaaattctcctctcaattttcctcgccatctttacgtgtcttcatcacacgtgctctctcattccatatccttttgcttcttaattcacccgcgaagattccgattcagatcccggtcaattttcgccggtaaatccctcagacaccggcgaatttcatcttccctcgatcgcaatgaatcccgagtatgactacctctttaagcttttgctcattggtgattctgtgcgtgggaaatcatgtcttcttctgaggtttacagacgacacatacctggaaagttacataagcactattggagttgattttaaaatccggacagtagagcaagatgggaagactataaaacttcagatttgggatacagctggacaagaacgctttaggaccatcactagtagctactatcgtggagcccatggcataatagttgtgtatgatgtgacagatcaagagagcttcaataatgtaaaacagtggctgagtgaaattgatcgttatgctagtgacaatgttaacaaaattcttgtcgggaacaagtccgatcttactgcaaatagagtcgtctcatatgaaacagctaaggcatttgctgatgaaattggtattccattcttggagaccagtgctaaagatgctacgaatgtagaacaggcttttatggctatgacttctgctatcaaaaataggatggcaagccaaccaaccaataattccgctaag

SEQ ID NO: 519 - DNA, 414 bp, Artificial
  Synthetic
cccacgcgtccgcgatttttcgcctgaacctgcggatttttcgattcttcaaattcaatgtcttatgcttatctcttcaagtatatcatcatcggcgatactggagtggggaaatcatgtcttctgcttcagttcaccgacaagaggtttcagccggtgcatgaccttaccattggtgttgaatttggggctaggatgatcaccatcgataacaaacctatcaagcttcagatctgggatacggctggtcaagaatcctttaggtctattacaaggtcatactatagaggagctgcaggggcattgcttgtctatgatatcacaaggagggagacatttaaccatctagctagctggctagaagatgcaaggcagcatgcaaatgcaaatatgacgataatgctcattgggaat

SEQ ID NO: 520 - DNA, 562 bp, Artificial
  Synthetic
ccttctccctcttctctctgtcacgtgctcggtctcggtcctttgagcttctctctctgtctctctccgattctcgctccctgctccgatgcctcgacgacctttccctttccttatctctatctctatctctctccttatccttttcgccgtcgccgcgagaccttttgctgctacgacgatctctattgtcgtcctcggcggcgtattcctcgctcccgtctctctcccttcggcgataggctttctcgctcttctccttctcggcgctgctgttgttgttgtctttgctctttgtagaaggaccaccgttgggctcttctacagtcttctccagataatcgtactcatcgaagtccatttgaggtgactttctctgccggacggccgaaggttcgttgttccgcctgtgaagaagtgctggttaggttttgacagaaaccttagatcaaaaaatcagtgtattcctctcagaaaaaaactaagcagcaaaaacatttcaagaaaatagcctaagccatggccaacatgatcatggcttcctccaaagtcctaatcacct

SEQ ID NO: 521 - DNA, 872 bp, Artificial
  Synthetic
ccccccccgctcttctctcattctcattccgcacaaatacatctccatttcctccacttttctaagccaataattcttcaatggccatggcaactcaagcttctctcttcactccagctctctctgccccaaaatcctcttccccatggaaacaatccctcgcttccttctctcctaagcaactcaaatccactgtttccacacaccgtcccattagggccatggccgaagaagcagccgccgccacaaaagaagcagaggctccagtgggcttcaccccaccacaattggacccaaacacaccttccccaatcttcggcgggagcaccggtgggcttctccgcaaggcccaagttgaggaattctacgtaatcacttgggaatcacctaaagaacagatctttgagatgccaactggtggtgcggctattatgagggaaggtgctaatttgctgaaattggcgaggaaagagcagtgtttggcacttggtactaggctgaggtcaaagtacaagattaactacaggttttacagggtgtttcctaatggtgaagttcaatacttgcatcctaaggatggtgtgtacccagaaaaggtgaacgctggccgtcaaggagttggacagaacttcagatccattggtaagaacaagagcccaattgaggtcaagttcactggcaaacaagtgtatgatttgtaagctcattatgttgtgcctttttatgtaatgattttgtgattattcaggccatcgtttcatgtaattttatttgccactacaaaatacagcacgggattctattatttctctctcttttttttgctcttatagttactctgttctttgagggtgacaaaggatgggtatgct

SEQ ID NO: 522 - DNA, 775 bp, Artificial
  Synthetic
tttttttttttggggggaaattatacagtaatccacatgtttaatggtacctttggaacaggaaaatacaaattaagttcaaacaataatttcattacataaccacacaacctactgcagctcgaggaaatcaactaccccttgaatattccatggctatggcaactcaagcagctctttttaccccaactctttccacctcaaaatcaagcaatttagcatggaaacaatcctcaactgtgtcattcgccagccctaaaccattcaactttgccgcaccacaacgttccattaaggcctcagctgctgaaggaaagacagaagctccagcgaaagaagccccagcaggtttcaccccaccagaattggacccaaacacaccatctccaatattcggaggtagtactggtggattgttgcgtaaagctcaagtagaggagttttacgtgatcacttgggattctcctaaagaacaagtatttgaaatgccaactggaggtgcagctatcatgagacaaggacctaacttgcttaagttggcaaggaaagaacagtgtttagctcttggaaccagattgagatccaagtacaagatcaagtaccagttttacagggttttcccaaatggtgaagttcaatatcttcatcctaaagatggtgtgtacccagagaaggtgaacccaggacgtcaaggagtcggacaaaacttcaggtctatcggaaagaatgtcagccctattgaagttaagttcactggaaaacaagcatatgattt

SEQ ID NO: 523 - DNA, 791 bp, Artificial
  Synthetic
attctgcacaaatacatctccatttcctccacttttgtaagccaataattctacaatggccatggcaactcaagcttctctcttcactccagctctctctgcctcaaaatcttcagccccatggaaacaatcccttgcttccttctctcctaagcaactcaaatccactgcttccactccccgtcccattagagccatggccgaagaagccgccgccgccgccacaacaaaagcagaggctccagtgggctttaccccaccacaattggacccaaacacaccttccccaatcttcggtggcagcaccggcgggcttctccgcaaggcccaagttgaggagttttacgtaattacttgggaatcacctaaagaacagatctttgagatgccaactggtggtgcagctattatgagggaaggtgctaatttgctgaaattggcgaggaaagagcagtgtttagcacttggtactaggcttaggtcaaagtacaagattaactacaggttttacagggtgtttcctaatggtgaggttcaatacctgcaccctaaggatggtgtgtacccagaaaaggtgaacgctggccgtgaaggagttggacagaacttcagatccattggtaggaacaagagcccaattgaggtcaagttcactggcaaacaagtgtatgatttgtaagctgattatggtattttgtgccttttcgtgtaatgtgatgaatttgtgattatttagtgcatcatttcatgtaattttatttgccactacaaaatacagcatgggattctac

SEQ ID NO: 524 - DNA, 689 bp, Artificial
  Synthetic
ggggttgtttctcaggcccagcatttgatacatcaaagatgcaggccttggcaatgcaagcgtctccaatgagcctgcgctccacgagcagcgccggcagcagcaccagcagcttcttccaaggtcagtccaagatctccatggcggcggctcctgcgcgagtgagcatgatggcgacggcagataaggcagataaggcggataaggcagctaaggcagataaggcagataaagcagcacctgcacccgcgggatttaccccaccagagctcaaggccgataccccgtccccaatctttggtggcagcacgggcggactgctgcgcaaggcacagatcgaggagttctacgtcatcacctgggaatcacccaaggagcagatatttgagatgccaaccggaggtgctgcaatcatgcgctccggcccgaacttgctcaagctggctcgtaaggagcagtgcatggcgctgggcacgcagctgcgctccaagctcaagatcaactaccagttctatagagtgttccccaacggtgaggtgcaatacttgcatcccaaggacggagtctaccccgagaaggttaaccccgggcggaagggcgtgggtgtcactctcaggtccattggcaagaattgcaaccccgtcgatctcaagttcacaggcaaggctgcatatgatgtgtaacgcttt

SEQ ID NO: 525 - DNA, 475 bp, Artificial
  Synthetic
ggtatcaacgcagagtgccattacggccggggtaaagcgcaagtggaagagttctacgttatcacgtggaactcaccgaaagaacagatctttgagatgccgacaggaggagcagcgatcatgagagaaggtccgaatcttctgaagctagcgaggaaagagcagtgtttagctttggggacaaggcttagatccaagtacaagatcacttaccagttttacagagtgtttcctaacggtgaggttcaatatcttcatcctaaagatggtgtttatccagagaaggcgaatccaggaagagaaggtgttggtctcaacatgagatctattgggaaaaatgttagtcccattgaagttaagtttactggcaaacaaagttatgatttgtaagatctgtaaactaaaaaaaccaaaaactatgtgcatgtggtgatgattatgactatgtttcatgttaatttttaatggattttgt

SEQ ID NO: 526 - DNA, 732 bp, Artificial
  Synthetic
gctctcagagcagtgtgctcgcgtgtgcccaccacgagcctgtagcgattccctcagcagcagcagcgatggccatgtctgcgcacgcctcccaggcggcagtcattgcagcaaccgccaaagcagtgccatcagcatcagcttaccccgcctctactgccacggtatcccttcgccaatcctcgatgcgcggcatgaagcttgttaccccttctctcttgtcgttgtcttcttcctctcctcgcatccgcatggcagcagctgatgctcctgctgcgccagcagaggaggcacctgctgggttcaccccccccgagctcaaagccgacaccccatcccccatcttcggcggtagcactgggggcctcctccgcaaggcgcaggtggaggagttctacgtcatcacctgggaatccccaaaggagcagatcttcgagatgcccacggggggcgctgccatcatgcggcagggcccgaacctcctgaagctggctcgcaaggagcagtgtctcgcactgggatccaggctgcggtccaagttcaagatccagtatcagttctaccgtgtgttcccgaatggggaggttcaatacctgcacccaaaggatggcgtgtacccggagaaggtgaatgctggcaggaagggcgtcggggtgaacttacggtcgatcggcaagaacaagaatccggtggaggtcaagttcactgggaattctgccttcaatctctgag

SEQ ID NO: 527 - DNA, 150 bp, Artificial
  Synthetic
tggaggatcagcccgccgcgggggcgacggaggaaaaaaacccaccccccgcggggttcgtgccgccgcaattggaccccaacacgccgtccccgatttttggtggaagcacggggggacttttccggaaggcgcaggtggaggagtttt

SEQ ID NO: 528 - DNA, 437 bp, Artificial
  Synthetic
cccacgcgtccgatccatttactccacagagaaagattcagagaaaacagaagaaactatggcaactcaagccgccggaatcttcagccccgccataacaaccactacttccgccgtcaagaaactccacctcttctcatcaagccaccgtcccaagtctctctccttcaccaaaaccgccatccgcgccgagaaaacagagtcctcctctgctgccccagccgtgaaagaagctccagttggattcactcccccgcagctagacccaaacacaccatcaccaatcttcgccggaagcacaggaggtctcctccgtaaagcacaagtagaggaattttacgtgatcacatggaactcaccgaaagaacaaatctttgagatgccaacaggaggagctgcgataatgagagaaggaccgaatctattgaaactggcga

SEQ ID NO: 529 - DNA, 885 bp, Artificial
  Synthetic
ccccgatctctctcctccacaccacaccactcgaatcgaatccaccacacggtaccctcctctctcctcctccgaccaccatggccatggccacgcaagcctccgccgccaagtgccacctcctcgccgcctgggcaccggcgaagccgcgctcatccaccctctccatgcccacctcgagggcacccacctccctcagagcggcggcggaggatcagcccgccgcggcggcgacggaggagaagaagccagcccccgcggggttcgtgccgccgcagctggaccccaacacgccgtccccgatcttcggcgggagcacggggggactcctccggaaggcgcaggtggaggagttctacgtcatcacatggacgtcgcccaaggagcaggtgttcgagatgcccacgggcggcgccgccatcatgcgcgagggccccaacctgctgaagctggccaggaaggagcagtgcctggccctgggcaccaggctccgctccaagtacaagatcaactaccagttctaccgcgtcttccccaatggcgaggtgcagtacctccaccccaaggacggcgtctacccggagaaggtcaacgccggcaggcagggcgtcggccagaacttccgcagcatcggcaagaacgtcagccccatcgaggtcaagttcaccggcaagaacgtcttcgacatctagacttcttcttcttcttcttcttctctcataatcgacctattaattacttgtgttttgggtggatggacatgtaattttaatcatctgtcaggctgctcttcagttattgatgatggtgtaatcgatcgatggtgggatataatctcttcttataatattgtagtatatgtttggtgaattttgatgcgtgttc

SEQ ID NO: 530 - DNA, 625 bp, Artificial
  Synthetic
cccacgcgtccgtctatgtctgtggaggtgatccggaaggcatttcaagcaacggaagagggtttcctctctgttgtgactaaacagtggccggtgaaaccacagattgctgctgttggatcatgctgccttgtcggaattatctgcagcggcacattatatattgccaaccttggcgactctcgagcagtcttgggaagacttatcaaggcaactggagagattctttctgttcagctgtccgcagaacacaatgcgagtattgaatccgtaaggcaggagatgcagtctttgcatccagatgactcgcaaattgtaattttaaagcacaacgtctggcgtgtgaagggtattatacagatttcaagatccattggtgatgtgtacttaaagaaagctgaattcaacagggaacctttgtatgctaagtttcgtctccgtgaaccgattagaaggcccatattaagcgcagatcctgctattttggtgcactctttgcaacctcaagatcagtttattatatttgcctcagatggtctatgggaacacctaagtaaccaagaagctgttgacatcgtacagaatcacccacgcaatgggattgctaaaaggttagtgaaaactg

SEQ ID NO: 531 - DNA, 605 bp, Artificial
  Synthetic
gaaacatacggtatatcaatgatcacctctttcagcatctcaagaggtttgcagctgaacaaaattgtatgtctgcggatgtaatacaaaaagcatttcaagcaacagaagagggattcttttctctggttacaaagcaatggccaacgaagccacagatagctgctgttggatcttgctgtcttgttgcggtgatctgcaatggcaccctttatgttgcgaatgtaggtgattcccgagctgttttatgaaggcttgtgaacgctacgggggaggttcttgcgatccagctttcagctgagcataacgcgagtattgaatctgttagacaggagttgcattcaatgcatccagatgattcacagatagtggttttgaagcataatgtatggcgtgtcaagggtcttattcagatttctaggtctattggtgatgtataccttaaaaaggctgaatacaacagggagcctttgtatgctaagtttcgcttgaaggaaccttttaaaaggcccatactgagcgctgatccatcaattacggttcaagaactcgaaccgcatgatcaatttctaatattagcttctgatggtctttgggaacatctt

SEQ ID NO: 532 - DNA, 696 bp, Artificial
  Synthetic
gttttcacttctccttctgctacttatgttggtgtttatgatggccatggtggccctgaagcctcccgttttgtcaatagacacctcttctcttatttgcataaattttcgaaagagcaagggggtttgtcatcagatgtgataaagagagcatttaatgctacagaagaggattttattcaattggtgaagagatcattgcctgtaatgccacagattgcttctgttggatcatgttgtttggttggtgcaatttctgagggcgaattatacgtggctaatttaggggattcgagggctgttcttggacgcagaggttttgaaggggagacaaattctgtggttgcagaaaggttgtcgactgatcataatgtttcatgtgagaaagtgagaaaagaagttgaatcacttcatcctgatgatcaagctgttgtggtttacattcgaggtgtttggagaattaaaggcataattcaggtctcaagatctattggagatgcatatttgaagaaacctgaatttaacagggatcctatattccaacgatatggaaatcttgtacctctgaagcggcctgtactaacagctgagccttctattgttacacgaagtattaggcctcatgacttattcctgatatttgcttctgatggcctctgggaacacttaactgatcaagtagctgtggaaatagtc

SEQ ID NO: 533 - DNA, 592 bp, Artificial
  Synthetic
gcgtgctggtccagaagctgcccgcttcataaatgaccgccttttcgagaacctcaggaaattcacctcagaggatcaaggaatgtcagctgatgtcataagcaaggcatatttggctacagaagaggagtttctttctctagtgagaaagcaatggctaattaaaccccacattgcttcagtgggatcatgttgtttagtgggtataatatgcaatgggatgttattcattgcaaatgctggagactctcgtgcggtattaggaagagaagagggggatctgaaagaggtcaaagctattcaattgtcttctgaacacaatgcgaatttggaatctgtccgggaggaactacgctctcttcatcctgatgatccacaagtagtagtattaaagcacaaagtttggcgtgttaagggtattatacaggtttcaagatcaattggtgatgcatatttgaagagagcagagtttaatagagagcctttgcttcctaagttcagaactcccggaacattcgagaagccaatccttcttgcggagccatcagtacttgcgcacagactccttccttctgatcagtttatcatattt

SEQ ID NO: 534 - DNA, 579 bp, Artificial
  Synthetic
cggacgcgtgggcggacgcgtggccggacgcgtgggctgagatgatgtatgtcatctggattaatgaacttgttgagggcctgctttcagccaagggcatatggacatgttcatacaggttcacatgcctgcggtcgtcaagatgggctcctatggtataaggatattggacaacattttaatggagagttctcaatggctgaagctcaagctaataatctactggaagaccaaagccaacttgaatctggctgcttgagcttaaatgattctggtccttatggtacctttgtctgagtttatgatggccatggcggtcctgagacttcaagattcatcaataatcacctctttcaacatctcaagaggttcagttctgatcagcaatcaatgtctgtggacgtgattcgaaaggcatttcaagcaacagaagagggtttcctctctgttgtatcaagacaatggccgatgaaaccacagattgctgctgttggatcatgctgtcttgttggaggtatgtgcaatgggacattatatattgccaaccttggtgactctcgggcaggcttgggtaggctt

SEQ ID NO: 535 - DNA, 568 bp, Artificial
  Synthetic
gaattcaggacagtggccaacacatgaatggagatttctcaatggccgttgttcaggccaataatttgcttgaagatcaaagtcagcttgagtcaggtcccttgagcttgctcgagtctggtccttatggaacttttgttggagtatacgatggccatggtggacctgaaactgcacgcttcgtcaacaatcaccttttccaacatctcaaaagattcgccaccgaacaaaaatccatgtctgtagatgtgattcgaaaagcatatcaggcaacagaagagggttttctctccgtggttactaaacaatggccaataaaacctcaaattgcagctgttggttcttgctgcctttctggtgttatttgtggtgggactctatacattgcaaacctgggtgattcccgggcagttttaaggagagtaatcaaggctactgggggggttcttgctatccagttatcagctgagcacaacgctagcatagattctgtgagacaggagctgcgtgcaacacatcttgatgatccacacataatagttttaaagcataatgtgtggcgtgtaaa

SEQ ID NO: 536 - DNA, 611 bp, Artificial
  Synthetic
cacgccaccaccaccacgcgcgacggacacgctccccctcactttcactccacacacacacacttcacggttcgcgcgacgaacaaacgggcagaaaaaccctgccacgacgacccacgactgagccgagcgtacgcacgcacccacgcacgccatgggggcgctgcggcggtggctgccgtgctgctgctgctgctgtcgcggcggcggaggaggtggtggtggtgggagcgtgggggatgggctggtgtgggacgtggccctgaaggcgcacgcgtcgggggactactccgtggccgtggcgcaggcgaacgaggcgctggaggaccaggcgcaggtgttcgtctccccggcggcgacgctcgtcggcgtgtacgacggccacggcggccccgaggcggcgcggttcgtcaacaagcgcctcttctccctcatccaagagttcgcggcgcagagcggcggcatctcggcggaggtgctcgagaaggcgttcggcgagacggaggaggagttcgtggcgtcggtgcagaggtcgtggccgtcgcagccgaggatcctgtccgtcggctcgtgctgcctcgtcggcgccatcgaggacggcacgctctacg

SEQ ID NO: 537 - DNA, 611 bp, Artificial
  Synthetic
ctctgtgtttcacttgctgcctttcagttgcaaagcatagctgttctcacacctgccttgtagctagagtggttagcagagaagggaagcagtggagttcaggttcagccatggaggttgaggcttcctacagctatggcttccttccttcaggcaggcaccagccttatgcaccacctcctccccaccctgcagaggaaggcgaattgtgggagtactttccatgccctttctgttacatcgaggttgaggtgcccttcatctgcaaccatcttcaggaagagcattgctttgacaccagaaatgctgtgtgcccgttgtgcgccgacaatatagggagagacatgggtgcccatttcagagttcaacactcacatcttctcaagagaaggaaaccttctaggcccagcagctcatggcctacaccctccaacaattcagacccctactttgaggggcctccacagtatatgatgaacaacaggacataccaagatcctgcacctgatccactgctctcccaatttatctgcagcatggctcaaactgacactaactcggataacacaaacactgaaattgcagtttcagcagtctcacatgatcagagg

SEQ ID NO: 538 - DNA, 823 bp, Artificial
  Synthetic
agaagacccaaatccagttagagcgaaaccctaaatcacaactctcaaagatgctacgaatagcaggtagaaagctctcttcctccgctgctgctcgatcttcatccgctttcttcaccagaaatcctttcaccttcaccgatgattcatcatctacggccagatccccttctcctacttccattgcttctcaatttgtcgatcaaatcagaggtttctcatctaattcagtttcccctgcacatcagacgggtttagtctcagatctcccagcaacagtggctgctattaagaatcccagttcgaagattgtatatgatgatagcaaccatgagcgttatccacccggtgacccgagcaaacgtgcatttgcttactttgtattgacaggaggcaggtttgtctatgcctcattggttcgcctcctgattcttaagtttgttctgagcatgtctgccagtaaagatgtccttgcacttgcgtctcttgaggtggatctttccagcattgaacctgggacgaccgttactgtcaagtggcgtgggaagcctgttttcatcagacgccgtactgatgaggacatcaatttggcgaacagtgtcgatcttggctcccttcgcgatccacaacaagatgctgagagggtcaaaaatccagaatggcttgttgttatcggggtatgtactcatctagggtgcatacctttaccaaatgctggtgattttggtggttgggtttgcccatgccatggctcccactatgacatctctggtgggattcgtaaaggacctgcaccatataatctggaggtgcctacctacag

SEQ ID NO: 539 - DNA, 635 bp, Artificial
  Synthetic
agggcattgggtttcttgagggctgctcgggcgccatggctgcgtcactgatccgggatctagggaagaagatagctccgcgcatcgcggcggcagcgtcggcgtcttctttccacacttgctcgtccggcgcctccaggggcgcggcgttgggcgctagcaacgtaatggcgcattgggactgggacagggaagacggcaagaccaccccatggagccactccactacacgaggatgcgccgtcaccacccggggcgccgatctaagcacacgaaacgaagactcggctttcctccaggctctccgcaaccccacggccaacatcacctacgacgaggaggtggtggagcggttcccgccgggagacccggaccgagcagcattcgtctacttcatcgtcacgggctcccgcttcgcatacgccgccgccatccgcgtcttcatcctccgcatgatcatgaccatgtccgccagcgccgacgtcatggccctctccagcctcgaggttgacctcagcaacgtcgtcgagggggcgaccatcaccgtcaagtggcgaggcaagccggtgttcatccgccgccggacctcagacgaggtggcggaggcaaacagcgtttcggtgaattccctgcgc

SEQ ID NO: 540 - DNA, 608 bp, Artificial
  Synthetic
acttcataaaatcaatttttgttaattaaaaaaatggcttctaacaaggttttctctactcttgctattttccttacttttaacctaatttttttcacatttgtttctggttgtggaacttgtcctaaaccaaaaccgccaccaaaacctaagccttcttgtcctcctcctccatatgttccaaaaaaggaaacttgcccaattgatacattaaaattaggtgtttgtgctaatgttcttggattagttaatgttgttgttggttcaccaccagtgaaaccttgttgtagtcttatttcaggacttgccgatgttgaagctgctctttgtctttgtactgctattaaggctaatgttttaggcattaatcttaatgtacctgtctcattgagtttgcttcttaatgtttgctccaagaatgtcccttctggcttccaatgtcctacttaattgaattaaacgacagttcagtgcacaaagtatctcgcgctgactcagaagtcagataagagttaaaaattcaaagtttatctcattgtttgtattttctttgagggttttctatttttcatgtcaatttttctttttggagtttggggtgggggtgg

SEQ ID NO: 541 - DNA, 680 bp, Artificial
  Synthetic
tagtacaattaagaagtagctaagttttccaatacgatgggcggcggcaagaataaggtgcaggtttgtgcggtgttcgtcgttgctctgaatatggtcatctccatgcagatgggtgcagtgcaggcatgcgagccctactgccccaccccgacgccgccggtgacgccgcctccgtcgccgccgtcgggtggagggaataagtgcccgatcgacgcgctgaagctgggcgtgtgcgccaacgtgctcaacctgctcaagctcaaggtgggggtgccggcgagcgaggagtgctgcccgctgctgggggggctcgtcgacctcgacgccgccgtctgcctctgcaccgccatcaaggccaacgtcctcggcatcaacatcaacgtccccgtcgacctcgtcctcctcctcaactactgccacaagacctgcccttccgacttctcctgcccactcatctgattcttaatcttcattaccaccacaaccctagctacctaattaaggcttaagctttgcatggcttagtctgtgtgttgcagttgtgtcatacatatatacttatctcgatctatcagtgtgattattgatgatcagatcgatcatctaatatatgtatcttgttattttaatgcgtactgtcaaataaaagtttcctccagtgtacgtacgttctatct

SEQ ID NO: 542 - DNA, 665 bp, Artificial
  Synthetic
cccccccgacctctctctagttgcagaccatcacttacgtagccctgtgtgcaacggcgcaagtgcttgtacgctttcagctagcgtagccatggcttccagggcattcctcctcgtggctctaaacctggtcctcttcttcaccgtggccagcgcctgcggcaagtactgcccgacgccttcgacgccgtcgacgacgccatcgacgccgtcctacaacaccaagtgccccaagaacgcgctcaagttcgcggcgtgcgccgacgtgctgggcctcgtcagcgccgaggtcggccagccgccgtacgagccgtgctgcggcgtcctcggcggcctcgccgaccttgaggccgccgtctgtctctgcaccgccatcaaggccaacgtgctcggcatcaccctcgacatccccgtcaagctcagcctcctcgtcaactactgcggcaagaacgtccctagtggcttcatctgtgcttaagctacgtaacgcgcgtacggtgtaacgacgtgctagctttgcatgcatgcagcacgcatgcacgaacacatcgttcgttcttgagtgcctgcatgcatatcggtcgagtctttacttactctgttattagttctgaatgtagaactgcttcagatatcaatccagcgagttaactgtacttgatttg

SEQ ID NO: 543 - DNA, 496 bp, Artificial
  Synthetic
aaaaatctacttataacaactaaagttagtagctatatcattcattaagaaatggcttctaaaaaaactacttctcttgctctctttattcttgtcaaccttctatttttctcccttgtgagtgcatgtggcacttgccctagtcctaaaccaaagccaaagccgaaaccaaaaccaggtcctagcccatccaaaggcaagtgcccaattgatactctaaaattaggtgtttgtgctaatgttttaggcaatttgcttggacttttgattggtaatcctccaaaaaaaccttgttgcactctcattcaaggtgttgcggaccttgaggctgctgtttgcctatgcactgctattaaagccaacattcttgggattaaccttaatgtccctctttctctaagccttcttcttaatgtttgtggaaaaaaggttccatctggcttccagtgtccttgaacagtacaacgtccacatattttgatttgggttttggatt

SEQ ID NO: 544 - DNA, 612 bp, Artificial
  Synthetic
tcagtattaatacaaaacataaatcctctgcttcgttatggattcaaagagatacttagttactctctttttattctttaacattcttttctttacccttgtaagtggctgctggagtggctgcaataatccaccaactccaaaaccaaattcgaacccgaacccaaatcctaaccctagcccatcaaagggacactgccctagagatgccctaaaactaggtgtttgtgccaaggtgctgaacggacctgtcggagccgtcatcggaactccaccggacatgccttgttgttccgtactaggtggacttttggatcttgaagctgcagtttgcctttgcactgcactgaaagccaacattcttggaataaacattgatattcccattgcattaagcttgcttattaatacttgtgggaaaagtctaccatctgacttcacttgtgcctaagctataatgcttctcttttaaagttcatgttgtattttagttcttcgttgttaggacttaggaatgagcacttgataatttgtacgaagctagggaatgttcttccatctcctttgtaattcactagtgctttctctattgacttgatgaatttctaattc

SEQ ID NO: 545 - DNA, 788 bp, Artificial
  Synthetic
cccacgcgtccgcccacgcgtccgcccacgcgtccgcaaaaagcagctccagcttcttctgatcgatcgatcgagctgagctataggcagtagctgctaattaagctaattaattgctaagcagtagtagagctagctaattaattaagatggccggcaagaaggtgcaggtttgtgcgctgttccttgccctcaatgtgctcttcaccatgcagatgggtgcagtagtgcaggcatgcgagccctactgccccacaccgacgccgccggtgacgccgcctccgtcgccgccgtcgggtggagggaataagtgcccgatcgacgcgctgaagctgagcgtgtgcgccaacgtgctcaacctgctgaagctgaagatcggcgtgccggagagcgagcagtgctgcccgttgctgggtggcctcgtcgacctcgacgccgccgtctgcctctgcaccgccatcaaggccaacatcctcggcatcaatctcaacatccccgtcgatctctctctccttctcaactactgccacaagacctgcccctccgacttcacctgccctctctaaattaatcgatcctccgatcccttaattaccataccattacaccatgcatcaatatccatatatatataaaccctttcgcacgtacttatactatgttttgtcatacatatatatgtgtcgaacgatcgatctatcactgatatgatatgattgatccatcagcctgatctctgtatcttgttatttgtataccgtcaaataaaagtttcttccacttgtgtt

SEQ ID NO: 546 - DNA, 642 bp, Artificial
  Synthetic
caacatttcactaattagccacattcaattgttgagagtgctaactatttaactcttagaaatggctaagtttgcaatatcctccattgcccttcttctcactttgaacattgtcttcttaactatggttagttccactaatgtcccatgcccacccaccccatcaaagggtcattccaagccccaccctaagcctacccctaccccctctatcccatccaccccatcaactccatcatcaaaaggtaagtgcccaaaggacacacttaagctaaaagtgtgtgccaacttattgaatgacttggtgcaccttgttattggaagtgatccagccaagactccttgttgttctctaattcatggacttgctgatcttgatgctgctgtttgcctttgcactgcaattaaagccaatttattgggaattaacctcaacgtacctctttccctcagtttgttgctcaacaactgtggaaagtatgttcctaaggatttccaatgcgcataaactagctagccaataactttctccctgcagaaaatttccacttcatatatttatttttcagtgtgtttaatttggtattttgtatgcttatagtttgcttatgttttcaaaggaagatatattgtattctaatt

SEQ ID NO: 547 - DNA, 665 bp, Artificial
  Synthetic
cccacgcgtccgcccacgcgtccgaattacttctctttacaattgttctaggaagtacattctgccttaacttccttataatatggcttccaaaacaagagcctcaattgcccttttcctctccttcaatctccttttctttgccatagccagtggaacagattgtatctcatgtcattataattctcctagcaccggtaatggtggtggcaatagtggtaatactggtggctcgggcaatggcggcggaggtggcaatggacaaggcacgtgcccgagagatgctctgaagttgggtgtatgcacaaatttagttggtggattggtgggcgcggtagttgggagtcctccaacgatgccatgctgcagcttgatcgcggggctggcggatttagaggcggcagtctgcttgtgcacagccataagggcgaacatgttgggaataaatctgaatgtgccactctctcttagccttgtcctcaacaactgcggaaggaatcctcctaatggcttcacctgctaatccaacgtccccaaatgcgtatttcagccttttgctatgtcagtcatgtactcatgttgtgtttgcatcaattttcctttatgatcatttgtttgctatgttgtgccaattgttattacaataagcgatcgagcttgcaaaa

SEQ ID NO: 548 - DNA, 577 bp, Artificial
  Synthetic
tcacagtagtgagtgcatgcagtacttgcccaggccctaaacctaaacctaaaccaaagccaaagccaaagccatgcccccctcctccttcttctcatggtggcaaatgcccaactgatgccttaaaactaggcgtttgcgctaatgtgcttaacggtttgctgaatgttaccctgggaactcctccagtaaaaccatgctgcagtcttattggaaatcttgtggatttggaggctgctgtctgcctttgcactgcccttaaggctaacattttgggcatcaaccttaatctccctatttctcttaacttactgctcaatgtttgtagtaagaaggctccaaagggattcacttgtccctaaatggttctctcgcttttcgtttttcttctgaagttggtttttgattttcatttgtttagcagtttgtgatgttcgatttatctcctgcattaaacttcttgttaggtgcaaggttgtggtttgttttggattgatcattgttggaaagcgcttttgtaaggccaattgtttgtgtaccctttggaaataaatatatttcttggatgattctctct

SEQ ID NO: 549 - DNA, 598 bp, Artificial
  Synthetic
caaaacgttacaatggcttctaaggctcttgcagttacagctcttcttattacacttaatcttcttttcttcacctttgtaacctccacaaaatgtccaccaactactcctaaacccccaaaaaccccgaaatcgcctaagaaggctcctgccgtgaaacccacttgtcctaccgacacacttaagcttggtgtttgcgcagacttattgggcctagttaacgttgttgttggttctccaccaaagactccttgttgtacacttcttcaaggtcttgctaatcttgaagctgcggtttgtctctgcaccgctcttaaagccaatgtcttggggattaatctcaatgttcctattgatctaaccttgctgttgaactattgtggcaagaaagttcctcatggtttccaatgttcttgaagatttgagactttaaaagagaaaaatctctttggtttgctatgtttttatatgtttgtttctactgttatctattggttttgtgagaaaaagctttgttctgtcactgttgagtttgatgtaatgcttgagcttgttcatgatagaacctttgttctctcaatattgagtttgatgtaat

SEQ ID NO: 550 - DNA, 452 bp, Artificial
  Synthetic
aaaaatggcttcaagttccatagctcttttcttggctctcaatcttctctttttcacaacaatctccgcctgtggtagctgtactccgtgcggcggaggttgcccctctcccaagccaaagccaactcctaaaccaaccccaagccctagctctggctcgagcaagtgccctaaagacaccctcaagctcggtgtctgcgctaatgtgctcaacggcctcctggacttgacccttggcaagccaccggtcgagccatgctgcagcctcatccaaggactcgctgatgttgaggcagccgtttgtctctgcaccgctcttaaggctaacattcttggaatcaacttgaacctcccaatatctttaagtctactccttaatgtttgcagcaaacaacttcctcctggcttccaatgctaaaaaccatattgatatataatttaaatacacttat

SEQ ID NO: 551 - DNA, 542 bp, Artificial; identical to SEQ ID NO: 24
  Synthetic

SEQ ID NO: 552 - DNA, 658 bp, Artificial
  Synthetic
gcgggcatatgcatcgcggggaagaggaggattgatggccaacgaccacgggccaggggcaattcgagcatttcttcgagctagccgaggctggttcttccccgacgatccaaaccgcgacgaggacgatgaagagtccgaggaggaggggagccaagcgaaaaaaggatcaggacaggctcctctacagaacgttctttcccaggagataaacatggccacttccgcaagcgacgagacgctgaagcgagccacagccaagaacgggagaacagtccacactgtctcgatgctggcggctagagagatcaactcttcgaagaatgggaagttctcttctgccgaagcttgccatctttcgtcgagatttctgccatccaagggagccgatgtactggctcgaaggaattcccggctctacatcagccagttttccaacaatggatctctcttcgttgctggctttcaggaccggactatcatggtctacgatgttgataacaactggacgcttcacaagagagtgaaagcccgtaacatgaactggactatcaccgatacggctttatctccggaccaacgatttctggtctatgcttcgataactccagtgttgtttctagtcaaccttgggaacaatactggtggaacagattct

SEQ ID NO: 553 - DNA, 636 bp, Artificial
  Synthetic
aacgcttcaggacgattaccagtagttactaccgtggggcacatggcatcattgtaggtttctcttctctcctttttagaactattaacaggtggatttggtctttctggctctgtaaaatagttcctccaaccactattttggtgattctggcagatagtttatgatgtaactgaccaagaaagctttaacaatgttaagcaatggttgagtgagattgatcgttatgcaagtgacaatgtaaacaagcttctggttgggaataagtgtgacctggctgacaaccgtgctgtgtcttatgatacagcaaaggcttttgctgatgaaattggtattccattcatggagactagtgcaaagaatgccacttatgttgagcaggccttcatggcaatggcagctgacataaagaataggatggcaagccagccagcatcgaataatgcaaagcctccaacagtccagatacgaggtcgacctgtttcccagaagagtggttgctgttctagttagaatcacttttcaggccttctcctggttgtattgtgccagatatattctttttaatctgccagtattctggtggcctgtacaaatcataagggttactccttaagatttttctttcctctttga

SEQ ID NO: 554 - DNA, 590 bp, Artificial
  Synthetic
accaaacacgcgcacacgcagccgagatcgagagcgagctacttgccctagcagcagcagcagcgaggagcgcgagggggcggcggcggcggcgtgcatggcgggggctccgtcgaggtcgcgcggcgacttcgaccacctcatcaagctcctcctcatcggcgacagcggagtaggaaagagttgcttgcttctgaggttctcagatgacactttcactacaagttttatcaccaccattggcattgatttcaaggttcggacagttgagcttgatggaaagcgtgtaaaattgcagatttgggatactgctggtcaagaacgtttccggacaattacaactgcctactatagaggtgctatgggcattctgcttgtttatgatgttacagacgagtcatccttcaacaacattagaaatgggatccgcaacatagaacaacatgcatctgataatgtcaacaagattttggtgggcaacaaggttgatatggatacaaagcgggtggtgtccacagctcaaggacaaaagctcgcacatgagtatggaatgaaattttttgagacgagtgcaaaaacaaatcagaacg

SEQ ID NO: 555 - DNA, 512 bp, Artificial
  Synthetic
gaattcaacgagccccagccagccttctcgatctgagactttttagacagacagattgcgaatccattatttctggtggtgatctgaaaccaatcactcggattactagatggcagcagctccggcacgtgctagggctgattatgattacctgattaaacttcttctcattggtgacagcggagtcgggaaaagttgcctgctattgcgttttcctgatgattcttttacaactagttttattacgacaatagggattgacttcaagattaggaccatcgaacttgatgggaagcgaatcaaacttcaaatatgggatacagctggtccaaaacgtttccgcactattactacagcatactacaggggaaccacgggtattcttctggtgtatgatgtcacagatgaatcttcattcaacaatatcccgaactggataataaacattgaacagcacgcatctgacaatgtaaacaaaatactggtggggaacaaagctgatatggatgaaa

SEQ ID NO: 556 - DNA, 700 bp, Artificial
  Synthetic
cgggagggaagatcatcgtgcatcgcgcggaggtctggatcggcagcgctaatggcggcggggagagcgcgggcggactatgactacctcatcaaattgctgctcatcggcgacagcggtgtggggaagagctgccttttgctgcgcttctcggacgattccttcacgacgagcttcatcacgacgataggcattgacttcaaaatcaggaccgttgacctggatggcaagaggatcaagcttcaaatttgggacaccgctgggcaagaacgcttccggacgatcacaactgcatactaccgaggagctatgggcattcttctcgtctacgatgtgacggatgaatcatcgttcaacaacatccggaactggatcaggaatatcgagcagcacgcgtcggacaatgtgaacaagatcctggtcggcaacaaggccgacatggacgaaagcaagagggccgtatcaacagaaagagggcaagctcttgcgaacgagtttggtatcaagttcttcgaaaccagcgcgaagacgaacatgaacgtggagaacgtcttcttcacaatcgcgggagacatcaagcggagactagcggaaacagactccagacccgagcctcccaggatcaacaacgtaatactagacccgtcgaaggatcagaacaacaacaaagacaagtcatcatgttgcacctgagagcaag

SEQ ID NO: 557 - DNA, 379 bp, Artificial
  Synthetic
tttctttttctccttttgtccgtacgcgttttcttaccggtgacctgaaagtctcaaaaaatggcggcgtatagagctgacgatgattacgatttcctctacaaggtggtattaatcggtgattccggcgtcggtaaatccaatctgctttctcgattcacgcgcaacgagttcagcctcgagtctaaatccaccatcggtgtcgaattcgccacccgaagcattcatgtcgatgaaaaaatcgtcaaggctcagatttgggacaccgccggccaagagagataccgagcaatcacaagcgcatactatcgaggagctgttggggctttgcttgtttatgatgttacacggcatgtgacatttgagaacgttgagagat

SEQ ID NO: 558 - DNA, 595 bp, Artificial
  Synthetic
attgtgagagtagcacaggagtttagtttggattcgggctcggggcgagaagaatgtcggatttcgatgtgaagatcgactatgtgttcaaggtggtattgattggcgactccgccgtcggcaaatctcagctgctgtcgagattcgcgcgcgacgagttcaccctcgactccaagtccacaattggcgtcgagttccagacccgcaccatctccgtcgacggcaagaccatcaaggcacagatctgggacaccgccggccaggagaggtacagggcggtgacgagcgcttactaccgcggcgcggtcggcgccatgctggtttacgacatcacgagaaagcagacgttcgagcacgtagcgcggtggctggaggagctgcggaaccacgccgacaacaacgtggtgatcatgatggtcgggaacaagtcggatctgaccgacaagcgggccttgtctttggaggaggcgcgagagtttagcgagaaggaggggctctacttcatggagacgtcggcactcgactcgaccaacgtcgagacagccttcatcaccgtgctcacggagatctacaagatcgtcagcaagaagagcct

SEQ ID NO: 559 - DNA, 589 bp, Artificial
  Synthetic
gagagagagaaagggagaaagagagatgcaccgtctttccttcgacaaagcactctagatctgtgttttaggcagagagagagaaagagagagagagagaaaaaccagcgaccctttcgaaatccgttgattccttaagcgggggcccgggggcaggttgcggggtaactgatacttgctatcagggtttcttcggaacggcggggtggaagcatgtcctaccgatcggaagatgaatatgattaccttttcaaggtggtcttgattggggactccggggtcgggaagtccaacctcctctcccgatttacaaggaatgagtttagccttgagtccaagtcgacaattggcgtggagttcgccacgcggagcatcagcgtggatgggaagatgatcaaggcacagatttgggacaccgccggacaagaaaggtacagggccatcacaagtgcctactaccgtggagcagtgggagctctgttggtttatgacctcacccggcaggtgacattcagtaatgtacctcgatggctgaaggagctgagggaccacacagactcctcggtggtggtgatgctggtgggggaac

SEQ ID NO: 560 - DNA, 645 bp, Artificial
  Synthetic
ctgcttagacttcagtgaggccagcatattctgtaggttccatccagaggaagaaaatggggtgtgctgcttccaggccggtgaaaggcttgcaaaatctgaacgacagtgctcaggagcacgatgccaaacacttgagggtcaagctggttcttctgggagactctggagtaggaaagagctgcattctcgtgcggtttgtgaagggccagtttgatccatcatcaaaggtcacagttggtgcttcctttctgtcgcaaaccatagctctccaagactcaagtacagtcaagttcgagatatgggacaccgcaggacaagagagatatgcttcgttagcaccgctctactacagaggagcgtctgcagccgttgtagtctacgacctgacgagcaaggaatcgttccagaaggctcagtactgggtcaaggagttgcagaaacacgcgaactctggaattgtcctggcgctcgttgggaacaaagccgaccttgaagactcgcgtgcggtctcgtcagatgaagctcggtcatacgcagagagcaactccatgtacttcagcgaggtgtcggcaaaaactgccgacaacatcaacgcgcttttcgaggaaatcgcaaagagacttcctcggcctggaaagcaat

SEQ ID NO: 561 - DNA, 641 bp, Artificial
  Synthetic
tcaagtttgagatttgggataccgctggtcaagagcgatttgcctctctggcgcccatgtactacagaaacgcccaggccgcccttgtcgtctacgacatcaccaagcccacatccctcgtcaaggcccgacactgggtcgccgagctccaacgacaagcctcacccggtatcgtcatcgccctggtaggaaacaagctagatttggctggcgaatcgaatggtgcaagcgaggaagccgagggcggggaagacggcgatgcccgcaaagtgtcaacagaagaagcccagtcgtatgccgaagaggagagtctgttgtttttcgagacgagtgcaaagacgggccacaacgttaccgaagtcttcacagctattgcaaatgcgatccccgagacgtctctcaagagtgctaggggagccggcgcagcgggcacggccaaccgggctggagacgagcagagagtgaacctatcaggaccaagggatgccggagcaaaggacggatgtgcctgttagatgggagatatttgaattgttatacaaggtacaagcaccatgttgtcggttgctaccgctgctgcgctacccgtcagatgaggtcggatttgttatggcatgtcattcgggagtcagagtcttgcg

SEQ ID NO: 562 - DNA, 683 bp, Artificial
  Synthetic
ggagggcaaaacaataaaggctcagatctgggacacagcaggacaggagagatatcgtgccatcacaagtgcttactaccgtggcgctgttggggctctccttgtttacgacatcacaaagaggcagagcttcgacaatgtccacaggtggcttcgtgagctccgcgaccatgccgactcgagcattgttatcatgatggtcggtaataagtctgatttgattcatctaagggctgtctccgaggatgaaggtaaggcattggctgaaaaggaggggctgttttttcttgagacatcagctatggaggccgtgaatgtggaggaagcctttcagactatcatcacagaggtctatggcattgttaacaggaaagcactggccgccaaagaagcagctgctgcttctgctccgctgccttcccagggtaaaactatcagcattgacagcgctgcaggaaacacaaagagggcatgctgctctgcttgatatgtacaatggagcgttcaacatcatattgtagagagccaggtgtgagattcgcgggtagactcggagcatagtgatcttaaatggtttggaggcaagtcctactttttttttttcagttgcgtgaacattccagagtgcctagctgcagttgcagtttgttcagtgtttcctaatcaaaagttagatgtgtgta

SEQ ID NO: 563 - DNA, 988 bp, Artificial
  Synthetic
gccattacggccgggggttctgaccattttcccctttcagcccaatgttgccgacgactttctgaccttctcaaaaacctctgtgtttctctcacatttctggtgccaatctcttgggttttgcatttgctgattcagatatttattggagaagacgatggcagctccaccagcgagggctcgagcagattatgattatcttatcaagctcctcctcattggtgatagcggtgtgggaaagagttgtttgctgctgaggttctcagatggttcctttacaacaagtttcatcaccactattggaattgactttaagataagaacaattgaacttgatggcaagcggattaaattacaaatttgggatacagctggtcaggagcgtttccgcactatcacgacagcatattatcgaggagccatgggtattctgctggtgtacgatgtcacggacgagtcatctttcaataacatcaggaactggattcgcaacatagagcagcatgcttctgacaatgtcaataagattttggttgggaacaaggctgatatggacgaaagcaaaagggctgtgccaacttccaagggtcaagctcttgctgatgaatatggcattaagttcttcgaaacaagtgcaaagacaaacatgaatgtggaagaagttttcttttcaattgctagggatatcaaacaaaggctttcagaatctgattccaagactgagcctcaggcaatcaagatcaaccaatcggatcaggcaggaacttctggtcaagctgtacaaaagtcatcttgctgtggttcgtgaatggagccaatcgtgtgggaagaacattcgttagttgcatttggatgtaaaaattgattgggatgaaaaactgattcctgttaacttcattaccaaatatttatttgccatctgatggcaagcttgatgtgtcaaaggttttactgctttcgttttgaatctattgtcatacagttaact

SEQ ID NO: 564 - DNA, 581 bp, Artificial
  Synthetic
cccctctccgcctcgcgaatctcctcccctcccccacgcaactcgccgcctgcgctgccgctgctcgtgagggggagacgacgccggaggagatcgccgccgccgccgccgccgcctcggacggccgcgcccccccgccgcgcgtgtaccacgggcttgggggattgattggtagcgatggcggcgccgccggctagggctcgggccgactacgattatctcatcaagctgctcctcattggcgacagcggtgtaggaaaaagttgtctcctcctacggttctcagatggctctttcacgactagtttcattaccacaattggtattgacttcaagataaggaccgttgagttggatggtaaacggattaaattgcaaatctgggatactggtggccaagaacgctttcgaactattaccactgcttactacaggggagcaatgggcattttactcgtttatgatgtcaccgatgaatcttcattcaacaacataagaaattggatcagaaacatcgaacaacatgcctctgataatgtgaacaaaattttggtggggaacaaagctgatatggatgaaag

SEQ ID NO: 565 - DNA, 622 bp, Artificial
  Synthetic
ccaacttctcccgggcagctgttcaaatcggaaaaccgccgaaatggcaagagggttgaagaaacatttgaagaggctcaatgcgccgaagcattggatgcttgataagcttggtggggcctttgctcccaagccttcttctggtccacataagtcaagggagtgtttgccattgattattatcctcaggaacagactgaaatatgctttgacataccgtgaggtcatctcaattttgatgcaacgacaagttatggttgatgggaaagttaggactgataagacttaccctgctggtttcatggatgttgtttccattccaaagacaaatgagaacttccgattgctttatgacactaagggtcgcttccgtctccactcactcagggatgaggaagcgaagttcaaactttgtaaggttcgatcggtgcagtttggacagaaggggattccatatctcaacacttatgatggaagaacaattcgctacccagatcccctcatcaaggccaatgacaccattaagctggatttagaatccaataaaattgtcgacttcatcaaatttgatgttggaaatgtggtcatggtgactggtggtagaaacaggggacgtgttgga

SEQ ID NO: 566 - DNA, 1030 bp, Artificial
  Synthetic
caggtaagatacttaagccggcggtggccgagagctctcggtgaggtgattcaaactctaatagaccaaaatggctagagggttgaagaaacatttgaagaggctcaatgcgcctaagcattggatgctcgacaaacttggtggagcctttgctcccaagccttcatctggtccacacaaatcaagggagtgtttgccgctgatcattatcttgcgaaacaggttgaagtatgctctcacataccgtgaggtgattgcaattctgatgcaacgacaggttatggttgatgcaaaagtgaggacagataagacttatccagctggtttcatggatgttgtatcaattccaaagactaatgagaactttcgtctcctttatgacacaaaggggcgattccgtcttcactctatcagggatgaggaagccaagtttaagctttgcaaggtccgatctattcagtttggtactaaggggattccttaccttaatacttatgatggtagaacaattcgctaccctgatcctctcatcaaggccaatgataccatcaagttggacttggagtccaataagattgttgacttcatcaagtttgatgttggaaatgttgtgatggtaactggtggtagaaacaggggacgtgttggtgttattaagaacagggagaagcataaaggtagctttgagaccgttcacattcaggatgcccttggccatgaatttgctactcgcttgggaaatgttttcacccttggcaaaggaacaaagccatgggtgtctctacctaaaggaaaaggtatcaagttgtccatcattgaggaggcacggaagaggcttgctgctcaatcagctaccactgcctgagttaccctggttgctcgtttcttcatttccatactcttcgagtatggaatacttgtgttttacagttttggactcgatgtttctatttgcttagtggcaatgccttttatattgtacttgtttgcttggcatattttaaatagattaaaactgtgtctttccgat

SEQ ID NO: 567 - DNA, 626 bp, Artificial
  Synthetic
tccggctgcaaacatggcaagaggattgaagaagcatctaaagaggctcaatgctcctaagcattggatgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtgtgattaagaaccgtgaaaaggcaattctcgagc

SEQ ID NO: 568 - DNA, 690 bp, Artificial
  Synthetic
aaaattcttacagcaccaaaatggctagagggttgaagaaacatctgaagaggctcaatgccccgaaacattggatgcttgataagctcggtggagcatttgctcccaagccatcctctggtccacacaaatcaagggaatgcttgcccttgatcattatcttgcgaaacaggctgaagtatgctctcacatacagagaggtgatctcaattttgatgcaacgtcaagttatggttgactccaaagttaggaccgataagacttatccagctggtttcatggatgtggtttcaattccgaagactaatgaaaacttccgcctcctttatgacaccaagggccgattccgtcttcactcagtcagggacgaggaagccaagtttaagctttgcaaggtccgctctattcagtttggccagaagggaattccatacctgaacacttatgacggaagaacaatccgctatcctgatcctctcatcaaagccaatgataccgtaaagctggacctggaatccaataagattgttgatttcatcaagttcgatgttgggaatgttgtgatggttaccggaggtagaaacaggggacgtgtcggtgttatcaagaacagggagaagcataagggtagcttcgagaccgtccacattcaggatgcattggggcatgaatttgctacccgtttgggaa

SEQ ID NO: 569 - DNA, 606 bp, Artificial
  Synthetic
tcggcacgctgcgaagctggagctggagcaggaggaataagaaggagaaggaggaggaggaggagcagcagtccagctatggcgcgaggattgaagaagcacttgaagcggctcaatgccccccgccactggatgctcgacaaactttgcggtgccttcgcccccaagccctcagcaggtccccataaagagagggagtgcctgcccctttttgttcttctcaggaacaggttgaaatatgcactcacataccgtgaggttgttgcaattgtcatgcaacgacttgtctccgttgacggaaaggtccgtactgacaaatgttaccctgctggatttatggatgtcgtttcaattgcccgaaccaacgagaatttcagactcttgtatgacagcaaggggaggttcactgtccactctgttggtgtggaagaagccaggtacaagctctgtaaggtgaaagcagtgaggtttggcgataaaggaatccccttcctcactaccaacgatgggcggacgatccgctatcctgatcctctcatcaaggccaatgacactgtcaagatcgacctagagacaggaaaggttgttgacttcatcaaatttgac

SEQ ID NO: 570 - DNA, 686 bp, Artificial
  Synthetic
acgcgtcgcggacgcgtggggcgatggcgcggggaccgaagaagcatctcaaggtgctcaatgcgcccaagcattggatgctcagcaagctcggcggtgcctttgctccaaagccatcgtcgggccctcacaaggagagggaatgcctgcctctggtcattcttctgcggaacaggctcaactacgccctgacgtaccgcgaagtcatgtccattgtcatgcagaacctcatctcgattgatggcaaggtccgcacggataagtgtttccctgctggattcatggatgtcgtgactatcggcaaggtcaatgagaactatcgtcttctgtatgacaacaagggccggttcactctgcattccatctctgctgaggaggctaagttcaagctctgcaaggtccgtgctgtcaagttcggcgacaagggaattcccttcctcacgacttacgacgggaggaccatccgctacccggacccgctgatcaaggccaacgacaccatcaagatcgaccttgagacggggaagatcaaggagttcatcaagttcgacatcggcaacatcgcgatggtcaccggcgggcgcaacaggggccggattggcaccatccagcaccgtgagaagcacaagggatccttcgacatcatccacgtcaaggacgctgtgggccaggacttcgccacccgc

SEQ ID NO: 571 - DNA, 641 bp, Artificial
  Synthetic
gcggggaccgaaaaaacatctcaaggtgctgaatgcaccccgccattggatgctcagcaagctgggcggtgccttcgctccaaagccatcgtcgggtcctcacaaggagagggaatgcatccccctggtaattctcctccggaacaggctcaactatgctttgacgtaccgggaagtcatctctatcgtcatgcaaaacctcatctccatcgatggcaaagttcgcacagaaaaatgctttcccgctggtttcatggatgtggtgactatcgggaaggtgaatgagaactaccgccttctttacgatacaaaaggccggttcactctccagccggtcaccgacgatgaggcaaagtacaagctttgcaaggttcgtgccgtgatgttcggatctaagggaattcctttcctcacgacttacgacgggaggaccatccgctaccccgatcctctgatcaaggcgaacgacaccatcaagatcgacttggagactgggaagatcaaagagttcatcaagttcgaggttggcaacatcgccatggtcacgggtggccgcaacaggggaaggattggaaccgtccagcaccgcgagaagcatatgggaagctttgatataatccacatcaaggacgctgccggcc

SEQ ID NO: 572 - DNA, 592 bp, Artificial
  Synthetic
gccgaaaatggcccgaggacccaagaagcatctcaagcgactcgcagctccctcccactggatgctggacaagctgtccggcacctacgctccccgatcgtctgccggtccccacaagctgcgagagtctctgcctctcgtcatcttcctgcgaaaccgtctcaagtacgccctgaacggccgagaggttaacgccattctcatgcagcgactggtcaaggtcgacggcaaggtccgaaccgactccactttccccgctggcttcatggatgtcatccagctcgagaagaccggcgagaacttccgacttgtctacgacgtcaagggccgatttgccgtccaccgaatcaccgatgaggaggctgcttacaagctcggcaaggtcaagcgagtccaggttggcaagaagggtatcccctacctcgtcacccacgacggccgaaccatccggtaccccgaccctctcatcaaggtcaacgacaccgtcaagatcgacctggccaccggcaagatcacctctttcgtcaagtttgagaacggtaacattgtcatgaccaccggaggtcgaaacatgggccgagtcggcaccatc

SEQ ID NO: 573 - DNA, 776 bp, Artificial
  Synthetic
cccacgcgtccgacgcccaacctttccgtcgttttcatcaccgtcgagaaaacagccagtcgtcaccatggcccgaggaatcaagaagcaccagaagcgccttagcgccccctcccactggctgctggacaagctgtccggtctctatgcccccaagccttctgccggtcctcacaagctccgtgactgcatgcccctgatcgtcttcatccgcaaccgtctcaagtatgccctcaactaccgcgagaccaaggccatcatgatgcagcgcctggtcaaggttgacggcaaggtccgcaccgacatcacctaccccgccggctacatggacgtcatcaccatcgagaagactggcgagaacttccgtctcatctacgacaccaagggccgcttcaccgtccaccgaatccaggccgaggaggccgagtacaagctgggcaaggtcaagcgcgttcagctcggccgtggtggaatcccattcttggtcacgcacgatgcgagaaccatccgttaccctgaccccctgatcaaggtcaacgacaccgtcaagatcgatctcgccaccggcaagatcaccgacttcatcaagttcgacaccggcgccatcgccatggtcaccggtggtcgcaacatgggtcgtgtcggcgtcatcacccaccgtgagcgccacgacggtggtttcaacatcgtccacatcaaggacgccatcgacaacaccttcgccacccgtgagagcaacgtcttcgtcatcggctccgagaagcctggatctccct

SEQ ID NO: 574 - DNA, 474 bp, Artificial
  Synthetic
gaattcggggaagaacgaatacaaaattagggcaaacctaatttacagtccaaaaactcaatcatggcgatgggggggaagaaacatcagaagaggcttaatgcccctaagcattggatgcttgataaattgggtggtgcttttgcccctaagccatcatctggaccacacaaggctagggaatgccttcctttgattcttatcctgcgaaacagattgaagtatgcccttacataccgtgaagttgttgctattttgatgcaaaggcacattcttgttgatgggaaagtgcgaactgaccacaagtatccatctggatttatggatgttgtatcaatccccaagacgaacgagaactaccgtcttttgtatgacaccaagggtcgtttccgtctccactcaatcaaggatgaagaagctaagttcaagctttgcaaggtcagaaatgtacactttggatctaagggtatccca

SEQ ID NO: 575 - DNA, 663 bp, Artificial
  Synthetic
ccccccccgatccctctctcctctttggcggcggcggcggaagagagcgacgcagacggacggcgtggtggtctccccctccggcgacgtagctcgagctcgcaaccatggcgaggggattgaagaagcatctcaagaggctcaatgcgcccaagcactggatgctcgacaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggag

SEQ ID NO: 576 - DNA, 608 bp, Artificial
  Synthetic
gaattcaagaagaagaaaagcagcgtttagccttagatcactccaaggcgaattaactcaaaatggcaagaggattgaagaagcatttgaagaggctcaatgctcctaagcattggatgcttgacaaacttggtggtgcctttgctccaaaaccatcatctggtccacacaaatctagggagtgtttaccattgatccttattctgcgtaacagattgaagtatgctctcacctaccgtgaggttattgctatcttgatgcaaaggcatattcttgttgatggaaaggtcaggactgacaagacatacccttctgggttcatggatgtcgtgtcaattcccaagacaaatgagaacttccgtctcctttatgacaccaagggtcgtttcaggctccactcaatcaaggatgaagaggccaagttcaagctttgcaaggtccgtaatgtgcattttggatcaaagggtatcccatacatcaacacattcgatggtcgcactatccgctacccagatcccctgatcaaggccaacgacaccatcaagcttgatcttgagagcaacaagattgtcgatttcatcaaatttgacattggtaacgttgccatg

SEQ ID NO: 577 - DNA, 290 bp, Artificial
  Synthetic
cggacgcgtggggtggttcggagctgtttctaagaaaacaacaggtagttcggatcggagctacgcttgcaaaactcaaaacatggcgaggggtttgaagaagcatctgaagaggcttaatgcgcctaagcattggatgcttgacaaacttggtggtgcatttgccccaaagccgtcttctggaccacataagtcaagggagtgccttcccctcgtccttatcatcaggaacaggttgaagtatgctcttacctaccgtgaagtgatttcaatcttgatgcaaaggcata

SEQ ID NO: 578 - DNA, 774 bp, Artificial
  Synthetic
gccattacggccggggagggctgttaaggtggctttcacatgagcggagcagcaggtaagcttagttactgcagaaagtggcggagctgtgacgctgctgattcaaatctaaagaccaccaaaatggctagaggtttgaagaaacatttgaagaggctcaatgccccaaagcattggatgcttgacaagcttggaggagctttcgctcccaagccctcgtctggtccgcacaaatcaagggagtgtttgccattgatcattatcatgagaaacaggctgaagtatgccctgacatatggcgaggtcatttcaattttaatgcaacgacttgttatggttgatgggaaagttaggacagataagacttaccccgccggctttatggatgttgtttcaattcctaagacaaatgagaacttccgcctcatgtatgacacaaagggccgatttcgtcttcactctgttagggatgaggaagcgaagtttaagctgtgcaaggtccgatctgtgcagtttggacagaagggtattccatacctcaacacttatgatggaagaacaatccgctaccccgatcctctcatcaaggccaatgataccatcaaactggacttagagaacaataagattgttgacttcatcaagtttgatgtcggaaatgttgtcatggtgactggtggtagaaacagggggcgtgttggtgttattaaaaacaggcaaaagcataagggtagtttcgagacagttcacattcacgatgcccaagggcatgag

SEQ ID NO: 579 - DNA, 600 bp, Artificial
  Synthetic
cccccccccactcttgtcatctcggcggcggcgcggcgcggagcagaggaggacgaagcagcaggcggcggcggcagagcacggcgacctagcccgacctcgcaaccatggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgggaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaatcccctacctgaacacctatgatgggtcgcaccatccgctaccctgacccgatcatcaaggcaaacgacacaatcaagatcgatctg

SEQ ID NO: 580 - DNA, 875 bp, Artificial
  Synthetic
ggggtttgaagaagcatctggggaggctcaatgcccccagccattggatgcttgacaagcttggtggagcatttgcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatggacgttgtgtcaattgcaaagactggggagaatttccgccttctgtatgacaccaagggtcgcttccgtctccacagcatcaaggatgaggacgctaagttcaagctctgcaaggtccggtctgtacagtttggacagaagggtattcctttcctgaacaccaatgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttgatttctgaaaatctccatgaatgaaactgttgatttgagcagtctatttatatagattatttagctcttaagatcatatgtccattggaga

SEQ ID NO: 581 - DNA, 1070 bp, Artificial
  Synthetic
gaattcaactctcctgctatcttttacagaaagtagtactcagattgcagaagtctgatcagacatggctgctgctttctcaaccgttggagcagttaacagagcacctttgagcttgccaagctctggccaaagctctgccttcttgggcagcagcttgaagaaggtcaattcttctgttgcaccaaaaccatcatcaagaagcttcaaagttgttgctgcacaagaggttgatcctaaaaagaatgaggacaaatgggccggtctttactacgaccagtctgatgatcaacaagacatcaccagaggaaagggaatggttgactcccttttccaagctcctatggataccggaactcacaatgctatcatgagttcttatgaatacgccagcaagggacaaagaacatacgactttgacaacaccatgagtggattctacattgctccagctttcatggacaagcttgttgttcacattaccaagaacttcatgacccttcccaacatcaaggttcctctaattttgggagtctggggaggaaagggacaaggaaaatcattccagtgtgagcttgtcatggccaagatgggaatcaacccaatcatgatgagtgctggagagcttgagagtggaaacgcaggagagcccgcaaagttgatcaggcaacgttaccgtgaagcagctgacattatcaagaagggaaaaatgtgttgtttattcatcaacgatcttgatgcaggagctggacgtatgggtggaaccactcaatacacagttaacaaccagatggttaacgccaccctcatgaacattgctgataacccaacaaatgtccagctccccggtatgtacaacaaggaggagaatcctcgtgtaccaatcatctgtaccggtaacgatttctccactttgtatgctcctcttatccgtgatggacgtatggagaagttctactgggcacctactcgtgatgaccgtattggtgtctgcaagggtatcttcaagactgataacatttctgatgaagctatcatcaagattgttgataccttcccagggcaatcta

SEQ ID NO: 582 - DNA, 561 bp, Artificial
  Synthetic
ttggatcttgcctttgctcattcctttccctcctctaccccctatggctgcccttgaggcctcctgtgttgctcagagtctgtctgtagtgagctgccaagcatctggcaatgtccgtccatcctcggctttcttgggtttaggcctaaagaagggggggtcttcttctgggaatgcaaagaaggcttcattgcagaagattgcagcatcggtagacggggatgaaacaaagcagacgaaaacggacaaatgggccggtctggccttcgacacctcggacgaccagcaggacatcacccgagggaagggtatggtggacccactcttccaaggtgctgtgggtttgggcacccaagaagctgtcatgagcacctatgactacattagcaccggtcagaggacgttacaatgggacaatatgaaagatggtttctacattgcccctgcattcatggacaagcttgtcgtccacattactaagaatttcatgaatcttcccaacatcaaggtgccattgatccttggtatctggggaggcaaaggtcaagggaaatcattcca

SEQ ID NO: 583 - DNA, 1014 bp, Artificial
  Synthetic
gccattacggccggggaaccaatttttgaatatattgagcaaatcaagaaagctcaatccttagcttctttgatcaagttgtcatcacagtagtcaagataatggctacctctgtgtcaaccattggagctgccaacaaagcaccgttgagtttgaacaactcagttgctggaacttcagttccaagcacagccttctttggcaaaacattgaagaaagtgtatggaaaaggtgtttcaagccccaaggttacaaacaggagcttgaggattgcagctgaaaaaaaagatgctgatcccaagaaacagaccgatagtgacagatggaagggtcttgtccaagacttttctgatgatcaacaggacatcacccggggtaagggtatggttgacagtcttttccaggctccaacgggtactggtactcaccatgctgtgttgcaatcctacgaatatgtcagccaaggtcttcgccaatacaacatggacaacaagttggacggattctacatcgctcctgctttcatggacaagcttgttgttcacatcaccaagaacttcttgaaattgcccaacatcaaggttccacttatcttgggtatctggggaggcaaaggtcaaggtaaatctttccagtgtgagcttgtcttcagaaagatgggaatcaaccccattatgatgagtgctggagaattggaaagtggaaatgcaggagagcctgcaaaattgattaggcaaaggtacagagaggcagcagaaatcatcagaaagggaaacatgtgttgcctcttcatcaacgatctcgatgcaggagctggtagaatgggtggaacaactcaatacactgtcaacaaccaaatggtgaatgccactctcatgaacattgctgacaacccgacaaatgtccagctccccggtatgtacaacaagcaagaaaacgccagggtccccattatcgtcactggtaacgatttctccacattgtatgctccacttatccgtgatggtcgtatgg

SEQ ID NO: 584 - DNA, 875 bp, Artificial
  Synthetic
gcgcaagactagctagctcttcgtcctcgcggtacatcgcaatggcgtcgtctctccaggcggtccccgttgctcaggcgatgagcttgccagcagcacagaagtcctcgtccaaggtttcatgcctcaactcccagttcctgggcctcaacgtcaagagaaagaccgtgttccaagcttctctgtccggtgccgctggacgcggccgggtggtctgcgagaaagttaaggacacagaggacgagaccaagcagacggccaaggatcgctggggaggcctgggcaccgatatctcggacgaccagcaagacatcacccgtggtaagggaatggtcgacaccctttaccaaggagctatcggaatgggaacccagcatgccatcatgagcagctatgagtacattagcactgcccagcgcaactttgcgtttgataacaccaaggatggcttctacatcgcacccgcattcatggaaaaacttatgatccatatcgccaagaacttcatgacacttccaaacatcaaggtgccgctgattcttggtatctggggaggcaaaggtcaaggaaaatcattccagtgcgagcttgtcttctccaagctcggtgtcaacccgatcatgatgagcgctggagaactcgagagcggaaacgccggagagcccgccaagctcatcaggcagaggtaccgtgaagctgccgatatcatcaagaagaaaggcaagatgtgctgcctcttcatcaacgatctcgacgccggcgccggacgaatgggtggaacgacgcaatacacggttaacaaccagatggtgaacgcgacgctgatgaacatcgccgacaatcccacgaatgtacagctccccggaatctacaac

SEQ ID NO: 585 - DNA, 1157 bp, Artificial
  Synthetic
cccccccactttgagcagcagcggccggccatcatcagtgatcctctacaatcatcgactttcagcaaattaagatggctgctgccttctcctccaccgttggagctccggcgtccactccgaccaacttcctggggaagaagctgaagaagcaggtgacatcggcggtgaactaccatggcaagagctccaacatcaacaggttcaaggtgatggccaaggagctggacgagggcaagcagaccgaccaggacaggtggaagggtctcgcctacgacatctccgatgaccagcaggacatcaccagggggaagggtttcgtcgactcccttttccaggctcccacgggtgatggcacccacgaggccgtcctcagctcctacgagtacctcagccagggtctcagaacgtacgacttcgacaacaccatgggaggcttctacatcgcccctgctttcatggacaagctcgtcgtccacatctccaagaacttcatgaccctccccaacatcaaggtcccactcatcctgggtatctggggaggcaagggtcagggaaaatccttccagtgtgagctcgtcttcgccaagatggggatcaaccccatcatgatgagcgccggagagctggagagcggcaacgccggagagccggcgaagctgatcaggcagcggtaccgtgaggcggcagacatcatcaagaaggggaagatgtgctgcctcttcatcaacgatctggacgcgggtgcaggtcgcatgggaggcaccacccagtacacggtgaacaaccagatggtgaacgccaccctgatgaacatcgccgacaacccaaccaacgtgcagctccccgggatgtacaacaaggaggacaacccccgtgtccccatcatcgtcaccggcaacgacttctccacgctgtacgcgccgctcatccgtgacgggcgtatggagaagttctactgggctcccacccgcgacgaccgtgtcggcgtctgcaagggtatcttccgcaccgacaacgtccccgacgaggacatcgtcaagatcgtcgacagcttcccaggccaatccatcgatttcttcggcgctcttcgtgcccgtgtttacgacgacgaggtgcgcaagtgggtgtcggacacgggtgtggagaacattggc

SEQ ID NO: 586 - DNA, 628 bp, Artificial
  Synthetic
attggatagtcagctcagctcaagaggaagacatggccatggctaccacactcctcgaggcttcgtgtgctactttgggatctcctctaggtggtcaaccagttgcgagttctaagtctggtggccctgtgtctctgtttttgggggcgggtctgaggaagtgctgcagcgtgcacatgcgcagaagcaggagcagagcagtgaaggttgtggcgttggaggatgagacgaagcagacaaagacagaccgatgggcggggcttgcgacggacatatcggatgaccagcaggacattgcacgagggaagggcatggtggacgcactcttccagggccccagtggtgaaggcacccagcatgccgtcatgagttcctatgagtacattagctctgctcaacgcacgcttaactgggacaacattaaagatggatactacatctcaccatccttcatggacaagctggttgttcatgtcactaaaaacttccttacacttccgaacattaaggttcctttgattctgggtgtatggggagggaaagggcaagggaagtctttccagtgcgagctggtcttcgctaagctcggaattacgcccataatgatgagtgctggagaattggagag

SEQ ID NO: 587 - DNA, 558 bp, Artificial
  Synthetic
tgtttgtatgtcctgttcgatcagtctatggcggcatcgtcaatgcagctcctaacccaggcctccgcccatccgatcggcgcgagatcgtcgctggcatcggcattcttggggagcggcatccatcagcacgaatccagtgcgcgagctggaaacctccgggctagatgccgggtagtgtgtgaattggaggaatcctcgaagaaggtcgatcgatggcagtctctggggaccgatacgtcggacgatcaacaagatattaccaggggaaagggaatggtggataatctgtatcaagggcctcaagggggaggaacacagactgccgttatgtcgagtctagagtatatcaacactgcccagcgcatgtactctatggacaacaccaaagatggattttacatcgccccagcgttcatggagaagctagttattcacatatcaaaaaatttcatgacacttccaaatgtaaaggttcctcttatacttggtgtctggggtggcaaaggtcaaggaaagtcgttccagtgcgaattggtgtcctccaagctgggaatt

SEQ ID NO: 588 - DNA, 633 bp, Artificial
  Synthetic
ctctctctctctttatccgtcctccggcgacccttttactccggtcaaactccgccggaaaatcttaaattcttgttttattgacggcttacttgcttgtaccttcatctcgcttcaccgatcttgcacttcacattaatcatcatgaatcccgaatacgactatcttttcaagcttttgcttattggagattctggtgttggcaaatcgtgtctcctcttaagatttgctgatgactcatatcttgagagttacattagtactattggtgtggactttaaaatccgcacagttgagcaggatgggaaaaccattaaacttcaaatttgggatactgctggtcaagaacgttttaggacaattaccagcagctactatcgcggtgctcacggcataattgttgtctatgacgtaactgatcaagatagtttcaataacgtcaagcaatggttgagtgaaattgatcgatatgcaagtgataatgtgaacaaacttcttgtcggaaataagtgcgatctcacagcgcagaaggtagtttccacagagacagctcaggcttttgctgatgagatcggcattcctttcatggaaactagtgcgaaaaatgccaccaatgtggaacaggctttcatg

SEQ ID NO: 589 - DNA, 673 bp, Artificial
  Synthetic
  misc_feature (488)..(488): The residue at this position can be any nucleotide.
gaactgtcaagcctctgcctgctctcaccagatctgaagatttccgtcttaccttcattatgaatcctgaatatgactaccttttcaagattttattggttggtgactctggtgtggggaaatcatgtctcctcctccgatttgcggatgataattatgtggagagctatataagcaccattggtgtggattttaaaatccgaactgtggaactcgatggaaagactctgaaacttcagatttgggatacagcagggcaggagcgcttccgaaccattactagcagctactacagaggagcgcatggcattattattgtttatgatgtgacaaaccaggcaagcttcaataacgtgaagagatggttgaatgagatacagcgatatgcaagtgacagtgtgaacaaattgttggtagggaataagtgcgatatgaccgaaaagaaagccgtagataccgaaacggcaaaggcatttgctgatgagatnggcattccatttctggaaacaagtgcaaagagcgcgacaaatgttcaagaggctttcatcacaatggcgactgagataatgaaaaggatggcaagtcaaccctcagtaactagtacaaagcccaaatttgtccagattcaagggaaaccggttaaccaaaaaagaggctgctgctcttaatgcaa

SEQ ID NO: 590 - DNA, 450 bp, Artificial
  Synthetic
aagaagaccgagttagagaagaacagggtagagaaagaagaagagttggagaagatgtcgtcagcagtgaggccgggacccggcgcagaccacgactaccgcatcaagctgctgctcatcggcgacagcggcgttggcaagagctgcgtgctgctccgcttctcggacgactcgttcacgacgagcttcatcaccaccatcggcatcgacttcaagatccgcaccatcgagctcgacggccgccgcgtcaagctccaggtgtgggacaccgccggccaggagcgcttccggaccatcaccaccgcctactaccgcggcgccatgggcatcatcctcgtctacgacgtgaccgacgagtcgtccttcaacaacatccgcaactggatcaagaacatcgagcagaacgcgtcggagaacgtctcccgcatcctggtcgggaacaaggccgac

SEQ ID NO: 591 - DNA, 677 bp, Artificial
  Synthetic
tttgcgggagagctctcgccgaaggcctgatctgtgctgggatctacaccaggagctcaagcatggcatccaggaagcgaactctcctcaaggcgatcattctcggcgacagcggcgtcggcaagacatcgctcatgaatcaatacgtgaacaagaaatttagcaaccagtacaaggcgaccattggagctgattttctcaccaaggaagtccaagtggaggataggctagtgacgatgcagatatgggatacagccggtcaggagcgattccaaagccttggtgtggccttctatcgaggggctgattgctgtgtgttggtatacgacgtgaatgtgatgaagtcgttcgataatctggacaactggcgcgacgagtttcttatccaggcaagtccttctgatccagagaacttcccttttattgttcttggcaacaaggtcgatgtagacggggggaacagcagagtggtatccgagaagaaagccaaggcctggtgcgcgtcgaagggcaacattccatactttgagacatctgccaaagaagactacaacgttgaggctgcttttcaatgtatagcgaagaatgccttgaggagtgaacccgaagaagacttctaccttccggacacgaatgacctcgcaaacaacaacagagtgacgagatcatctgggtgt

SEQ ID NO: 592 - DNA, 647 bp, Artificial
  Synthetic
gcgcgatccgcgtagatagatctggagctgctccttggatgtggaatgccgtggtccaagcttttggggaataggtcgtgagcggcagcgcggcaaaataggtcttgatcgagagtgatttgcgagaaatgggtgtgccaaccgcgacggtgtcgccgctcgccaagtacaagcttgtgttcttgggcgatcaatcggtggggaagacgagcatcatcacgcgtttcatgtatgataagtttgacaacacgtaccaggcaaccattgggatcgacttcttgtcgaagaccatgtacctggaagatcgcactgttcgcttacagctctgggatactgctggccaggaacgttttcgcagcctaattcccagctacatacgggattcgtccgtggcggtggtcgtgtacgatgttgcgaatcgccagtcgttcctaaacacggccagatgggtggaagaagtccgcaccgagcgtggtagcgatgtgatcatcgttctcgtcgggaacaagaccgacttggttgacaaaaggcaagtctcgatcgaggagggggatgccaaagcccgggaatttggagtcatgtacatcgaaaccagtgccaaggccggattcaacatcaaggctctcttcagaaaaatcgctgccgca

SEQ ID NO: 593 - DNA, 720 bp, Artificial
  Synthetic
gatcgatcgatagaatcgactctagggtttagcagcagcagcagctcgtcgattctttcctccttcttgattgatcatggcgcggcggccggatgaggactacgactacctcttcaaggtggtgctcatcggcgactcgggcgtcgggaaatccaacctgctctccagattcacgcgcaacgagttctgcctcgagtccaaatccaccatcggggtcgagttcgcgacccgcacgatccaagtggacggcaagacgatcaaggctcagatctgggacacggccgggcaggagcgttaccgcgccattaccagcgcctactaccgcggcgccgtcggcgctctcctcgtctacgacatcaccaagcaggcgacgtacgagaacgtggagcggtggctcaaggagctgcgcgaccacgccgactccaacatcgtcatcatgctggtgggcaacaagtcggaccttcgccacctccgcggcgtgacgacggaggacgcgcaggccttctccgagagggaggggctgtcgttcatcgagacgtcggccctggaggcgaccaacgtggacaaggcgttccagagcatcctgggcgagatctaccggatagtgagcaagaaagcgctggcgacggcggacgagctgtcgtatgtggctccgggcgaaggcaggccatccacgtcgggcccgagcaggatggcggcgccgtcaagaagaaggcgtgc

SEQ ID NO: 594 - DNA, 765 bp, Artificial
  Synthetic
gagccaaccatccgcttcgattgccactttgaccaaacctgcacctctttcaactctcaagccttccgcttctatttctcccgttccaacacaaacaccaacaaccgccatcatgaaccccgaatacgactatctcttcaagctcctcctcatcggtgattccggtgttggaaagtcttgcttgctgctgcgatttgccgatgacacctacaccgagtcttacatctccaccatcggtgtcgatttcaagatccgaacgatagaactcgatggcaagaccgtgaagctgcagatctgggataccgccggccaggagcgtttccgaaccatcacctcgtcttactaccgcggtgctcacggcatctgcgtcgtctacgatgtcactgatatggactccttcaacaacgtcaagcagtggctccaggagattgaccggtatgccaccgagggcgtcaacaagttgctcgtaggcaacaagagcgatatgtccgataagaaggttgtcgagtacaccgttgccaaggaattcgctgacagcctgggcatcccattcctcgagacttccgccaagaacgccagcaacgttgagcaggctttcctcaccatggctcgccagatcaaggagcgcatgggcaccacgactgccaacaacacgaaacccagcgtgcacgttggcccagggccagggtgtcggcaactcttccaacagcagctgctgttaaatgtattcctctttgatggtttcgtgtggttcgctttgtcgtg

SEQ ID NO: 595 - DNA, 601 bp, Artificial
  Synthetic
cccccgccagtgtctccccactccatagtgacactgcgccgggctgcgagatccaaaatccgaccagccagcgttagctcggagaggcgaggcgagaatgtcggccgcggcgggcgggtacagggcggaggacgactacgactacctgttcaaggtggtgctcatcggcgactccggcgtcggcaagtccaacctcctctcccgcttcaccaagaacgagttcagcctcgagtccaagtccaccatcggcgtcgagttcgccacccgcagcctccaggtcgacggcaaggtcatcaaggcccagatttgggacaccgccggccaggagaggtatcgtgctatcactagtgcctattaccggggagctgtgggagcattgctcgtctacgatgtcacccgtcgtgctacattcgacaacgtgggacgctggctaagggagcttagagaccacactgatcctagcattgtctgcatgctgattggcaacaaatccgatctccgccacttggtggctgtctcaaccgaggacggcaaagagtttgctgaagccgaatcaatgtacttcatggaaacttctgcgctcgacgctaccaacgtcgac

SEQ ID NO: 596 - DNA, 559 bp, Artificial
  Synthetic
gaacaatttgctaagcgcacgcagcacaaagtgcgcagaatagccaattgaggtgtgtgtgtctgtgtgtgcaaatcatatacgaattgattattcaatggcagcaccaccggcaagagctagagcggactatgattacctcataaagcttcttttgatcggcgatagtggtgttggtaagagttgccttcttttacgtttctctgatgggtccttcaccacaagctttataacaaccattggaatcgactttaaaattcggaccattgagcttgatggaaaaaggatcaagcttcagatatgggatacagctggtcaggaacggtttcggactatcactactgcttactatcgtggagccatgggtatattgttggtgtatgatgttactgacgaatcctcctttaacaacattaggaactggattcgtaacattgagcagcatgcctcagacaatgtcaacaaaatacttgtagggaacaaggctgacatggatgaaagcaagagggctgttcctacgtcaaagggccaagcacttgcagatgagtatgggattaag

SEQ ID NO: 597 - DNA, 575 bp, Artificial
  Synthetic
cccaactctctctctctctagatcaccatttccactttctgcctcttcccccgaagactcttacacttttcacaacttcaaaaatggattcatcagatgatgaaagtggtgaggaatatcttttcaagattgtaataattggtgattcagcagttggaaaatcaaatttgttaacacgttatgcaagaaatgaattcaatttgcattcaaaagcaacaattggtgttgagtttcagacccaaactcttgaaattgatggtaaagaagtaaaagctcagatttgggatacagctggtcaagaaagatttagagctgttacttctgcttattatcgtggtgcttttggtgctctggttgtttatgatattactagacgtaccacttttgatagcatccctcgttggcttgatgagctcaagactcattctgataccacggttgcaaggatgctcgtgggaaacaaatgcgatttggataacataagagctgtgagcgtagaacaaggcaaaagcctggcggaatcagaagggatgttcttcatggaaacatctggcctcgatgcaacgaacgtaaac

SEQ ID NO: 598 - DNA, 647 bp, Artificial
  Synthetic
cccccgagcagcgctcgtgttcggtcaaaagcctcgccgcggcgagctcgagctcatgggcattccggaggggagggagggatgggggacgagtcggagggggagacggaggagtacctgttcaaggtggtgatcatcggggacagcgcggtggggaagagcaacctgctgtcccgctacgcccgcaacgagttcaatctccactccaaggccaccatcggcgtcgagttccagacgcagagcatggacatcaacggcaaggacgtcaaggcccagatctgggacaccgccggccaggagcgcttccgcgccgtcacctccgcctactaccgcggcgccttcggcgccctcctcgtctacgacatctcccgccgctccaccttcgacaacgtcggtcgctggctccaagaactcaacacacattcggacacgactgtagccaagatgttggtgggcaacaagtgtgatctggataatatccgtgaagtgccggtagaggaaggcaaagcacttgctgaagctgaagggctgttcttcatggagacctctgctctggactcgacaaacgtgaggacagctttcgagatcgtaatcaaggagatctacagcaacgtgagcaggaagatcttgaattcggactcctacaa

SEQ ID NO: 599 - DNA, 715 bp, Artificial
  Synthetic
gaattcgaagaccggatgaagagtatgattatctattcaagatcgttttaattggtgattcaggtgttggtaaatccaatcttctctcccgtttcactcgtaatgagttttgtttggaatctaaatctaccattggagttgaattcgctactcgtactcttcaggttgaaggcaagacaatcaaagcacaaatatgggatacagctgggcaagagcgatacagagcaattaccagtgcctattacagaggtgcactaggtgctcttctagtctatgatgtgacaaaaccaacaacatttgagaatgtaactcggtggctcaaggaactgcgtgatcatgctgactccaacattgtgataatgctcattggaaacaaaactgatctgaagcacctccgtgcagttgcaacagaagatgctcagagttttgctgagaaggaagggctttcattcatcgagacctctgcccttgaagcaataaatgttgagaaggctttccaaacaatccttggagagatatatcgtataattagtaagaaatcccttgcgtcagaggagtctgcaccgtctagcattaaggaaggccaaacaattgatgtctcaggatcagatggcaattcaaagaaatcatgctgttctacttaaggggtgatttcttccattctttatcctttctggtgactaatgttctataggtctcaagtctttcaactatg

SEQ ID NO: 600 - DNA, 651 bp, Artificial
  Synthetic
gatcgaagccccaaaaacatgcgcagaaaaggtcggttgtccagataagggagtagtacatattatgctcaataacaactactgggcatcaatcatcaattctactggaaacgtctaaaattgccaactgtctgtcttcctcacgccacacacacacacacataccggcgcggagttttctgaatttagtctcgttttgtcagatcgaagtccgccgaagatgccttcacgccggcgaactcttttgaaagtcatcatcctcggtgatagcggggttgggaagacctcgttgatgaatcaatatgtaaataagaagttcagcaaccagtacaaagcaactattggggctgatttcttgacaaaggaagtgcagtttgaagatcggctctttacattacagatttgggacacagctggccaagagagatttcaaagtcttggtgttgcgttctaccgtggtgctgattgctgcgtccttgtgtatgatgtaaattcaatgaagtcatttgaaaacttaaacaattggagagaagagtttctaattcaggcaagcccatcggatccagaaaactttccatttgttgtgctggggaacaaagttgatgttgatggtggaaatagtagagtggtgtcggagaaaaaagctcgggc

SEQ ID NO: 601 - DNA, 643 bp, Artificial
  Synthetic
ttcttgacgtcaaccatcctcttccttttttcaagtcctaattctaatcaaaaccctaatcgaacgatcacaaaaatctccatcacgaccaaataatcatttctcttctgcaaatttcgatcaattaacaactatggcaaccggtggaaacaagaatatgaacgccaaattggtgcttcttggagatgttggagctggaaaatctagtctagttctgcgttttgttaaaggacaatttattgaatttcaggaatcaactattggtgctgcatttttctcccaaacagtagcagtgaatgatgcaactgtaaaatttgaaatatgggacacagcaggccaagagagataccacagtcttgctccaatgtactatagaggagctgcggctgctataattgtttttgatatcacaaatcaagcatcatttgatagggcacaaaagtgggttcaggagcttcaggcacaaggtaatccaaatatggtgatggcacttgccgggaataaggcagatttgttagatgcaagaaaagtggctgcagaggaagcccaaacatatgcccaggagaatggccttttcttcatggaaacatctgcaaaaactgcatctaatgttcatgacattttctatgacatagcaaagaga

SEQ ID NO: 602 - DNA, 655 bp, Artificial
  Synthetic
aaagatccctccaaaaaaaaacgcctttttttttcttgagcacacaagagacgccaatcccaaagcaaagagaagcgcaaagatcatctctttgcttctcgccttctcctcctcctcctcttctccctcctcgtgctccgcccgatccgtccgccgcctccagatccgcgcccatggcgtcgcgcaggcgaatgctcctcaaggtcatcatcctcggtgacagcggggtcgggaagacgtctctgatgaaccagtacgtgaacaagaagttcagcaatcagtacaaagcgacgatcggcgcggatttcctgaccaaggaggtgcagatcgacgaccggctcttcacattgcagatttgggacacagcgggacaggagcgatttcagagtcttggtgtggcattttaccggggagctgactgctgtgttcttgtatatgatgtcaatgttaccaagtcatttgaaaggctcaacagctggcgtgaggaattcctaattcaagctagcccatcagatccagagaatttcccttttgttgtacttggaaacaaaattgatgttgatggtggtaatagccggactgtttctgagaagaaagctaaagcttggtgtgcttctaagggaaacatcccttattttgagacatctgctaaaga

SEQ ID NO: 603 - DNA, 561 bp, Artificial
  Synthetic
ttacttttactctctctgtatttgttcttcttaaaaatcccttttacagaaaacccaaaagtagtgcaaaaattgagaattaatggcaaatctaggaggaattcgtgaggcaggaggatctgagaacagccttgagatcaatgatcttgctcgctttgctgttgatgaacacaacaagaaacagaatgcacttctggagttcggaaaggttgttaatgtgaaggaacaagtggttgctggaaccatgtactacataacactggaggcaactgaaggtggtaagaagaaagcatacgaagccaaggtctgggtgaagccgtggcagaacttcaagcaattggaagacttcaagcttattggggatgccgctagtgcttaacaagtgctaaatgaatgcatcttatgcttgtgaaaataaaggtaacatagtttcgcttgcgagtatttgaatatcgtaaagtaagctttaaactatgtcgtagtgttaagttacaagtaactgtaactttacaatgttccatatttcatattatatggtcctccatatgatagttctatgat

SEQ ID NO: 604 - DNA, 588 bp, Artificial
  Synthetic
ttcgcattattatgcatgtcgagcgacggagggccggtgcttggcggcctcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgccgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaaccgcaaaaatgcgcc

SEQ ID NO: 605 - DNA, 619 bp, Artificial
  Synthetic
gaaaccggaggaggattttgcggtgaagaggaagagaaaggaaataatctgattgagatggctactcttggtggggttcgtgattcgcatgcttcgtcccagaacaacgacgagatccataaccttgccaaatttgcagtcgatgagcacaacaagaaggagaatgcgatgattgaattggccagagttgtgaaggcgcaagagcaagttgttgctggtacactgcaccatctgactcttgaggtcatagatgctggaaaaaagaaactctatgaggctaaggtctgggtcaaaccatggttgaatttcaaggaacttcaagagttcactcatgttgaagatgttcctaccttaacttcttcagatctaggtgttaagcaagaagaggaaggctctggattgaagtcagtgcctgtgcatgatccggtggttcaggaagctgcagagcatgcaattaagaccatccagcagagatccaactcgctacttctgtatgaactccaagagattgttcatgcaaatgctgaggtcattggggaggacaatatgaagcttcatatgctcatcaaaactagccggggagggaagcgagaaaagttcaaagttcaagtgcaccata

SEQ ID NO: 606 - DNA, 679 bp, Artificial
  Synthetic
cccccccccgatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 607 - DNA, 594 bp, Artificial
  Synthetic
agcgctactgccgcgttgatgtctttgctgtgtgcagcggcatcgagcgctagggtgtctttgcggtgcttggcgacgaagggccagggcgagcagctaccgatggcgcagctcaaagaaatcgccaagaacaagatgtttgatggatttaatcgccggttccagcaccagagcagctcctgtggttgtaacatgaatttcacggtctatttccctccagctgcggatcataaaaaagttccagttctttactggctttcgggacttacatgcacagatgataactttatccaaaaatctggagcacagcgtgttgctgctgccgagggagtagcaattgtttgtcctgatacttctcctcgtggattaggagttccaggagaaagtgatagctgggattttggtgtacgagccggtttttatctcaatgcaactcaagagaaatggaagaactggcgaatgtacgactactgcaccaaggagcttccggaactcctcagcgccaatttcgatcagcttgacaccaagaaggcgtcaattttcgggcactcaatgggaggtcacggggccttaactatcttcttgaagaacccg

SEQ ID NO: 608 - DNA, 813 bp, Artificial
  Synthetic
ccccccgaaccttccagaagctccagattccaaaccagcaggagtcgcctcgcctcctccttcatcctcctcgtcgtcgccgcgggggtcgcctgagatcacattaacaatggtgaaggctgttgttgtgcttggtagcagtgagattgttaagggcactatccactttgtccaagagggagatggtcccaccactgtgactggaagtgtctctggcctcaagcctggtctccatgggttccatattcatgcacttggtgacaccaccaatggttgcatgtcaactgggccacactacaatcctgccggaaaggagcatggagcaccagaagatgagacccgccatgctggtgatcttggaaatgtcaccgctggagaagatggtgttgctaatatccatgttgttgacagtcagattccacttactggaccaaattcaatcattggcagagccgtcgttgtgcatgccgatcctgatgatcttggaaagggtgggcacgagctgagcaagaccaccggaaacgctggtggccgtgttgcttgcgggatcatcggacttcaaggctgaaacctggaggtgtgaactcaccttccatctcccagcaccagaagcctgaaactctacgagctcttagccgtttcgtctttacctgagtggctactctagattctacaataagcacctgatctctgcgcatggtttttggtgtaccattctgtcgcccgcatcgttggcgcccaatgaactatgtgttttgtgttaaaccttaagctgaagggtaccatttgtagactcgatgttgctctcttcct

SEQ ID NO: 609 - DNA, 380 bp, Artificial
  Synthetic
cttgattctttccaaaggggtttcctgagatcacaaaggccaagtaacaatggcgaaaggagttgcagttttgaacagcagtgagggtgttacggggactatctttttcacccaggaaggcgatggtgtgaccactgtgagtggaacagtttctggccttaagcctggtcttcatggtttccatgtccatgctcttggtgacaccactaacggttgcatgtctactggtccacatttcaaccccgatggtaaaacacacggtgcccctgaggatgctaatcgacatgctggtgatctaggaaacatcactgttggagatgatggaactgccaccttcacaatcactgattgccagattcctcttactggaccaaactcta

SEQ ID NO: 610 - DNA, 690 bp, Artificial
  Synthetic
tcagtcgtgtctgtcattattatcgaccacgcgtcgcaatggctggaatttgtgtagacgcgccagtgctgtccagagttagggtttatccgggagagcgcaggctgggacgcagcgcattcgcaggggcgcgaattgcgccgggtaagaggcagtggcagtgcgtccgtgtcgccgctgcaaggggaattggtgtcacggcggagctgaagaaggccgtcgccgtgctcaagggctctgtggatggagtcgtccagttggaacaggatggagacggtccaacgacagtgaaggtgaaaatctccggacttactccaggcaagcatggctttcacatgcatgaattcggggacacaactaatggctgcctatctacgggcgcgcatttcaatcccaagagtatgacgcatggcgcaccaaatgcctcggtcaggcacgctggagatcttggacacgttgttgcggatgaaaaaggcaatgtggacgaagttatcgtcgattctcagatcccattgtcgggtccgaactcggtcatcggaagagcactcgtagttcacgagctggaggacgacctcgggaaaggcggacacgaacttagtctgtcgactggaaacgcgggaggtcgtctcgcatgcggtgttgttggtttaactccttgaaaaagagagacacagaaagagagagaagaga

SEQ ID NO: 611 - DNA, 660 bp, Artificial
  Synthetic
gtcatcagtagctctccgttgaacgaagcaattgtaaacaccaccgccaaaatggtcaaagccgtcactgtcctccgaggagacgccaaggtctccggcaccgtcatcttcgagcaggcctcggagggtgcccctaccaccatcacctacgacatcaccggcaacgacgccaacgcaaagcgtggcttccacatccacacctttggtgacaacaccaacggctgcacctctgccggccctcacttcaaccccttcaacaagactcacggctctccttctgatgaggcccgtcacgttggtgaccttggtaacatcgagaccgatgctcagggtaacgccaagggtaccatcaccgactctcttgtccagctgattggccccaacagcgtcattggccgcaccgttgttgtccacgccggcaccgacgatctcggcaagggtgacaacgaggagtccctcaagactggcaacgctggccctcgtcctgcttgcggtgttatcggtatctctgcttaacctcgtcaaatgcactgtagctatgcttgacctaagctccttgcagattgagacaaaatctatagagcgactgaatttatgcagctcgggtcgacataggttctaggtacatgtagttatagcaaacaaacaaataaacaattc

SEQ ID NO: 612 - DNA, 605 bp, Artificial
  Synthetic
caattcctgaaaagtccaaaagatggcacaatgtgagaaaaatttggaagcagaactggaagtactgagagagacatttaaatctgagaaaacaagagaagaatgttggagaagatcacagttacaaaatttgctcagacttcttgaagagaaagaagatgatatatacaaagcccttaaacaagacttgggaaaacaccacgttgaagcttacagagatgagattggaacattaataaaatctgtgaattatgcactggatggcttaaagcaatggatgtgtggcaagaaggccaaattgccaattgctgcatttcctgcttcagcggagttggttcctgagcctcttggtctagtcctcattatttcctcttggaattttccttttgggatatcattggaaccactaattggagcaatagcagctggaaatgtggttgttttgaaaccctcagaacaggctcctgcatcatcatcagtgttagctaagacaatctccacttacttggataataaagctattaaagtcattgaaggtgataattccgttggtgacaaactgttgcaacaaaaatgggacaagattttctttacagggagtacaa

SEQ ID NO: 613 - DNA, 743 bp, Artificial
  Synthetic
gattcacctcatgttctgcttgcaaagtttcaatacactggagtgagtcagtgaggttggtgaagcagagtgaggaaaggaggatgggaagggtggcgcctagcgtcgaggaggtcgggggcgagcagccgccgcccgcgcttgggcccggcgagaccgtgagcgggacggtggccgagctgagggcggcgtacgagagcggcaggacgcggagcctggagtggaggcagtcgcagctccgggggctcctccggctcttggcggaggaggaggccgccgcgttccgggcgctccgcgaggacctcggcaagcaccaagccgaggcctacagagacgagatcggcgtgcttgtcaagtcggcgaacgccgcgctgcgtgaggtcgggaaatggatggcgccggagaaggtctgggtgccgctaatcgcgttcccggcaagggcgcagctggagccgcagccgctcggggtcatcctcgtcttctcttgctggaatgtcccgttgggcctctctctggagcctctcgttggagcattggcggccggcaatgcggtcgcgctgaagccatcggagctggcgccggccaccgctaagttcctcggcgacaacgtcggcaaatacatggacgccacggccgtgaaggtcatccagggcgggccggaggttggcgagcagctcatggaacacagatgggacaaggtccttttcaccgggagcccgcgcatcgcgcgcgtcgtgatggcc

SEQ ID NO: 614 - DNA, 1423 bp, Artificial
  Synthetic
ccccgactcacacacacactcctcatcccagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcggcgcacccggagctgatcctggcgtcgaaggacgacggcgagatcgtggacgcctgagcgaatagaacagggtaaaaaaaaatccgcaagacgtggtggtgacacggaggcgttggggacgagaagaagatgtggactttcccctgtgttttttttttcgggatttgctttgatccccttgtttgttttagctctggatgttgattagcgtcttgttcatagcaattccactgccaccgtgtgtgtgtgctctgcttgcctgatgagggcaagaaaacttccatggatccgtctctctgggaggaatgaataaaaaggatgaggaaataaaaatgattcagtgccatt

SEQ ID NO: 615 - DNA, 796 bp, Artificial
  Synthetic
  misc_feature (701)..(701): The residue at this position can be any nucleotide.
gaattctcagaaaccctaaaagcttttcctccaagaatcgaaaccccaaaatttctaatccccaatgtaaggtttccgagaatacgtgcagaatcgcaaacagttgaccaagcagctccattaacaggtaataaaccttcttcctctaacgatgcaatcgataaatttcttaaaagagattataaatggggatttgtatcggatattgaatctttttcaatacctaaagggttatcagaagaaacagttagatttatatctgcgaaaaaacaagagcctgaatggatgcttgaatttaggttaaaatcttatgaaaagtttttgaagatgaaagaacctaattggtctgataataggtatccaaaaattgattttcagaatatgtgttattattcagaaccaaagaagaaacccactttgaaaagtttagaagaagctgatcctgagcttcttaaatatttcgaaaggttaggggttccattaactgagcagaataggttagctaatgttgctgttgatgcagtatttgatagtgtttccattgcaaccacgcataggaaaactttagaagctaaaggtgtaattttttgttcaatatctgaagcacttagagaatacccagatttagtcaagaaatatttaggtaaagttgttccttctgaggataattactatgctgcactgaattctgctgtgtttantgatggatcattttgttatatcccgaagaatacagtttgcccaatgccaatttcaacttattttcgaataaacgctatggagaccggacaatttg

SEQ ID NO: 616 - DNA, 623 bp, Artificial
  Synthetic
ccctggggggaagaaatcaagaacggagaggagggaccggacatggctgcaccgggcgaggaggagcaggagcaggggaggaaaggcatcccgtctctgctctcctccagggaggagaacatcgcctctaacatcactcagctgattggatggacaccgcttgttgagatgaagaacatcgcgaagaacgaaggcgtacaggctcgattggttgggaagatggaagcataccagccactctgctctgtcaaggacaggagtgccctcagaatgattgaagatgcagaggagaaagggttgatcacacctggtgttaccacgctgattgagccaacgagtggtaatctcggtatcggtttggtgctggttgctgttcaaaaaggctacaggtttattgctgtcatgcctgctaaatattcgcttgacaagcagatgctactgaggtttttgggtgctgaattgatattgacagatcctgcaattgggtttaatggtatgatggacaaggtggaagagctcatgaagagcataccaaattctcattgtctcaatcaagtaacaaacccagcaaatccagaggcacactttatgtggactggacctgaaatatggaaagacacagc

SEQ ID NO: 617 - DNA, 595 bp, Artificial
  Synthetic
ccacgcgtcgaagaaaagaatggcgactggcgctgctgccgcgggtggaatcagcgtggttctgggaaatgccgggtgcggcaggagagagccagcgatcgcggtggcgatgcagcgccggatggtcccgtcaatgctccggatccagcgagggaagattgtgacgtcgcccagggcgaggattgcgatctcggctgtctctacagaggtccagcaataggctggcgatgctgagccggaagaggggctcaacatcgcggaagacgtgactcagctcatcgggaagacgcctatggtctacttgaacagtgtcgtcgatggttgtgttgcgaaacgtcgctgccaaagctggaaatcattggagccatgctgtagcgtgaaagatcggataggatacagcatgatctctgatgccgaagagaagggagcaatcactcccggcaagagtgtactggtagagcctaccagtggcaacacgggaattggactggcattcatagctgcggcgaaaggttacagctcattctaaccatgcctgcgtccatgagtctcgagaggcgtattttactgaaggcatttggtgctgagcttgtcc

SEQ ID NO: 618 - DNA, 610 bp, Artificial
  Synthetic
gtctggaaagaaaaactcgccatggctaatccattcttctcgattggggaatgcgatggaaaggagaggatccttggcagtgctgctgagcttattggatggactcctctggtggaaacgaagaggatctctgccagggaaggagctcttgcgagaattatcgtcaagttggaaggatatcaacctggatgctctgtcaaagatcgcatagctctctcgatgattgtcgatgccgagaacaaaggaattctcgtccccggtgtctccaccatcgtggagccgacgagcggcaacaccggaatcgctctggcactcgtcgccgcgctacgaggatacaaagtcatcgcactcatgccttcgacctactcgatggagcgccgaatgatcctcaaagcctttggagctcagattatcctcacagatccttctctaggattaccttacctgttcggcaaagctcgggagatgtccacaacacttccaaacgcttgcatgctggatcaaactcagaatccatgcaatcctcaagctcacttcgtcagcacaggtccggagatctggcaagacaccgcaggcaaagttgatatcttcgtctctggctgcggaacgg

SEQ ID NO: 619 - DNA, 639 bp, Artificial
  Synthetic
  misc_feature (559)..(559): The residue at this position can be any nucleotide.
ttaatggcggctttaagcagattgttgaagagatcaagatactgtaatagtaatgttggtttatcaccgaatgttttctactcagtctttagttcctactcccaaattacaacttcctcttactcacatcaagactcaagtttctcaactaattggaaaaacaccaatggtttatcttaacaaagtgacagaaggatgtggagctcacatagctgtgaaacaagagatgtttcaacctacttctagcatcaaagacagaccagcgttggcaatgatgaatgatgcagaaaagaaaggcttaatatcgcctgaaaaaacgacattgattgagccaacatcgggaaatatggggatcattatggcatttatggcagcaatgaaaggctacaaaatggttttgacaatgccctcatacacaagcttggagaggagagtgacaatgagagcatttggagccgatttagtcctcactgatccaaccaaaggaatgggaggcactgttaagaaagcttatgaccttttggaatctacacctaatgccttcatgcttcaacagttntctaatcctgcaaacactcagattcattttgagacgactggtcctgagatatgggaggaaacacagggtaatgtcgacat

SEQ ID NO: 620 - DNA, 683 bp, Artificial
  Synthetic
gcgcccacgcgtgcggcgggagaaaagaatggaattgcgaaggatgtaactgaattgatcggaaacactcctttggtgtacctgaataatgttgaggatgggtgtgttgctcgcgttgctgccaagctcgaaagcatggagccatgctctagtgttaaggataggataggttatagtatgattacagatgctgaggagaatggcctgatcaaacctggcgagagtgtcctcattgaacctacaagtggaaacactggagtaggattggcatttatggctgctgctaaaggatacaaactcatcataacgatgccttcttcaatgagtcttgagaggagaattattttgcgtgcttttggtgctgagttggtgcttactgatccagcaaaagggatgaaaggttctattcagaaggctgaagagattaaggccaaaacacctaactcctttattcttcagcaatttgaaaaccctgcaaacccaaaggtacactatgagacaactggtcctgagatctggaaaggctcaaacgggaaagtagatgctctcgtctctggaattggaacaggaggcacaataacaggttcaggcaagtatttaagagagcagaacccccataaagctctatggtgtggaaccagttgaaagtgctattctttctggaggaaatcctggtccgcata

SEQ ID NO: 621 - DNA, 1006 bp, Artificial
  Synthetic
tcaagaggttgccaagggtcacgaattccagtccatggacgctgggctcaagtcgctgggcatggatggcgccgccaagcccggggttttgcgccgccgcgcatcgcccgagcttcgatcggacttctcgggaggtaagctcagcgccgggctggccaaagatccggcgctcaaggatggcgaattgtctggcgtcaatatcgctgaggatgtcacacagttgattggaaaaactccaatggtctatctcaacagcgtggtggaaggatgtgtcgcaaacattgctgcgaagctggagaccatggagccatgctgcagcgtgaaagatcgtattggcttgagcatgatcgccgacgccgaggccaaaggagccatttctcctggaaagagcgtcctcgtggagcctacgagcggcaacactggaattggtttggcattcatcgctgctgccaagggctacaagctgatcctcaccatgccggcgtccatgagcatggaacgtcgagttctactccgcgccttcggtgccgagctcgtcgtcaccgatcctgccaaaggaatgaaaggagccgtttccaaggccgaagagatcgtcaacaagacaccaaacgcatacatgcttcagcaattcgagaatcctgctaatccgaaaatccatttcgagaccactggacccgagatctgggaagatacacgcggaaaaatcgatatccttgtttcaggaattggaaccggtggtaccgtgactggtgccggacggttcctcaagagcaagaacccgaatatcaagcttgttggtgtggagccgactgagagcaatgtcttgtccggcgggaaaccaggggctcacaagattcaaggaatgggagctggattcatacccggcatcttggacgtcggaattcttgacgaggtggtggagatatccagcaacgaggcagtagagatggcgaagcagctcgcgctccaggaaggcctgcttgttggcatctcgtcgggagctgct

SEQ ID NO: 622 - DNA, 781 bp, Artificial
  Synthetic
attgtatctagcctgaaaaagagggaagatagagatagcttgagcaaatagcaatggcgactttcatcaacaatcccttgacttcactctgttccaacaccaacaagtctgaagctaatctcttcagaatttgccctttaagggctcagactttggggatttccaagtttatccccaacagaaaggttactttcccttctattgtttgcaaagcagtgtctgtgcaaccaaaatcagccactgaagttgaaggacttaacatcgctgaggatgttactcagcttattgggaacacaccaatggtttaccttaatacaatcgttaaaggttgtgttgcaaacattgctgctaaacttgagattatggagccatgctgcagtgtcaaggacaggatagggttcagtatgatatctgatgctgaggaaaagggacttatatctccggggaagactgttctagtggaacctacgagtggaaacacaggcattgggcttgccttcattgctgcttccagaggatacaagctcatcttaacgatgcctgcttcaatgagtcttgaaagaagggttcttttgaaagcttttggagctgaacttgttttaactgacccagccaaagggatgaaaggagctgtttcaaaggctgaagaaatattgaataacacaccagatgcctatatccttcaacaatttgacaatcccgcaaaccccaagatacactatgaaacaacgggcccagagatctgggaagatacaaaaggcaagatagacatacttgttgc

SEQ ID NO: 623 - DNA, 614 bp, Artificial
  Synthetic
gaattcagagaaaggaagaatcgctaaagatgttactgaattaatcggaaacaccccattggtctacctcaacaatattgttgatggatgtgtggccagagttgctgcgaagctggagatgatggaaccttgctccagtgttaaagacaggattgggtacagtatgatcactgatgcagaagagaaaggccttattacccctgggcagagtgtcctcgttgagccaaccagtggtaacactggcatagggttagccttcatggctgctgctaagggttacaggctcatcattaccatgccagcttcaatgagtcttgagagaaggatcatcctccgaggttttggtgctgagctggtccttactgacccagcaaggggtatgaaaggtgcagtccataaggccgaaaagataatggcaaaaacccctaattcatatattcttcagcagtttgaaaacccagccaacccaaagattcactatgacacaactggaccagagatctggaaaggctctggaggcaaatttgatgccttcgtgtctggagttggaactggcgggaccataacaggtgcagggagatacctcaaagagcagaagcctgaaatcaagctta

SEQ ID NO: 624 - DNA, 564 bp, Artificial
  Synthetic
tggtatcaacgcagagggcattacggccggggagcttatagctccttttacttgttattctatcacaaatcaaatcacaaaataccctgttcggttgcaaggcatcgatcactctagatcgatgcctgaaatcgaacaattttccgaggccacggccccttcagagagttgcctatttggtaaatatgagctcggaaagttacttgggtgtggtgcatttgccaaagtgtaccacgctagagacatcagaaatggccaaagcgttgcagtcaaagttatcaacaagaagagaattgccaatccgactttgattacaaacgtcaaacgtgaaatctatattatgcgtcgattaagtcacccccatatagtcaaactgttcgaagttcttgcgacaaaaacaaagatctatttcatcatggagtttgtcaaaggaggtgaattattcagcaaaatttccaagctgggtcggttcaacgaagatctgagccgcaaatatttccagcaactcatatcagccgtacgatattgtcattctcgtggggtgtaccatcgtgatttgaaacc

SEQ ID NO: 625 - DNA, 693 bp, Artificial
  Synthetic
gttaaagggggtgaattatttgcaaaaatagccaaaggcaagttgagggaagatgtggctagaggctatttccagcaattaatctcggcgattgatttctgtcatagccgtggtgtttatcacagagatctaaagcctgaaaatttgttgttggatgaagaaggaaatcttaaggtaacagattttgggctaagtgcatttactgaccatttaagacaagatgggctattacatactacatgtggaactcctgcttatgttgctcctgaagtgattggtaaaaaaggctatgatggtgcaaaagctgatatttggtcatgtggtgtaattctttatgtccttttagctgggtttttaccatttcaagatgaaaatattatggctatgtataaaaaaatttataggggtgatttcaaatgtccaccttggttttcatcagaggctagaagattaatcaccaagatgttggatccgaatccaaattcaagaatcactacttctaagattatggagtcaacttggtttaaaaaatcactgccaaagattttaagaaccaaagaggaggaagaattttctataggagatgatataaattgtgtcgaaaaggctaaagatctcgagacattaaatgcgtttcatatcatttctttatcagaaggtttcgatttatcgccattatttgaagagaagaag

SEQ ID NO: 626 - DNA, 680 bp, Artificial
  Synthetic
aaaaattcagtaagtcaatatactcaagacttgtctgaattctgaagaatctgagattaaaccccttttcccttgattatggagcgttatgagatagtaaaggagttgggttctggtaattttggggtagccaagcttgttagtgacaagaaatccaaagagctctttgctgtcaagtttattgaaagaggccacaagatagatgaacatgtgcaaagagaaattatgaatcacagatcattgaaacatccaaatatagtcagatttaaagaggtcttgctgacacctactcatctagctattgtaatggagtatgcttccggaggagaactctttgccaggatctgtagtgctggaaaatttaatgaagatgaggcaaggttcttctttcaacaactgatatcaggggttagctactgccatttcatgcaaatctgtcatagagatctcaaactggaaaatactttactagacggaagtgctgcaccgcgtgtcaaaatatgtgattttggatactccaagtcaactatctttcattctcaacctaagtccactgtagggacgcctgcttatgtagcaccagaaatcctaacaaagaaagaatatgatgggaagcttgcagatgtttggtcatgtggagtcacattatatgtaatgttagttggagcttatccatttca

SEQ ID NO: 627 - DNA, 592 bp, Artificial
  Synthetic
gaaaaataccattgattctctggttttttcctgtaaaccctagctaaaaaataccttaattctctttcgggaatgcagagagatgagaggttatcggttttctgattcccttttgactgccggagaaatccaaaaaccagtcgccggcggcaggaattgccaccggaaacacgtagaagacgggtgaaccaatcacccgttttcccccctttctgtcaaccatttccatttttctttacagaaacagacaccctttttaatctttagcctctttttttacaaattcaaccaaaatctttctctgttccaaaaaatggcacctgaggaaaaatgcatggctttgtacggtaaatacgagctcggccgccttttaggccatggaacttttgctaaagtttaccatgcacgtaacgtgcaaaatggcaaaagtgtggctatgaaagttgtgggcaaagaaaaagtgattaaagttggtatgatggatcaaatcaaacgagaaatctcggttatgaaaatggtaaaacacccaaatatcgttgagcttaacgaagtcatggcgagtaaaacaaagatttactttgccatggagttc

SEQ ID NO: 628 - DNA, 940 bp, Artificial
  Synthetic
ctcaaacatagcctttcgtattcagcttctcatatactcttcgatctgaatagtttattataatatttgagttctctttaatcttttttaatctttttattttggaaaagtttaagatgagtgtatccaagtcccaggtttggcaaccttgtaaaaagaagaggatttagcttaaggcttaatccagaagtaaaaaaaataaaagaagatttttttatagggaagaaaaaaaagaggatggtctttgtattgatttagggtagggatttaataagattgtaggatctgtaagaaatagaaagtttggagatagatgggttcaagatcaaataatggaagtgggaggactacagtgggaaggtatgagatagggaggacagttggggagggtacttttgcaaaggtcaaatttgcaaggaatgttgagactggtgataatgttgccattaagattcttgataaagagaaggtcatgaagcacaagatgatcggccagattaaacgggaaatatcaacgatgaaacttataagacaccccaatgttatccgaatgtatgaggtcatggccagcaagacaaagatatatattgttttggaatttggtactggtggcgaactgtttgacaaaatttctagtagaggtaggctcaaagaagatgaagcaagaaaatactttcagcaacttataaatgcagttgactactgtcatagtagaggtgtattccacagagatctcaagcctgaaaacttgttgctggatgcgaatggtgttcttaaagtttcagattttggactgagtgcgctacctcagcaagttcgcgaagatggactactacatacaacatgtggaacaccaaattatgtggcccccgaggtgatcaacaataaaggttatgatggagctaaggctgacctgtggtcatgtggtgtaatccttttt

SEQ ID NO: 629 - DNA, 611 bp, Artificial
  Synthetic
gtaaaacgtagaaaggtgctgtagcatagtctgtgctttcccctcttttcccttccttccttccttccttccaagtgcgaagaacggagaaggagtttgcctttcatcttggtgaaaacccggtgctgtaagaacaacgagtgatgagtctgcagagtgtgcggacgagggttgggaagtatgagctggggcgaaccctgggggaggggaccttcgcaaaggtcaagtttgcacggaatatggagacagacgaaagtgtggccatcaaggtcattctcaaggataagatcctcaaacacaagattgccgaacagataaagcgtgaaatatcaatcatgaagctgataaaccatccaaatgttgttaatttgcacgaggtgatggcgagtaaaacaaaaatctatattgttcttgagtttgttaatggaggcgaattgttcgataaaattgtccatcaagggaaactcaaagaagatgaagccagaaggtatttccaacaacttataaatgcggtggatttttgccacagcagaggagtttgtcatagagatttgaagccagaaaacctgcttctagatgcacgaggcactcttaagatttcagactttggt

SEQ ID NO: 630 - DNA, 642 bp, Artificial
  Synthetic
tagatatagtagtactgtgggaatacccatcttctctcataaagtgaacctgaacctgaaggccatagttggaccctgtgctaagtaaggaagcatggatcgttatgaggcagtgagagatatcggggttggtaattttggtgttgctagattggtaagaaataagaagacaaaggagcttcttgctgtcaagtacatcgagcgaggccccaagattgatgaaaatgtccagcgtgagatcatcaaccatcgcttgctccgccatcccaacattattcgcttcaaagaggtttgcttgactgccactcatttggccatcgttatggaatatgcagcgggtggtgagctttttgaacgcatttgtgatgctgggaggttcaatgaagatgaggctaggtttttcttccagcagttgatatcaggggttagctattgccatgatatgcaaatatgtcatcgggatttgaaacttgagaatactctactggatgggagtcctgctcctcggctgaagatatgcgactttggctactcaaagtcggcactcttgcattctatgccaaagtccacggttggaacaccggcctatattgccccagaagttctttctagaaaagaatacgatggcaagcttgcagatgt

SEQ ID NO: 631 - DNA, 944 bp, Artificial
  Synthetic
gggtagtagcgggaatgtgctggatcgtttagctggggcttggagaggcgatggatcaggagcagcagctggcgcagcagcagccggccaggaggaatgaattcctgcactacaagctcggcaaaactctgggcattggatcgtttggcaaggtgaagatcgcggagcatatactcaccgggcacaaggtcgcgatcaagatcctcaaccgcaggaagatcaaagccatggaaatggaagagaaagttcgcagagagattaaaatcctgaggttgtttatgcatccacacatcataaggttgtatgaagttgtggagacgagcacagacatttacgtggtcatggagtacgtcaagtcgggagagctcttcgactacattgttgagaatggtcggcttcatgaagatcaagctcgacgtttctttcagcagattatatcaggcgtcgagtactgccatagaaacatggtagttcatcgtgatctcaagccggaaaatctgctcctcgactccaaatggaacgtaaagattgcggactttggcttaagcaacattatgcgagacggacatttccttaaaactagctgtggaagtccaaactatgctgctccagaggttatctctggcaagctctatgctggaccagaggttgacgtatggagttgcggcgttattttgtatgcacttctttgcggcagccttccatttgacgatgaaaacattccaaaccttttcaagaaaattaagggtggcatctacactctaccaagtcatctctctgccggtgcaaaagatttaatcccgcgtatgctagtggttgatcccatgaaacggatgactatagcggagattcgtgagcatccttggttccaagtcaatcttcctcggtatcttgcggttccgcccctggacaccgccgagcaagcgaagcggatcgatgaagat

SEQ ID NO: 632 - DNA, 723 bp, Artificial
  Synthetic
ggagctaggggaacgatcacaactttgaagagatgagcttccaaagcaaagtgatgagaactcgcgtcgggaagtacgagctgggaagaactcttggagaggggacgtttggcaaagttaagtatgccaggaactttgagagcaacgagagttttgcgatcaagattctggacaaggagaagatcttgaagcacaagatggtcgagcagatcaagcgagaaatctccactatgaagctggtgaaacatcccaacgtcatccagctctttgaggtcataggcagcaaaacgaaaatttatatggtgatggagtatgtcacaggtggagaaatgtttgacaaaattgcacgcgagggaaagctagatgaacataaagctcgaaagtatttccagcaattgattgatgccgtggattattgtcacagcagaggtgtttgtcaccgtgacttaaagccggagaatttgctcttggattcagatggaaatctgaaaatctcggacttcggattgagtgctcttcctgagcagtgccgaaaagacggccttcttcatacaacttgtggaacaccgaattatgtagcacccgaggtcgtcagtgacaaaggctacgacggtttcaaagcggatatctggtcttgcggcatcgtcttgtacgttatcctggctggatatttgccatttgacgagcctaatctggttgcattgtacaaaaagatgcatcgag

SEQ ID NO: 633 - DNA, 677 bp, Artificial
  Synthetic
gaagtctgtggggaagaaatctagggttagaaggccgtgcgccaggaagcggcccaagggtagttagaaccagcacttcgcggcgcaccactgacgagttcttcgcgacttttttggtagcgtattggaatttggggcgattctagttctggcaatggcggcaacgcccagtggcctccagaccagggtcgggaagtatgagctgggaaagacgattggcgagggcaatttcgccaaggttcggcgagccaggaatctcgacactggcgagatcgtggcgatcaaggtcctcaacaaagaggaggtgatgaagcacaaaatggtcgagcagctcaagcgggagatttcgaccatgaagctagtaaagcatccaaacattgtccagctccacgaggttctggccagcaaaactaaagtttacatcgttttagagtacgtcactggtggagaactttttgacaagatcgtgaaacaaacccgcttgaaagaagacgaagcaaggaagtatttccagcaactcatcaatgcagttgactattgccacagcaggggtgtgtatcaccgcgacttgaagccggagaatttgcttctcgataaaaatggaaacttgaagatctctgacttcggtttgagtgcgcttccgcaacatcttcggccggatggtctacttcacacta

SEQ ID NO: 634 - DNA, 688 bp, Artificial
  Synthetic
agttagagctagagctagagctagggtaatcgcggcagcggctagctgggcttcgccggatccaccgggtgatggcgctggacagggcgatttagggttttatcggattgggcgaagaacgcgctgcgatttcagggtaatcggccttgttcgtcgccatggtggaagctccggagggggaagagagagctgttccggaggagaggcgatggaagctggcggatttcgacatcggcaagccgctaggtcgcggcaagtttggcaacgtctatctcgcgagagagaagaggagcaagtatgtggtggcgctcaaggtgttgtttaagaaccagttacagcagtcccaagtcgagcaccagctacgccgcgagatcgagatccaaagccacttgaggcatccaaacatccttcggctgtatggatacttctatgatcagaatagagtgtaccttattctagagtatgccgctaaaggcgagctgtacaaggagctccaacggtgcaaagttttctctgagaggagagcagccacttacattgcctcattggcgagggcgttaatgtactgccacgaaaaacacgttattcacagggacataaagccagagaatcttctaatcggaatgaagggagagctgaaaatcgcagactttggatggtcagtacatacgtttaaccggaggcggac

SEQ ID NO: 635 - DNA, 664 bp, Artificial
  Synthetic
cccacgcgtccggtcaatggaggcgagctctttgacaagattgccgtaaaaggaaaactctctgaacatgaaggaaggagacttttccagcagttaatcgatgctgtgagctattgccatgataaaggtgtctaccacagagaccttaagcccgaaaatgttcttgtggatcgaagaggaaatatcaagatctctgactttggcctaagtgctttgcctcaacatcttgggaatgatggattgctgcacacaacatgtggcagccccaattatattgctcctgaggttttgcagaaccgaggttacgatggctcattgtcagatatctggtcttgtggagtaattctctatgtaatgctcgtcggataccttccctttgatgaccgaaatcttgttgtcctgtaccagaagattttcaagggggacactcaaatcccaaagtggctttcacctagtgcacgggatcttcttcgaaggattcttgaaccgaacccgatgaagagaatcaacatagcagggatcaaagagcatgagtggtttcagaaggattacactcctgttgttccatatgacgacgatgatgacaattatcttgactcagttcttccaatcaaagagcaaattgatgaagcaaagcaggaaaagcctactcatatcaatgctt

SEQ ID NO: 636 - DNA, 610 bp, Artificial
  Synthetic
gttcaacaaagttcagagaggaagactaaaggaagatgcagcaaggaagtacttccaacaactgatttgcgctgttgacttttgccacagcaggggtgtttatcaccgtgatttgaagccagaaaatcttcttcttgatgagaacagcaatctgaaggtttcagattttggcctaagtgctcttgctgattgcaaaagacaggatgggctgctccacacaacctgtggcacacctgcttatgttgctccagaagtgatcaacagaagaggctatgacggtgctaaggctgacatatggtcttgtggagtgatactctttgtgctattggccggctatctacctttccatgataagaacttgatggatatgtataagaagattgggaaagcagaattcaaatgtccaagttggtttaataccgatgttcgaaggctcttgctcaggatacttgatcctaacccaagtacaaggatctcaatggacaaaatcatggaaaatccttggtttaggaagggtctcgatgcaaagctgctcagatataatctacaaccaaaggatgcaattcctgttgatatgagcacagattttgactccttcaatagcgctcca

SEQ ID NO: 637 - DNA, 585 bp, Artificial
  Synthetic
aaagaaaaaagccaaaatcttgttcgtcaagcccaatatgctttcctgaaaaaccagaaaaggaaaaataatgggttgaagaaatttggaagaagaagaagaagaagaagaaaaacggtgtcgtgtttggtaggaaagatggtgataaggaaattaggcaagtatgaagtagggaggacaataggggaaggaacatttgccaaagttaaatttgcacagaatacggaaactggtgaaagtgttgcaatgaaagtcctcgatcgtagtactatcatcaaacacaagatggttgaccagataaagcgggagatatcgataatgaagcttgttagacatccatatgtagttcgattacacgaggttatagcaacccgcactaagatctatattatcttggaatttattacaggcggtgaactgtttgataaaatagttcaccttgggcgattaagtgaagccgagtcccgtagatactttcagcaattgattgatggagtggattattgtcacatcaaaggagtctatcatagagatttgaagcctgaaaatcttctgctagattcccaaggagatctgaaaatatca

SEQ ID NO: 638 - DNA, 574 bp, Artificial
  Synthetic
cccacgcgtccggaaagaccgtacctctatagatgactttgagataataaaaccaattagtcgtggtgcatttggccgtgttttcttggcaaaaaagagagcaactggagatttctttgcaattaaggttttgaagaaggcagatatgatacgcaaaaatgccgttgagagtatcttggcggaacgaaatattttaatatcggttcgcaatccctttgtggttcgcttcttctactcttttacttgccgtgaaaacttgtaccttgtgatggaatacctgaatgggggggacctgtactcattgttgaggaatcttggttgcttggatgaagacgttgctcgtgtatatgtcgctgaagtagtgcttgctctggaatatctgcactctttgcgagtggttcatcgtgatttaaagccagacaatttgttgattgctcatgatggtcatatcaagttgacggactttgggctttctaaagttggtcttatcaatagcacggatgacttgtctggtccggcagtcagtggagcatccatgatggaagatgatgaatctcagttattggcacctgag

SEQ ID NO: 639 - DNA, 648 bp, Artificial
  Synthetic
gaattcaagaacatcaccagcataattcttcgggtcaaaaagcagtttcgtcggtttcacaaaacagataaatattgatagatttgagatataaatatagatttattgtgagatttactaaaaacatacagttgagagatagagatttagagaaacagaaaaaaaaaacagaggataattaatacagtttcattattgttagagagacagagagtccgagagaaggaaggaaaacagaggtagaagagagtatcttgatggtgaaagaagtggagaaattgggaatgcgacttggaaaatacgagcttggtaaaactcttggtgaaggaaatttcgcgaaagttaaatacgctcagaatcttgaatctggacagatttttgctgtcaagattttggagaagaagaaaatcattaacctcaaagttaacgatcagattaagaatgagattggaacattgaaactgttgaagcatccaaatgttgtcagattacatgaagtcttagcaagtaagacaaagatatacatggtgcttgaatatgtaggaggaggtgaattgtttgacagaattgcaacaaaagggagggtttcggaagctgttggtcggaagcttttccaacagttgattgatggtgtgagttactgtcata

SEQ ID NO: 640 - DNA, 719 bp, Artificial
  Synthetic
gacccacgcgtcgatttgattcaagctctaggcgtttaagtagatggatgcgtgattgattgaatggaagcgatagacaagctagatctagcttgatcttcactgatagaggaagaggaggaagggaagatcaaggatggctcctgacgaagaatcggcgctcttggggacaaatagcgatcatcacagcaagcgcaaattccggcgcaaagtcgtcgctacaagctgtgttcttgggatctttctcgttctcactactgtttggttccttgaccgtggcggcttcttagaattctacgctggtcaggcgatagaatcgtcgaatcctctggtctcgccggtcgatcgtgtagctccagtgaacttcttagcgataggggattggggacgacatggattgtataaccaaacgttggttgcttcccagatgggaaaagttggcgaggagctcggcatagatttcgtggtctcggtgggagataatttttataagaatggattgactggcgtggacgacattgcgtttgatcaatccttctcgaacatctacactgctccaggccttcaaaagccatggcatgcagtgctgggaaaccatgactatcatggagttgttctcgcacagcttgatcaccggctagctttgcgtgattggagatggcactgcgtcagaggtggacaaattatttatgatctgagctcatctctttctcgaggat

SEQ ID NO: 641 - DNA, 317 bp, Artificial
  Synthetic
cccacgcgtccgaaagaacagaatgagttctaagtttgatatcggctccttaagcatagtaatgactctgcttatttgcttcttattattatctttggctccaaaacttgaggctgagctcgcaacggtccaacatgctccaaaccccgatggctctatcagttttctggtgattggagattggggtaggcatggactctacaaccaatcccaagttgccctccagatggggagaatcggggaggagatggatatcaattttgtggtatcgacgggtgataacatctacgataacgggatgaaaagtatcgatgatc

SEQ ID NO: 642 - DNA, 607 bp, Artificial
  Synthetic
gcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtccgtgtgggcttctatctatcagtttgtgtgtctggttttgaaaaacatttgcttttcgattatgcagggtttgcttgtagctttcgctgctgtgacctgtgttgtttatgtgaaccttctttgtggcatctttaatatccaa

SEQ ID NO: 643 - DNA, 644 bp, Artificial
  Synthetic
ccccccggtggacaccctgcgctgcagccgaacgaccgagctaccgagccaatccagccatggcctccaccgcgctctccaccgcctccaaccctactcagctgtgcaggtctcgcgcctcgctgggcaagcccgtcaagggcctgggcttcggccgggagcgcgtgccgaggacggcgacgaccatcacatgccaggccgcgagcagcatcccggccgaccgcgtcccggacatgggcaagcgccagctgatgaacctcctcctgctcggcgccatctcgctccccaccgtcggcatgctcgtcccctacggcgccttcttcatccccgccgggtccgggaacgccggcggcgggcaggtcgccaaggacaagctcggcaacgacgtgctcgccgaggagtggctcaagacacacggccccaacgaccgcaccctcacccaggggctcaagggtgacccgacgtacctcgtcgtggaggccgacaagacgctggccacgtacgggatcaacgccgtgtgcacgcaccttgggtgcgtcgtgccgtggaacgccgccgagaacaagttcatctgcccctgccacggctcgcagtacaacaaccagggcagggtcgtccgtggacctgctcccctgtcgctggca

SEQ ID NO: 644 - DNA, 676 bp, Artificial
  Synthetic
gccattacggccggggattcagaaatggcttcttctactctttctcacgtaactcagctatgctcgagcaagagcggtttgtcttcggtttcacaatgtttgctactgaaaccaatgaagattaacagtcatggattgggaaaggacaagaagatgaaagtgaaatgcatggctacaagtattccagcagatgatagagtgcctgatatggaaaagaggaatctcatgaatttgcttcttttgggtgcgctttctctacccactgctgggatgttggtaccttatgctactttctttgcaccacctgggtcagggggtggtgggggtggaacccctgccaaggatgcattaggtaatgatgtcgttgcatctgaatggctgaaaactcatccacctggtaaccgaactctcacgcaaggactaaagggagaccctacttaccttgttgtggagaatgatggaacacttgcaacctatggtattaatgctgtctgtactcaccttggttgtgttgtgccatttaatgctgctgagaacaagtttatttgcccgtgccatggatctcaatacaacaaccaaggaagagttgttagaggacctgctcctttgtccttggctttggctcatgctgatattgatgatgggaaggtggtgtttgtcccatgggttgaaacag

SEQ ID NO: 645 - DNA, 408 bp, Artificial
  Synthetic
ttgagaccataaccttttagcgttttcggctaaagctttcgctgactactacaacaatggcgtcctcatccctttcccctgctactcagcttggttctagcagaagtgctttgatggcgatgtcaagtgggttgtttgtgaagccaacgaagatgaatcatcaaatggttagaaaagagaagattggattgagaatttcttgtcaagcgtcgagtattccagcagacagagttccagatatggaaaagaggaagactttgaatcttcttcttcttggggctctttctccacctactggctacatgcttgtcccttacgctaccttctttgttcctcctggaaccggaggtggaggtggtggtactccagccaaggatgcccttggaaacgatgtagttgcagcggaat

SEQ ID NO: 646 - DNA, 598 bp, Artificial
  Synthetic
gttaatataatcatatattcttattaaaataaaatcatgcataggggagtcttattcaattctcacaacatatatatgtaagcttcccaacaatggagcaattaataattaaaatctttggttattcttcaattcaacttctttaattacttggggtcctaacaagggagattatccccagtctccacacctagttgttgacaatactcagtataatactcaacccttctggcaacagtctgagggttgccgttgtcacattcaatccggccattaatggctcgaatggttgggccaaaaccttggccaaaagtgatgaaagaatggcaattgttcatccaataccacagggcagtcttgaaggaaataactgcatctttagccacaatgtccgggtcatttaggccatcgaatcctatggattttccagcaggtccatagttgaagttccatgatagttggatgggtcctcgaccgtagtactttttgcctgagacacaagggtactctgggttttcctcatcacaatagtcgcctgaaggaccatttatctcatttatgaagcacatgtgtccagtttcatgggtgacatgagcaa

SEQ ID NO: 647 - DNA, 772 bp, Artificial
  Synthetic
acgcgtcgatcttcagctccgagttctcttcctcctgctcgcgatcttagctgccgctgccgaagactgcggacgacaaggcggcggaagaagttgtccgcctggaaactgctgcagcaggtggggatggtgcggtgacactcccgaccactgcggcgaaggctgccagagtcagtgcggtggagtaacaccgccgcctggtgacggtgtcggatctatcatcacgagttccatcttcgagagcctgctcaagcaccgcagagactcgggatgtgccggtggcttctacacgtacagtgcgttcctcacggctgccagatctttcccgctgtttggaaacgaaggctcgttggagcagaggaagcgagagctcgctgccttcctggcacagacatccaaggagaccacaggtggatggccgactgctcctgacgggccttatcgatggggctattgcttcgttgaggaacaaaataaggacatctactgcagcgcttcggcgacatggccatgtaatggcagcaaaagatactttggtcgtggtcccattcagcttacatggaactacaactatggcctggcaggatcacaagtcggcttcgacggcatcaacgatccggacatcgtttcgcgagacgcggtggtgtcgttcaagacagcgatctggttctggatgacgccacagaacccgaagccttcgtgtcacgacgtaattctggggaaatggaggccatccagtgccgacttagcagcgggaaggactgcgagctat

SEQ ID NO: 648 - DNA, 533 bp, Artificial
  Synthetic
atattgcaaagctctcaatcctttcacttgtgctgctccctcttgttctaactctggtcgcagcaacccactgtaactgcggagaaagaggacgacaaggcggccacgacactactctgccagcaccgtctatcagcgccaacattggaaccatagtgacgaattccctgtttgatcattttgctcgacaagaccaagctcggactcggctgtgccggtggatccttctacactcacgattccttcatggctgccgcaaaggcgtacccgaagtatggctgcaccgggtccgaggagcagcgcaagacggagatcgcttccttctttgcgcagacgtctgcgcagaccgctggaggtggattgcaactccactggatattgtttggttgaataaccagaaaggaaccactactgtaagccatcagctgcttggtcttgtgccccaggaaagagctaccatggtcgaggacctctgcagctcaaatggaactataactatggaccttgtggacatgcacttggctttgatggcg

SEQ ID NO: 649 - DNA, 648 bp, Artificial
  Synthetic
cccacgcgtccgcaaaacatggctttcacaaaaatctccttagtccttcttctctgcctcttaggtttcttttctgaaactgtcaagtctcaaaactgcggttgcgctccaaacctctgttgcagtcagttcggttactgtggtaccgacgatgcatactgcggtgttggatgccgatcaggtccttgtagaggtagtggaaccccgaccggagggtcggtcggtagcattgtgacacaaggtttctttaacaatattatcaaccaagctggtaatggttgcgcggggaaaagattctacacccgtgactctttcgttaacgccgctaatactttccccaactttgccaattctgttaccagacgtgaaattgctaccatgtttgctcatttcactcacgagaccggacatttctgctacatagaagagattaacggagaaacacgtaactactgccatagcagcaacacacaatacccatgtgcaccgggaaaaggctacttcggtcgtggtccgatccaactatcatggaactacaactacggagcgtgtggtcaaagtctcggtcttgaccttctacgccagccctaacttgtgggtagcaacccaactgtagctttcaggacgggtttgtggttttggatgaat

SEQ ID NO: 650 - DNA, 621 bp, Artificial
  Synthetic
aaaaaggtcaaaatgagacttttggagttcacagctctgtcttctctactagtcttgtttctgctcctgcctgtctcggcagagcaatgcggtagacaggcgggaggtgcacgttgtccctcgggaatgtgctgcagcaactttggatggtgcggaaacactcaagactattgtggtccggggaagtgtcaaagccagtgtccttctggccctggacctaccccaagaccacccacccctcctggtcctagtactggggacatatccaacatcatcagcagttccatgtttaatcagatgctcaagcatcgcaatgacaatgcatgccaagggaagggcttttacacttacaatgcctttatcactgcagcaagatcatttcgtggcttcggcaccacgggtgacaccaccaggcgtaaaagggaggttgctgctttctttgcccaaacctctcatgaaactactggaggatgggatacagcaccggatgggagatacgcatggggttactgctaccttagggaacaaggcaaccctcctagctactgtgttcaaagttctcagtggccatgtgctcctggccaaaaatattacggaagaggccccatccaaatttcatac

SEQ ID NO: 651 - DNA, 761 bp, Artificial
  Synthetic
cttccattttccaccgttcgggcaagataataaaaactacaagtatatagcagtaacgtttcttcttcttcttcttcctttgtgaagcaagaaatacttaatagtagaagagtatggctctgagaatgtgggtttcttcaacagccaacgcactaagaatctccagaaccaatctaattgccccctctttttctttctccagatgcttttcaactgttcttgatgggctgaagtatgcatcttcacatgaatgggtgaagcatgacggttcagttgccactgttggcatcactgatcatgctcaggaccatcttggagaagtagtgtttgtggatctgccagaaacaggtggttctgtttcccaaggaagcagctttggagctgttgagagtgtcaaagccaccagtgacattaactgtcctatctcgggtgagattgttgaggtcaacacaaagcttactgaaacgcctggcttggtaaattcaagcccatatgaagatggatggatgattaaagtgaagccaagcagtccatcagaattggagtctttgatgggttccaaagagtacacaaaattctgtgaagaagaggatagtcattgacacctgaatgtacttcttggtccaatttggattaactggggtgcttaaggttgctattgttatagaaatttccagtcaataaataaaattgttcaagcataaaaaattatcttccacttgtctcataacatctttgcctatgcagttctgtgatttgat

SEQ ID NO: 652 - DNA, 330 bp, Artificial
  Synthetic
caccaatctcaggtgaaatcattgaggttaacaagaagctcacagaatcacctggcttgatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttcgaagttctatcaattctcatgcttgttttctaaatttgcatacactctatgaccaacttcacaaaataagagttcaagaagatgaaacagagacctaacaaacacattaagattt

SEQ ID NO: 653 - DNA, 635 bp, Artificial
  Synthetic
agcgtcgattctctgccctaataatctgtcttgctgcttactacgatggctctacgcaccatggcgacgcaagctgcgacgctgctgagaattcggtgccagccgaactacctcgcgcaggcgctggcaattcgtggatttgcaactgaagccgcagctaccgttccaattccccaagatttgaagttcctcgagtcgcatgaatgggtgaaagtggaggatggaactggcaccgtaggaatcagtgaccatgctcagcatgagcttggagacgttgtgtttgcggacttgcccgaggtggggtcgtcggtgagcaaaggcaagaactttggcgtggtggagagcgtcaaggcttgcagcgacatctacagccccgtctctggcgaagtcgtcgaagtgaacgaagaggtcaaggcaacgccagctctggtgaacaagagtgcattcggcgatggatggctcatcaaagtaaagctgtccagcgtgtcggacctcgacggcctaatggattcagcagcatacgaagagcacgtcaagagtgaggctcactagccgagcacaaagcgcaaagcacaaatcacagtatgtttcgaaaagctctactagcaagaaggataattttctttccaaagtcc

SEQ ID NO: 654 - DNA, 332 bp, Artificial
  Synthetic
cccacgcgtccggaaaactcaaaacaaagtaaacaaacaaaccagaaaaaggaatggcactgagaatgtgggcttcctctacagcaaatgctctcaagctctcttcttctgcctccaaatctcatctcttgccagctttctccatctccagatgcttctcctcagtgttggaaggacttaagtatgcaaattcacatgagtgggtgaaacatgaaggctcagttgctacaattggtatcactgaccatgcgcaggaccatttaggagaagttgtgtttgtggagctgcctgaagcaaacagttcagtgagcaaagaaaaaagctttggagct

SEQ ID NO: 655 - DNA, 675 bp, Artificial
  Synthetic
ggagagagagagacagacagagtgcggcgccgaggaggagaggagcaataatccaattccaatccattcctccgcgacctcgtcgtccgatcatggccatggccgcctccaggttgctgtgggcttcccgcgccgcctcctacctcaagatctccactttccccagggccttctccaccgtgctgaaggatctgaagtatgctgacactcatgaatgggttaaggttgagggtgattcggcaaccgttggaattacagaccatgcccagcaccatttgggtgatgttgtgtatgtggagcttccagaagttggcagcagtgtatcccagggaaagaactttggtgctgttgaaagtgtgaaggcaaccagcgatatctactctccagtatctggagaggtggttgcagtgaacgatggactaggcgatgaacctggattggttaatacaagtccatacgagagtgggtggatcatcaaggtcaaggttagtgattcaggtgagctcaattcattgatggatgacgcgaaatactcgaaattctgcgaggaagaagatagcaagcattgaacaaataccagtgacttgtgatctgcaaagaatgcgccttgacccttttgtcaatgcttgtgatgtgctatcgagcacttatctttaccaccggctgctcctgaaa

SEQ ID NO: 656 - DNA, 682 bp, Artificial
  Synthetic
cccacgcgtccggaaaaaagaagaacgcagatactttggtaacaagcaagaaattggcacagaaatggctctgaggctgtgggctagctcagctgccaatgccctcaagatctcatgcagtggagccaccagggctgcacctgcctactcaatctccagatacttctccactgttcttgatgggttgaagtacagctcctctcatgagtgggtcaagaatgatggctctgtggccacaattggaattacagaccatgctcagggccatctgggagaggtggtgttcgtggagctgccggaggcgggggcgaaggtgagccagggaggtgcattcggcaacgtggagagtgtgaaggccaccagcgacatcaactcccccatctccggtgaggtcgtcgaggttaacgacaagctctctgagacacccggcctgattaactcaagcccgtacgaggacgggtggatgatcaaggtgaagccgagcagcccgtcggagctggacgccctgctggacccggccaagtacaccaagcactgcgaggaggaagacgctcactaggctcttcctctctgtttttttctctcccattttgtcactccgacctaatttctccctgttgcaacaactgctctgtatccgtatacgattaataactgaatcttcaggctttgccatgtgttc

SEQ ID NO: 657 - DNA, 648 bp, Artificial
  Synthetic
cattactagagagaaaaatggctttgagaatgtgggcttcttcaacagccaatgcattgagaatttccactgcctcaagagctaatctttcccctgcttattcactctctagatgcttttccactgttcttgatgggctgaagtatgcatcttcacatgaatgggtgaaacatgagggttcagtggcaacagttggaatcactgatcatgctcaggatcatcttggagaagtagtattcgtagatctaccagaaactggtgctgctgtttcacaaggaagcagttttggtgctgttgaaagtgtgaaagctaccagtgacattaactgtccaatctcgggcgagatcgttgaggtcaacacaaagctcactggaacacctggtttggttaactcgagtccatatgaagacgggtggatgattaaggtgaagccgagcagtccatccgagctagaatctttgatggggtccaaagagtacacaaaattctgtgaagaagaggatagtcactaaaacttgaaggtgttttgtttattcaacttggactaactttgcctggttaaggctgatactgtgatgaaacttcctgtcacttgttaaaattctacaaaaatcaaaacaacatccacttttctggtgttaaaaaaaa

SEQ ID NO: 658 - DNA, 576 bp, Artificial
  Synthetic
tgaattcagtatagggacattggaagtaaaagcaatcatcatgctgtatataataggattgggactaggggatgaaaaagacataacactgaaaggtctagaagctgttaaaaaatgcagcaaagtgtatatggaagcttacacttcacttctctcttttggcctttctcccaatggcctttccaatctggaaaatctatacggaagatcaattgcaattgcagatagggaaatggtagaggaaaaagctgatgagatcctcaatgaagctcaatcttctgacgtggcatttcttgttgttggtgatccttttggagccacaacccacactgatcttgttgtccgtgctaagaagttgggtgtggaggttaaggtggtacacaatgcatcagtaatgaatgctgttggagtgtgtggcttacagctctatcattatggagagacagtttccatacctttcttcactgagacctggaggcctgatagtttctatgagaagatcagggaaaaccgaaagcttggactccatacactctgcttattggatatacgagtgaaagaacccaccattgagtc

SEQ ID NO: 659 - DNA, 630 bp, Artificial
  Synthetic
cttcactctgtcttcacactctctgcttttgccgtaggacagaatcgtcgagtttagtgacgaagactgtaatcaatggcatcagctacagcttctcactctttgtgcggcatccccgccacctcatcctctactaccaacaagtctattgccccttcatctgctcgcttcctctctaaaactcctctccgccgcctcggcttcgctggcgccgccgctgattctctcttcaccaaccacgtggcaaccaagctccgatccctcaagagctcctccaagcctgttaggggcgttgcttctatggccaagaaaagcgtcggagacctcaccgctgccgagttgaagggcaagaaagtcttcgtcagggccgatttgaatgtcccacttgatgatagccagaacattactgatgacactagaattagagctgccgtccctactatcaagcacttgatggccaatggtgctaaagttattctctccactcacctgggacggccaaaaggagtcactcctaaatacagcttggcacccctagtccccaggctatccgaactgcttggaatccaggttgtgaaggctgaggactgcattggttccggaagttgagaagttggttgcttcacttcc

SEQ ID NO: 660 - DNA, 963 bp, Artificial
  Synthetic
gaattcgaaaacaaaaacaacaatggcttcaacagcttcacacactactctatctctactcagaacaacagcatcatcttcatctgctcgcaacaaccgtgtatcatcaacattacaagttgcagcagcatctcgattgagaaacatcggattacaagttagaaacccaaaaagtcttgggttttctggtgttgcagtagatcctcttctttcatcacacgtttcttcacaaattggagctgttaatggtaaaggggtgagaggtgttgtttcaatggctaagaaaagtgttggggatttgagtgcatctgaattgaaaggtaaaagggtttttgttagggctgatttgaatgtcccgttggatgacaatcagaacattactgatgatactagaatccgtgctgctattccaactatcaaacatttgatggccaatggtgctaaagtcattcttaccagtcatttgggaagaccaaagggtgttactccaaaattcagcttggcccctcttgtccctaggctctccgagcttcttggcatcactgttgagaaagctgatgattgtattggccctgacgttgagaaattggttgctgcactaccagaaggtggtgttctccttcttgaaaatgtgagattctacaaagaggaagagaagaacgaaccagaattcgcaaagaaacttgcttccctcgcagacctatatgtcaacgatgcctttggaacagcacacagagctcatgcttcaactgagggagttaccaaatacttaaagccatctgttgctggtttcctcttgcagaaggaactggactatcttgttggggcagtttcatccccaaagagaccatttgctgccatcgttggtggttccaaggtgtcatctaagattggtgtgattgagtcgttgctagagaagtgtgatattctacttttgggtggaggtatgatcttcacattcta

SEQ ID NO: 661 - DNA, 499 bp, Artificial
  Synthetic
gttctatcgatcgatcgatccatcagccatggccgccgcaacagccgccgcatcgtcgcagctcctctcgccggcggcgtcgctgggctcggcggcgtcgccgtcgtcgtcgtcgtcgccttccggcaatcgcgccgggttcaggtcattggggaggcaatgcttcgcgggactcgtcgcggggcgccgggaggtgcggcggctgggggatttcgagcggcagcagccggatttcgcggcggcagtggcggcggcggtgaggtcgtcggggggcaatgggcgcggcagccgcggcgtggtgtgcatggccaagaagagtgtgggggatctcaaggaggcggacttgaaaggcaagcgtgtctttgtcagggctgatctcaacgttccactggatgccgatctaaacatcaccgacgatacgaggattcgtgctgccgtgccgacgatccagtatctcattggcaatggggctaaggtcatcctcagcagccatctgggg

SEQ ID NO: 662 - DNA, 169 bp, Artificial
  Synthetic
ccaaagttgaatcggtgcgtgggaagggaagcagaggagtggtttctatggcgaagaagagcgtcggagatctgacctgagctgatttgaaggggaagaaggttttcgtgagagctgatctcaatgtacctctcgatgataatcagactatcactgacgataccagaat

SEQ ID NO: 663 - DNA, 708 bp, Artificial
  Synthetic
atttatacgatcctcgatccttccaattagtcacagacatcgttccgttcatcgtatcgatttttccgacggaaaaaactatagagaaatggcggtgaagaagagtgtgggatcactgaaagaagcagatctgaaggggaagagagtattcgtgagagttgatctgaacgttccattggatgacagcttcaatattactgatgacaccagaatccgagctgctgttcctaccattaagtatttgatgcaacatggatctcatgttattcttgcctctcatcttggtcgtccaaaaggtgtcactccaaaatacagcttgaagccacttgtaccaagactgtcagagctattgggacttgaggtcaagatggcagatgattgcattggtccagaagttgagaagttggttgtcgaaataccagaaggaggagttctgctgctggaaaatgtgagattctataaagaagaggagaagaatgagcccgagtttgcaaagaagctggcgtctcttgcagatttgtatgtcaatgatgcctttgggactgcacacagagcacatgcttccacagaaggggttgctaagtacttgaaaccggcagttgctggattccttatgcaaaaggaacttgactatcttgtcggagctgtatcaaatccacagaagccatttgctgccattgttggtggttcaaaggtttcaagtaagat

SEQ ID NO: 664 - DNA, 611 bp, Artificial
  Synthetic
  misc_feature (166)..(166): The residue at this position can be any nucleotide.
atggcgccgaatccgcgctgctacatggacatcaccattggaggcgagctggaggggcggatcgtcgtggagctcttcgcggatgtcgtgccgcggactgcggataatttccgggcgttgtgtactggcgagaagggcgctggctccactggatgcccgctgcatnattttggcgtgactttccatcgcgtgatcaaaggtttcatgatccagggaggcgacttcaccgccggcgatggaaccggcggcgagtccatctacggcctcaagttcgacgacgagaacttcaagctcaagcacgaacgcaaaggcctgctgtccatggccaactccgggcccaacacgaacggctcccagttcttcatcaccaccgctagagcgtcacatctcgacggcaagcacgtcgtcttcgggaaagtcctcaaaggcatgggtgtggttcgtagcatggagcatgccatcaccgacgacaaggaccggcccgtgaatccgctggtggtggccgactgtggagagcttccacaaggagctgacgatggtgtgtcgctcttctggaaggatggcgatgtgcttccggactggccggctgacttgcccgagcagccggagga

SEQ ID NO: 665 - DNA, 607 bp, Artificial
  Synthetic
gaagccggcagcactgctgcagcaaagcaagcgcaagaagggaccgtcgcggctcagcctccccaccatcgtctcctgcaacctcatcgtcgtcctcctcttcttctccatcctagcgctccacaggcacaatcgtagtagcggcaattggaatgcccaggtcgctggacgaaaggagaaaatgggacttcttcccaagtatgtgttgatgaacacaaccaagggggtaattgttttggagctctttggcgatgaagttccgaaggccgtggagaacttcgcggtgcatgggcagaaaggatactacgacggcgtcaagttccacagagtgatcaaggactttatgatccaagctggtgatcccaccggtgacggacgaggaggcgactccatctggggtggatccttcaaagacgagttcagaccaaacttgaagcacgaagcatttacgttatccatggcgaattctggcccggattccaatcggtcccagttcttcatcacaactgtggagacaccacacctggatggcaagcacacggtgtttggacgcgttgtgcgtggtcaagaagttgtaaaggaaatagaaagccaagaaactaatgtg

SEQ ID NO: 666 - DNA, 545 bp, Artificial
  Synthetic
agctatgtcgtccgtgtacgtgcttgagcccccgacgaaggggaaggtcgtccttcacacctcgtctgggcctctggacatcgagctatgggccaaggaagccccacaagctgccaggaatttcgtccagctctgtatggaaggctactacaacaatacattgttccatagagtcattccaggatttttgattcaaggtggtgatcctacaggcactgggaaaggtggagagagcatctatggagagcctttccccgacgagatccacacaaggttgaagtttagacatcgaggttttgttgcctgtgctaatgagggaaggccaaactcgaacgggagccagttcttcatcactttggatcgcagcgattggatcaatggcaaacactcgatttttggaaaggtaactggagatacaatatacaatctgatcaagcttgcagagtgtgatgttggcgaagatgatcggcctacagatcctcagactgtgctgtctacagaggttatctggaatccttttgatgatatcgttccgaggaaatcga

SEQ ID NO: 667 - DNA, 633 bp, Artificial
  Synthetic
aagagggcctccagaggtcactctagaaacttcatgggttcttttacactcgagatgtattacaagcatgcaccaagaacgtgtcggaatttcatagagcttgctcgtagagggtactatgataatgtcaagtttcatagaattatcaaggattttattgttcaaggtggagatccaactggtactggaagaggtggagaatctatttacggcgcgaagtttgatgatgagataaaccaacagttaaagcatacaggagcaggtatcatatccatggctaatgctgggccgaatacaaatggaagtcaattcttcatcaccttggcacctgctcaatcacttgatgggaaacataccatttttggaagagtttgtcggggaatggaaattatcaagagacttggcagtgttcaaactgataatactgacagaccaatccatgatgtgaagatactgaggaccacagtgaaagattaatgtcctgcaatttcaaagcaattgttaccatgcgctagaggtgttgttctagcgttgtcaattgtcatcacagccaagacacatgctaccttcggcttttgattctgctttcgaagttattgaaactgatctagtcctgtctgtggggatgcggat

SEQ ID NO: 668 - DNA, 1006 bp, Artificial
  Synthetic
aacagtgcccatggctactcaacgaagggcaaaccctagctctctccatctaattactgtattctctctgcttgtcgctgtcgtctccgctgaggtcttcttcgaggagagtttcaacgatggttgggaaagcaggtgggtgaaatctgaatggaagaaagatgaaaacatggctggagagtggaatcacacatctggcaagtggaatggagacactaatgacaaaggtatccaaaccagtgaagactacaggttctatgccatttcagctgagttccctgaatttagcaacaagggaaaaaacttagtgttccagttctctgtgaagcatgagcagaagcttgactgtggtggtgggtacatgaagttgcttagtggggatgttgaccaaaagaaattcggtggtgacactccctacagcatcatgtttggcccagacatctgtggctacagcaccaagaaggtccatgctattctcacttataatgacacaaaccacttgatcaagaaggaagtaccttgtgagactgatcaactgacccatgtttacactttcatcctccaccctgatgctacatacagcattctcattgataatgtggagaaacagtctggtagcttgtactctgactgggaccttctcccaccaaagacaatcaaggatccaagtgccaagaagcctgaagattgggatgagaaggaattcattgatgatcctgaggataagaagccagagggctatgatgacattccagaagagataactgatcctgatgccaagaagccagaggactgggatgatgaagaagatggtgaatggacagccccaaccattcccaaccccgagtacaagggcccatggaagccaaagaaaattaagaaccccaactacaaggggaagtggaaggctcctttgattgacaacccagacttcaaggatgacccagatctctatgttttcccaaatctgaagtatgtgggagttgaactgtggcaagtgaaatct

SEQ ID NO: 669 - DNA, 1028 bp, Artificial
  Synthetic
cccccggatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaagatggatgggaaagtcggtgggtcaagtcagaatggaagaaggatgagaacatggctggtgaatggaaccacacatctgggaagtggaatggagatcctgaggacaaaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacagcattatgtttggaccagacatctgtgggtacagcaccaagaaggtccatactatctttactaagaatgacaagaaccatttgatcaagaaggatgtcccctgtgagactgatcagctgtcccatgtgtacactttgatcatccatcctgatgctacatacaccatactcattgacaatgttgagaagcaatctggcagcatctacgagcactgggatattctgcctccgaagcaaatcaaggacccagaagctaagaagccagaggactgggatgacaaggagtacattcctgaccctgaggacaagaagcctgagggatacgatgatattcccaaggaaatccctgaccctgatgctaagaagcctgaggactgggatgatgaggaacatggtgagtggactgcaccaaccattcctaaccctgagtacaagggaccatggaagcaaaagaaaatcaagaaccctaactaccaaggcaaatggaaggcaccgatgatcgacaacccagacttcaaggatgatccatacatctatgcttttgacagcctgaagtacattgg

SEQ ID NO: 670 - DNA, 621 bp, Artificial
  Synthetic
gtctcctcgacggttatcgatcgatctctcgcggttgatcgatctctcacatcgatcgcctcgatctgatgcgttgctggctgcattccaggttaatccggcggatcgatgaggatttccgcgatcgccgcggcagttctcgcggcgattctcgcgctggctctttctggagctgcggagatcttcttcgaggagcgattcgacgatggttgggaacatagctgggtccagtccgattggaagcgatccgacggtctagcggggagctggcgacacacagcagggaaatggcatggtgatccagatgataaaggcatccagacttatcccgatgctcgttacttcgccatctccgcgcagttccccgagctcaacaccaaaggaaagaccctcgtaattcagtactctgtgaagcacgaacaaaagatcgagtgtggtggcggctatatcaagctactcagtggttacgtgaatcagaaacggttcagtggggatacgccttacagtatcatgtttggtccggacatttgtggaactcagaccaagaaggtccacgcgattttgcagtataagagccagaactatccaatacggaaggaagttacttgcgagacggaccag

SEQ ID NO: 671 - DNA, 343 bp, Artificial
  Synthetic
cgatctgagttttttttagcaatggcgaaaatgattcctagcctcgggtctctgattcttatcggtcttgttgcgatcgcctccgccgcagttattttcgaggagcgctttgatgatggctgggagaacagatgggttaaatctgagtggaagaaggatgataacactgctggggagtggaagcacactgcgggaaattggtctggtgacgctaacgataaaggtatccagaccagtgaagactacagattctacgccatttcagctgagttccctgaattcagtaacaaggacaagaccttagtcttccaattctcagtcaagcacgagcaaaagcttgact

SEQ ID NO: 672 - DNA, 609 bp, Artificial
  Synthetic
taaaactagtcttctcagctgaatcatttctactagttttgttacttttctcacttctcagctcttcattctctgagatcttttttgcagaacagttcgatgatgattggcggagcagatgggtgaagtctgactggaaaaggagtgaagggaaagcaggttcatttaagcatacagctggaaaatgggctggtgatcctgatgataaaggtattcagacatcaagcgatgccaaacatttcgccatttctgctaaggtaccagaatttagcaacaagaacagaactttcgttgtacaatattctataaagtttgagcaagacattgagtgtggtggaggttacataaagcttctctctggatatgtcaaccagaagaaatttgggggagacaccccttacagtatgatgtttggaccggatatctgtggtacacagacaaagaaacttcatgttatgctttcctatcaaggccagaattatcccatcaaaaaggatctacaatgtgaaacagacaaattaacccatttctacacattcattcttagacctgatgcatcatacagcatctggattgatggtcgagaaagggattctggaagcatgtata

SEQ ID NO: 673 - DNA, 609 bp, Artificial
  Synthetic
ggctagagatggctagtctaaccctaagttgccttctcttggtactcttccccttggcctctttcgcccacgttttcttcgaagaacgcttcaatgatggatgggagaacggatgggtgaaatcggattggaaaaaggatgaaggtgctgcaggagactgggtacacacggcagggaaatggagtggtgactccgaagacaattgggattcaaaccagtccagacttacgattttttgccatatcagctgagtttcctgaatttagcaacaagggcaaggatttggttgtccagttttctgtaaagcatgaacaggatcttgattgtggtggaggttatatcaagcttttaagtggtgatgtggatcagaaaaagtttagtggtgataccccgtacagcatcatgtttgggcctgacttctgtggctatagcacaaagaaagtccatgttattttgaactacaatgacaagaatcaccccattgagaaggaaatttcttgtgaaaaggatcaactgacacatgtctacactcttgtgataagacctaacaacacctacagtgttctaattgataatgaagagaaacaaaacggcagtctgtacaaggac

SEQ ID NO: 674 - DNA, 769 bp, Artificial
  Synthetic
ccccccgattttccattatttcctaactcctgagtatcacagacatatttgacttctatcttcctctctttctctctctagccattcaaggggttccctgagactcttgtatcataattttctagatcacacatacaaaaatggtgaaagccgttgccgtccttagcagcagtgaaggtgttagtggcaccatcttcttcactcaggatggagatgcaccaaccacagttactggaaatgtctctggcctaaaacccggatttcatggcttccacgtccatgcccttggtgataccacaaatggctgcatgtcaacaggaccacattacaatcctgctggtaaggagcatggtgctcctgaagatgaggtgcgtcatgctggtgatcttggtaacatcacagttggggaagatggtactgcatcttttaccattactgacaagcagattcctcttgctggtccacaatccatcattggaagagctgtagttgttcatgctgatcctgatgaccttggaaagggaggacacgagctcagtaaaaccactggaaatgctggtggaagggttgcttgtggtatcatcggcctccagggttaattactcatgtaccatgaagattctcagctactactagtggagggatctttgaataaggtttcattggagctattgagcattgttttctatgtttcatgtgatgctttttgtttttgaggtgaaccaatcatacatgatgtagatctaatttccagtgtgtgagttgtact

SEQ ID NO: 675 - DNA, 846 bp, Artificial
  Synthetic
ccgcccacacaatcttcactaccaccaccagcactaccaattctttgttattcccagtcgctgcccctaacaccaacccctccccttcacttcactcttctttccacggtgtttccctcaatctcaagtcaaagactcctcaatctttaacactttctgctgccactgctcctaaacgtctcactgtttttgctgctactaagaaagctgttgctgtccttaagggcaattccaatgttgagggcgttgtcactctctcccaagatgatgatggtccaaccactgtgaaagtgcgcataactggacttacacctggacttcatggattccatttgcacgagttcggtgacactacaaacgggtgtatgtctacaggaccccatttcaatcctgatggcaagacacatggagctcctgaagatgaaatccgtcatgcgggtgacctgggaaacatagtggccaatgccgatggtgtggctgaagcaacaattgtagataatcagataccattgtatggtccaaactcagttgttggaagagcgcttgtggttcacgagcttgaggatgaccttgggaagggtaggcatgaactcagccttaccactgggaatgctggtggacgattggcatgtggcatacttggtttgactccaatatgaagtaatcaagattgatccaggaatagaatatcaatagcaagctgactgcggcttcattgattcaagttgaactattatgctgaagtttcgaaacttcagctagtacgactataggacaaaaacttcagcttatttagttctgaagttttacaaatgaactaaataacttcaacttcttctgctaatg

SEQ ID NO: 676 - DNA, 923 bp, Artificial
  Synthetic
actttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggtgaaggctgttgctgtgcttgctagcagtgagggtgtcaagggcaccatctttttctcccaagagggagatggtccgacctctgtgacgggaagtgtctctgggctcaagccagggctccatggattccatgtgcacgcgctcggtgacaccactaatggctgcatgtcaactggaccacacttcaatcctactgggaaggaacatggggcaccacaagatgagaaccgccatgccggtgatcttggaaatataacagctggagcagatggtgttgctaatgtcaatgtctctgacagccagatcccccttactggagcacactccatcattggccgagctgttgttgtccatgctgatcctgatgatcttggcaagggtggacatgagcttagcaagaccactggaaatgctgggggccgagttgcttgcggaatcatcggactccagggtgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaacttt

SEQ ID NO: 677 - DNA, 934 bp, Artificial
  Synthetic
caggcacttcaccaaccctctggctcccttccgccgccctccgccgccgcatgcaagccaacctcgccgctgccatggccgcccagaccctcttgttctccgccaccgcccctcccgcctcccttttccagtccccttcctctgcccgccctttccactcgctccgcctcgccgccggccccgggggcgccgccgctgccagggcgctcgtcgtcgccgacgccaccaagaaggccgtcgccgtgctcaagggcacctcccaggttgagggagtcgtcaccctcacccaggatgaccaaggtcctacaacagtgaatgtccgtgtgacgggacttactcctggacttcacggcttccacctccacgagtttggcgatactacgaatgggtgcatatcaacaggaccacattttaacccaaacaatttgacgcacggtgcaccagaagatgaagtccgtcatgcgggtgacctgggaaacattgttgccaatgctgaaggtgtagctgaggcaaccattgttgataagcagattcctctgagtggcccaaattctgttgttgggagagcattcgttgttcatgagcttgaagatgatttggggaagggtggccatgagcttagtctcagtactggaaatgctggtgggcgacttgcatgcggtgttgttgggctgaccccgttgtaggtcgctgcaagttgcagctgaagtgtcagtatcgcatccatgtcaccctttttgtcatcttcgagcctgaggcagtcgttcttgtatcacatggatttcgcaacatggatgcttaatagtatctgttgatcgttcgtctcacagtaataaaatttagttgagcaaataagtgtcgtcacatcccctgttctccaccctgtcaaactataaattgtgaaacatgagctgttctgggtatacaacgcata

SEQ ID NO: 678 - DNA, 1149 bp, Artificial
  Synthetic
  misc_feature (903)..(903): The residue at this position can be any nucleotide.
ctattagcttaagtttccataagcaagtacaaatagctatggcgagttccgttttctctcggttttctatatacatttgtgttcttctattatgccatggttctatggcacagctatttaatcccagcacaaacccatggcatagtcctcggcaaggaagttttagggagtgtagatttgatagactacaagcatttgagccacttcggaaagtgaggtcagaagctggggtgactgagtacttcgatgagaagaatgaattattccagtgcacgggtacttttgtgatccgacgtgtcattcagcctcaaggccttttggtacctcgatacacaaatactcctggcgtggtctacatcatccaagggagaggttctatgggtttaaccttccccggttgccctgcgacttaccagcaacaattccaacaattttcatctcaaggccaaagtcagagccaaaagtttagggatgagcaccaaaagattcatcaatttaggcaaggagacattgttgcactcccagctggtgttgcacattggttctacaatgatggtgatgcacctgttgttgccgtatatgtttatgacgtaaacaacaacgccaatcagcttgaacccaggcaaaaggagttcctattagccggcaacaacaatcgggctcaacaacaagtatatggtagctcaattgagcaacactctgggcaaaacatattcagcggatttggtgttgagatgctaagtgaggctttaggcatcaacgcagtagcagcaaagaggctacagagccaaaatgatcaaagaggagagatcatacatgtgaagaatggccttcaattgttgaaaccgactttgacacaacaagcaagaacaagcacaagcacaagatcaatatcaacaagtncaatacagtgaacgacagcaaacatcttctcgatggaacggattggaggagaacttttgcacgatcaaggcgagagtaaacattgaaaatcctagtcgtgctgattcatacaacccacgtgccggaaggataacaagtgtcaatagtcagaagttccccatccttaacctcatccaaatgagcgctaccagagtaaacctataccagaatgctattctctcgccgttctggaacgtcaatgctcat

SEQ ID NO: 679 - DNA, 477 bp, Artificial
  Synthetic
gctgcctggttgtccagagacgttccagtcagttaggtctccctttgagcaagaggtggcaacagctggtgaggctcaatcatcaatccaaaaaatgagagacgagcaccagcaacttcaccaattccaccaaggtgatgtaatcgcagtgccagctggagtagcccactggctatataacaatggtgattctcctgtggttgctttcactgtcatcgacaccagcaacaatgccaaccagctcgatcctaaaagaagggagtttttcttggctggaaagcctagaagtagctggcagcagcaatcgtactcataccagacagaacaactgagcagaaatcagaacatctttgctgggttcagcccagatttactttctgaagccctgagtgtgagcaagcaaactgtgttgaggctccaaggcctgagtgacccaagaggtgccatcattagagttgaaaatgggctccaggcact

SEQ ID NO: 680 - DNA, 616 bp, Artificial
  Synthetic
accagcccaagtttccaataacatcctcaaatagctatggcgaccatagctttctctcggttatctatctacttttgtgttcttctcctatgccatggctctatggcccagctatttggtccgaacgtaaatccatggcacaaccctcggcaaggaggttttagggagtgtagatttgatagactacaagcatttgaaccacttcggagagtgaggtcagaagccggggttacagagtactttgatgagaagaatgaacaattccagtgcacaggtacatttgtcatccgacgtgtcattgagcctcaaggccttctggtacctcgatacagcaatactcctggcatggtctacatcatccaagggagaggttctatgggattaactttccccggctgcccagcaacctaccaacaacaattccaacaattcttgcctgaaggccaaagccagagccaaaaatttagggatgagcaccaaaagatccaccaatttagacaaggagatatcgttgcactgccagctggtgttgcgcattggttctacaatgaaggcgatgcaccagttgttgctctatatgtcttcgacttaaacaacaacgctaatcagcttgaac

SEQ ID NO: 681 - DNA, 541 bp, Artificial
  Synthetic
gggcggacgcgtgggattgcgttctcttcttcctcttgccctttgcttttttctcctctttaatggttgttttgctcaaatagagcaacagcaacgattcttatggcagaaacttcagcaacagcaacaacacagtcgtggccgagctagaactgagtgtcggatccagagccttaacgctcgggaaccgacttataaatttgaatcggaggctggaaccactgagttttgggaccgtaataatgaggaattcgaatgtgctggagttgctgctgttagaaatgttattcaacctcaaggcttgctcttgcctcattacaataatgctcctcaactcctctacattgtccaagggagtggacttctgggtactgtaatacctggatgtgctgaaacatatgaatcaccacgaagagagagaggcatgatgggagaagatagcatagagggagaaagccagttcagaagtggtggtgatcaacatcagaaagtcaggcaatttagacaaggtgatgtattagcattaccagcaggtcttact

SEQ ID NO: 682 - DNA, 809 bp, Artificial
  Synthetic
ccgtccgcttctctacacaacaataataatcatgggttctagctggctctctttctccttgagtttcctactggtgttgcacggtacctttgctcagcagagataccagcagcggcaaggcgaatgccaactcaatagacttagccctcaggaacccaccacccgcattcaagccgaagctggagtcaccgagttgtgggaccaaaacaaccagcagttccaatgtgctggcgtctcgctaattcgccacgtcatccagtctagaggcatgctgttgccttcttatgtcaacactcccctacttgcctatgttgaacgaggtcggggattttatggcatcatgcaatctggatgccctgaaacattccagtcgtccttgcaaatgcagcaaggtgaaaggggtgcaggctcaagattccaagatcgccatcagaggattggacagttcagacagggtgacattattgccttccctgctggagctgctcactgggcctataacgaaggaaatgaggagcttgttcttgtttgtttagaagacagcagtaacaatgccaaccaacttggtcaattttcaaggagattcttcatagctggaaacccacaacaaggacagcaacaacagggacaatacggtggcaaaagcttgcgcagggaacgattcgaatctggaaatgttttcaatggctttgacgtagaggtcttggccgaggcatttggtgtagacagggagatagcaaggagacttcaaggacaggacgaccagcgaggccacattgtaaacattgagcaaggactcagagttgtga

SEQ ID NO: 683 - DNA, 676 bp, Artificial
  Synthetic
gcatccataaatcgccccatagttttcttcacagtttgcttgttcctcttgtgcaatggctctctagcccagcagctattaggccagagcactagtcaatggcagagttctcgtcgtggaagtccaagagaatgcaggttcgataggttgcaagcatttgagccaattcggagtgtgaggtctcaagctggcacaactgagttcttcgatgtctctaatgagcaatttcaatgtaccggagtatctgttgtccgtcgagttattgaacctagaggccttctactaccccattacactaatggtgcatctctagtatatatcatccaagggagaggtataacagggccaactttcccaggctgtcctgagtcctaccaacaacagttccaacaatcaggccaagcccaattgaccgaaagtcaaagccaaagtcaaaagttcaaggatgaacatcaaaagatccaccgtttcagacaaggagatgtaattgcattgcctgctggtgtagctcattggtgctacaatgatggtgaagtgccagttgttgccatatatgtcactgatctcaacaacggtgctaatcaacttgaccctaggcaaagggatttcttgttagctggaaataagagaaaccctcaagcatacaggcgtgaggttgaggagcggtcacagaaca

SEQ ID NO: 684 - DNA, 622 bp, Artificial
  Synthetic
ctacatttacaccatctagtaatcttgttaagcatctcccatacgctgtcaacaatggcatcatacaagatcttggttgtctttgctttgctagctctttctgcaagtgcagctaccgcaatcaccaccactataccatacttcccatcaacactagcaatgggcaccatgaatccctgtaagctgtacatgatgcaaactttgggcatgggtagctacgcaaccatgttcatgtcacaaccaattgctctcctgcaacaacaatgttgcatgcaactacaaggcatgataccacaagtgcctttgtggtgctagttgtcaaatgatgcagaacatgcaaaatgctatttgtggtggactcgggcaacaacaaatgatgatgaagatggtgatgcaactgccatatgtgtgcaacatggcacccgccaactttcaaactctttccttatggttgttgttgatcgaatttcaattactttgtatagtcaaataacaagtgtatgatgcatactatcgtgtgcatctcacactggtggagaaaccgtttgtagtcccggttgataacccccctttagtcccggtttccaaccgggactacgaatccgggactaaagatcgctat

SEQ ID NO: 685 - DNA, 979 bp, Artificial
  Synthetic
  misc_feature (960)..(960): The residue at this position can be any nucleotide.
gaactgatgtgagagatgtagaagttttgagtgagatttatatctctatcaatgacaattacgaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggcagcatacaccagcaagatctttgccctgtttgccttaattgctctttctgcaagtgccactactgcaatcaccactatgcagtatttcccaccaacattagccatgggcaccatggatccgtgtaggcagtacatgatgcaaacgttgggcatgggtagctccacagccatgttcatgtcgcagccaatggcgctcctgcagcagcaatgttgcatgcagctacaaggcatgatgcctcagtgccactgtggcaccagttgccagatgatgcagagcatgcaacaagttatttgtgctggactcgggcagcagcagatgatgaagatggcgatgcagatgccatacatgtgcaacatggcccctgtcaacttccaactctcttcctgtggttgttgtgcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctatnggaaccgcaaaaatgcgcc

SEQ ID NO: 686 - DNA, 431 bp, Artificial
  Synthetic
agcataataacactgtagtgccaacaatggcagcatacaagatcttggccctctttgcgttacttgctctttctgcaagcgccgctactacaatcaccaccatgccatatctccaaccaacaatagcaatgggcaatatggatccgagtacgcagtacatgatgcaaacgacgggcacagatagctacgcaacaatgttcatgccacaaccaattgctctcctgcaacaatagtgttgcatgcagctacaaggcatgatgccacagtgccagtgtgggtatggtactagttgccagatgatacagaacatgcaatatgctatctgtggtggcacttggccaacaacaaatgatgatgaagatggcgatgcaacttccaaacatgtgtatcatggcccctgcctacttccagctctctccctatggttgttg

SEQ ID NO: 687 - DNA, 631 bp, Artificial
  Synthetic
aaaaaaaaggaaaaaaaaaaaccaaaacacaccaagccaaataaaagcgacaatgggatcgctcaccaccaacatcgtcctcgccgtcgccgtggtggccgcgctggtcggcggcgggtcgtgcggcccgcccaaggtgccacccggcccgaacatcacgaccaactacaacgccccgtggctccccgccagggccacctggtacggccagtcctacggctccggccccgctgacaatggtggcgcgtgcgggatcaagaacgtcaacctgcctccctacaacggcatgatctcctgcggcaacgtcccaatcttcaaggacggcaggggatgcggctcatgctacgaggtgaagtgtgagcagccggcggcgtgctcgaagcagccggtgacggtgttcatcacggacatgaactacgagcccatctcggcgtaccacttcgacttctccggcaaggcgttcggcgccatggcttgcccggggaaggagaccgagctccgcaaggccggcatcatcgacatgcagttcaggagggtgcgctgcaagtaccccggcggccagaaggtcaccttccacgtcgagaagggctccaaccccaactacctcgccgtgctcgtcaagttcgtcgcc

SEQ ID NO: 688 - DNA, 695 bp, Artificial
  Synthetic
ctaagtaacacccatcagcaacaatggcatcctcttgtctccttctggcctgtgtcgtggcagcggccatggtgtctgcagtgtcatgtgggccgcccaaggtgccgcctggccccaacatcactgcggcctacggcaaacagttgctggaagctaggggtacctggtacggcaagccaaagggtgccggccccgacgacaacggcggcgcttgtgggtacaaggacattgacaaggctcccttcctcggcatgaactcatgtggcaatgaccctatcttcaaggatggcaagggctgcggctcctgctttgaggtcaagtgttccaagccagaggcctgctccgacaagcccgtcatcatccacatcaccgacatgaacactgagcctatcgccgcctaccacttcgacctctccggccatgcttttggtgccatggctaaggaaggcaaggatgaggaactccgcaaggcgggaattatcgatatgcagtttcgtcgcgtccgctgcaagtaccctggtgagactaaggtcaccttccacgttgagaagggctccaaccccaactactttgcagtgcttgtcaagtacgtcggtggtgacggtgatgtcgtgaaggtggaacttaaggagaaaggctctgaggagtggaagccactcaacgagtcatggggtgctatctggaggatagacact

SEQ ID NO: 689 - DNA, 610 bp, Artificial
  Synthetic
caaccgatagccaaagagctgagaactctggcaatggctacccactgctcttcctcttcgttaatgttcacttccacttcaccaaaatccttttctttttccccaaagaaaaccccatttctgggtttctcaatggcagccttatcgaagccgtcgtttcagttatcacccctcgccaagaccaatcggacggcccaaattcgttgccaagataaagctgccgcctacattcctcttgaccaacgatggatgttcgtagagtctgaaattgacggccctgacatttggaacgagacatggtatcccaaggcttctgaccatgtgaacacagacaaaccatggtatattgttgatgcctctgatttaattcttggaagaatggcatcaactatagcgatacatatgagagggaagaatctggccacatacactccaagtgttgacatgggtgcatttgtcatagtggttaatgctgagaacgttgctgtatctgggaagaagacgacccaaaaactctataggagacactctggcacacctggtgggatgaaagtggagacttttgatcaactgcaacagagaattcctgaaagaatcattgagcatgctg

SEQ ID NO: 690 - DNA, 454 bp, Artificial
  Synthetic
aaaagttgcttacttttcagtgcctccgcccttcagtctggtgcgtgtggttatggagatttagcaataggctttaatgggggtcgacttgctgctgctattcctagcctttacaaagaaggagctggttgtggtgcttgttatcagattagatgcaaagactcaacactctgttcgaaagagggcacaactgtaattgtaactgatctaaataccaataaccagacggattttgtgatcagtagccgagcttttatggccatggccaataagggaaaagctaaagacgttctcaaattgggaattgctgatgttgaatataaaagagttccatgtgattacaaaagcaagaatttggccattcgtgtggaagaatcaagtcaaaaaccaaattatctagcaatcagcttcttgtaccaaggtggtcaaactgaaattgtcgctgtcgacgtag

SEQ ID NO: 691 - DNA, 621 bp, Artificial
  Synthetic
cgccacctctctcatcggatccctgcagaggaggagagggcagtggcggcgaaaggcgacatgggctcgctgtcctctctcgccgccgcggcggtgtttctctccctcctcgccgtcggccactgcgccgccgccgacttcaacgccaccgacgccgacgccgacttcgccggcaacggcgtggacttcaactccagcgacgccgccgtctactggggcccctggaccaaggccagggccacctggtacggccagcccaacggcgccggccccgacgacaacggcggcgcgtgcgggttcaagcacaccaaccagtacccgttcatgtcgatgacctcctgcggcaaccagccattgttcaaggacggcaagggatgcggctcttgctacaagatcagatgcaccaaggaccagtcgtgctccggcaggtcggagacggtgatcatcaccgacatgaactactacccggtggctccgttccacttcgacctcagcggcacggcgttcggcaggctcgccaagcctggcctcaacgacaagctgcgccactccggcatcatcgacatcgagttcaccagggtgccatgcgagttcccggggctcaagatcgggttccacgtg

SEQ ID NO: 692 - DNA, 635 bp, Artificial
  Synthetic
cccacgcgtccgattatattgcagcaatggcatcctcctcccttctactcgcctgtgttgtggtgggggctatggtgtccgccgtctcctgcgggccacccaaggtgccaccgggccccaacatcacgacaagctacggcgacaagtggctggaagccaaggccacctggtatggtgcgcccaagggtgctggccccaaggacaacggcggcgcctgcgggtacaaggatgtcgacaaggctcccttcctcggcatgaactcctgcggcaacgaccccatcttcaaggacggcaagggctgcggctcatgcttcgagatcaagtgctccaagccggaggcctgctccgacaagcccgcccttatccacgtcaccgacatgaacgacgagcccatcgctgcctaccactttgacctctccggccttgccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtgacgtcgtggaggtggaaatcaaggag

SEQ ID NO: 693 - DNA, 920 bp, Artificial
  Synthetic
gatccggcgttaccatacgcttcgtcatcggcgatgacctcaacattatcaacaaccaacaacaaaaccccatttctgggtttcacatttgcctctgcaaaaccttcttttttagttaaaaccttaaataacaataattctaagcagcaatctctttcgattcgttgtcaaaacctaaccgctgtacctaaagatgaacgatggatgtttgaagattctgaaatcggcggaccagacatttggaacaagacctggtatcctaaagctgctgatcacataaacacagagaagaaatggtatgtggttgatgcgactgacttaattttgggcagaatggcatcaaccatcgccattcacattcgtgggaagaatctcgcaacctatactcccagtgttgacatgggggcttttgtaattgtggttaatgcagaaaaagttgctgtatctgggaagaaaagattgcaaaagctatataggagacattctggaagaccaggtggtatgaaggtagagacttttgatcagctccaacagagaattcctgaaagaataatcgagcatgctgtccgcggaatgcttccgaaaggaagactgggtagagcgttattcaaccatctcaaggtatacaagggtggggagcatccacatgaggcccaaatgcctgttgatcttccaataagagacaaaaggatacgaattcagaaataggcataccacatgaagtatggagttagttggggttttaacacttctgaagattgtggtcatgagcctaggctttcttgaatatgtacaacttattattgtgtatgattttgtatgaatctagtggatatcaagtaaatttcattttgagttttgtagaatctatatccgactttgagttctcatgtaatgcaaggaatttcataaaaaaaaaa

SEQ ID NO: 694 - DNA, 1068 bp, Artificial
  Synthetic
gaatcctacctgactagtactaccactactagctagtagcgagctactctctctggtcatcaagctttgagtggttggagtggtggcagctatggctttttccatctccaagaaggctgcagttgctgcactcttctccttccttgttgtcacctgcgtcgccggcgccaggccggggaacttcagcgcctccgacttcaccgccgatcccaactgggaagtcgccagggccacctggtacggcgctcccaccggcgccggccctgacgacgatggcggtgcttgcgggttcaagaacaccaaccagtacccgttctcgtcgatgacctcctgcggcaacgagcctatcttcaaggacgggaagggctgtggctcatgctaccagataagatgcgtcaaccaccctgcctgctccggcaacccggagacggtgatcatcaccgacatgaactactaccccgtttccaagtaccacttcgacctgagcggcacggcgttcggcgccatggccaagccggggcagaacgaccagctccgccacgccggcatcatcgacatccagttcaagagggtgccgtgcaacttccctgggctgaaggtgacgttccacgtggaggaggggtcgaacccggtgtacttcgcggtgctggttgagtacgaggacggcgacggcgacgtggtgcaggtggatctcatggaggccaactcccagtcgtggacgccgatgcgcgagtcgtggggctccatctggaggctcgactccaaccaccgcctcacggcgcccttctcgctccgcatcaccaacgagtccggcaagcagctcgtcgccagccaggtcatcccggccaactgggcccccatggccgtctaccgttctttcgtccagtacagcagctaagccaatgatcaagaacaagcataattcatgcctactatagcagcagcagaagcagcattagctactatacatacctctacgtacgacatttgagatcgatcgtttggccatttttatctgctcgggtattgattagctctccctcggtattgtatggatttgcatggatg

SEQ ID NO: 695 - DNA, 619 bp, Artificial
  Synthetic
gccgaaaacccaaagaaatcaaaaccagggaaagttctctttttcaactggataattcaaagaattattctgctgattccaaaatcaaaattgagtagaagatcagaaaaagatggggatcagattcgtattaatggtaaataagcaagggcaaactcggctggctcagtactatgagtacctcactttagaagaaaggcgtgctcttgagggtgaaattgtgcgtaaatgccttgctcgcaatgaacagcagtgttcatttgtggagcatcgtaattacaaaatcgtgtacaggcggtatgcgtcactctttttcctggttggagttgataatgaagaaaatgaacttgctattttggaattcattcacctgttagttgaaaccatggatcgtcattttggcaatgtgtgcgagctggatataatgtttcatcttgaaaaagcacacttcatgctggaggagatggtaatgaatgggtgtgttgttgagacaagcaaggcaaacatcctggctccaattcagctaatggaaaaggcatcataagtagtacactctgatccatggaattcgtaataaaccgatttgcttgtgtagtgtttacgttttgggatttgtgct

SEQ ID NO: 696 - DNA, 352 bp, Artificial
  Synthetic
ttctggagatctcttctgggaatcgagcttcactgttaaagattttccttcaatcggctaaaaatgatacatttcgtgttactagtcagtcgacaagggaaagtaaggctcaccaagtggtattcgccgtatacgcagaaggaaagatctaaggtcatacgtgaactcagtggagtgattctgaaccgaggtcccaagctctgcaattttattgaatggagaggatacaaggttgtctacaaaagatatgcaagcttgtacttctgcatgtgcattgatgaggcggataacgagttagaggtactggagataattcatcactacgtcgagattcttgaccgctactttggca

SEQ ID NO: 697 - DNA, 611 bp, Artificial
  Synthetic
  misc_feature (514)..(514): The residue at this position can be any nucleotide.
gcgatctcgacgagatgatcagatttattctgctgcaaaatcggcagggaaagactcgtctcgccaagtactacgtcccactcgaagactctgagaagcaaaagctccagtatgaggtccacaggctcgttgtcaatcgggatccaaaattcacgaactttgtcgagtttcgcacacacaaggtgatctatcgacgctatgccgggctcttcctttcaatgtgtgtggacatcaccgataacgagctggcctatctggagagcatccacctctttgtggaaattctagaccatttcttcagcaacgtctgcgagcttgatctggttttcaaacttccacaaggtttacttgatcctcgacgagttcattctcgctggcgagttacaagaaaccagcaaaaaggcaataatcgagcgcatggcagagctagagcggcaggaataagcatactcgatcgtctcagtttttcaaaacgcgataggcagcctccgggcacgcacaaaggcatcgagtntatcccaaaactcgagaactgccgttcggtcctggtgcctcttgtgcttgctcagctgtttaagcaaacaaagaagtgtaagaagtcattcgaattc

SEQ ID NO: 698 - DNA, 533 bp, Artificial
  Synthetic
gggggagattatggcgattcgattcgtgttgctggtgaacaagcaaggtcagacgcgattggcgcagtactacgagcagctgacgatcgacgagcgccgggcgctggagggcgagatcgtgaggaaatgcctggcgaggacggaaaatcagtgctcgtttgtagagcaccggaattacaaggtcgtgtatcggcgctacgcttctctcttcttcctcgttggagtagacagcgaagagaatgagctagcgatactggaattcatccattgcgtcgtggagacaatggatcgctactttggcaatgtgtgcgagctggatataatgtaccatttggagaaggcccattttatcctggaagagatggtgatgaatggctgcattctagagaccaacaagagtaatattctggggcctatacagcttatggacaaatcgtcctagtaacaaagtacgtgtcgtccccaaggtagatttctgacgacctggatttggaaatctcgacgagctatggctggaaataaaggagactttg

SEQ ID NO: 699 - DNA, 567 bp, Artificial
  Synthetic
tcctgcacacacgcacaactgcagccatgctctcttttatcctcatccagaacagacagggcaagacccgtctcgccaaatggtacgccccctacagcgacgacgaaaagatcaagctcaagggcgaggtccaccgcctcgtcgccccccgcgaccaaaagtaccagtccaacttcgtcgagttccgcaacaacaagatcgtctaccgccgctacgcagggctcttcttctgcgcctgcgtcgacacaaacgacaacgagctcgccttcctcgaggctatccacttcttcgtcgaggtcctcgacgccttcttcggaaacgtctgcgagctcgacctcgtcttcaacttttacaaggtgtatgctattcttgacgaggtctttcttgcgggcgagattgaggagacgagtaaacaggttgttttgacgcggctggagcatctggataagctggaatagtagcgcgtgggagggacgcgtctttttttttacaaaaacccttttttttctggcgttatatattctccccccttacacttcttcctttgtcctctttaatgaagagaag

SEQ ID NO: 700 - DNA, 795 bp, Artificial
  Synthetic
cccccgagcaagcaaaggaaagaacttcccttgcaccaccacctgatcagagaagtagctagctgcaggagagaaaccgaccaacaatggcggagtactactccagcaccgtggacgagtgctacgagaccaccggcaggcagcacggccacgggcacggccacggtcacgggcacgggcacgggcatggtggcatgagggtggagtcccacaccgacgactactacagcgagggcggcgagatcgaccgtgggaggaggaacaactccatgcactcgcaggagtacctgatgaggcagcagagcggccatggcggctacggctacggcggcggccagcagcaggagtactacaagcgggaggagcgcgagcacaagcagcgcgagcgcgtcggcgagatcggcgccctcgccagcggcgccttcgctctctatgaggggcaccaggcgaagaaggacccggcgaacgcgcagaggcacaggatcgagcagggcgtggcggcggtggcggcggtgggcgccggcggctacgcctaccacgagcaccgcgagcagaagcaggccagctacggcgccaaggagcagcagtacggctacgccaggatgccgcagcagcagggctactactgcaactgattaattattaatcaccccccaaattattaataatccatgcgtacgtacgtaccactaaataaatactggctactacgtacgtatatatacggtacaataagatgagcaaggatgtacgtacgtacacgtatatacgttgctcacccacaatttcgccgcc

SEQ ID NO: 701 - DNA, 605 bp, Artificial
  Synthetic
ccccccccggaggcccaaactaatgttattagcaagtagctgatgctagccgctccttgctataaatacatgtgctttgctagttagcttttgcacagatcaacaccggcaaccgactaactctgtctgaaggaagctaagattattaatcagtgagtagctagccatggctgaggagaagaagcaccaccacctgttccaccacaagaaggacggggaggaggagagctccggcgtggtggactacgacaaggagaagaagcaccacaagcacctcgagcagctcggcggcctcggcgccatcgccgccggcgcctacgctctccacgagaagcaccaggcgaagaaggacacggagaacgcgcacgggcacaaggtgaaggaggaggtggcggcggtggccgcgctgggcgccgcggggttcgccttccacgagcaccacgagaagaaggacgccaagaagcacgccgccgaccaatactagatcgatcccgatcgaatgaacgcaagaacgaacggtttatatgcttaattactttctccccataattacatgtatgcatgtggttgatggcttaatttgcttcttcttgttcgtcgtcata

SEQ ID NO: 702 - DNA, 618 bp, Artificial
  Synthetic
gataaacattaaacaagctgtgtgaacttcttttttcgtgacaagtttaattctttctcgatcgatcgtcgtgatggctgacgagtacggccgcggcggctacggcaggtccggcgccggcgccggcgacgactacgagagcggcggctacaacaggtccagctccggcggcgccgacgagtacggccgccggccgggaggcggtgccggtggctacaacaagcccggtggcaccgacgactacgacagcggctacaacaagtccgccggcggcgacgacgacgactacggccgcaccggcggcggcgggtacaacaagtccggcaccgacgacgactacgacagcggctacaacaacaggtcaggggctaacgagaagtacggccgcaacaagtccggcgacgacgagtacagcggcggcggcggcgccgaagccgacgaggagtacgtcgacgggttgtcgtcccgggacgacccggagaagtacaggaaggaggagaaggagcacaagaacaaggagcgcctcggcgaggtgggcgccctcgccgccggcgccttcgccatgtacgagaggcaccaggcgaagaaggacccggagaacgcgcagcggcacaggat

SEQ ID NO: 703 - DNA, 844 bp, Artificial
  Synthetic
cccacgcgtccgcttattgtcacttccatctcattctcctaattgtcatcactagcttctagctagcttaattaattaattagccatggcggaggagaagcaccaccaccacctgttccaccacaagaaggacgacgagccggccaccggagtagactcctacggcgagggcgtctacacgtcggagacggtgaccaccgaggtggtcgccggcggccaggacgagtacgagaggtacaagaaggaggagaagcagcacaagcacaagcagcacctcggcgaggccggcgccctcgccgccggcgccttcgccctgtatgagaagcacgaggcgaagaaggacccggagaacgcgcacaggcacaagatcacggaggagatcgcggccacggcggcggtcggcgccggcggctacgccttccacgagcaccacgagaagaagaaggaccacaagagcgccgaggagtccaccggcgagaagaagcaccacctcttcggctgatcgacctcatcacaacgtcgccggcggcggcgacgacctcgccgtacgtcgccggccgccgtgtcgtcgatttgtgtgtgtaataatttgtcttcttctgcatgcgtggtgttgctgtttttcacaagagtctccggcctcgaccagtgagaggctgacaggtggggccgtgagttcagcttgtgttgcttgattttctctgcagccttgccctctgtgtgtccaaataagtggtgtgcatggctctctccgtgtcatgtatcaatgtatttttatctgtactttgtacaagtgaagcaatatttatcgaaccttgactttctccattctatgggaaaaacc

SEQ ID NO: 704 - DNA, 636 bp, Artificial
  Synthetic
caccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttcgtatgttaaaaataaagtcatacatcatcatgtgtgactgttgaaacttagggtcatataaatctaaataaaatcatcttacctaaaaaaaaa

SEQ ID NO: 705 - DNA, 626 bp, Artificial
  Synthetic
caaacattatagttgaagcatagtagtagaatcctacaaaaatgaagatcattttcgtatttgctctccttgctattgttgcatgcaacgcttctgcacggtttgatgctcttagtcaaagttatagacaatatcaactacaatcgcatctcctgctacagcaacaagtgctcagcccatgcagtgagttcgtaaggcaacagcatagcatagtggcaacccccttctggcaaccagctacgtttcaattgataaacaaccaagtcatgcagcaacagtgttgccaacagctcaggctggtagcgcaacaatctcactaccaggccattagtagcgttcaggcgattgtgcagcaactacagctgcagcaggtcggtgttgtctactttgatcagactcaagctcaagctcaagctttgctggccttaaacttgccatccatatgtggtatctatcctaactactacattgctccgaggagcattcccaccgttggtggtgtctggtactgaattgtaatagtataatggttcaaatgttaaaaataaagtcatgcatcatcatgcgtgacagttgaaacttgatgtcatataaatctaaataaaatcacctatttaaatagcaaa

SEQ ID NO: 706 - DNA, 589 bp, Artificial
  Synthetic
cccacgcgtccgccttactgaaaaatcacaaacatcaaaacgttataagagttctctagcatccatcacatagccatgaagatctttgtcatcctctctctcctcgccctcgcagcgagcagcgcctcggcacagtttgatgcttgcacctatgggcaatgccagcagcagccgtttatgcaaccgatcatgaacccgtgcaatgagttcgtgaggcaacagtgcagcccgatgagcctaccttgggagcagtcacgcaggctacaactgagcagctgccaggtgatgcggcagcaatgctgtcagcagatgaggttgatggcgcaacaatatcattgccaggctatttgcaccatggtgcagtctatcatgcagcaagtgcagtttgatgctggctttgttggcgagccccaagctcaggcccaggcccaggtggctctcaatttgccctccatgtgtggagtctaccctaggtactgcagcactccatgcaaagttgctactggtcattgcggttcttggtagtgtgtaccatcatatatatatagttggataaataaagtgtcacacatcatcgtgtgtgtcatgt

SEQ ID NO: 707 - DNA, 650 bp, Artificial
  Synthetic
atcacaactcaaacattacagcgaaagcataacaactagaatcccaccacaatgaagatcattttcttctttgctctccttgctattgctgcatgtagcgcctctgcgcagtttgatgctgttactcaagtttacaggcaatatcagctgcagccgcatctcatgctgcagcaacagatgcttagcccatgcggtgagttcgtaaggcagcagtgcagcacagtggcaacccccttcttccaatcacccgtgtttcaactgagaaactgccaagtcatgcagcagcagtgctgccaacagctcaggatgatcgcgcaacagtctcactgccaggccattagcagtgttcaggcgattgtgcagcagctacagctacaacagtttgctggcgtctacttcgatcaggctcaagctcaagcccaagctatgttggccctaaacttgccgtcaatatgcggtatctacccaagctacaacactgctccctgtagcattcctaccgtcggtggtatctggtattgaattgtagcagtatagtagtacaggacacaaaaataaagtcatgcatcatcgtgtgtgacaagttgaaacatcggggtgatacaaatctgaataaaaatgtcatgcaagtttaaacataatgcctctgt

SEQ ID NO: 708 - DNA, 631 bp, Artificial
  Synthetic
ggacccacgcgtccgcaaaaaaagaaagatctagtgtcccgtagcaatgaagatcattttcgtctttgctcttcttgctattgctgcttgcagcgcctctgcgcagtttgatgttttaggtcaaagttataggcaatatcagctgcagtcgcctctcctgctacagcaacaggttcttagcccatataatgagttcgtaaggcaggagtatggcatagcggcaagccccttattgcaatcagctgcgtttcaactgagaaacaaccaagtctggcaacagctcaggctggtggcgcaacagtctcactatcaggatattaaaattgttcaggccatagcgcagcagctgcaactccagcagtttgatgatctctactttgatcggaatctggctcaagctcaagctcaagctctgttggctttgaacttgccatctagatatggtatctaccataggtactatagtgcacctagtagcattaccacccttggcagtgtattgtactgagttttaacaatatagtggttcggaagttgaaaataggctcagatatcatcatattcgacatgtggaactcaggttgatatatcctagtacatcatcgtaactaattaccatcgttggtactct

SEQ ID NO: 709 - DNA, 891 bp, Artificial
  Synthetic
agaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatgaagatcattttcgtctttgctctccttgctattgctgcatgcagcgcctctgcgcagtttgatgttttaggtcaaagttataggcaatatcagctgcagtcgcctgtcctgctacagcaacaggtgcttagcccatataatgagttcgtaaggcagcagtatggcatagcggcaagccccttcttgcaatcagctgcgtttcaattgagaaacaaccaagtctggcaacaactcgggctggtggtgcaacaatctcactatcaggacattaacattgttcaggccatagcacaacagctacaactccagcagtttggtgatctctactttgatcggaatctggctcaagctcaagctctgttggcttttaacgtgccatctagatatggtatctaccctaggtactatggtgcacccagtaccattaccacccttggcggtgtcttgtaatgagttttaacagtatagtggttcggaagttaaaaataagctcagatatcatcatatgtgacatgtgaaactttgggtgatataaatagaaataaagttgtctttcatatttaaaaaaaaaaaagaa

SEQ ID NO: 710 - DNA, 483 bp, Artificial
  Synthetic
agctggagaatcggaaccgcatggctctcaggtaacactcgggtggtccagtgcatcaactactaagatatcgaaaatgtggtggcccttgcatctagccatatctgagaggttcggcaggcccagtgcagcttagaagggaatgcagttacctacgtaaattacattcatccagtgttcggtattacttgcgatgcgggatgctgaatcggcatttccctgactaagggactctcgctggacagtacaatgaatgatcaagctacaaaggcatatatttttagacggccaaagtcttacattcagagacatgtagccgttgttcccctacataggtttcagctgtaagggcttttgttatgaagccggcatcccgagttctcctccttacatctcgtgctttttcatatagtggcatagtaatcaggtacttgcacaccatcttaattaacgatagtgatttctaaaaaaagaaacacaagg

SEQ ID NO: 711 - DNA, 484 bp, Artificial
  Synthetic
caagaaacaaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattaaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggacaccgctctgttcatttctgcaaaaa

SEQ ID NO: 712 - DNA, 570 bp, Artificial
  Synthetic
aaacaaccttcttcatcaattctactacaacgaccttcctacttaaacaatctctcgataccaactccccaagatgaagttcactctcgtccttgctacctttgccgccgtcgtctacggtcaaaccatcgatgacattcccgcatgtgctcgtacttgcattgagaacgccgttctagccgctggttgctcgtctggaactgacgtcgcatgcgcttgcgcacatttcactgctgttcagaatggctctactagctgtgtcattgctgcttgtggcgtttctgtcgccattagtatgtgctcccctctcattttggtcgaggatatttacgtctcaaatgcttatgtatatttatagaccaagttctgcctgccacccaggctctttgtgccaaccagtgaactcatccatcgagagggagaaaatgacatgggagaaaatcaggtactcttgtacattgacaaacaagtacatagctgaatggtgtgaatgaataaaacgcattgctgctggacaccgctctgttcatttctgtatttcaatgagtattcatgcgatatgtagcttga

SEQ ID NO: 713 - DNA, 79 bp, Artificial
  Synthetic
gcgcttgcgcacattgcattgctgttcagaatggctctactacctgtgtcattgctgcttgtggcgtatctgtcgccat

SEQ ID NO: 714 - DNA, 195 bp, Artificial
  Synthetic
aagagggactgtactgtacagtaactgtaccttatgcaattgtgcaggattatgtctctgctgtaatgtatctgcggacgtatctgcggatgccggggatggactccggtgtacttggcacggctcgcttccgtttgacataaaaatgcagtgtaacaggtagatggacgtacatgtagatgtaaatgcggtact

SEQ ID NO: 715 - DNA, 221 bp, Artificial
  Synthetic
accgagactcgggccacgatctgccaattggcggagctagacggagtatggcatagcgccaattgctcagagcagctgagcttgcgcaattggccctcatcacaaggattcagccctccctctggaggttcagcttcattgatattgcgaggtggtgtctactgtacatactatacaatattcagcacaggagctttcggtaccaaaacccttcaacaccg

SEQ ID NO: 716 - DNA, 388 bp, Artificial
  Synthetic
gtttcggaggctgattgagtcggaggggctgccttattgcggcagaggaatagtgacgtcatgactatcaaggaccctggaggttacctaaaagaaaagcatctggacgagtgttagagtgtgcgaatggatctcattgtttgaattgatgaatctcggaagatctgagctagctgcaagatgcctcaagccatgcgcaaggcacgtgtggatggaggcaagattggatggagatttactgtaaatcttccaactttaactatagaagggaaagggggaaagaggcgatcgctataccgctggttggattcagctccagggacagatttcatcaaaacaagcgatgaactgtgtggtgacatatatatacgagtacgggtttgatcat

SEQ ID NO: 717 - DNA, 313 bp, Artificial
  Synthetic
cgaccacgcgtcgtgatatctgatatatatcaaacagcccagcacaccattccaaaaacttcaagaccctcgagtctacatcaacaactcttacatcttaaacaaactgcttcaaaagcacatacacaaaccggtttcccccagtttcacccccaaataccttctgagtggcaatgtccccttctgctatcagcaactccccagagcagcgacctgcaaacaacggcaccacccccgacaacttcgctatccagcctcccgccgacttcaccggctatgaccacgtaacgtggtgggttggcaacgccaagca

SEQ ID NO: 718 - DNA, 711 bp, Artificial
  Synthetic
tctcatccacctcgtccatctcatccttttgcttccagcagctatcaagacttgacttaaaaaaaccagtcctcataaagacatctacaatcagtcaccatgcagatcaccaagagcctcatcgctaccctctttgccgcttcgaccgcctttgcggctcccactcctgcggacaagtccatgatggccgctgtccctgagtggacaatcaccaacctgaagagagtgtgcaactccggcaatacctcctgcacatggacctttggcgtcgatacacatctcgccactgccacctcatgcacatacaccgtcaaggctaccgccaacgcttctcaggccaccggcggccccgttacttgcggcccttacactatcacatccagctggagcggccagtttggccctaacaacggcttcactacctttgctgttaccgacttttcgaagaagctcatcacctggcctgcctataccgatgttcaagttcagggcggcaaggttgtttcgcccaaccagagctacgccccgaccaacctgccatagatggaatgaatttgcttggaattactatacgcaaggtcaatttactcccaaaggaacagctggtgataattggaaacgacaatgaatcaggcgaggggggatacgtaccacaaaatttaatgtaatagatgattgactatgataatacactattgattaatgcgtctc

SEQ ID NO: 719 - DNA, 540 bp, Artificial
  Synthetic
gaatccaaagtcgtacaaatctcaatgaattgaaagcttccggcctacagcttgccagggtcccgctggaaccactagaattatttaggttctgatggccactccaggggggggggcaccactccgatccactacgcagaagcaaaaatagccgcatgacgcaactcatgatgtgtggagtggcctgacttttttgagcagctgaatgcaaaagcaaaaacccttgtgatcaaaaaccgcataatgcaggtttgcgggcgagacacgcgcgtgcaacgcatcaagacatttgtcgtttgtgtcgaggtgagggcgaaaatggctcggatgaggtgcacacgtgcctcacagactgcgcgttaaagcgaatacgaaggagtccagcgacacttcatattgcctggttgggggccccttgcatatgcagagatgcgtgcgattcccactttgggcctatttctcgggatctatctcgtagtaatcgtatagtctatggagtcttattccagaaaaccaaatagtagtagtaatttcactgac

SEQ ID NO: 720 - DNA, 625 bp, Artificial
  Synthetic
cggacgcgtgggcaaacatcgacgaattcgaatcgcccacgatgtttgccgcccgacaggttacccgcaacgccccgcgctttgctgcgcagctgcgcactcccatgcagcgccgcttcgccagcaccgccgagaacgagttcatcgctgagcgccagcacatcaaggaacacgccaagggcaccactgagctttggaagaagatttccatctacgccgttgttcctgcgctggctatcgccggtgccaatgcctactggctgtggactgagcactgggagcactggagccatcttcctcctctgcccgagcgcaccgagtacccctaccagaacatccgcaccaagaactaccagtggggtgatggtgacaagactatcttctggaacgacaacgtcaactaccacaacaaggacaagaccaaataagctggaacaatggctcccggaggaaaactgctggtatttgtagattaccctttttgggacccctctgtatatttcccttggagcttcaatcgattacactgtggctgaggagagacttccatgctgtgtgtgacatggcgactgagcttgaaccgttttttcaatgtacattattcccctgtgtccctaccttagta

SEQ ID NO: 721 - DNA, 565 bp, Artificial
  Synthetic
gacacgctctgaaaggctgcgctctaaagtggccacattgattctcggttttttattatcatttttttacatggatctatggcttctcgcatggcctctcctctccgcggcacagtatcgttgcaatcgcagcccttgtacacccacccccttccacccgaatgcttccctccccctgccaaaagtcgggactcgtccgcagaacatgccgagcaaagtgctctgctctactgtacgagcatcttcgtccttgctctctatttgtcttgctcgagtttgtccccccagtgcaaaaaaaaaactttactttttcttcattttatccggtcagctgatttccttttaacatactgtaccttgtgcatcggccctcactcgctccgggcaaggggtgcactacgcaccgccatcacctcgattcggtgagatttctgaatatgacaggctgcctgataaatactactcgtatccctacccaaaatgccggaattctctgtttaatatccatatgcatatacagtatgcagtagcccgtaaatgggccaatgaaaggatacatcatgtc

SEQ ID NO: 722 - DNA, 295 bp, Artificial; identical to SEQ ID NO: 76
  Synthetic

SEQ ID NO: 723 - DNA, 602 bp, Artificial
  Synthetic
  misc_feature (246)..(247): The residues at these positions can be any nucleotide.
aaaaggtagggcacacgacaaacttggccccgtcagcaaccagcgcacggcatgcctcagggaaggccaagtcccagcagatgatgagtccgacacgaccccagggagtatcaaacgccctgtgcggcgtcaatccatcggctgtcagatgatctctctcggggtgccacaagttcttcttctggtagcgtcccagaacggcgccgtccggaccgataaagtacgccgcattcgcaattccttcanngtcatggaggcatttgccctttccctcccggcaaggggaatgggggggggctctaggatcgtgcccggagcaatggcgatgccgagctccttggcaatggcctgatattttgcaagatacggcgtctgctccttggccgttgcgaggaggatcttggagtcgggcttccatgagccgagatggtactcaggaaggacgaccaggttcgcgccctgggaggcggccttgcggatgtatgactctgcgcgagcaaagttgccagctacatcgagcggctagagttggtgaacaattaggagacaagatcagccttcataattgcttcagctgcagcaggggttgttggtggcacacg

SEQ ID NO: 724 - DNA, 633 bp, Artificial
  Synthetic
aatcatcttacaaaagcttcccaaaatggccccggtattaaagattgcacttattcagtttcaggccaagcctctttgtgtgcaagaaaactttgacaaagcggtttcagaaatccgatccgctgcctctcaaggaagccatttagttgtattgccagaatatcacctcacatcatgggttccagaggacccttcctttgctacagcctgtgcagcttccacgcaatatctttcacagtatcaaaagctagctagggagttaaatgttcacatcgttccaggtaccattgttgaacctgttactatccaaccatcaaatgtcgttgctacttctcatgcagagcaagacgtacttgcaggtgatctcatagtggagctacacaacaagacatacttcatcgctgcaacttctggagatatcctaggaacataccaaaagaaaaacttgtggcacgtcgagcgcggcgttttgaccgctgataggcgaacgccgcacaaggcgtttgatgttccactccccggtggccatatcgtgcgagtcggtctgcttatatgctgggatctcgcctttccggaagccttgagacaattagctgcggatggtgcaaagattgtcgttattcctgcctactg

SEQ ID NO: 725 - DNA, 967 bp, Artificial
  Synthetic
gtgccttgttgcagcatcccgtaacccctgcaggataccgccctaagccgcccaatttctcgtcactggctctagctttttgctgtttatcccgaaatgggcatcgaatggcttctgttccctccccccctatgatgtgtggcttgaccagtcgatgacgcaaacatggaagccggcttcctttctccttcttggtcggaatgcctgggaagggccaagatgacgagccacggcaataaatagtacaagcttcgcagaaaccttcttgtccgctcttctcccttttgtgtctcacacagcttttcttcatctttactccgcgatcttcttgatcttcaccaaaacaacatcattgcgcccttgaagccctcttagcaaatattcgatatacccaaaaggcattgagcccttgagccttacgagaaacacatatatccaacatgcctttcaccgctagcgatatctgcaagattattcttgccatcattctgccacccgtcggtgtcttcctcgagcgaggctgcggtgcagacctcttgatcaacatcctcctcacaatcctgggttacttccctggtatcatccacgctctgtacatcatattgaaatactaagcccgccttccgctcccgtatcccgccggattcaaagcgtcatgtcgtcgcaccgcatcatgttgtgcagacaccaattactcccacgtttgaccggcaattgtcgttttagaatggatgcgtcagtggaggagtgaaggttacggtcgccggctcaccacgtggccggtcatagacgccataatgacagtgggctttcctttatggcttttcttttgttttttcttttcctctcttgttggctggaggcagatgcaccctatttgaaagggggcgtcaggtttggctattgttaatgaattgatacccgacttcctcaaatcacaaatacctacctttattcagtctctaaa

SEQ ID NO: 726 - DNA, 667 bp, Artificial
  Synthetic
aacgggcctccatcgactccagaccatccacgacctacacggaagtggcaagagatcgaaatcgtctgcagcttacccctgcaacggccttaacaagctcccgactcggcgggaagctatagcgatccaagccgctcttgtctcgtatataaccaagagctagacttcgcattagatagttcttcgtccttgtgtctgaggacaactcccttcttcattacatacaattgattcaacctgaccacaatggctgacgttcagtccattcgggcattcggcaaagcccgctccaccatcgagggcaagcccctgtctgacgaagaaatcaagcaatacaatgattatttcaaagccagctgctacctttctctgggtatgatctacctgcgagagaaccctctccttcgcgagcccctcaagaaggagcacttgaaatctcgtcttcttggacactttggttcagctcccggacaaatcttcacatatatgcacttcaaccgtctcatcaaaaagtacgatctggatgcctatttcgtgtccggccccggtcacggtgcccccgccgttctttcgcagtcttatctcgaaggtgtctattcggaagtctacccagacaagtcacaagatatccaaggcctccagaaattcttcaagtatttctcctttc

SEQ ID NO: 727 - DNA, 580 bp, Artificial
  Synthetic
atctcaatatatatccacaatgaatcgaaaacattccgagactggcatcaccgacgaggcggctattgaaggccatgacctcattcacaacgccgagattgaggagcagagggtatatttcaaccactaatgtcgtatcttgggttacacgattctaataatgttttaaaggctcatggcgaccaggcattgacgcagccagacgagggagatgcgccgctcaacgcaacgaagcagtccgagcccgccatggcgggacaaaccggacgccgccattcagcgatggacaagataaaggagacactgcatctcaagaaataaatgagagatgaaaaagatgaggtcggaaataattacaaaaaaatggtcaaactgatgatacctggcggatgggcagtctggatggtgggacgaaaacaaaagaaaaccacaaataaagaggaagggcacgtgtgtgtcacgtttcgtcaaagtgtattatatgaattccccacatccgccctcgaatttcgttgtctgattcggtcgccgcagtaggatatttatctttttctcaatacatgaattattattattttta

SEQ ID NO: 728 - DNA, 541 bp, Artificial
  Synthetic
gggtgacagctcaactgaacaatctcaatatatatccacaatgaatcgaaaacattccgagactggcatcaccgacgaggcggctattgaaggccatgacctcattcacaacgccgagattgaggagcagagggctcatggcgaccaggcattgacgcagccagacgagggagatgcgccgctcaacgcaacgaagcagtccgagcccgccatggcgggacaaaccggacgccgccattcagcgatggacaagataaaggagacactgcatctcaagaaataaatgagagatgaaaaagatgaggtcggaaataattacaaaaaaatggtcaaactgatgatacctggcggatgggcagtctggatggtgggacgaaaacaaaagaaaaccacaaataaagaggaagggcacgtgtgtgtcacgtttcgtcaaagtgtattatatgaattccccacatccgccctcgaatttcgttgtctgattcggtcgccgcagtaggatatttatctttttctcaatacatgaattattattatttct

SEQ ID NO: 729 - DNA, 561 bp, Artificial
  Synthetic
ggtttggcttgcagtaagaccggcttatgagaaagaccattgtgagagatgtaaggctgatccggagctctacgtcatctgagacatgacattggcatgatgagggtccagtaactacctgatgattggggtaatcgaaagagatgcagagagaaacacgcaactctgagaaagcgtcccgttacacacggaacacactgcctccggacagcggcttgtggctcattgcttgagtcccttaatcagcaatccccaggttctcttgacagctcagcggtgcagttttgcgggcacagctgatccacccgtcaacggggcgggacgccgggaagccgggactccggggctaaaatgacatcgccatgacatccgcaccgtccgaccagaactgctactactcaagacggtaagcaagtgctagcaaaagtgagttttacgaggtaagcaagtaggaacgtggcttataaagccacagctagcttgaggcgaaggctgctagtaggaactaaagtcagcttatactatttataagctcactgcatgggctagtaataatagctc

SEQ ID NO: 730 - DNA, 653 bp, Artificial
  Synthetic
catttctgtctcactcttcgccggcgacaatggtgaacgttcctaagacaaagaagacctactgtaagtcaaaggagtgtaagaaacacactttgcataaggtcacacaatacaagaagggcaaagatagcttagctgctcaaggaaagcgtcgttatgatcgcaagcagtctggatacgggggtcaaacaaagcccgtcttccacaaaaaggcaaaaacgacaaaaaagattgtgttgagattgcaatgccaggggtgcaaacatgtttcgcagcacccaatcaagaggtgcaagcattttgagattggtggggacaagaaaggaaagggaacctctcttttctagattgcctgtgaagcggaatgtaacagatctttcacccccttctgttctgttacactgttcagatactttggtaatatttgatgtagtgcaggagtttctgttattgaatcatgtgatcaattttgtgatgtcttagagaatctgataaggagagaaaatgaatattttaagtttttggtttagtatcttgttgcctaaatctattgcaagaaagttatgctgctctacctcacttggctgcatcaatttgtatgttgggattatattataggttgttttctccaaactagtgtatattgaaacact

SEQ ID NO: 731 - DNA, 638 bp, Artificial
  Synthetic
cccccccggccgccactcgccgcagcgtgtcggccagacaaggcagcgcctccgaaaccctagctccccgccttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggc

SEQ ID NO: 732 - DNA, 324 bp, Artificial
  Synthetic
cggcagtggaagtacgacggcacgagcttcaccgaagagcgaaaatggtgaacattccgaaaactaagaacacttactgcaagaacaaggagtgcaagaagcataccttgcacaaggtgacgcagtataagaaaggtaaagatagccttgctgcccaaggaaagcgtcgttatgatcgtaaacaatctggttatggaggtcagaccaagcccgtcttccacaagaaggctaagacaactaagaagattgtgctgaggcttcaatgccaaagctgcaagcatttctcgcaacgcccgattaagaggtgcaagcactttgagatcg

SEQ ID NO: 733 - DNA, 420 bp, Artificial
  Synthetic
gcatttcggcggcatcgtcttccggcacaatggtgaacgttcccaagacgaagaaatccttctgccaagggaagaactgccgcaagcacacactgcacaaggtcacgcagtacaagaagggcaaggacagcctctacgtccaaggtaagaggcgttacgaccgcaagcaatctggctatggaggtcaaaccaagcccgtgtttcacaagaaggctaagacgaccaagaagatcgtgctccggctccagtgccagacttgcaagcgcgtctctcagcacccactaaagcggtgcaagcactttgaaatcggtggtgacaagaagggcaagggaacgagcttgttctaagcaccgggtctttttttcctacttcgatgttctcaaattttcaagcaatatcataacttcgatactatactaa

SEQ ID NO: 734 - DNA, 669 bp, Artificial
  Synthetic
aaacactcaagtaacgacaccgcacaccgtcgtcaaaatggtcaacattcccaagacccgtaacacctactgcaagggcaaggagtgccgcaagcacacccagcacaaggtcactcagtacaaggccggcaaggcttccctgttcgcccagggtaagagacgttatgaccggaagcagagcggttatggtggtcagaccaagcccgtcttccacaagaaggccaagaccaccaagaaggtcgtcctgcggttggagtgcgtcaagtgcaagaccaagttgcagctggccctgaagcgatgcaagcacttcgagctgggtggtgacaagaagacaaagggtgctgctctggtgttctaaatgcgttgttctccggtattatcaattcttatgcttctcctggcggcatacgggcatcatggaacttggcgaagggggtactggtccttgtttagaggacagcggctcataggaaacgaataaaaagatttcttcatggaccgcattcacgcgttttttactgggatatgctttacagtgttatggtggaaaagccaacctgggacaatattccaattcacgatggcctggtgtctctgtgctaggcaactttagttcatggaggaggctcagactagctaacatgaaaagaagccgaatttcaccctttt

SEQ ID NO: 735 - DNA, 390 bp, Artificial
  Synthetic
cgacccacgcgtccgggcaatgctccataaggaacgatatgtttgtaagattggagaaaagggggcaaatttacttgcctctagccgctgagggagggctcgatgattggaggtccatgggcaatctatctggagcaggcagagcgtggggtcaattgcaagtcgtcaatggcactaggggtttggtttggggactgctgaaggcgggaggcgtttgtgtacaagactccccgatgagtcgaatgccaatggacggatatatggatggatggatatcatgtaaggggaacgaagccaaaagggcagcgtgctcatcatttgtcattactcacagcaatgaacgaatgctctgcagcagtgctagcatcaatccttacaaggcaagtaacc

SEQ ID NO: 736 - DNA, 301 bp, Artificial
  Synthetic
aaacgaagtactgtaatcgtacgtactcaattgacgggctttcgacccctgttttgcatctgcggtcgaataaacaccgactgcatctccatcagattgcgcttggcggccgggtctactgttgcagttgatgccgcccaactctggcaaaacctggcgctgcggctgcggctggagaccgggggagcgattctggctgcccaaacgagaaccgggggggatgtcaatgcacagttgcatcgaaatttggcgattaatttttttacgagggaggattacgattaggactttgcacggtagg

SEQ ID NO: 737 - DNA, 395 bp, Artificial
  Synthetic
tctaggtaaccaccagcacacgcaaacgatacgaaaaaccgagaacaagtataccttcagctccgcggacaacaatcatcaccgcggacaacaatcgtcactgcacgtctgcctagttgagagttccaagtgtaaaaacatcagcagttgccttgctgcgtggttcccaagtccagatagtcaacagatcaaacacaagacaaacctgcctgttcgattactttgcctccttgtagtacaattcgcaatagttcaccaaatcaccagtcatcatgcctgtcactgagtttgccattatcaagctgaggcccaatttcgaccccctcgagtttctcgagacactcatggagtgtcaagagattcaggacaattggattcgccgcaatcagccatgc

SEQ ID NO: 738 - DNA, 404 bp, Artificial
  Synthetic
tcgacccacgcgtccgggagaaagcaagagaaaaaaagctggagaggcggcgccccaagaagagcttgcagggacgttcaagggtcgaggctcgccacatgggctggtccgggctgctgattcgtccactcgccggcgacaccatggggagcacgcgacacttttctcgatgatgcttggtcaattggaagaggcacgtattcggccttcttttttgctcgagttactttctggttcgcccagctggggggaggagagagagagggagggggtttgtcttgtcttcatgtgttcattctccttgtgccggactcatcaggacaaggaggtacttgtgctgtacatagtgaaatatagctgagagcaccgtcctttctctcagacgcctctcatctcgtcctctc

SEQ ID NO: 739 - DNA, 907 bp, Artificial
  Synthetic
tcaccactctccatcctctactctactctactctactgcttagcagtcaagcaaacaaacaacaacaacatccatccatccttcggcatcactgacggaaaatcctcgttgcatccacaccaccccacggtaacgcccgaagcacacacacactatacacaatagcaatcaacagaagccgagcaaactccaccaaccggtcttatcaatatataaaccatctcaaccccagatttctggaacaatactccatcacacccatctacctctctcacacacaaacacattcacaatgttcggttcatacagctcatacagctctgtgagcaccatgtctaccgccatcgatatcagcccctccaaccttcgaactcgcgatgcctcgtgcgcctttccctcctggcccaggcgagagtctctctccgagttcgaccgcgaggagcgagccacttctttcctctccgacgacgaccttctcctgtcggaccccttcgacagtgacagccacagcattgccagctccagcgcctcgtcctctcccatcatgatgatgcagtcccctcctcgcttgactgacgccgaggtcctggagatgcagcgagagaagcttgctctgcagcgcgagtgcatgcgccagatcatgcttgagaaggagcgccgcaagcaggcctcaaagaagaagagccgctctgcttccagcgccaagaagagccccaagtccaagcttgtctccatgactcccatttccgagtaaaaaacatctacaacttactctgcgggtcatgcgctggcgcaaacaaagggctctttctttctcactactacttccggctttctacgaaaagcctctaatagacttcaacacacctttgaatggtgtacacgacgattacgactttcttctttc

SEQ ID NO: 740 - DNA, 236 bp, Artificial
  Synthetic
catgtggccacgggaatgacgcaaaaggcgccgagagcggaaatggagagaaaaaaaacccaattgcacctcgctgatgatgccactcaaatgtctgtggtcgagccactgtgcttctacctacgacttacattacctaacaaggcaacgaaacattttgcggcaaggagaattggatcattgacttggcgaatgggctaatgaatgtcgtcaattgcaggcctcgtggtttggcg

SEQ ID NO: 741 - DNA, 787 bp, Artificial
  Synthetic
ggtacgttattgtttttttgttggccttttcactttggtttgtttttaatttcttcgtttttgttttctgttgcagaggagaagcgtgaagataggagagaatagagatagagaggcaattgcacggaatgtttagccaacaagttgctcgtggcgggcgccgcatcggccagatggctcgaggcggccaatatccgtcactcgctgcgctcagaggagctgctcaacgacgatgttatgctgaggctgcacaggcagcccccaagggacgtatcggtcgaggcctcgggctgctcctgtatggcgttgcatttagcggcctcggagcagcagcaacattctattcgatggtacaaaagggtttcgcctcgttcaccgacgccgagtcagccaaactgtttgtcccagatagcgacgagctgcaacaaatcgaagagacaatcaacaaacacccgctcgtccaagagcttcgatcacgaccagagttcaaggagtcacgaccacacctaaagatgtcaagcgaagtccgcagccgcaccctcaccggcggcgctctacaaggcgacggcatgatcatggtcccccccgtcgccttcatcgaggacggcggcaagtccatcgtcagcgtcacgtacattggcgacaaactatgcggccacccaggcctcgtgcacgggggcctgctggcgacgatgctggacgaggggctggcgaggggctgcttcgacgcgctgccgcacaagattgccgtgacggcgagcctggagatcaactaccgcaagccgac

SEQ ID NO: 742 - DNA, 628 bp, Artificial
  Synthetic
atcattgtgtctactcccagtcatcgtcgacaacttctttgatacaagattgcaagactctatccaagtatggctaccccaggtaccgaccccatcgagggacaatacaacaaagaatccgcggccgacgtgcccaccaacgggcactatgtttccaatggcatgggctctggacagcaattccagccccagcagtatcagcagtatccgggctatggacaatttgttccgtttagcaacacccaagatcctcgggctgggcctcaccaggccatgatctcccaggtctaccaacctacccttggtaagattggtaacccaggtcctcttggtctgatcggtttcgctttgacgaccttcgtgctcggactttaccagtgcggtgctggtctccctaattccaacccattgggcaacgtcggccctgatcaagctgtcttcggtgtggctgtcttcttcggaggcatggctcagtttgttgctggtgtcatggaatttgtccttggcaataccttcggttgtactctccactgttcatacggggctttctggcttgcctttgccatgttctcagtccctacactgggcatccaggccgcttataacggagatcaacgtgcctttagct

SEQ ID NO: 743 - DNA, 583 bp, Artificial
  Synthetic
attggtggcaccatcattgcatcgctgctctgcattctcgctgccgtcggtctcatcaacggcctccttacctggtggggtcactacatcaacatcaatcaccctaccctgactctccagaccattctgtcctacgtcttctacccggttgctttcttgcttggtgttcctcgagacggcgatctcctcaaggttgccaagctcattgctgagaaggtcatcaccaacgagtacaatgccttcaacgccatggccaccgacccatactacgccgacatgtctcctcgctcccagctcatcgccacctacgctctctgcggcttcggcaacattggctccctgggtatccagattggtattctgagccagctggccccgtcccgtggtggtgacgtctcccgacttgccctttctgccctcatctctggtgttttctcgaccttgacctcagcctccgtcgctggtcttgtcgttaccacccagctctcccactttacccgacctccggcgtctggttaagtggagttttgtgcgtgttttttcatgtgaaagatttgtgccatgtaaggaggttatgtgtgtg

SEQ ID NO: 744 - DNA, 677 bp, Artificial
  Synthetic
agcagattggaactctcgggagcgccttatacatcttctacattgacaatctaaacattacacttactcaaaatgcccattgatgagtattctcacttcttttctaatggagacgtcaagatccattaccacctttacggacaaggcccagccttggtgttcgtccacggccatccagacaacgaaatgaccttttccaagcaaatcgacgagttctccaaagaccacactgtaattcttcctacgctgcgaggatatcccccaagcgatgtgccgctggacccagacgcctacgatggcaatgttatggccggtgacttggtggctcttctagatcacttgaagattgaaaaggcagtttttgcaggaggggacgttggtggcattactgtacaaaagctggctttcctacaccctgagaggctattgggtttggtcatcttcaacacaccaattctcggcaccatgatgcatctcatccaccacgacaaggaacaacaggagttgtccaagtattcaatcaagtacatcaaacacaatccaggagacgagtacgacctggaccatgtcgttcgcaccatcacggatcccgagtaccgcgccgagattaaagagtatctcaagaactccccagagggtggcatgttttactttttccgcaagaactttcccgcgcc

SEQ ID NO: 745 - DNA, 406 bp, Artificial
  Synthetic
actcacacacacaactcaaccacactttcaactctcaactacaccacaacttacaatctcatctcgcgaccaaccaactttcacaatggagactgtcaagcaagccgtcaactacgtcgctgagtccgtccagggcgctgcctctggtatcagcaaggagaccaacaaggagattgccaaggacagcaacgtcgacgtttccactcgtttgtccgctggcaaggacgcccttggtgacaagatcgacgagactggccacaacaacaaggccgaggctcacaagcagctggctgagcacaactagattggcataaggagcttcgattgcttcacaggcgttgaaccggatcagagcgaagggaatatatagcctcactaggcaggaattgatgatttgaattcgcac

SEQ ID NO: 746 - DNA, 391 bp, Artificial
  Synthetic
aacaatctcagatcttcatctcaactttcaatcttccacacaagcaaataaccaaccaaccaaccaatcacaatggattccatcaagcagggcgccaactacgtcggtgagaaggttcagcaggccacctctggtgcctccaaggagaccaacaagcaggtcgccaaggactccgatgcctctgtcggcactcgtgcctccgctgccaaggacgctctcggtgacaagatggacgagtccaagcacgacgccaagggcgaggcccacaagcaggccatctaaatggactgagtgagagggaacgatgacaacacttttgcttctaccccgtcttgagagacaaatagtcgatacccctatgagaactcaataatacaactttttcagcctg

SEQ ID NO: 747 - DNA, 645 bp, Artificial
  Synthetic
cgccgatctccatctggcgagcagagcaggggaggggaagggaaggtatcctgaaagatgcttaatcttatcaaaataaaggataaaaagaaagagcaggcagcaagtgctgctggaaaggctcctgtgaagaagcaatctgctggagagctccgtcttcacaaagatattagtgagctaaacctacccaagagcacatcaatttcttttcccaatggcaaggatgatctgatgaattttgagatcatcgtccgacctgatgaaggatattacctaggtggcactttcgtctttacttttcaagtctctccctcttatcctcatgaacctccaaaggtgaagtgcaagaccaaggtataccatccaaatattgatttggaaggaaatgtatgcctgaacattttgcgtgaagattggaagcctgttctcaacatcaacactgttatttatggccttaaccttctttttacgcaaccaaacgatgaggatccgttgaaccatgaagcagcagctgtcctccgtgacaacccaaagctgtttgaagctaatgttaaaagggcaatggccggaggctatgtgggtcaacactatttcccaagatgtgcatgatatggtgctgggtgccacaaacattagtaagttaag

SEQ ID NO: 748 - DNA, 614 bp, Artificial
  Synthetic
ggcaacgagcaccgaatctccccgcggataaggcttctttttttccgtctacaaaacgtcacctgtgcaacaactgaaagctctctggcttctccgattcggcggtccaggcctctctttccacctcttccaacgtttctttcaaccctctccctttgatcaggcatttcaggataccgcttctcgtcctcaccggcgatctccgacgagccaagatgttgaacatatggtctatgaaaaaaaagcaaaaggaggctgaaaatgccgaaggtcaggctgctggagggaagaggaagaaggtgacggcggcacagctacgagtacaaaaagatttgtcagaactatctctcggcgcaacgatgaagactgacttccctgaccccgacaatatcctcaactttatcctgtcgatcgagccggacgagggcatgtaccgaggcggaaaattcacattcgactttgccatcaaccagaacttcccgcacgagcctcctaaggtgctgtgcagggagaagatatatcatcccaacattgatctcgagggcaaggtctgccttaacattctgcgggaggactggaagccggtgttgaacttgaatgctgtcattgtgggg

SEQ ID NO: 749 - DNA, 555 bp, Artificial
  Synthetic
cggtctcctcagctgcttgcgccaagacgagtcgcggctcaacagggggaggggcggcgatctccatccatccggcgagcagagcaggggaggggaggggatcctggaaaatgctaaaccttattaagataaagggtcaaaagaaggaagatgcagccaatgcaaatggaaagcctcctgccaaaaagcaaagtccaggggagttgcgtcttcacaaagatattgctgaacttaaccttcctaagtcgactagaatttcttttcctaatggcaaggatgatttgatgaactttgaagttactattcgacctgatgagggatactatgtaggtggtaaatttatttttactttccaagttcctcctgcctatcctcatgaaccacccaaagtcaagtgcaagactaaggtctatcatcccaatattgacttggagggaaatgtctgccttaacattctgcgtgaagattggaagcctgtcctgaatgtcaacacgattgtatatggcttgaatcttcttttctcacaacctaatgatgaggaccctctaaatcatg

SEQ ID NO: 750 - DNA, 618 bp, Artificial
  Synthetic
gataagagagaagaaaagaacccatttgctggctcttacgctaacctgagatcacacaaatcctcttttttcttcagcttttttgtgccttctcacttaagcagggaccatgattaagttgtttaaagtaaaagaaaagcagagagagcaagctgagaatgcaaatggaaagccaccagtcaagaaacaaagtgcaggagagttgcgtcttcacaaagatataagtgagctaaatctacccaaaacatgtagcatatcatttcccaatggaaaagatgacctcatgaactttgaagtcactattcggcctgatgaaggatattatatgggtggcacatttacgttctctttcagtatttccccaatgtatcctcatgaagccccaaaggtgaagtgcaagacaaaggtttaccaccctaatattgacttagaaggaaatgtgtgtctcaacattcttcgagaagactggaaacctgtgctcaacattaacaccattatctatggtctatatcatctgttcacggagccgaatcacgaggatcccctcaatcatgacgcagctgctgtattaagagacaacccaaagttgttcgagtccaacgttagaagggcaatgca

SEQ ID NO: 751 - DNA, 660 bp, Artificial
  Synthetic
acaacaaacaacgaaacaaccgcccaatcgccaatcgccgcctcgacatggtgctcggcgactacgaggaagcacaataggcgggacgcgaagcaaacaagcgctgggcgtctgagaagtagcccgagagtcacagctacagctacagctacagtgaacacgcgatagagtgattcaggacatccagagacgagacgaggcgcctgaacgagatacgaagcaaacagacacgggaaagcagatgcaatgtcggcaaacgtaacaaagccggcgcccaatcggccgcagcggcgcgtaacggccggccagatcctgtcgatgccgccgaaatggctcggcatgtacgacgaattcatcaccaagaacgccggccaggtgtcgcagattgagagcgcgctgaggagcttgacgtatatcattccaggccgctttcgcgatgctgaaatcgcctccgagtcgattcactcgggcgtccagctgctgtcgctctaccacgacggcatcctctcgcaggcagtgtccaagctgcccacgccgcctgtccggtcggctcatgcgcgctacacgcgatactggacgcagaagagcaaaacgtaccgcaggatagccatggtgctgcagatggtcgtctacacggagctgctgtgcgaaatgagcgcc

SEQ ID NO: 752 - DNA, 890 bp, Artificial
  Synthetic
gattaatcaccagtggattcctcctcagtggattgccctctccatatggttaatggagatatttacggtcttcctcccatgctgggaagtcttgtgccatcaaagcctctgccaagagacactaaacacaattgaacagtgggagaacaacaagacaggcctcggcaaggccatcagatcattcaagtccaaatcgacaatcatcgactccatcaagaccggatggaggtcgaccaacagctcgatccaaacatcttccgtcgagtcgattctgacgctgagtgctctcgaatacgtcctggagaggaatcccgagcctctacaacaattctcagccctgcgggatttttccggcgagaacattgcgtttttaacaagcgtaggagagtggaagtcatcgtttcccgcttcggtccgcagccgcagcggcattatgtctgacgatacgaagcgggagctggtgcgagagcgattcaaccgcgcgcttcggatctatactgagtacatcagcgctagcgatgcggcatttcccatcaatatctcatcagtacagctgaagaaactcgaatccatctttgaggaacccgcgcgttccatgtacggcgagaagcaagccatcaatcctgcaactcccttcaactaccccgaatggaacaagcccgcctccgtcgcttcgtgctgcgagactcccaagtcggtctctgagaaagacagtgtttcaggcgactgggttcagtattggggtgatattccggaagacttcgaccacggcgtttttgatgacgccgagaagagcataaagtacctcgttttaacaaacacctggcccaagtttgttcgtgatcgccgagattccatggaatccttcgagaacgctgggagcaccgaaa

SEQ ID NO: 753 - DNA, 538 bp, Artificial
  Synthetic
cacgatactcccgcttggagcttcattttgcatttccatacttggtgtttgatcgtctgtttaattgtttatccattcgctcatcatgccgggaaacgtcaccactcaccacgatgactccacgcccgagtcgagcgacagtggccatcatgaacatgaacatcaccatgaagaacacgaagaacacgaacacaaaggccctcccggtggctttgacaagactccacttcctgatgcgccgcaaggatacactgttcgcttcgtttttcatggcgcgactaacatcccgattgcggattttcacaccggatcttcagatcctttcttggtagcaactctcaagggaacgcagccgaagcgtcacaaggaggatcccgacttaaagtacaggacacgaactctgcacacaaccacggagccgaaatgggaagaggaatgggttgtctccaatgtgccccctaccggcttcaccctcaagtgcagaatgtacgacgaggatgttgccgacaaggacgacagactcggcaatgtcaccatc

SEQ ID NO: 754 - DNA, 770 bp, Artificial
  Synthetic
cgtcgagctaaggtctccggtccgaaattttggttcgatggggattaaagtcattgttcaaagattcgagtttccgtcaaagtccggacatatttgtttttcgttcgagttcatcgttgttctgatccggtacacagctggtagaccttgtaagttgataacatgaagcatgaatacgaagttgaagcggcagcagttttcagtctcagttgcataattctgagcttcttctctccactctctgaaagatggcagcatatgcagcaatgaagccgaccaagccaggtctagaggagccacaggagcagattcacaagattaggatcactctttcctccaaaaatgttaagaatctcgagaaagtgtgtgctgatttggttcgtggtgccaaggataagaggctcagggtgaagggacccgtgaggatgcccacaaaggtccttaacattaccactagaaagtctccttgtggtgaaggtacaaatacatgggacagattcgagctgcgtgtccacaagcgagtcattgaccttttcagctctgcagatgttgtcaaacaaatcacctcaatcaccattgaacctggtgttgaggttgaggtcactattgctgattcttagatcctttgtcttacctaggtagatgagttactctttatatgctgtcgtattttgccctccagactttatgtattacgagttttttggaattacaattttgctgttaaactaagacttttgataaaagtaaagtgtatggtttgtttattt

SEQ ID NO: 755 - DNA, 602 bp, Artificial
  Synthetic
acgcgtcgggtgtcaacaagcttctgcgcaccttgtctccttcgatcaccctcaaggtaggagataaaacatggcgatggcaatgggtatgaagcccggaaagcctggcctcgaggagcctcaagaagccctccatcgcatccgtatcaccctttcttccaagagtgtcaaaaacctcgaaaaagtgtgtgcggatttggttcgaggtgccaaagaaaaaaagttgaaggtcaaggggcctgttagaatgcccacaaaggtgttgcgccacaccaccaggaagtccccttgtggagaaggtaccaacacgtgggattgttttgagctgaggatacacaagagaatcattgatttgcacagctcttcagaagttgtgaagcagatcacctcgattacaatcgagcctggagtcgaggtggaagtgacaattgcagatgtctgagtgtagtcaattatttcttttcgaccgggaaaaggttattgacttggttgaagagggatgactggtctttcaattttaggttatgtttctccttacgaatatttgttaggatttttgacatttaatcctgtgttaacggagaattgagctggatagtatt

SEQ ID NO: 756 - DNA, 550 bp, Artificial
  Synthetic
ctttcccggcctcatcactttgccgatacgaagatcgtcccctttcaatccaattataacgatccgttcgagtcgtgaagccgttcaaaatgtcttaccagaagaacgacaaggatgttcaggagccggctaaaagccacaagatccgcatcaccctttcttctcgcaaggtccaggtcctcgagaaggtctgctccgagatcatcgaccgtgccaagaacaaggacctccgcgccaagggccctgtccgtctgcctaccaagtgcctgaccgtcactccccgcaagaccccttgcggtgagggttccaagacctgggaccgcttcgagatgcgcattcacaagcgtctcatcgacctccacgcccccactgaggtcgtcaagcagatcattgtcaacatcgacgctggtgtcgaggttgaggtcaccatcgctgcttaagcgaatctccaatttcgtaaagatgttggagtggccgagaccctgacgtcgagggagatgaaaacagccctcgcagcagataagcacaaaataaactggttcaagacata

SEQ ID NO: 757 - DNA, 460 bp, Artificial
  Synthetic
actggcctagggtgcggccgccctttttgggttttttttttttggttcattaaggtctcttatagatgaaaaaaattcgatagacaaaaaccacctcagaactatcaaaacccaagaaacaaggttgcaaacaaaaatgtaggaccagaaacgataaaatacattcttttgaagcggttttggaacaagtgtctaagagtcagcaatagtgacctcgacctcaacaccgggctcaatggtgatagacgtgatttgcttaacaacgtcaggggagctgaagagatcgatgacacgcttgtgaaccctgagctcaaacctgtcccaagtattggtaccttcaccacaaggcgcctttctggtagtgatcttaagaaccttagtgggcattctcactggtcccttaactctaagtctcttatccttagctccacggaccaaatcagtgcacactttttccaag

SEQ ID NO: 758 - DNA, 587 bp, Artificial
  Synthetic
ttttacatcttcgtcgcatctccctcagcaaatcaaatcaaatcaaaatatggcgtatgcagcaatgaaggcaacaaaaccagggctagaggagccccaggagcagattcacaagattagaatcactctttcttccaaaaacgttaagaatcttgagaaagtgtgtgctgatctggttcgtggtgccaaggacaagaggctcagggtaaaaggacctgtgcgaatgcccactaaggttctcaacattaccactagaaagtctccctgtggagaaggcacaaatacatgggacaggtttgagctgcgggtgcacaaacgtgtgattgaccttttcagttccgcagatgttgtcaagcagatcacctcaatcaccattgaaccgggtgttgaggttgaggtcaccattgctgattcttagattcttctctgttttcattaggttgttgaatttttttcaagtactagtggtttgcagttgctttcttggccgtctaaattatgggcttaaggttttctttattccaattaaagttttgcagctaaaccagatactaatactatttgatattgggaagaggatttgtccg

SEQ ID NO: 759 - DNA, 967 bp, Artificial
  Synthetic
tcacaaaattaggtagaactgatgtgagagatgtagaagttttgagtgagatttatatctctatcaatgacaattacaaatcttacaaagactttaaggtgcttgatgctttggataaggctttagtggatagatatcgatccccttatagtgctatttctgctttggtttctttatgttatcatatctttgactttaataagtttaagttgctgtttaattgtgaagggaaatttgtggataagaagctgagaaaagacttcgagtggtgaactctaggtcctgatgtttaaatctactgtatttaccttcgcattaattaagcatggcggcggctgcggtgtacggcgccggcggcgcgatgaagggcgggaagctcggcatggaggaggcgcgggagctgcagctcaatcgcatccgcatcaccctctcctccaagaacgtcaagaacctcgagaaggtttgcgctgatctggtgaagggcgccaaggacaagcagctgcgcgtcaagggccccgtcaggatccccaccaaggtgctccacatcaccacccgcaagtcgccgtgcggtgaaggaacaaacacatgggatcgtttcgagttccgcatccacaagcgggtgatcgatctcatcagctccccagatgttgtgaagcagatcacctccatcaccatcgagcctggtgtcgaggtcgaggtgacgatcgctgatgtggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactacaagtacttactgtggtaagagatgtgagcgaaagcatgtatattctgaaacaagaaataagagattggaactttacaagaagtatctattggaa

SEQ ID NO: 760 - DNA, 414 bp, Artificial
  Synthetic
gccaaaatgtcattcaacaaggataaggccgacgctgaagctccccagcagctccgaaagatcagaatcactctgacttccaccaagatgaagtctcttgagaacgtctccgctgacatcatctctcgagctaagaactccaacgttggcgtcaagggccccgtccgactccccaccaaggttcttaacatcaccacccgaaagacccctaacggtgagggttccaagacctgggatcactttgagatgcgaatccacaagcgactcatcgatctccactcccctgctgaggttgtcaagaagatcacctctatcaacatcgagcctggtgtggatgttgaggtcaccattgccgcttaagcttgttgaccccaaaacttggtataaaaaattgcacatgtattattgatgtct

SEQ ID NO: 761 - DNA, 662 bp, Artificial
  Synthetic
gttcctcggacagcaagtttaaccatcctcccacaatcgcagtagagacggaaacagtggcggggattaccgccatgattattgcggcgacgttaatcattttcccagagcgttcgaactctccagaccttgaactgggacagacagagagatcgttctttcgaagggccattgctttaattgtgcgatgtttaggactgcaccatgctgatgtggccaaaaatgatccgtgcttcggtcatgcgatgctcatcagagctttgcatcaatgtggcttcgaaatgcgatgagctctcttctgttgcttcgtatccctttatatcatggctacgtacggctagaaaagaaccgtgttgggcagtcccgaccccaaacaggctgctggggctgagacctcgacacgaattacgccatgcttggatgttatgctcacgccgctcatgcaaacaaacaaataaacaaacaatccagtgaactcatctgatttttgcttcagttgcataccggtaaactgatctgatttttgctttcgctgcattatagtgtaaatgtactgtaaatattactactgtatgtgtaaagtattgggagtcaaaagctcaaacaaagctgttataagtacatagttaattacatttattcattcaaaaaaaaaacacaaa

SEQ ID NO: 762 - DNA, 539 bp, Artificial
  Synthetic
  misc_feature (92)..(92): The residue at this position can be any nucleotide.
tgaggcgacaaagcttgcccagcatgactgcccagcacatatcaggcggtcagccggatcagtacggcggtcatatcacggacgtaccctcncggctggagtaagaactgccgcaaccgccggcctatatgcacccagtagtggtcagggtcaggccgttggtaacggcagctcgagcgtgtcaaccagtattgggggcagccacacacccaacaccagcatctcttcggtggcagttggcgggccaaatgcaggtctctatgcgcaggctggtgtgccggaaaccgggaagccactgagccctggtggtgtccaaggccacgacggctctggtgtcgtacggcaacgatcgcctagcctgtctcagcagctacaacagcagcagatgggaaggcggcagtcggagatgcagtctcctcatggtggacaaaacaggcctaagttgcctggcttaactcaccctggatacgcctcgacaggctctccaggattctcccacggccggccgccaaccgcaaccgcctcgagcggcgatagtg

SEQ ID NO: 763 - DNA, 614 bp, Artificial
  Synthetic
caattcgacaagcaaggtagccagaaatggccccgaccaacgacaatgaacggcctaatgcgaacgaaaaagtgctgcacgtgtggtcgaagccgatagcagagggcgatcaggttcccggtctccaagggccggacaagaatccagatgggactccgagaggttcaaggtctgcctttgcagaggcagtctcaatgatcaagaaggatgattttacgaacgtggcaaacacgccctgcgcacggcaaggactgctgacgggaattggggcgggagctggcttgggcggcttgaaatttgtgattcaaggtaatgctgtcaaatctgccaactgggcggttggcttcttcctcttgggtagtatagcatcgtacgagtactgccagtatcaacggcgggccgagaagattcagatgaagaggcacatcgaagtggtcacgcagaacagaaaagagcacgcaaagaaactagccgaggagaggagggagcagttgaggatagaggaagagcaacgagctcgaaataaggcctggtataagttttggtgaaagccaaggcagatgagctgccatgtacaattatatgtatgaataaagactctattttggatgctt

SEQ ID NO: 764 - DNA, 422 bp, Artificial
  Synthetic
gcggcaggtgatggccgcggtgcagcaagtaccaggcaggttgcttaattgatcatccggtggcgggaggtaccttgcccgactaatcacaaaaaagagacgacacaaaaaagggtgcgtgcgagcgagcgactagccccgtgcgcgggtttagcacgagcatgtgctgagaagcgctcggagcaagcgagggaacgaggaatggaaagtttgggcaaaaagaaggtgagagaagccgctctgccagtttttatgtgtgtattctgttcgggacgttgagatgctgtaatgtggcttgtcagaagtcaacatgcaacaccactagtgccgctgaggccattgaatggtgggtgccaaacaatgtggtgtggcaagtgatgtgcgcaataaaaggcagaaaaagaaaacaaaattctccttag

SEQ ID NO: 765 - DNA, 520 bp, Artificial
  Synthetic
caaaatcgcagcacaacgtatcatcatgccgtcagcttctgaaaaggcgagagcaaagctcgatgcggtgttgaacgacccgggacgatttgactgtacccaacggtcgaatcgcatagcgacgacacgatatgctacaggctgtggcgtagtcaactctgttccgcgtcgccccagccagagtagcatagaaagcgattcaggcggcgtcaggaacagactgaaacgcctcatgtccttacccgcgtactaaagcgaaaaaaaaaagtgactggagaaatattcttgatatggataacaacctcgatggttgtgaacagtttcatatgtcctagtgtcccatcgagcaaaggttgcctgtctattggcacgctcgtactttatctcgtgcctccttggcaagattggaagatgtacacatctcttaacctgaatttctctccgaagagcattgaggatctgttgtagtccatctctgtagcagacatgttagatgcaatgaatttttatccgtgaaaac

SEQ ID NO: 766 - DNA, 662 bp, Artificial
  Synthetic
gacgaagcatgtcattcaacaacagccaagggtagttgctttagggggcccagcaaatcgacagggtcgactcgccgcagatgatatagccggcagaccagtgcactatcgcggcaacatcggcacaatcatctgtcaggtcttcgatttaaccgtcggtttagctggcctgtccgtctcggcgctgcgtgacttgggacaggagccgctctgggttacagtgcatcctccacaccatgcgaggtattatcctaacgctcgtccaatcacgatcaagaccgcgttcgaaaagggcacaggccgtattctgggggtgcaggcagtgggaatggctggcgtggacaaacgcatagacgtcctggcaacagcgatgcaagctaggatgacagtcaatgacctggaacatctcgaactgagctacgcaccaccctatagctcggccaaagatcctgtgaacatggtcggatttgttggctcgaacttgctccgcggggactatcagatcgtacacgccgaagacattaacatcaagaatcttcatgcctggcaaagtcgtggatgttcgcacacccgaggagtttgcgactggccacctcccgggggcaatcaacttgccaattgcaacactgcgcaatcagaaattggagcttgaccaatccatg

SEQ ID NO: 767 - DNA, 624 bp, Artificial
  Synthetic
aagatcaggacaagacaattcgagagtgccaaaaacagcaaaagggcagagagacgtcatcatggctcaggccaagttcgccgtttatcccagcctcgtcgaccgcaccgtcgtcatcacaggtggtgcgcagggtatcgccgccgacatggtcgagcagttttccctgcagggttctcaagtcatatttttcgacgtcgaggacgagcttgccgctgatttagtccgaaaagtgtctgatcagggcgtcaaacacaagcccatatactaccactgcgatgtcatcaagatcgacgaggagctcaaacccacagcggccaagatcctgaaagaccatcccaagatcgacggactcataaacagtgccgcgagggcaatggtgaagccctcgcaggatatcacgactgagtggtgggatgagagcgtcgccgtgaacctgcggcatcagttcttcctgacccaggccttgctgccggggcttctccttgctgctggaaacgcttcggtgattaacatggggagcatcaactggctcgtctctgcgacgggtcaggcgccttacacgacgagcaaggccgccgttgtgggactgacgaggacgctggcacatgagtttggaccgca

SEQ ID NO: 768 - DNA, 563 bp, Artificial
  Synthetic
tgagtgcagtgtaagacaacatggaagacatgtatgtcagcaatacggatgtttccatacagtcaaagcgttgcatcaaccccggcatgtcaggaagatgctctggatactaagcgggaaaatcttccggatgctgacctggctgcttccaattgccctgttgtcgattcttaatttgcgcaggcgatcaggccacatgccacatgcaagtccgagtgcaggtccaagccgagccgcagaggagacaatgggtccaaatgcaaatgcatacaggtagtactgcctacgtgcgctgctacagtaccgctggctgttcatttcgtcttcagggacaaagggggatggatgtacaccgatagatcggcctagtcgaatgttacttggtccattcgttccttctaagccatattaggcatccaagatgctcggtactcgcatggccatgtacggtctcacggctcaccgctaggccttttttgaatgtcgttacttcgttacgattattgggacagatggcgtagagctaccagtgctagtggtgtaatcgacaaagttcgctcctg

SEQ ID NO: 769 - DNA, 534 bp, Artificial
  Synthetic
acaagccaagcacatcacagacaaaatggcgcctgcagctggagcaaagaagcaaaagaagaagtggtccaagggcaaggtcaaggacaaggcccagcacgccgtcctgctcgacaagaccatctccgagaagctctacaaggatgtccagtcttaccgcctcgtcaccgtcgccgtcctggtcgaccgaatgaagatcaacggctccctcgcccgccagtgcatccgcgacctcgaggagaagggcatgatcaagccggtcatcactcatagcaagatgaagatctacacccgtgccatcggcgagtaaatttaccaccatgtttgaaagttaaagcattgagatttggcgcctggttggtctgaaaggaagaaaatgggaccatgagtgaagaggatgatacgaggtatataaagccttagttgggacgcttttcatgctcggtgtagcatttcatgggaaccggaaacgctttagcaaatggcaacggaatgaagaacttcaaaaaatgaccaaaacgacgcgaataccta

SEQ ID NO: 770 - DNA, 565 bp, Artificial
  Synthetic
gcaaaatcagacatcatggcgccagcagcgaccggaggcaagaagcaaaagaagaagtggtccaagggaaaggtcaaggacaaggccaaccacgccgtcgttctcgacaagaccaccaccgacaagctgtacaaggatgtccagtcgtaccgcctcatcacagtcgccgtcctcgtcgacagattaaagatcaatggttcgctcgcacgccaggccctcaaggacctcgaggagaagggtcagatcaagaaggtcgttgcccacagcaagatgcaggtctacacgagagccgttggtggcactgactaagcgccatctcatgttcgactaatgaagatatgcaaatctgccacacgacagtcgcgcggcggagcatatgcaaggctttgatgatgggaacgggtggcaatgcgctatcgcgagtgcacatgtggaaatcattcatgggtcacggagtctcgagcatgtcatatattcatgggcagccgtaaagaaatgtgcttcggagctgaaaccgggccgtttgtattgcgcaatagaaatgccattcgattgcttcttgttg

SEQ ID NO: 771 - DNA, 197 bp, Artificial
  Synthetic
tcttgcgtgttttctcctttttcttttccttgttacgattgaacctcccttcgcctgttgctcggaacatgcggattgccggctgagcagttcaagcgaccaagccagagccgagcctctgaatttcatgcatcaatctgacgtctttgaccgctgagcctctggatttccgcaaaccgcagcagcaatataacaat

SEQ ID NO: 772 - DNA, 218 bp, Artificial
  Synthetic
tgcccacgcgtccgcccacgcgtccgcccacgcgtcgccacgcgtcgcaatgtctttagtccggacccttacggggtgacttaccgcagcaggcgcgatcactgtatcgacagctactgaggcaaagcaacgaattcggctcttacaatttccggcgaatatgcgaagcgacggacccgagatgctttccgagaaaacgctgcggtagaagactcgcg

SEQ ID NO: 773 - DNA, 201 bp, Artificial
  Synthetic
tgggcctcctgcgcgatcagaggtctctatgaggagatgagctattgattgcactcagcgctagatgtttgatgaaccctcaggacacagcattggaagtattattgatcagagaaaggctctgggctattcactccagagttgcgagaactatgattcacgttgacatacgtgtcgggcctgcaagaccgctggaaaaaa

SEQ ID NO: 774 - DNA, 530 bp, Artificial
  Synthetic
gagaaaaagaaaatagagaagggggagaaaagaagagagcctcttagaggatgatgctgaatgacgctgtggatggtgaaatgtgagatgagcaaggtttgtgttacatgtatattaagaggattttttctttttgtggacggttttttatatgtgatattatggagaaactagcaaggatggagaaaagggggagaaaaggaacgataagtttatctctgtttgggcatgtatgggtgttaatatgattgacttgtcatatgtgaatgatgagtagatgatgtgatcaacacttggatgagagactcacaaccagatttacgagtcattcatctatacagacataaacgctgagaacgtcatcggaggtattgcttcacttcacatcttgatgctatatgtagctggccgcatttcgtttgctggaaagaggtgcacggattaagatgcaagtagcacatgtacggttgagaaactcaggaacacaaaagatgtacattaaactcccattctagagaacctatttacag

SEQ ID NO: 775 - DNA, 62 bp, Artificial
  Synthetic
gctcacatgaagtgaagggaaaagggcgacatggagcagattgagacgcaggcatcggacct

SEQ ID NO: 776 - DNA, 547 bp, Artificial
  Synthetic
cccacgcgtccgggcatacgttccagaagctgtttcgcaataggctcgtccggaccgacttgcgctgaggcgcaggtttcacacgctgcaatatgacatcaaccttgtctggtacatgacaaagtcctccgtatccgtataagctactgctattataaccgtagaagccgtagcgagactcgcgggactcccgacccccgcaaccccggggcggaacgggtggatgtcaggatcgggagtgggaggattcaaaggggggttccggcacacccggctaccgaagtctgggaggattccgtagtgccgagagtattcccacccaagtattgctgctccatcttgtaatttgtgcctgtaaatgatgagtttcatcattcgagtaaatggggtaagatgagatgaactgggcgtgtatttccgcctgggcattctaatggatactgcggtatttaaggtccccctgtatctattaataactcaggagtatttcctggatgtcgtgtctcttatggaaacagaatcattgcaactttgcactctcaataaa

SEQ ID NO: 777 - DNA, 292 bp, Artificial
  Synthetic
cggacgcgtgggtcgacccacgcgtccgggaacatgggggatattgatggagacatttttttgtttacttggactagttgccgggcgaagaggtgcgggactcttttttgctgcatggaaccaagcgggttgcagcagttcactggggaggtgatatgacgtccttgtgcaggtgggcgttagaattacaaactctttgattgccagataatccggacatcattcacgatggatagtgtggagatggaattatttgaggatttgtctcaaagggaggggaaagctcagacag

SEQ ID NO: 778 - DNA, 247 bp, Artificial
  Synthetic
ggaggggagagaaacctaacattaataaagcggacacttatttcggccgctactgtagtctacggataattaatacctatcgcatgagaaaccgtagagagataggacattaacagaggagagccggaactagattgtggcaatatatgggctactatgaggaaacgtcataacttgagggccatttatgtaacacagattgatagttgccctagatccgttttaatcaaaaaaaaaaatccaaatc

SEQ ID NO: 779 - DNA, 1131 bp, Artificial
  Synthetic
gtatcttcacagtggcatgaaacgatggccgttggacaaacgccaccaccgctcccatttcccgttctcgttggccgaatgtcaaaagctggcacagtacgaacgccgagacaagtgagaggagctgctccccggcttttcccaccccgcactatgtgcgccttaggggggcaaaccgcgggaaatctggggtaaatcaggccataagtcgagatttcttcggcgctagctatctggcaaaggttttggaatccgttctagagctcgagggcccttgcgtgggctggtacgaaaaagtaagactgcagcggtaagatatcgaagggtcgatggacgttgttgggacaatgggttgcattttctgactgcgctgcgctcgacctgcatcccccgtcaggccccgtacatcggccagccctcaactggacggacggcctatgtgggtaatgcgagtacggcggtcgggctaaaatgtcgcgatgctgggttagggttcaaatttcttcagccagcgagcctcacgttgcggtgattgcacagggaatgttctcccatctgccggagcagccagtcgctagcatcgttcccgtacaagtactagaaggcaaacccttggtgagctagcacacacaggtactccgtgccagcaaatggacatggtcatggattagtagatcaacattggaacagagtcatggctactgtacgagtacaggcagagccggggtggggggatctcgtggcctactagggggggcgactagcgagcgcagtgcaaaaaaaagatggaagaagacaaccgacgtacgtcaatcaaagtcgggattgatgacagccccaacgaaagacgttggcgggtggagcagcctcgctcggatctgtccagtcacagcggcgcggtgcctattagggcgtgcggcgtgcatcagcaatttgggtgttttttcatgcggcgagcaaagggggaacaagaggatttccgatgggcaagacgagataccgtgggttggtacatgtaggattggggccatctccaggcgaggatgcggtggttgcggccctttgcagccggctgcagcaggtaccgcgttcgtacctctccggcgctggacgtatgcagggctaacatgt

SEQ ID NO: 780 - DNA, 182 bp, Artificial
  Synthetic
gtcgtggatagcggatggatacttgcagggagtatggggtaagtgagtgagtgagtgagtgatatggatacagcgggatgatgatgatggtggtggtggtggtgttgtcactgatgttgtcgagtgagttgtttgttttgtttacctttggaattgattgaaatgaaatgaaatgaaacagg

SEQ ID NO: 781 - DNA, 721 bp, Artificial
  Synthetic
ggccagaaccgcgcgagtatacatctatctgcaacatctcttacctccatcttcgcaatggcttctgataagatggaccgcggcctcgacgaaatcattgcagacaagcgcagcaatggatctcgaacccgacgcggtggcgaccgccgtcgtgaccgtcaagactatccccgtgatggggtgaaaaagtctctccgcaacgaacctcgaaacttggatagcgaatgggtacatgatcgatacgaagagaacacgtatcgcaatagaggccctgcaccgcgtcgcaggcgcgagtctcccagcgggggagatgcccgcggcgcacgactccgagtcgaaaatatccactacgatctcaccgaggaggatctcgatgaacttttccgaagaattggccccatcacaaaattgcaactgcgttatgatcggtctggacggtccgaaggtgtagctttcgtaacgtatgagagcaaagacgatgccgcagaggctgtgagacaattcgatggtgccaatgcgaacggccagccaattcgtttgtccgtcatgtcaagtgggccttctcgaaacccgtttgatactgctgtgatgccaggcaagcctttgtccgaacgcatttctgctcctggtggcagatctcgatcactctcccctcgccgatacgatgaagaagatgccgctcgcagaggcattgatcgatatgttccaggcggaagtcgct

SEQ ID NO: 782 - DNA, 441 bp, Artificial
  Synthetic
tgcttcaccggatggccgtggacgagtcggagtctgaagcctccgatgtcatgtcccagacttcctccttctcagagctggacctctcggagagaacccaatctatgagcacagtctacagcgatctgccacctagcccttcaagcaccacatcttcgggccatagatcgcccttttcaaagcacttccggaaaacctcgagcaatttgtccgacaaggacaaggagaagcaaaaggacgatgccctgtcgcgatggctgcgggacggcactgtcgtttacaagagcgtgggagtgggcttgatggatctggtggttgggacaaagctgattgaggttgcccagcagaagaacattggcacgcagattgaaggcttttgatcaagatggtacggagcagtgtagatgtgttggcatttagtagcattcaagattccaaacg

SEQ ID NO: 783 - DNA, 644 bp, Artificial
  Synthetic
gaattcaagaaagagttccactcgagatcccttcagcaaaatgtctttggttgctaacgaagattttcaacacattcttcgtgtgttgaacactaacgttgatggaaagcaaaagattatgtttgctatgacctctatcaagggtattggtaggagattcgccaatattgtctgcaagaaagctgatgttgacatgaacaagagggctggtgaactatctgcagcggagttggagaatttgatgacaattgttgctaacccacgtcaattcaaaattccagactggtttttgaacagaaagaaggattacaaggatggaagatactcacaagttgtatcaaatgctcttgacatgaaactcagagatgatttggagcgtttgaagaagatcaggaaccatcgtggtttgaggcattactggggtctcagagtccgtggacagcacaccaagactactggtcgcagaggtaagactgttggtgtctccaagaagcgttgaagactggttgttattcttttgatcaaagaagttcttgtggtgaggagtttgtcattctgctttatagttggaacctagaaggacttaaattatgatactagtatagtttaggattttgaatatctcggaattttaatgtcctcca

SEQ ID NO: 784 - DNA, 696 bp, Artificial
  Synthetic
tccgccctcttctcttcaacccgaacaatcgaatctaacgagcagcacggcaacgtcccatacagttgcccagcatgtcgctcgtcacgggagagaagacgaactttcagttcattctccgtcttctgaacaccaacgtcgatggaaagcagaaggttatgtacgccttgaccaagatcaagggtgtcggtcgccgatactccaacttggtctgcaagaaggccgatgtcgacctgaacaagcgcgccggtgagcttacctccgaagagctcgagcgtatcgtcaccatcatccaaaaccctacccagtacaagatccccgcctggttcttgaacagacaacgcgatattgttgacggcaaggactctcacatcctggccaacggtgtcgactccaagctccgtgaggatctggagcgcctcaagaagatccgtgcccaccgtggtctccgacactactggggtctccgtgtccgtggtcagcacaccaagactaccggtcgtcgtggccgaactgtcggtgtctccaagaagaagggtggctaatggttttactgttttcggtctggggtggacaggcgtgacggctgggtttttcatcactgtgatgagcatttccatgggactgctttctggcatacgcagctggagctgtactctagatcagagtcaaatgaattaaaagcattttcaaagc

SEQ ID NO: 785 - DNA, 683 bp, Artificial
  Synthetic
gcaggagagagggagggagagggagagggagagggagagagagaagtcgaaaaccggctaatcttctcctctaatcatgtcgctgatcgccaacgaggatttccagcacattcttcgtgttctcaacacgaacgtagatgggaggcagaagatcatgttcgccctcacggcgatcaagggtatcggccgacgtttcgccaatctcgtctgcaagaaggcagacgtcgacgtcaacaaaagagctggagaactctctgctgcagagttggaaagccttatggtgattgttgcaaatcctagacagttcaagatccccgactggttcctgaacagaaagaaggactacaaagatggacgcttctctcaagttgtgtccaatgctttggatatgaagctcagggatgaccttgagaggctcaaaaagatcaggaatcaccgaggtcttcgccactactggggccttcgtgttcgagggcagcacacaaagaccactggccgccgaggaaggactgttggtgtctctaaaaagcgttaggggggtaattctagtttcttgttgtggctggcattttgaaatgtctcaattttatttagttttggagatgcggcatgtaacccatgtccagtagtatttagccacatggaaacaatccttttcatcattagaatgcgaacacaacgga

SEQ ID NO: 786 - DNA, 564 bp, Artificial
  Synthetic
acgcgtcggtttgtaggcggctcggcggcgaagatgtctctggtgagcaatgaggagtttcagcacattcttcgtgtgctcaacaccaacgtggatgggcggcagaagatcatgtttgcgctcacctccatcaagggtatcggccgccgcttcgccaacattgtctgcaagaaggccgatgtggacatgaacaagagggctggtgagctgaccgctaccgagctcgagaacctgatgctgatcgttgccaacccgcggcagttcaagatccccgagtggttcctcaacaggaagaaggactacaaggacgggaggtactcccaggttgtggccaacgctctcgacatgaagctcagggacgacctggagaggctcaagaagatcagaaaccaccgtggtcttcgtcactactggggtctccgcgtccgcgggcagcacaccaagaccactggacgccgtggaagaactgtgggagtgtccaagaagcgatagatagccgcagcttttgtttggtctcttaatttccaatatgttttaagtgcaaattttaaaattcattaagaa

SEQ ID NO: 787 - DNA, 602 bp, Artificial
  Synthetic
gcatctctttcaaactaaagcagccgcagccgcagccgcactgtgccgaaagcagtgaaaccctagccatgtcgctggttgcaaacgaagagtttcagcacattcttcgtgtacaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgacagcttgatggtggttgtggctaatcctcgccaattcaaaatcccagattggtttttgaacaggcagaaggattacaaggatggcaagttttctcaagttacatctaatgcacttgatatgaaactcagggatgatctggaacggctgaagaagatcaggaatcaccgtggttagcgtcactactggggccttcgtgtacgtggtcagcacacaaagaccactggccgcagggggaagactgttggtgtctccaagaagagataaatcatttacttgccagttcctttatgttttatgcttctctttggtatgtggagtccgaacacccgcaggaagttt

SEQ ID NO: 788 - DNA, 572 bp, Artificial
  Synthetic
gtcgcaatcgatcaaacaaacaccagcacaaaccggcaaagaaataccctgcagtcctcgagactcgcgatagagcagaagtacatcagtcttatttactagcgagcaagacagtcaaaatgtcgtgggcgggattcaagaagaatgtgaaccgcgcgacgacgcaggtgatgatgaagacggggcatgtggaaaagacaaacgatcgcgattacgaggtcgaagagagacggttcaagacgatggaaacagctgcactgcggctgcagaaagaatcaaagggctaccttgactctttgagagccatgacagcttcacagatgcgaatcgccgagacgatagatgcgttttacggcgactccggtgcgaaggatggcgtgagcaggagctacaagcaggccgtcgaagatctcgacgccgaaaccatcaaggccctcgacgggccttaccgaatgacggtgctcgaccccattggccggttctgcgcctacttccccgacgtcaacgaatgcatcaagaagcgctcgcacaagcttctcgactacgatgctctccgagctaaagtgaagaag

SEQ ID NO: 789 - DNA, 643 bp, Artificial
  Synthetic
caaaaaggctccaggcatcgtctttgacaaggaggactacactgctcgctacaactggtcaattccgctacgttcatacgcggaagaaaaagaacatgtcgctaacagcaatcgcaacaacaatgcagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcgaacgcacatttctagcatggcttcgaacctctctcgcttttgcatcgattggcgtcgccgtgacgcagctattccgcctcaacactgataacgcttccgcctccgatttcgaccacacaaggctacaaaagat

SEQ ID NO: 790 - DNA, 1098 bp, Artificial
  Synthetic
ggcgcaatgcttcaacagcgtctctcgccacagtctggatctgcccgtgccgccactctgaactacaatcacgcaaccaaaccttagtttaaatgcgccgctctgcgcccccacaagagcttgtgcgcatgtgctgtggcactcagttcaaagtggtactgccgagtcaagtgagacgtgcaccctggtcgaggccgtgaccatggcttctcaccctcagaccaacgagcttgacgcatctgcctctgcagtggcattgccgaagaagacgctatcgagggctgacctgcatcgtcgtcagtcggcagacgagcggattaacaacattctcgagacggctctgcaacgagcagaaacgatggatcccgcctctctaagccttctccagaaaggctcttcccacaattcctctcccaactatggagcctccggaacggtgacaagagggatattgcaagactatcaggcggtaccgaccagcgatgaaagcgatgccacccgtccgagaaaggtttcatacagcgatgcggcgaagaaggccgggaaccatgcgaagagccagagctctctgcggcaacgaaacggagtctccggctcggaggatacaagatcgccaacaaaagcaaagtcatcatggacgaaggaaacatttcgaaaatttcagtcccttcagttggaaaacaagggaagcgtggctagagatcacctggctctcggtatgtcgcatgcgtatacagcagctgagctgcatgtctcaagagaaccaattggctgaccatttcatttccccccccttccagaacgcacatttctagcatggcttcgaacctctctcgcttttgcatcgattggcgtcgccgtgacgcagctattccgcctcaacactgataacgcttccgcctccgatttcgaccacacaaggctacaaaagatgggccgcccgttgggtgcgacattcctcgccattagtattgtgaccttgctcctcggttgcagacgatatttccatgcccaggaatggatccttcagggcaagttcccggcaagccgagggaccatcattatcatgtcactggtggcattggccctcatgatttt

SEQ ID NO: 791 - DNA, 913 bp, Artificial
  Synthetic
gcttttctcctgggattttcgagtgcaaacatctgcccttgtttgcgtctttccgcctgcgcaaaccagaacaccgcacttcctcccgagacagaaacgagtgttggttgccccagactgtctttgattctgagacatttggcctcccttgcaggtaactgacggtgagaataaaagccgacgggccgccgcctgcagcaaacgaaaccagcgacatacaaaaagaaacacaaacaagcaaatcaattcccgagcaagaaaaaaagaagaagcccatcatgaagatgctttcgtttgccgccctctcggtgctcgtgttgggcgcttcggccctggctgcgccgccggcccaccccccggccgacaatgggtgctgctgctgcgacatcaacaagaagagaatcgactgcgacaggtcgatcccggcgtcggagtgcatctgcccccaggtcatctgccccgccggcgcgcccacgttcacgcacggcacgccgccgaaagccaccccaccgcccacgccgctgccgacttacaagcagtgctgctgctgcaatcccaacattaacaagattgtgtgctcgctgaggctcgtggaggactgtatctgcttggccgtgatgtgtccgacggatgcaaagaccatctttgtcaggccaactggcgttccgactgtcgcttaagagtattcgttggcgagccgacttgcctgaatcctggaccggggacatgacatggggggagggaaaatacagggcaaggcattgctgatggtgaatgcacaacacgcgtggcagactggccgaaaattgatgatttactgatgggcgactttggacttgaaatggggcatgccggatgggttacttgacagtatttacaccatttctattcaacaataaatggaattctctag

SEQ ID NO: 792 - DNA, 771 bp, Artificial
  Synthetic
agcccttattacagtctaacagccttattaattctagcttgttatacggccacagtgttactatgagcaaacgcatattgctcgtcttatgcatcgtttgtttacagcgacgactcgtgattactcatgagtaaaccatttacagggttgatttgaactaattaattaacccccccccccccccccccccgaagtctaatcagtcgcattgcatagaagaagaatagaagcatttgaagcctcctcctccaggttgcagcaaaagcacaggaagcagcgagatggaaggcaagagccggcgaccggagataaccgtcgtgccggcggcaggcggcggcgccgccgccgccgttgatgcggtgaaggcggcgaacaaggagcccatcagcccgggctcgccgtccctggcgagcggcgccggcaaggagagcctgagccgccatgaggccgccgtcgtgtccctgcccgcgtggaagctcgacgcgctctgccaggagtccggctcgtcgccggcggtgatgagggcgcgcttcccctacttctgaatttctgaatttctgatgaagccatgagctttttgccatcttcgtacgtgtgtgtgtgtgtgtgtgtgtgattgtaactgtgttgttcatggctgagtaaagaattatacttcctacaagcggctgtgatgtatatgtgagctgctttagctgacgcgttcatctttggacgctgtaaaaactaaaaactgccagtttttcatgtagcatcattggaaaaaaaaaa

SEQ ID NO: 793 - DNA, 585 bp, Artificial
  Synthetic
ttgtaaagactccccctcaaggccccagaaaagacgaattcaaatctacgccgactgtctctctgcaatcgaaagctattcgtgcaaccattacacgtcaacaagccatcgatctcttaacaaacctttatagaacttgcgacaactttctaccgccatcatgggtgtctgtgccgcagtactaattgtcatcgtcaccatcttcttccctccgctcggcgcgtgggctgtggcaggatgtggaatggacctactcatcaacgtatgcttgacgatacttgggtatttcccgggtcacatacatgcgttctatctcgaatacgtgtattacgaccgtcggcaacaagcccgcgagggccattatccgccgcgtcgtgctcccggcatctactctgacaaggtgcaaacgggtggacaaggccgtcgacaaggctatggaacgatggcaccgccgcctgctgggcagcctgctggtgctggtgcgcctgtcgctggccctccctatgatagccaaggttataacaacaaccaaggctatgtaaatcagggctatgtcaaccaaggttatagcaaccaaggtcaaaa

SEQ ID NO: 794 - DNA, 397 bp, Artificial
  Synthetic
gcccacgctgtcgcccacgcgtccgatttcactcttctgcagacgaggacggacccgattgaccatgttgcgacaatccttcagagcctttgcccgcacggctgttgcgagaccggccgcggcgagaagctacgctaccttcaactgggaggatcccctcaatgcgaacaacctctttaccgaggaagagcaggccattgcagaaaccgcagagcgatactgccaggaacgactacagcctagggtcttgcaggcctaccgagacgaacactatgaccccaagatcctcgaagagatgggcgagctgggcctgcttggctccagcatcaagggctacggatgcgctggcgtttcttcggtggccggcggcctgattacacgagcggtcgagcgagtc

SEQ ID NO: 795 - DNA, 476 bp, Artificial
  Synthetic
tcatgcgcctcaaagaatggaagaaaacacaggcgaatgacgtgaaacgaaagataaaaagacaggcgccttcatgcgagggtttcgccagtcgcctctagcgtgtttcgaagcgcagggttgaaacgcggctgcatgatgcccggccgcccatctgaggcatggcggctaccggaacaggacgacatccgaagacttgaggaggctccgtgtttgttcgtttcgtttcgtctttcgagtgaagggttggttcttgttttcggctgttgtgtgttttggttgacttgtgtttacgggttgggggtgagttgaattgagtgcgagacttgatgcttctgtcaacaagccagccacttacactgcggcttcaccctttcgtctcttttaccatgttacgcaacatggcgaatttccttctataggatccatattgcccaaattcagatccagcccgcaagggagaattttatccgcct

SEQ ID NO: 796 - DNA, 317 bp, Artificial
  Synthetic
gggaaaatagactgcgagagagagagcgacgaaaagaaggaaatgctccgatcacgattaggggcggaattggaaatccggagctccgacagagtgcgaaatgcgaatgcgatagttcaaatgtatgattgatttactgtatgaggcgacgatgatgcgatgaagaagaacggaaaatatcccgagctgatgcatacattgcgggctttccggatatctcgtcagccctccttccattatgtcagaagctattatgcagttggttttgatggatgggcgaatttgatgacaaggtgcagtttactggacgggaccgg

SEQ ID NO: 797 - DNA, 638 bp, Artificial
  Synthetic
tgaccatctcaccctacgtcacgaaaaggcaaacaccaaagaacccaaagagcgtccagcttctttctgcctttgtccggcgtctgctccagttgctccccatcctcgagccctttgcgactcgaacagggacaacgactccattgaccgactgttgctatttgcatcacaacgcatcgcaacatcttcgcctttgttggggggaaaatatccatccaccgcaacgtagcaccaaagtactctggacttgaaaagctaccccgcacccggtcgcatttctacagcgcttccttctgctctacccctccaaacctcttttctacctcttttcccgcttcggcacacacaaaccacacaaactcttcaacaaccgcagccatggccgacaaccagggagtagtcgtggaagcccacgagattgagactttccagcctcctcagaagatgttcgcaaagcaccccggcaaaccccacattgcaagccttgaggagtaccagaagctctacaaggagtccatcaccgagcccaacaagttctggggccgaacagctcgcgagctgctttcctggacccgcgactttgagaccgtctctgccggcagcctcgctgaaggcgatatcaagtggttcgtagaggg

SEQ ID NO: 798 - DNA, 659 bp, Artificial
  Synthetic
aaatcccacacttcagactcagactcagactcacgctcagaaacagtcgtcacaatggatcccttggagagcatgtcaactggagggcccctgcccaaggacttcaatgccgacgatgcgggcaacatggaggatatggagaagcaatttgccgtcaaagttgtgcaacacatggcaacctactgggccattctcgaaaaggtcaagggctccggcctgcgactgacgaagatcgacgacgagatctacgaccacctcaaggaggcctttcccgagtttgaccccgccgccacgatcgacgaggaccagatgaagagcaagaccggcaaggagaggtggcgcgccttcatgatgaagtacgagaagaaggtggacgactacaactttggcaccatggtgcggaacaacgccaaggccgagtacgagcaggacacaaccattttcgtccccaggatgcagttttatgccattgagatcgcccgaaaccgaagcggcctcaacgactggatatacgaaaaggctcaggaagagaagaatagctccaaataaataccccaatacacaagccaattcaagagttgtttttgttatcaccgcgtgcctttgtcaactaaaaatattgaggattcactcaacgggcgtggatatggttttgtcat

SEQ ID NO: 799 - DNA, 426 bp, Artificial
  Synthetic
gaactaactcaagaaaagggaaaaggacaaagggaacgttcggccttcttccccggccttggcttaagccccagagaagagccgcacgtggtgcgacgttgacgccatcagatctcacatcaccatctagcagatagtatgtgcggatgcagcctatacaatgccaagattcccacgcatgcctttggcaatggaattgctggtgttttagcagtgtgcctgtgatatgagtcgggcgactccgatgctttcggggtgcgtcatcgctgggctcggtggagggaggcagccgagttacgaacaagaatgatgctgtatataatcaccctgttgtaagatgcttcatgatgacccttttcatgttcgttttccgatatgttgtagaatatttgtgtatatcggctacagtttctgtattagttgatg

SEQ ID NO: 800 - DNA, 560 bp, Artificial
  Synthetic
gaaaccgcaatccatctcccggcggaaattgccctccaaccgcaaccatgtcgaccctccccaggactctgggcaacctgcgcaagattggcatcaaggaatacttccgccagatgctgtacatcggtgacaccaagtacggtactctcatcggccaggatcgcttcggcaacaaatactacgagaacctcgaggaactgcccctccgaacccgctgggtcgactacgccaagcacgactacgatgcctcccacatcgagcccggctggcacgcctggatcagctactccgtcgacaagcccccgacccaggacagcctcatcgccacgggcaccagacactttgagcccgcccttcccaagcccaactttaccggaacgcgaggcgcttacaagccgtataacacagtgaaatcgaagcttaatgcttgggagccggtggccaaggatcgggtatgagtggtttttacgttttcttttttaaaccgtgggaaaatatggtgtacatattgaaatcgcgcaacaaacgcaaacaaatcaaacaatagacacagacatgtg

SEQ ID NO: 801 - DNA, 627 bp, Artificial
  Synthetic
tttttcctctccaatctccaatctcccgcctaaagctggcctttgcttctcaggcccctttactctcacaacaatttgttactgcctgtgtatctctgctgcgatatcaacttgaccaaactcaccacttttctctctcttcttcctggcacccggcagaccttcctttgcccgtgctcttcatcggcaaatatattccatcgctaccagcatctagtcttgctcgatcgagattcccttgagcctcatattcttgcatgatcattctgcagattgacatcgctgcacactacttttgatacagctctgcgagcccaagagaatttcttgctttcgcatcatccaacttcatcagcatttgttcgtcgactcaaacacacaatacatacccagtcaaataccgacaacatgtcaagcggtcaaattgctgcgccttttgctattaagccttcccagcgggctaacatccggctggcaacggctcaggacctttactccacgctgagcagttgtctcagcccgctaaaaggacatcagcaaccagctattccttttgataccaagcaaggcgacggctcctcaactcctgctcatcgcatccttgaggatgactacaccgttccagcg

SEQ ID NO: 802 - DNA, 600 bp, Artificial
  Synthetic
tcttctctatcctctcttgactatcattgttataccaaactcactcttaagttcacctctccatcatcatcaacaacaccaaccaaccaaccaaccagcaagcaaacaaacagaccaacaactgtgacaatgtccagccaacgcagcgtctatgttcaccaaaccagctctggcccttctaccgccagctcttccagccgctcctccagctcatctgcccattatgcggcatccaactcccgctctgtctccaatgcccgcgagtatgatgccgcaggccgttctgctcaagtggtccgaggcagtgcctctgtcgtcatcaaccaccacagacgagactacgagacggactctccttctcctcgctaccgtggtggctaccagtgatgcgacatccgtcacgcagcttgcaactacttacacaacttcacaaccacatattgggacacaacccgcttctggggagccagccgggggctagcggggataccctctgctaccgtggctcctctacacacccactcatagaaccgcatggcgctgttggcgttcttttttgtgttactatttttactcttctttacaaccttacaactttgg

SEQ ID NO: 803 - DNA, 365 bp, Artificial
  Synthetic
agcaaaaatgccccctaaagtgcagcagaccaaggccgctaaggccgccgccgccatggccggaggaaagacccgaaagaagaagtggtccgcccagaagatgaaggataaggctcagcaccacgttatccttgaccagcccctgtacgaccgaatcttcaaggaggctgctaccttcaagctcgtctctgtctccgtgcttgttgaccgactcaagattggaggttctctcgcccgagttgctctccgagatctcgaggccaagggtatcatcaagcccgttgtcaagcactccaagcagtacactttcacccgaactgctgccgagtaaattagttattttatagctgaaaaaaatatgtatt

SEQ ID NO: 804 - DNA, 374 bp, Artificial
  Synthetic
ggggtgcgatgtgaggctgatttggggtgtatgattcgtgagcgtgtaagaggaggcagcccacgactttctctctgtgtctgtgcttgctcacttgctcgcctccttggattcggcctgttgatccgaatcagaagtaaatgtgtttgagactgagacttggtctggtcgagacgatatgagatgtggcatggaattagaaacacgtgtttggtatggcgattgcgatgcgatgatccgcagaaagcaagatctcagggcgactaacacggatatacggaggttcgaccaagacacgaggaatgatggggaaagtctcagtatgtcactacggaatttatgattacgtagcaatgtatgaattatcatttcac

SEQ ID NO: 805 - DNA, 61 bp, Artificial
  Synthetic
ggggtgcgatgtgaggctgatttggggtgtatgattcgtgagcgtgtaagaggaggcagcc

SEQ ID NO: 806 - DNA, 1356 bp, Artificial
  Synthetic
gttgtttttttgtttttcatctttcttctttgtcacaatcactttgccgtcttccacggacatttccgcagatctgcatcacagagatctgcatcagagaggatttcaagcttttcctctttgtttgccttcctctcctcttctcttcttggatcacaaaacaatcggcaaaattgacatctcgatattttctgcctccaatcacagccgtcataccacctgtggcgtctttgccatcaattctctgctgcggtgctacccgccctgcagcaatttttcccgctggccgtctgcaggcttgcctcggctgtgggtttttcgtcgaccactgaggcttagtgcccatcagccactaaagcggcttgacgtcgattctcaactttgaacccttttgagctgcctctggcctctgcctcatctctcccacaccctcacgcgcgcagtcttgaatcaacaccccttcacgcactcgccattgccgcgctcctcgtcacgctctgctcgattagccgtctctcgcccattgattgaacctgctctcggcctctgcagccaccctcacgcaacctacgcctgacatcctctgcgtcgctcggctgtctcccggttttatccatcagctgaaccttcaccttcgccttcgctctcaagagggaatccgagggcccggccgttctctgccatctattgttattgccattaacgctgctgctgctgccactgtctcctctactcctgtttcgccctcatatgtctcagccgcctcgccggatgcctctactatcacaccctaaacaccgtattagcatacttgatcttaccaaactgccgttgcagtaacgccggcttcatcttcttgacaatgccgtcgaaaactaacaatggtgtgggagttcaggtcgaggacacaaagatatgcgttgtcatggttggtctcccggcccgcgggaagagctacattgcccagttagcccagagatacctgcaatggctgtcgattccggcagcgactttcaatgtcggcaactatcggcgcaatgacgctccacagccgactgccgacttctttgattttaacaatcccgaaggagagcggaagcgccgtgcggctgccgaggccgccgttgctgacatgcttgcctggttccgcaccggcggcgtcgtcggcatccttgacgcgaccaattctacaaaggagcgccgtaaatgggtcatggacacgtgcaccgctcacggcattgaagtgctctttgtcgagagcaaatgcgatgatgaagaggtcatcatggccaatatccgtgacgtcaagctaacgagccccgactatcgaggccaagatcccgaggccgcggcgca

SEQ ID NO: 807 - DNA, 972 bp, Artificial
  Synthetic
cccacgcgtccgcccacgcgtccgcgaaaggtagcctctatacggtacatcgcgatatactcgtagcgctcagttgcagttggtaccacgatcgtgcatctgtaatttcagaaggagggcgtcacacagacctcgtcactccacccaccccctgccatccagatcgcagcttctcttttgttgttaatgacgttgatcaaccagatctgccagctggcgtggtggccagagcgtcagttgtcggcaagcactacatacaaggtacattgcaaagaggtggtagggcagtgtcaagcgaggtaccaccagagggacggctgttgctacttcctcacttcataaacgctctaggcccttctcctcttgcccagtgcctaccaggtgaccgcaactccttcttctctctctttctccaagattctccctcttcacctcttgtcctcttggagctcccaaacttctcctcgttcatcaccaccgttctcaagcacaaaataaacgtcaagctctcctggtcgcctcgccatcgccaatcgttgtttgcgtcgtctctcgttgcatttctgtatctcccagaactcaagtcgacttttttgacaacgtcaccgccaagatgaagtccgtcgttatcgccctttgcaccctggttgcggttactgccgctcaaggctctgccaaccttgcagcctgcggccaaacctgcgccaccaacatgttgagcgccgacaaggctgaggagctcggttgcaaacagaatgacttgaggtgtctctgtgccaacaagaacttcctttatggcctccgagactgctctgcggctatttgcccggctgaggatgccagaaaggttgttgactatggtatcagtatctgtgctggagctggtgtttcgatccaaacatctggaggtagcagcggtggtgctagtcacactggaagttctcccggaagtgccactggcagtgctactga

SEQ ID NO: 808 - DNA, 401 bp, Artificial
  Synthetic
cccacgcgtccgggacaggaaggacggagtgcgagaagaccggtacattcttgttcgtaccgtacatgcacggagcctgcagtgcaaggctgcaagcaagaaaaatacctggaaacgcctcagtcccccagtcgcccccttcaatgcgattcggcaggccgttgagccaacaagggctcgcgtttggcacaaaatttgcaaattttatctgttgggcaagctccattgctagtcaagtcccgtcccgttgcgagtacgaaggcacccggacggaatccgcactggcgcattaccttggccgtaccgtgctcgttacgcacaacatactataaacgtttgacgctgggctgcccggcaaaccaaaccatgaataatacatgacgaaagtacccgctacaagc

SEQ ID NO: 809 - DNA, 965 bp, Artificial
  Synthetic
gttcacgattcctcctttcttcccctccatactatttatcctgcctcttcctcgtcttccatctgttgccggtgtgactcttgcaattcattccctgcccggcttcctcgcttgattgaatagccgttgctacttccaactgcaaatcattatagctatacctccctagcttcatataagctcggctcttctaggaacgcgcaagcaaacatcctcggcagtgacccacgagccttgtctggagattttaaataggaaagctcatcaacggcacctgagcagcgtccaattgctctgttcagctcaattaagctttcaagatgcctagagacggcagtaaacaaccgccctcagcggcgacaaacctcatcgctggtggtggcgccggtatgatggaagccctcgcctgccaccctctagacacaatcaaagtgcgaatgcagctctctcgccgtgcacgaatgcccggcgccccccgccgcggcttcatcaagactggtgtagaggttgtgaaaaaggaaactcctctcgctctatacaagggcctcggcgccgtcttgacgggcattgtccctaaaatggctatccgattcacatcatttgagtggtataagcagctcctagccgataaaaccaccggcaccgtctcaggccgaggaacatttctggctggtctcgctgccggtgtgacagaagccgtggccgtcgtgacacccatggaggtcatcaaaatccgtctgcaggcgcaacatcactcaatggccgatccgctggatattcccaaatacagaaacgccgcgcatgctctgtataccgtcgtcaaggaggaaggcttcggagcgctataccgtggagtcagcttaacagccttaagacaaggctccaaccaggctgtcaacttcacggcatactcttactttaagcagtggctcaaggactaccagcctcagtataccgacggtaac

SEQ ID NO: 810 - DNA, 568 bp, Artificial
  Synthetic
gggttttttttcgggaagtttcagcattagcattacaccagtaaccctccagggcagctagcgaagagagcaggcccagttccgggtgacaggtcgggcaacgccgcgacggctgcgattccgagcgaacggcgctggcgttccagacggcacagcagcaagcacagcaacagcacagcacagctacgaacatcgaggatcccgctccaggaaccggtgctatccagaacaaggccccggcgctaggacccgcggttggcagtggtggatcgcaaggctccagtcatgccatgcaagcgagggaaaaacgcttgcatgctcatgctttgctctggctctagatgagtctgaatctcatccatcctcgacctgctgctgtgtctccccgtcccgcacgaggcttcggtcggcgagagccgggatcgaggcgttgggggatggcgtctgtgagccagacatgacctgtcacagcgctgcgtcgatgatgaaaatggcctgatttcttgctcgcggagctatgccgggaccctgcaaccgcgaaatgggctgccaccggccacagagaaaa

SEQ ID NO: 811 - DNA, 706 bp, Artificial
  Synthetic
cgaatatcatgctatcagccgcttccttcgttcctggaaatggtccatgctgacctacctacccctcgccttggcccttcaactacgcaaccccaggcgcatcaacctcgtcaaggccatcaccggctctacccgatcatccacttttcttgctacctttataaccctcttttactacggggtgtgtctggcccgcactcgcctcggcccccgcgtcctcggcaaagaaataccgaaccgccagcgaatcgacgagggcatctgtgtcggtaccggatgctgcctttgcggatggagcgtcttcatcgagacggcaggtagaaggaaagacatggccttgtttgtggcgccgcgggcactggcaacgttggtccctcggcggtatcccctggagaagcagtggcgagagaagttgatattcgcagcgagcacggcagtcgtgtttacttgcgcccttgagaatccaaagagagttagaggcgtactaggggggattttgggcatggtgttgaagaaataaaccgggcatatgggcaaatatgatctcttttagggagttctgagacgtgacatgactaatttcttcttcttctttggatgtctttggaataagctacggtttttagatgatatacacaaacaaccctgatgctataattggtaataaatacataatattaattgtttatccaaacaaaaaaaaaaa

SEQ ID NO: 812 - DNA, 370 bp, Artificial
  Synthetic
gacccacgcgtcgaaaaatggttcgctttttatgcgagcatagcatgatgtgagcgagagggatgggacgccatggctggattgggttaccccgaggccgggattccgaggcattgggagatggcaagcatgctgagctgcgagggatggggatctggaaccccctgtgcattgggagctgtctacagtacctaaccttgtgaatgcatgtacgagtatgtgtatgtatgtgagatggagggctgtatgttatgtgtgagagcacgtctgtgtgctgcagggggtttcaatgcggacgaggggaagagagtcaaaagtgaagagtgacgagataagcggggtattctattctattctgttcttttcattc

SEQ ID NO: 813 - DNA, 240 bp, Artificial
  Synthetic
tgtgctgtgctgtgatttttgaacggatattacaaggctggtccgagttcttggagtttgaagcgctggcgttgtttcttcaagatcgcgacgtcgatcaactaaagccagagcttatacgtccgggtgcatatgcatatgcggacatgagcctgtaagcttcaactgcttcgctgccaagccaaagcgcgcatccgaacttcaatttctcaacgccctgcatacggattcgatttcgcg

SEQ ID NO: 814 - DNA, 749 bp, Artificial
  Synthetic
acgtaatgcgtcccccatgtaatatatacctgcttgcgcccctttcgacgagtcacgatagcctctcctgcggccaatgtctgctcgcttggctggctcgagactcctaggtgcagcgctcaggatggattttgctggcggaagcacaaaggcggaccacctctgcgtcctggttcacggactatggggtaatccgaaccacatgaacaatatcgcaaagacgctacgagcccaacattcccctgacgacctctacctcctgctggccaagcgaaacagcggcagcttcacctacgacggcatcgagcttggcggcgagcgagtctgcgccgagattatagaggagctcaagacgatagaacagaatggcggcaagattagaaagctgagcgttgtgggatactctctcggcggcctggtatcgcggtatgccgttggtctgctgtatgcaaagggcatcctggactcggttgaatgcatgaactttgcgacctttgcctcgccgcatctgggcgtacggacccccctcaaaggatggcacaaccatatgtggaacgtgttgggcgcgaggacgttgtccatgtccgggagccaattgttcacgattgataatttccgagataccggccggcccctcctatctgtcatggccgatccccagtcgattttcatgctgggactgcagaagttcaggagacacacgttatacagcaacatcgttaatgaccggagcgcggtttactacacga

SEQ ID NO: 815 - DNA, 646 bp, Artificial
  Synthetic
cactgtcgctatcatggcccgcggaaggtcagcgtgatttggcgcgcgcaaaaaatcagaagaatgcgtccaaacatgtgagtcggttttgcatataaaatcctcaacaggaaccagggttgactaattcggtgtcgtgtctttgcagaaaggcggcaataccgagaacggatatgagcaagcaaaatccaagttgagtaacgccgagattatgaggcagaagcaagccaaaggtccgaacaaccaagtctacccaatacctcttacgaaccagtcaacttaccaaggcaacagccaatgccgagagagacctagcggcagcaaaggcattacaagagaaaagggacgcaaaggcgaagaaaccgactgaattgggcgcttcagctgtggaggttactggacatgcaaataacccaagaggatagcaagagatgggagaaaacacggcacggcgaaatcaggcgctccttgagactttcacaatacggcgcaaatttgggacaatctaggtgaagagggggaagcgttttttggcttaataccaggtatagccatggataatagcgaaatggatattttgttgcggtattgctattattattctaccaaaaaaagttcgacctttgtgtccctttttttcccctcg

SEQ ID NO: 816 - DNA, 1114 bp, Artificial
  Synthetic
atccagcagctgcctatcgctggtggcggctcccagccgatggcattggccttgctcgcatggagtttgtcgttagtaacgctatccaggtgcatcctatggctctcgtccattttgatcaactcaaagacgcggatgccaagaaacgcatcgccgaactcacggcgggatatgagcacaagcccaattattttgtggacaagctgtcgcgtggctttgcagctctttgcgctgccgtttatccaaagcccgccatcattcgattgagtgactttaagacgaatgagtatgctggccttatcggcggtgctgagtttgaaccagatgaggaaaaccccatgcttggctttcgcggtgcgtcacgatactattcgccgcgctaccaagaggggtttgcgctcgagtgtcgagccatcaagcgtttgcgcgaggagattggcctctctaacgcgatagtcatgattcccttctgtcgtacagttaaagaggcacgaaaggttctggatgtcatggctcgccacgggcttagacgaggagagaatggcctacaggtatatgtcatgtgtgaaatcccctcgaatgtgattttggcggcagatttcaccgagtactttgatgggttttccatcggctccaacgacctgacacaattgacacttggggtcgaccgcgactccggcgagctgggtgacttgtttgacgagcaagatgaggcagtcaagtggatgatttcgcgagtcatttccatagcgcgcgcgagaggctgtaagattggcatctgtggacaggctccaagcgaccacccagagtttgccagatttctcgttgacgcaggcattgattccatctccgtcagccctgacagctttttagctgcaaagaagcaagttgtggccgccgaaaaggcattgggaaaatcgcgcggctaatctaatcaaatctggtctatatttgtagttgactttcacgaaaatcaggctgaaatctttgaacagagaatcgtttatatggccatatggaagtaggtaatggtgttcgaagtgttgcagatggcaatgcggtttggctcattcaactggattctgttgagagttgcgatgcacgctattatcta

SEQ ID NO: 817 - DNA, 279 bp, Artificial
  Synthetic
gctgagacagccctgttcaacctggcatcgctatgctaccatgtgcccaaggcgttgatcttgttggactcggaacatccgtgatgcgtggacttgcatggaacgtgcttgggctagaagcgctctggaatgtttggtctggaacgttgcatgcaacctattgagttttgctgaagcttgatctgcgctctcaactgatgctccacatatatcggcagtcagtatccatggacaataagggcggatgatctgaagataagctcttcatgcagctttgac

SEQ ID NO: 818 - DNA, 228 bp, Artificial
  Synthetic
aggggagaataaaagaagcaggcggaaggcgggaagatggggaaccaagcgccaggggggaccattgagaagagcaaggatgaaccagggtcaaactctcatccgcaaaagtaaacatatatcgtactactcctcccttctctcctccacccagacacccaagccatttgtactctttcgtagaagaaaagaaacggaaaaaagaacaagtatctatacataaaaaac

SEQ ID NO: 819 - DNA, 553 bp, Artificial
  Synthetic
tctcgtacaagaaaagaaacggaaaaaggaacaagtatctatacataaaaaacaacccagcacatcatatccaagaaagcaaaaaagacacacaagacagcaagcaaccatgggctctctcgtttccacaatgggttccaaatcctcaaagagctcaaaggccaccaaccccgagggcgagccgcggtactggttccgcgacaacttcttcctcacaaacgacaagaaatatctcgagccccaggccgtcaacgccgtctttgaatcagacctcatgtggtggaacgatccgctgccggagtcacagatgcgcaaaatgctgtccaactgcatgacaatgagcatataccacgtacccgagtcggagaagcagatgcagaacaacggagctccgcggagaccatacggctccaatgtaaaactcgtcggcctcgcccgtgtcgtaaccgactacgtcacattcgcctacctcaccgacgtcttcatcatcgaggagttccagcgccgcggcctcgccagctggatgatgcaaggcctcaaggaaatcgtcgac

SEQ ID NO: 820 - DNA, 596 bp, Artificial
  Synthetic
tcggagactcatgcacaagtacaacacctatttccccgacgacgccacgaatgacaccctagtggccgagagggagaggctcctcaacgagatgctgggcaagatcggcacgaaccccttcatcgagacgcccttcaacgtcgactatgggtgtaacacgtcgattggagacaacttttatgccaatttcaatctggtgattcttgactgcggaatggtcacaatcggtaaccgcgttctgttcggccccaatgtgtcaatattcggtgcaacacacgagaccggaatccaatcgcgccgcagcggaatcgagtacggcggcagcgtcaccattggggatgattgttggatcggaggcaacaccacgatcatgccgggcttgacgattggaaagggatgcacaataggagcaggcagtgtcgtcaccagatcgatccccgacttttctattgcgattggttcaccagccagggttgtcaagaaagttgatccagtcccagatttatgatgattcgaagccgaaaaaaaaagagaacttgcatatatgatagagacgacatcttaacgaggcaatgaatatttccattaacaataga

SEQ ID NO: 821 - DNA, 610 bp, Artificial
  Synthetic
aaagaaatcgaccttgaagatgaaaatactgctgtacctcgatcaactattgatgacgaatatgctaatgcaactgacaaagatcccaaaattttgcttaccacttcaagaaatcctagtgctcctcttactcagtttgtcaaggaattgaaaattgtgttccctaatgctcagcggatgaaccgtggtggtcaggttatatcagaaataattgaaacctgccgagctcatgattttacagatgtaattttggtccatgagcatcgtggtgtacctgatggtattatcattagccatcttccgtttggtccaactgcttactttggattgctcaatgtggtcacgagacatgatataaaggacaaaaaatctattggaaccatgcctgaggcgtacccacatcttatttttgacaaattttcaacaaagcttggtgagaggacagttaacatcctaaggcatttgtttccagtacccaagcctgatacaaaacgtattatcacatttgctaatcagtcagactacatttcattcagacatcacatctatgaaaagcacggaggtccaaaatcaattgagctgaaagaggttggtcctcgatttgaactac

SEQ ID NO: 822 - DNA, 689 bp, Artificial
  Synthetic
ttattactacagatacccaagcaacagccaatgcctagtagaaaacactgtcatctttattcctcgttctcactcacacggcagactattgtctcagctgttactcctcctgcagcctcaatcgttaccatcgccaaaacctgccattttcgcggctatgggctggggggccgcctcgttggcctctgcatggcaacaggcttttccgagtgtgaccttcccacccttggaatggcgctgatagcattgccgcatgctgtctgctacttcacaaatatacatgacatatctattgaactgcatggactccaagttatccattatccatcacacaaacgatttgtttacagtattgatgctgtacattagctcgtacaagccgagccaacagcatagacatactgcaatatgactctgcatgcagaagtgccttaattacggaaactccgttgttacatgcagccttgcacatcccacgcagatactcaatcccacgactcaaaaactggaatactgatacccgtggcctgcttgtacgcacagatacagaagatgtcgacccctggtcaagagtctgattccacatctgcgtacgattactttggcaaagatggcattctttctctctcttccatttcctaatttccaactgtagatctatcttctctcttcttctctacatctactta

SEQ ID NO: 823 - DNA, 567 bp, Artificial
  Synthetic
agctgttactcctcctgcagcctcaatcgttaccatcgccaaaacctgccattttcgcggctatgggctggggggccgcctcgttggcctctgcatggcaacaggcttttccgagtgtgaccttcccacccttggaatggcgctgatagcattgccgcatgctgtctgctacttcacaaatatacatgacatatctattgaactgcatggactccaagttatccattatccatcacacaaacgatttgtttacagtattgatgctgtacattagctcgtacaagccgagccaacagcatagacatactgcaatatgactctgcatgcagaaggtttgacgagtacctgatcacatacaggagatatactttgtacatcctccgagacagggcaccgggcttacaccaaacttgcagtgccttaattacggaaactccgttgttacatgcagccttgcacatcccacgcagatactcaatcccacgactcaaaaactggaatactgatacccgtggcctgcttgtacgcacagatacagaagatgtcgacccctggtcaagagtctga

SEQ ID NO: 824 - DNA, 466 bp, Artificial
  Synthetic
tcgaccgacgctcggcaacaatggcgacaattgcaagcggcttgcggcatgcgagatgcgcaagctcgattgctgcagctcaatggcggccggcaatcttcccgcggtcgaactttcaactcgccatccggtctataaccagcgactctcaaaagcctcccagtcttgaacttgaagccgccgagtccgtcccgatcccataccagggcgttacgcatgcgcgagttgttccggcgacaccatcttatttctcaagagaaccccagttcaacgatttatacattggaatctccaagctgctcaccaagtacaaccacctgcccacagtgccgccaagtgaggctccgcaaatgccatggacaaagctggaggagatgcgggcgcagatgggagagcccatcaagtcatcacactatgcgaaggtcatgcgagtggccaagcgcttgaacctcatcgagcccagcct

SEQ ID NO: 825 - DNA, 625 bp, Artificial
  Synthetic
accttagcactgtcacctcaacccgaatgtcgccaatccgattagacgcccatgtaaacccagaccagcatacgacacggagcaatacaccgcgaatcaaatatcccatgtcgaagctacgcgacttctcgccataccaatgcctatctgtatagagtgccggtatcctgtcaaaactctgtggacgcaatattctggagctgatgataagtccaatgggcacttgattcgcctcactgtctgccgaaaatgtggccatttctgtgataaatatgtagagcacgactttgttgtgctctttatcgatctggttctcatcaaaccccaggtctatcgccatttgctgcacaacactttgatgcgggatggagatcgcttcgacccttctatcattcgtttgggggtgttgctcctgctattcgatgtctacttgacatgggcccgcatagagaaacaaaccattccctcgtctgagagtagattagggccgctcgcgcaacagccgattgtgattcagtacatgttctttctggtcctatgcgccttatccacaatcgctttccatctaagcatccgattttttacatcatcccacctctcgccgctaaatatcacaggcctgatg

SEQ ID NO: 826 - DNA, 668 bp, Artificial
  Synthetic
cacactccaatttccaatttccaatttcccaatctgcaattttctctttccctttcaacaaagaaaaatctcagagagaaaaatggcggatcagctcaccgacgatcagatctctgagttcaaagaagcctttagtctctttgacaaggacggagatggttgcatcacaactaaggagcttggaactgtaatgcggtcattggggcagaacccaaccgaggctgagcttcaagacatgatcaatgaagttgatgctgatgggaatgggaccattgatttcccagagttccttaacctgatggctcgcaagatgaaggacactgattccgaggaggagctaaaggaagctttcagagtgttcgacaaggatcagaacggattcatctcggcagctgagcttcgtcatgtcatgacaaacctaggcgagaagcttacagatgaagaggttgatgaaatgatccgtgaagctgatgtggacggcgatgggcaaatcaactacgaggagtttgtcaaggtcatgatggccaagtgagaactgacgaatccaacttttaatctttattagaagtaaaaaatacgaagagaaggaaacagggcagataagtttgttgagattctgtttcaaattaggacatatttacctgtctcagtgcttgcctattttccta

SEQ ID NO: 827 - DNA, 695 bp, Artificial
  Synthetic
cccggaaatgaattgaaaagacgattattttgtctgaaattccagaacaatcttctctcttaagttttctctgttgttgaattgaagaagaaaatggcagatcagttaaccgatgaccaggtctctgagttcaaggaggccttcagcctattcgataaggacggagatggttgcatcacgactaaggagcttgggactgtgatgaggtcgctcggacagaaccccaccgaagcagagctccaagacatgataaacgaggtggatgcagatggtaacggaaccattgacttccctgagtttctaaacctcatggcccggaaaatgaaggatactgactccgaggaggaactgaaggaggcgttcagagtgttcgacaaggatcaaaatggcttcatctccgctgctgagcttcgtcatgtgatgactaaccttggggagaagcttactgatgaagaagttgatgagatgattagggaagcagatgtcgatggtgatggtcaaattaactatgaggagtttgttaaggtcatgatggctaagtaatttcaccatctcttattgaagttgaagtttagacttgttaaaaatgtgaaaattccaaaaatatttcattggataggatttgcctagtgtaatgtgttccgttgtaccatcttggatgtattggacctggaatgaatgtaatgctttattgt

SEQ ID NO: 828 - DNA, 632 bp, Artificial
  Synthetic
atagggttctttgaaatcgtgaaaagagagagagagagagaaatggcagagcagctaacggaggagcagatcgctgagttcaaggaggcctttagccttttcgacaaggacggcgatggctgtattactaccaaggaattgggaacagtgatgagatcacttggtcagaatcccactgaagctgaactacaggatatgatcagcgaggttgatgctgatcagaatggaaccattgattttccagagttcttgaatctgatggcacgtaagatgaaggacactgattctgaggaagaactcaaagaagctttcaaggttttcgataaagatcagaatggctttatttctgcagctgagcttcgtcatgtaatgacaaaccttggagagaagctgactgatgaagaggttgatgagatgatccgagaagcagatattgatggcgatgggcaagttaattacgaggagtttgtccgcatgatgcttgccaagtgactttagattctcgtgtattttgcgacggccacttagttacctataacttctagctgtcagtttatattctgtgttgctgttaagacaaacaaatgtgccctatgcttttactagtatctagactcctttcagtttatatg

SEQ ID NO: 829 - DNA, 643 bp, Artificial
  Synthetic
cctcaggcgatactgcttctgctcatcttctctccttcaatatctcgtccttggcagtagcgcgaatcgaacagcggtggaatggcggagcagctgagccctgagcaaatcgctgagttcaaagaggcctttagcctcttcgacagagatggagatggctgtattacaactcgggagctgggggtagtgatgcggtcgttgggtcagaacccaacggaatcagagcttgtagacatgattaacgaagttgatgctgatggcaatgggaccatcgattttgcggagtttctcaacttgatggcccgcaagatgaaggatactgactctgaggaggaattgagggaggctttcaaagttttcgataaggaccagaatggctttatctccgcttccgagctgcgccatgtgatgataaaccttggcgaaaagctgactgacgaagaagtgaaagagatgattcgggaggctgatacggacggggatggccaagtcaactacgaggagtttgtgaagatgatgctctctaagtgagtcgggaaagtaaaagtcaaaagcgaaaagtgaaaagtaaaaagtaaaaaaattggtatgaattgggtttggttatgcatgtctctactggattctcacggtgtataaattt

SEQ ID NO: 830 - DNA, 624 bp, Artificial
  Synthetic
gccacgcgtccgccacgcgtccgcttctctctctctctctctctctctctcactctgtccagctcctcctcctcctcagcaatggcagaccagctgacagaggagcaaatcgcagagttcaaggaagccttcagcctctttgataaggatggagatggttgcatcacaacgaaagagctgggtaccgtcatgcgttccttagggcaaaatccaactgaagcagagcttcgagacatgatcaatgaggttgatgctgatggaaacggaacaattgattttccggaattcctgaatttgatggcccgtaaaatgaaggacacggactctgaagaggagctgaaggaggcattcaaggtctttgataaggatcaaaatggctatatttctgccgccgagttgcgtcacgtgatgactaatttgggagagaagttgacggatgaggaggtcgatgagatgattcgtgaagcggacattgatggggacggccaggttaactatgaggagtttgtcagaatgatgcttgcaaaataaaatcccccattccttgcactcaatctaacacaaataggttgctaatttgctttttgggataggttgtattaagcttgcactccctaaggaatg

SEQ ID NO: 831 - DNA, 638 bp, Artificial
  Synthetic
gaaagccctaaatcgatccatcgatccaccgggcatttcgtcaaagaggagatggctgatcagctgaccgaggaccagatcgccgagttcaaggaggcgtttagcctgttcgacaaggatggagacggctgtatcacaactaaggagttgggaacggtgatgcgatcgcttggacaaaacccgaccgaggcggagctccaggacatgatcaacgaggtggacgccgacggcaatgggaccatcgacttccccgagttcctcaacttgatggcgcgcaagatgaaggacactgactcggaggaggagctcaaggaggcgttccgcgtcttcgacaaggaccagaacggcttcatctcggctgccgagctccgccatgtaatgaccaacctcggcgagaagctcacggacgacgaggtggacgagatgatccgcgaggctgatgtggacggggacgggcagatcaactatgaggagttcgtcaagatgatgctagctaagtagtagaagatctgtttcctttttctctactttgttcctcgcctttcctctctctgtcttttctctttcctttttgttttggtaaagtccttcttccatgttaggatgatgattccaccacgtctaaaaccttttaaatt

SEQ ID NO: 832 - DNA, 470 bp, Artificial
  Synthetic
aaaaatattacaaatgtcgcaaaactccaaatctttcaaggacgccttttccctgttcgacaagaagggcaccggcaagattcctgctgaagctctcggtgatcttctcagagctgtgggccagaaccccaccctcgctgagattgatgatctgaagcagaccattcccgctgagttcgactacgagaccttctccaagatcgtcaaccgaccaagcggtttcaagtctctcggtgagcccgaggattacatccggggattccaggtgttcgacaaggactccactgggttcgtgggtgtcggcgagatgcgatacatccttacctcgctgggcgagaagatgtctgattccgaggttgatgagctccttaagggagtcaacgttactcgagacggcaacgtcaactacgttgacttcgtcaagtccattctggcccagtagatacctaatatattttttatgtttgagc

SEQ ID NO: 833 - DNA, 624 bp, Artificial
  Synthetic
gctccatcgatccatccaccgatcgatcgagctctacatcctgcgcaagaacacacgatggtagaggagctcaccgaggagcagattgcagagtttaaggaggcattcagcctcttcgacaaggacggcgatggctgcattaccaccaaagagctcggaacggtgatgcgatcgctgggacagaacccgacggaggcagagctccaagacatgatcaatgagatcgatgccgacggcagcggcacggtcgatttcccagagttcttaaacctcatggccaggaagatgaaagacaccgactccgaggaagagctcaaggaggcgttccgagtcttcgacaaggaacagaacggcttcatctccgcggcggagctgcggcacgtcatgaccaacctcggcgagaagctcaccgacgacgaggttgacgagatgatccgcgaggcaaacgtcgacggcgatggacagatcaactacgaagactttgtaaagatgatgatgtccaagtgatccagggaagtcgccattgattgctctgctcgctctatagatcaagggaatgcgaccacgatgtattgctctgtctctattgtgcaattccttgccacctctgtcttgtatggaata

SEQ ID NO: 834 - DNA, 631 bp, Artificial
  Synthetic
gtctctcctcctcccatctccgcttcccttcttcttcttcttcgttgatccactcacccgccgcgcgcagaggaggccatggcggatcagctcaccgacgaccagatcgccgagttcaaggaggccttcagcctcttcgacaaggacggcgatggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggtgtttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaggcagaggagattgtgtgttgcatagtcctagttaagatgcaacacttgttttatcaatttccagtgaagcatcctactagct

SEQ ID NO: 835 - DNA, 526 bp, Artificial
  Synthetic
cacagcccgcgcacctccacaccattagccatcaacgaccagcatctcggctttgctcgccttctcgaagcttctgctgccatggcggaccagctctccgaagagcagattgtagagttcagggaggccttcagcctcttcgacaaggacggcgacggttctatcaccaccaaggagctaggaaccgtgatgcgaagtctggggcagaacccaacagaggcggagctgcaggacatgatcagcgaggtggacgcggacagcaacggcaacatcgaattcaaggagttcctgggcctgatggcgcgcaagctgagggacaaggactccgaggaggagctgaaggaggcgttccgcgtcttcgacaaggaccagaacgggttcatctccgccgccgagctccgccacgtgatggccaacatcggggagcggctcaccgacgaggaggtcggcgagatgatcagcgaggccgacgtcgacggcgacgggcagatcaactacgaggagttcgtcaagtgcatgatggcca

SEQ ID NO: 836 - DNA, 593 bp, Artificial
  Synthetic
ccttatttcaaatttccagtaaaataatcgaaagagattatggcggatcagctgactgacgatcagatctctgagtttaaagaagcctttagcctcttcgacaaggacggcgatggttgcatcactacgaaggagcttggaaccgtgatgcggtcactggggcagaacccaaccgaggctgagcttcaagacatgatcaacgaagttgatgctgatgggaatgggaccattgactttcctgagttccttaacctgatggctcgcaagatgaaggacactgattccgaggaggagctcaaggaagcttttagagtgtttgacaaggatcagaatggatttatctctgcagctgagcttcgccatgtcatgacaaacctaggtgagaagcttacagacgaagaggttgatgagatgattcgtgaagctgacgtggatggcaatgggcagatcaactatgaggaattcgtcaaggtcatgatggccaagtgagaatccaacttaatctttaaaattaaagtacaacaaaaaggaacggcggataagtctgatgaggtttctatttctggttaggatgtcttctttggcttattagc

SEQ ID NO: 837 - DNA, 595 bp, Artificial
  Synthetic
ttcaaacttcaaagaccaatctttttgtttctccctttacgttctctgaattccagaagcttcttctccctctctcaatggcggatcagctgaccgatgatcagatctctgagtttaaggaggctttcagcctattcgacaaggacggcgatggttgcattacaactaaggagcttgggactgtgatgaggtcattgggacagaacccaactgaagctgagctccaggacatgataaatgaagtggatgctgatggtaatggaaccattgacttcccagagtttttgaacctcatggccaggaagatgaaggatacagactcggaggaggagctgaaggaggcattcagagtttttgacaaggaccagaatggtttcatttctgctgctgagctccgtcatgtgatgaccaaccttggtgagaagcttactgatgaagaagttgatgaaatgattagggaggccgatgtcgatggtgatggacaaattaactatgatgagtttgttaaggtcatgatggccaagtgatttccctcttctgcagtttaccttttttacactgaagaaagaccaaacattcatcagactgggtcagc

SEQ ID NO: 838 - DNA, 542 bp, Artificial
  Synthetic
gcagatcagctcacagatgatcagatctctgaattcaaagaagctttcagccttttcgataaggatggagatggttgcatcaccactaaggagcttgggacagtgatgcggtcattgggacaaaatccaactgaggctgagcttcaagacatgatcaatgaagtagatgctgatggaaatggaaccatcgactttcccgagttccttaacttgatggctcgcaagatgaaagacactgattctgaggaggagctcaaggaagctttcagagtgttcgacaaggatcagaatggatttatttctgcagccgagctgcgacatgtcatgacaaacctaggcgagaagcttactgatgaagaagttgatgagatgattcgtgaagctgacgtggatggtgatggccatatcaactatgaggagttcgtcaaagtcatgatggccaagtgagaactgatcaacttgacttaattcttagtagtaaaaaattacaaaaaaagaagctggcaacggagcagataaattggatgagatctctatatttg

SEQ ID NO: 839 - DNA, 716 bp, Artificial
  Synthetic
ctctccgggacggtctcgtcttccccacccctcgcctcctcgcgcgctcggtgagagaagcgaagaagaagaagaagaggaggaggaagaagccaggctaagcccagcggcatggcggaccagctcaccgacgaccagatcgccgagttcaaggaggccttcagcctcttcgacaaggacggcgatggttgcatcacaaccaaggagctgggaaccgtgatgcgttcgctggggcagaacccaacggaggccgagctccaggacatgatcaacgaggtcgacgcggacggcaacggcaccatcgacttcccggagttcctcaacctgatggcacgcaagatgaaggacaccgactcggaggaggagctcaaggaggcgttcagggtgttcgacaaagaccagaacggcttcatctccgccgccgagctccgccacgtcatgaccaacctcggcgagaagctgaccgacgaggaggtcgacgagatgatccgcgaagccgacgtcgacggtgacggccagatcaactacgaggagttcgtcaaggtcatgatggccaaggcggccgcttatccgtatgatgttccggattatgccgagctctacaaacagctgttgaattttgatttgctgaagttggcgggtgacgtggaatctaaccctggtcctaggtctagaatggctactttctcttgtgtgtgttgtggtaccttaactac

SEQ ID NO: 840 - DNA, 532 bp, Artificial
  Synthetic
gcgcgattgtgaattcgcgagcgaatgaaactcgtcgcatgctttggatcctgcttccgacaagctcccacgacttggcttggataaacctctaacctccattttggaatcgagtgtcctccatggctcgagaataagtcacatattcaatcaacagtatacatagttgtaatcgatacaccaatttctactggaaacgaggtttccatgggcttcatcgaacttctcttggagaaattctccatcacgaggttcttcctcatcatggctggcgtctggacagctgtattcatcgtcggccgcatacgagaacaccagaaaatcaagagcctcggcagctacggcccttctctaaagcctcttcttccatttggactggattttatctaccacggagctcgtgccacattccgccaacagacctttgcgctatggagggacgtcctcttctcccaattctggaccgtcgagatgcgcgtcctcaacgaacgagtctgcttcaccgctgaccccgagaacatcaacgccgtgc

SEQ ID NO: 841 - DNA, 798 bp, Artificial
  Synthetic
cggacgcgtgggctacacctcacctttctctctctatagaccaaacctaacctcaccatgtcttctcggaggcttctagcctctctcctccgatcaaccgcccaacgcggtggcgctatttccagatcgccattagcaaattccattcccagaactacttcacgcgcctcaccgaaaggattcctcttaaaccgtgccgttaagtacgctacctcagctgctgctgaaaagccgaaggcgactcctcctaaaccttccggtaatgaacctactggaaaaatcaccgatgaattcaccggcgcgggttcgatcgggaaagtgtgtcaggttattggtgccgtcgtagatgtgagattcgacgaaggtttgcctccgatccttacagcgcttgaggttttggataaccagatccggcttgtgcttgaggttgctcagcatttgggtgagaatatggttaggactattgctatggatggtactgaaggtcttgttcgtggtcaacgcgtcctcaatactggttctcctatcactgtccctgttggtagggccaccctcggtcgtattattaatgtcattggagagcctattgatgagagaggcgacattaacaccgatcactttttgccaattcaccgtgaagctcctgcctttgttgaacaggcaactgaacaacaaattctcgttactggtattaaggttgttgatcttcttgccccttaccaaaggggaggaaagattgggctttttggtggtgccggggttgggaagactgtgcttattatggaactgattaacaat

SEQ ID NO: 842 - DNA, 1154 bp, Artificial
  Synthetic
caaaccctcccccatggcttctcggaggcttctcgcctctttgctccttcaatcggctcaacgtggcggcggtccaatttcccgatcattaggaaactccatcccaaaatccgcttcacgcgcctattcacgcgcatcccctaagggattcctcttaaaccgcgccgtacagtatgctacatccgcagcagcaccggcatctcagccatcaacaccacccaagtccggcagtggaccgtccggaaaaattaccgatgagttcaccggcgctggctcgatcgggaaggtgtgccaggtcatcggtgccgtcgtggatgtgaggttcgatgaaggtttgccaccaattttgaccgctctcgaagtgttggataatcagatccggcttgtgcttgaagtggctcagcatttgggtgagaatatggttcggactattgctatggatggtaccgaaggacttgttcgtggtcaacgtgtcctcaatactggttctcctatcacggttcctgtcggtagagccacacttggccgtatcatcaatgtcattggagaggcaattgatgagagaggcccaattactaccgatcactttttgccaattcatcgtgaagctcctgcctttgtcgagcaagccactgaacaacaaattcttgtcactggtattaaggttgttgatcttcttgctccatacctattttgaggaaaaattgggctttttggtggtgctggtgtggggaaaactgtgcttattatggaactgattaacaatgttgcaaaagctcatggtggtttctctgtctttgctggtgttggtgaacgcactcgcgagggtaatgatttgtaccgagaaatgattgaaagtggtgtcatcaagctaggcgagaagcaaagtgaaagcaagtgtgctcttgtatatggtcaaatgaatgagccccctggtgctcgtgcacgtgttggacttacaggtttgaccgtggctgagcacttccgagatgccgaggggcaggatgtgcttctctttattgacaatattttcaggtttactcaggctaactcagaagtgtctgctttgcttggtcgtatcccatctgctgtcggttatcaaccaactttggctacggatcttggaggtcttcaagaacgtatcaccaccacca

SEQ ID NO: 843 - DNA, 653 bp, Artificial
  Synthetic
gctgattgctctctgtcatctgccaagatgttcaagagcggcgtttcgtccctcgcaagggctgcccgcccatcaattgccgctcgacgagctatccgaccagccttcccccgatcccccatcgtcaggcttgcaagcactcagagcgttggagatggcaagatccaccaggtcattggtgccgtcgtcgacgtcaagttcgacactgccaagctgcctcctatcctgaacgccctggagaccaccaacaacaaccagaagctggtccttgaggtcgctcaacacttgggcgagaatgtcgttcgctgcattgccatggacggtactgagggtcttgttcgtggtgccaaggcttccgacactggtgctcccatcaccattcccgtcggccccgccactctcggtcgtatcctgaacgtcactggtgaccccattgatgagcgtggacctgtcaagaccgacaagttcctgcctatccacgctgatcccccctctttcactgaccagtccacctctgccgagattctggttactggtatcaaggtcgtcgatctgctcgctccctacgctcgtggtggaaagattggtctcttcggtggtgctggtgtcggcaagaccgtcttcattcaggagctgatcaacaacatcgccaa

SEQ ID NO: 844 - DNA, 620 bp, Artificial
  Synthetic
gaaaaaaaagtctaaccctagatccaggccccgcgtctccggcgatctcccggccatggcgactcgccgggccctctcctccctcgtccgcgccgcctccaggctccgcggggcctcgcccgccccgcgcccgcgcgggccgctccaccgaccgtcgccatcggggtacctcttcaaccgcgccgccgcgtacgccacggccgccgcggcgaaggaggcggcgcctcccgcgcccgcgacggggaaggccacgggtggaggtaagatcaccgacgagttcaccggcgccggcgccgtcgggcaggtgtgccaggtcatcggcgccgtcgtcgacgtgcggtttgacgaggggttgcctcccatcctcacggcgctcgaggtgctcgaccacaacatccgcctcgtgctcgaggtggcgcagcaccttggcgagaacatggtgcgcacaatcgctatggacgggactgaggggcttgtccgcggtcagcgcgtcctcaacaccggctccccaatcactgttcctgttggcagggccacgcttggacgtatcatgaatgttattggtgagccaattgatgagaagggtgacataacaacgaaccacttccttcccatccatc

SEQ ID NO: 845 - DNA, 324 bp, Artificial
  Synthetic
cccacgcgtccggagggtcttgtccgtggaaggaaggttctcaacactggtgctccaatcactgtacctgttggaagagctacccttggccgtatcatgaatgtgcttggagaacccattgacgagagaggcgaaatcaagaccgagcattacttacctattcacagagatgctccggctttggttgatctagccactgggcaagagatcctggccactggtattaaggttgttgatcttcttgctccttaccaaagaggaggaaagattggtctctttggcggtgctggtgttgggaaaactgtgcttattatggagctgatc

SEQ ID NO: 846 - DNA, 573 bp, Artificial
  Synthetic
tgctatggcgtcgaggcgggcgctgggacagctcctccgcgcggcatcgcggacatcttcgtcttctaccaggcaagccttcccgggcggaattctcccggcatcgcggcgggcatctagggatcccctgggcgacggccatgcccttgccgggatcaggagcttcgccactgccgctgccgcgaagccgcagacggataccttgggctacatttcccaggtgattggagccgtggtggatgtcaagttcgacaaggatctgcccaacattctaaacgctctcgaggtccaagaccattccttccgggtcgtgctcgaggtggcgcagcatctgggcgacatgaccgtcaggaccatcgccatggacaccaccgatggccttgtgagggggcagaaggtcttgaacactggggctccaatcactattcctgttgggaggtgcaccttgggccggatcatgaacgtcattggagagcccatcgatgagcttggggattttgtcaccgatcatttcctgccgatccatagggaagctccggttttcacagagcagtccactgaacaggaggttct

SEQ ID NO: 847 - DNA, 519 bp, Artificial
  Synthetic
gattcaatatctttctctcgacgtggttcgatttcgattcgacgtatcggtgggggggcatgaataaggtaatggttgtgtttagttgggctcgaaactaatgttacccatcagtagtatcacctattgctgacgtcggcttgaggaagtgggttcaatcgtgatacattcggctcgtacagtgcaatacagataagatgatgcgatcagagaggcaattgttaggtcatgattgacggaggattcgagccgatgatgacaaggcgacaagagctgggcaatcgaccccaattggatgattctggcaccccaagctgtgaattcggcttgacctttgaacatcaacttgctgtagggtagtgcaaccttggacgtaaagagaaggcagcgtcagcatttgttagcgcacagtacctacctgtatgtatgtatgtccgtccatacaactttgatgagaccgagaccgagataaaaagtgagcggcgtcagtgcccaacttggtataaaggcttgaagaac

SEQ ID NO: 848 - DNA, 648 bp, Artificial
  Synthetic
cccgatccctagccactttactcctattcgcctccaccaccttttcatttcctatctcctcctcttttctcttctgctcagttcctctctttcacatacacactcacaaaaaaaattcgattatggccggaagcggtgtggtaacactttacggaaatggtgcactcaccgagactacaaagcaatcccctttctcagtgaaagtgggtctcgctcagatgcttcgcggcggcgttatcatggacgtcgtcaatcccgagcaggcccgtatagccgaggaggcaggcgcgtgtgccgtcatggcccttgagcgcgtccccgctgatatacgcgctcagggcggcgtagcccgcatgtcggatccccagcttatcaaagaaatcaaacaggctgttaccatccccgttatggccaaggcccgtatcggtcacttcgtcgaggcccaaatcctcgaggctatcggaatcgattacgtggatgaatcagaagtcctcactctcgccgacgatgagaaccacatcaacaagcacaatttccgcattccttttgtctgtggctgccgtaacctcggcgaagccctccgccgtatcagggagggagccgccatgatacgcaccaagggggaagccggtaccggcaacatcatcg

SEQ ID NO: 849 - DNA, 274 bp, Artificial
  Synthetic
ctcttgaacgtgttcccgccgatattcgagctcaaggcggtgttgctcgaatgagcgatccagagatgatcaaagaaatcaaaaacgccgtgacgattccggtgatggcgaaagctagaattggtcatttcgttgaagctcagatcctggaagcaatcggagttgattacgtcgacgagagtgaagttctcactctcgccgacgaagataatcacatcaacaaacataatttcaaaatcccttttgtttgtcgatgtaggaatctcggtgaagc

SEQ ID NO: 850 - DNA, 713 bp, Artificial
  Synthetic
gcgaagctttgtcgtttttgataaattgtcacccaatttggttcaggcattttcatcaacaccttgcaaatggaagaagacagtgccgttacagtgtacagtggcagcgcaattaccgacaccaagaagaatccgttctcaatcaaagtcgggctggcccaaatgctccgtggaggagccattgctgaggtcaccaccgtcgaccaagcgaagatcgccgaatccgccggcgcctgctgcctcgtagtatcggaacctaaaggacccggaatctcgcgcatggccgacccatctgtaatcaaagcgatcaaacaggccgtctcaattcccgtaatggcaaaagcccgagtcgggcattttctggaagcccagatccttgaagctattggagcagactatgtagacgagagcgaggttttagccttagccgacgaagatcatttcatcaacaaacacaatttccgtgccccattcgtctgtgggtgtcgagatctcggagaagcattaagaagagtccgtgaaggtgctgcgatgattaggacccaaggagatctattaggtacaggtaatattgtggacacagttcgcaatgtgaggaaagtgatgggagatattagagttctatcaaacatggacgaagatgaggttttcactttttcaaaaaagatctccgcgccttatgatatcgttgcgcaaacgaagcagatgggtag

SEQ ID NO: 851 - DNA, 605 bp, Artificial
  Synthetic
acaacacacacacaacacaatgtctaccgtcgagaagtcttttgaggagcagttcaagctgcaggccggtctggcccagatgctcaagggtggcgtcatcatggacgttgtcaacgccgagcaggccaagattgcccaggaggccggagccgtggccgttatggcccttgagaagatccccgccgacattcgagccgacggaggagtcgcccgaatgtccgaccccgctatgatcaaggagatcatggctgccgtgtccatccccgttatggccaagtgccgaatcggtcactttgtcgaggcccagatcattgaggagattggtgtcgactacattgacgagtctgaggttctgacccccgctgaccagttccaccacatcaacaagcgagacttcaaggtccccttcgtttgcggtgccaagaacctgggtgaggctctccgacgaatccacgagggagctgccttcatccgaaccaagggtgaggccggtactggtgatgtcaccgaggccgtcaagcacatgcgaaccatccagtccgagatcaacaagacccgacacatgtctgagattgagctctacacctacgccaaggagattggtg

SEQ ID NO: 852 - DNA, 707 bp, Artificial
  Synthetic
ctcaaataaaccactcaatcgattccttgataccccttgggacaaatctacttgttctctccaaacttacccctccaaataccatcatcaccatcaccatgaccaacgacgtctctaccaacggctcttctgccgctcctgcgaccacctttgccctcaaggctggtctcgcccagatgctcaagggcggcgtcatcatggacgtcaccaacgccgagcaggcccgcatcgccgaagaagctggtgcctgcgccgtcatggccctcgagcgagttcccgccgatatccgcaaggacggcggcgtcgcccgcatgtccgacccggctatgatcaaggagatccaggacgccgtcaccatccccgtcatggcaaaggcccgtatcggccacttcgtcgagtgccagatcctcgaggctcttggtgtcgactacattgacgagtccgaggtcctgacgcccgccgacgacgagagccacgtcgagaagagcccctttggcgtgccctttgtctgcggctgccgcaacctgggcgaggccctgcgccgtattgccgagggcgctgccatgatccgaacaaagggcgaggccggcaccggtgacgttgtcgaggccgtccgccacatgaagactgtcaacagggacattgcgcaggccaaggctgctcttgccgagggcggtattgttcgtctccgcgagcttgctcgtaag

SEQ ID NO: 853 - DNA, 455 bp, Artificial
  Synthetic
gaattcaagcaggtgcttgtgctgtcatggcattagaacgtgtaccagcagatattcgtgctcaaggtggtgttgctcgtatgagtgatccacagatgattaaagaaatcaaacaggctgttactattcctgtcatggctaaagctcggattggtcattttgttgaagctcagattctcgaagcaattggtgttgattatatcgatgagagtgaggttttgacccttgctgatgaagaacatcatattaacaagcataatttcaggattccatttgtttgtggttgtcgtaatcttggtgaagccctaaggaggattcgggaaggtgcggctatgattcgaacaaagggtgaagctggaactggtaatgttgttgaagctgttaggcatgtgaggtctgtcatgggtgatatgaggcttgtgcgtaatatggatgatgatgaggtgtgttcatat

SEQ ID NO: 854 - DNA, 702 bp, Artificial
  Synthetic
ttgaacaatctaccaacatcacaagcaattcaccatgttgagcttcctcggaaaatcggtagccttgctggctgcgctgcaggctactctcagctctgcaagccccctagccacagaagagcgctctgttgagaagagagccaacggatacgcaaactccgtctatttcaccaactggggcatttacgaccgcaacttccagcctgccgatttggtggcatcagatgtcactcatgtcatctactcattcatgaacctccaggcagacggcacagttgtctctggcgatacctacgctgatttcgagaagcactatgccgatgattcttggaatgatgtcggcaccaatgcctacggctgtgtcaagcagctgttcaaggtcaaaaaggccaaccgaggcctcaaggttctgctctccatcggtggctggacctggtccaccaacttcccctctgcagcaagcacggatgccaaccgaaagaactttgcgaagactgccattaccttcatgaaggattggggtttcgatggcattgacgtcgattgggagtaccctgcagacgccacccaggcctccaacatggttcttctgctcaaggaagtccgatctcagctggatgcttatgctgcccagtatgcccctggctaccacttcctcctcaccattgccgcaccagctggcaaggataactactccaagct

SEQ ID NO: 855 - DNA, 658 bp, Artificial
  Synthetic
gcaaccatttcgtcatcggaccatagcactccccaaatacctcactcttctcgctgatctggtcctgctcttatccctcattcccatcatcaacttttccacatctcgaacaaatatgtcgggagacggctatcgttcagtcgcctatttcgtcaactgggccatctatgctagaaagcatcgcccccaagatctccccgttgataaactcactcatatcctctatgcctttgccaatgtccgccaagatagcggggaagtacacatgacggatggctgggcggacacagacatccattgggagggcgactcatggaacgacacgggaaacaacatgtatggatgcctcaagcagctgaatcttctcaagaagcgcaaccgcaatctcaaggttttgctgtccattggaggttggacgtacagcggcaacttcaagggccccgccagcactcagcagggccgtgagacattcgccaaatctagtctcgagctgctcaaaaacttgggtttcgacggacttgatatcgattgggagtatccccagaatgcagacgaggctaggaatttcgtcgagcttctcgccaccgtccgcagagagctggatgcctattctggctaccttccaaactacagccactttgaactgactgttgcttgt

SEQ ID NO: 856 - DNA, 292 bp, Artificial
  Synthetic
ggttctcaaagtcttccggtgccgccggccgtttggctgcggaccgaaaggtggacaggaatcaactcgtgatgagatccgggaaatggcggcctccgccgggatttggattccattctttcgttttttgttggtttctaacgttgatgaccattcagtggcggcggctatgaaggatatgatgagaggtggtgcttatgccggtgtgtatcaagtaacgagtccgcctggtccaggcatcatcatacgatccatcaatcataatcaaggggaacacagaggcaaatcttct

SEQ ID NO: 857 - DNA, 653 bp, Artificial
  Synthetic
gcgtctgaagctcttcgctgacccgctatggcggggtcggtgtcagcgaagcctcgcctctgtagcctcgcaacaatcgcaatcaccatcgcagtatgggaaaccgccctttcgctttgagacgggcattgggctgtttgcaaagcggtcgcctcggccgttcccgccgcccttcttgtcccctccatctgtatccttctcagatcccctaagcacccatcaccagagtcgggaccgtcgagctcgcgcctttgtgaatggagaactcattaaaggacttacgaatggtgacgatgccgtgtatgctagcgactatttcatatgtgcaaacgatggcgtaggcgcgtgggcagctcgccccagaggtcatgctgggtaatatatccctcccgtgacttggaacacgcatgctgtaggaatgcgtccctgacgtgagaaacaggttgtggtcgcgactgatattgcacttctgggcgacggccatcgaagaagagtcggcgcagaacctattccagcaaaaggcctaccagcctgaccccgttgcgtctctgcagacggcatttgagcaaacacaagaagcaaccggtgctcatgactggcagggaacaacgacggtgtgcggtgctcaactccattataaaacgttgacagat

SEQ ID NO: 858 - DNA, 640 bp, Artificial
  Synthetic
gcaacggccgtggtcagcgacccgacaagtcgtagcttgctgtacatggttggaatgcgcacatcaccctctccatcgttggcgactttcctgacatctccatctccatcgcgtctgaagctcttcgctgacccgctatggcggggtcggtgtcagcgaagcctcgcctctgtagcctcgcaacaatcgcaatcaccatcgcagtatgggaaaccgccctttcgctttgagacgggcattgggctgtttgcaaagcggtcgcctcggccgttcccgccgcccttcttgtcccctccatctgtatccttctcagatcccctaagcacccatcaccagagtcgggaccgtcgagctcgcgcctttgtgaatggagaactcattaaaggacttacgaatggtgacgatgccgtgtatgctagcgactatttcatatgtgcaaacgatggcgtaggcgcgtgggcagctcgccccagaggtcatgctgggttgtggtcgcgactgatattgcacttctgggcgacggccatcgaagaagagtcggcgcagaacctattccagcaaaaggcctaccagcctgaccccgttgcgtctctgcagacggcatttgagcaaacacaagaagcaaccggtgctcatgact

SEQ ID NO: 859 - DNA, 428 bp, Artificial
  Synthetic
gaccattaccatcatacagccaacctctacataagcacaaataccattcaaaatgtcttacggcggtgacaacaacgacaactacggctctcgccgtaatgacgacaactttggctccggaggagattctttcggctctggtggaaaccagcaatatggctccggaggagactcatttggctctgggggagattcatacggctctggtggaaatcaattcggctccggcaaccgccgtaacgatgacagctcatttggtaccagtggccagggcgagttcggctctggaggtaactatggcagctctggcggtgactcctatgggtctggaggaaacacctatggctccggcggcaatgacaactttggctctgggggcaatgatacgtacggctcgtcccgtaaccaagagtcttcttttggatcca

SEQ ID NO: 860 - DNA, 249 bp, Artificial
  Synthetic
acacaattcctcgctgcgtgtgactcgtgtctccagcaaataccgcaaagatgtctgacgacgggctctcaatatacgatgagatcgaaatcgaagatatgaccttcgacgaggttcttcaaacatacttctacccgtgtccctgcggcgatcgtttccagatcgctatcgatgacctgcgcgacgagcaggatattgctgtgtgccccagctgtagcttgatgattagagttattttcgaccttgacg

SEQ ID NO: 861 - DNA, 385 bp, Artificial
  Synthetic
gacaatttgttagtgcagggtaatatgttccaggtaggcacatgtatggagagcctgtacaagccaccaatacgttgaaatgagctaaccagtgtgttactgttcctggtcacactaatactacagagtctatgtcgaagagatgacaacaattgttctgaaaacccagaaataactcttcaacgcattgaatgtttggtcgcgtttaagattatggtgccaatccccggccggtggctggtgttgttgccaagaatcgtcttcgtatagcccgcatagagtacaccgtacttatcgctataccagaatcaatacgtgtgttctcagcaatgtatttgcaccaacaatctctttctgatgtctttctggaatctataactcgtac

SEQ ID NO: 862 - DNA, 649 bp, Artificial
  Synthetic
aagccctcacctcacataaacacgggagaactacattcaagatggatttctctaaattcagcaagggtttctctgatttcagtgcgcagattactccgtttgcgtcacggaccttccagtttaccaaggagcagttgggccaagcagatgatcgaactgagcttcctgccgattacatcgacctcgagaaaaaggtcgatgcgctgaaacaagcccaccagaagatgcttgcggtgacttcgcaatataccaacgaagcctatgactatcctcccaacatcaaggagacatttcaagatcttggccgaaccgtgagtgagaaggtcagccttctatcttcggctacatctacttcagaggcccaagcagctcttgtggctccagcatctgcgaagccgcaaccaaagactttcaaccatgccatctctcgtgcgagcttatccagcagccagctcctgcaccagcaccacactggtgctggcgaagatcctctggcaacagctctcgagaaatatgcactcgcgatggaacgagtgggcgacgcgcgccttgctcaagattcacaaatccaaagccgattcctagcaggatggaacacaaccctcaataccaatcttacctttgcggcgcgtgctagaaagaatgttga

SEQ ID NO: 863 - DNA, 772 bp, Artificial
  Synthetic
ggcgggttgacgtgatgcttgaccatgtcccatattcctagagccgatagcacccacgcgaggcgggcgtgattgattacgctttcgcaggagctgagcacgcaaaatggctttgtgaccttttgcctccttcagcatgctctactctctgtctctatatgggtattgtttgatgggttactgaatcggtgctgatagcagatatcgggcttgattcgcgattcggagaagaaaaagctggaggcaaggctcggcgagaccgatgtcggatactacgcatagacgattgcttgggatggcaaacacttgaagatcgaaatttctcgagctttcatgttcatggggctgtgatagtcttagggattttgacgaccaccgatgctgaccttccctgtatttgctcatttgataccctgccactgcgacgagccagcaacggtgaaatgagatacagactcatgatgcgaaaggatatataagaacccaaagtgtcgcttaatgtcgtttaattagatggctataccggacccgtccctgattgtgttgctcaatggccttcttgtatgctatatctgcaggaggcgagagcaatatcgccttgacatcccctgtcattcgccttattgattccgctttcagatataattgtttaatgtgagatgccgtatatgttggaatatgtgtcgtgtaatagctttcgactggattcgcatatatcgggcgctgatggcatgctatacatatgtatgtcgataccatagctacatatatg

SEQ ID NO: 864 - DNA, 456 bp, Artificial
  Synthetic
acaaatcagctcgaatccatcaccatggcagacatcacagaagaaccccaggccctccctgtcgatgagacgcccatctcttccgtcaagaccaactccgctcgcaagaactctctttccaactacctcaagcaccgacccgaacgctccgagctggtagagaagaacattctcccagactctacagccgcacccggcctcctcgctcagcaaaaagagcttcagaaacacatgctcggagacaagctcaacgacaagatttcacatcgtccctcccccgacgccctcctcaaggaaggtgtcttacacgaagacccccgctccccagaggaaaagtacgccgaggccatcgaggaggagtacgctaagcgggagggcggcgcttaagcagcattagagctacatggcgaacacggatgctgggaaatgcgaacttgttttttctttttttttttt

SEQ ID NO: 865 - DNA, 951 bp, Artificial
  Synthetic
agaaatcgtaccacgtcaattagaataaaggccccaagcggcgaatcgatttgaagccgccgtgctacatctctttttgcttcttctctttgttttatatgtcgtgcttcattcgcatcgattgatttctcaagctgcggttccgtcatcgctaatgcgcattcacatgtgcttgtgcttatcgcatcacacatgacccgcgcaaaatgtcatcctcaccaagccaaacccccggctctggcgacgccagcaaggccacgccctcgggagcagcagtaaacgcagatgacaagccgcggctcacagaggaagaaaagaagcagaaccacattgcatcagaacaaaagcgccgtcaggccattcgcgagggcttcgatcggctgactgaactcgtgcctggtttggaagggcaaggtcgctctgagggactggttctgaagcgtaccgtggattacatgcgcgaccagattgtgcagaggcaggccttgattgagcgtatcgagcaggcaggcggcagcgttgaccccaagtacaaaaaggtttcacaactgtcaagacaagggcttggccggtgagcggcttcccgatgtttgcgttgccctcagcttggggtgagagtcgaggatcgagcgagattgggccgcaaagtcatcatggagtcagtttgatctccccatgactgctgcagaaagcagaagtcgtcgcggcaggtcaagcagtgcatgatgggactacatcgatcatcgtccacgttgcagcctgcatgtgcagtttgtcatgtcacgacgaaccaaaaaagtatcaacatatatcctcgaagtcgattgtttatttgaagattggaaacgggcttgtgatacccatctcgaaccaggggcggtggataaataatagaaggatagaggtcaatatttggcgtggttggatgggagtaatagatgagagagttgt

SEQ ID NO: 866 - DNA, 576 bp, Artificial
  Synthetic
ttcgcatgcaaacagcaattccaagccaggggcaaatctcacaatgcttcgtcaagtaaaaccccgtaacgcccgctccaagagagccctcgagaagcgcgagcccaaggccgtcgagaaccccaagacatgcctcttcctccgcggcaacaactgctcccaggtcgtccaggacgccatgaacgacctcttctccatgcgccagcccctctccaagaagttcaccaagaagaaccccatccaccccttcgaggacgccgcctccatcgagttcttctccgagaagaacgacgccagcctcttcgtctttggcagcacccagaagaagcgcccgcactcgctgaccttcatccgcacttttagccacaaggtgctcgacatgctggagctgtacctcgacaacgagagctaccgctccatctcgcagttcaagaccaagaagtttgccattggcatgcggcccatgatcctcttcgcgggaagcgcctttgagagccctgtccccaacgagtacaccctcgcaaagagcttcttcatcgacttcttcaagggcgagccctcggacaagatcgacgt

SEQ ID NO: 867 - DNA, 724 bp, Artificial
  Synthetic
cctacatactcatccttcacgcttcaatcacccttgaataatgaacgaggaaaagctcggccacagtaatcatgaggacattgtgcctccagaatcctctactggagatgaattacagacaccatctacggattccaagggcaaacagaaggcaggcctggagttagcagcatctcaacttggggcctctacaaagctggtcgtcaatgccatcacaacgtttcgggaaatgccagctttggcatcagaatcaaagtcctctcatggttcaagtagcatgggctcgttttcatctatcgctggcgagtactcgtcatacaaaccactccagaatccgttgcttgacgagactactcatgagggccaggatgatttgtttgagacgtttatcaagagttcaacggatgcgttggtaaatgatggctatcaagtagacgtttcaggatcctcatttgcagatcaagaagcatcggatggcttggccgtttttgaatttctctcacagccaggaaatgaatcgatcgagacggccatttctagggaaaatgattttcagatctcaggcgaggatgaatcatggagtgaagctgtggctggaacactcatcgatgagaacgaccaacttgattttactcctgattttatcactaatcccgaactgtcttctcaagcagcgccgtaccttggaacaacgaacattgaagaaacaagttatacttggttt

SEQ ID NO: 868 - DNA, 613 bp, Artificial
  Synthetic
gtcggattcaggcctcagcgctcggatcggcctcttttcctctcttccctctctgctttccatctgcccagcagaccgagtttggcagcgcaatgttgcctctatcggtgcggcgcgcggtggccgctgctcctcagggggcaagtgggctgacttctctcgccgcgtcggctccaaagatcacagcctcgagcttcatcctgaatcgtcctcagcggcgctactcctcgtcgaaaccctcaagatccgatgagcccaacgatattgctgccggccagtcggtgccggcatctacctcgcgcggagagagcaaaggcagcaggaaacgaaagagcaaggattcagccgaccgaaatgcggctttcaagaaactgcccagtgtccctagcactcaccacatgtctcaagaggccctgagcttatcgagcttcttctcactccaccgtcccatttccatcacccagaccatgcccaggactgttaccgacgagcactttgcatccatatttgcgcctcgatcaaaatcgaacaggatacgagacactgtctctacaatttctgacaccattgagcagctggaaggccccatggctcaggtgacaataggatctca

SEQ ID NO: 869 - DNA, 689 bp, Artificial
  Synthetic
cccacgcgtccgcaactacaactacaacactactacaaacaccaactactctcttaccacatcttccaatctcaacttcacactcaataactcaaatcaccatcaaaatgcagtccgctatcgccttcactgtctccctccttgcccttgttgcctcggcagctcccaccactcgcaccgttggcactgttcaagtccagtttgccaacgatgtcactggagcaaacggcaatgcccgtatccctcttgacggatccaacataaaccttggagaggcttatggcaacaccaacctagagaaggacggcaccctctttgtcaccagccttcagttcactgccgacttccagaacgtccagtgcgttgtcctcaaggacttccagaccagagtcgccttcattgccgaccctcaccaggacttccagaccttctctcagaagcccctggactggcagaacaacttcaccattgcttgcaatgtcgcttcttcttaagcattcttctaagaattctcttaagcactctcttaagcactctcaaggtcgcggggtagaatggacaggtctttggaggggcgtcgatttggtttgatttttatctcctttgtcagggacggaagcgatcggcttagcacaaatggccagagcgtatctagttgatatataactgagaactacatcattttagac

SEQ ID NO: 870 - DNA, 1069 bp, Artificial
  Synthetic
gctcgactctcactttcttcttttcatccctcactcttctctcatcttctctccaatccccaatcctcaataacctacgccgtgtcagtcaagcagctgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagcaggagggcgtcgtggcccagggcaaggctgccgtttccaccgccttcgtcattagcaacgaaacgctggcctggctgagcagctgggtcgctgtcaagaaggccgacgcctctgaggctaccaaggagaagatcaaccagtagacgatttccggagtggattacaagcgaaacagcgcatcatttcctttcttgaccggccctctctctcttctttgtctttctcttcttacccttttgttggcattgagtcgactttctctgtcactggatctcatttgctttgttgatgccagttcgcttttgtgatgaacagcacctagagaaaagggggaagaagggcaggctgcttcgtccgctgcgactaggcgtctacgtctggcatcatgatcgccactactagctagtggccaagctctgacgcatctcgtttcgatttcatctctctttgattccttgtttcggcggactatg

SEQ ID NO: 871 - DNA, 634 bp, Artificial
  Synthetic
aataacctacgccgtgtcagtcaagcaggtgtacatcatcgcatatcgaccgacgacgaccttgtcctgcgtcttccatctccaattctcacccaccacttacaccatcacacatcacaatgcctgctcctcaggttaacggcgaggtcaccagccatgtcaattccgccttcctccaggtatgcatggataaaagaagagattcgccttgtcatcacacaatggcaaatgcgaatcgaaccgaatcgtgatggcttttggtccggttattgatcatattggcagcacctcttctcctatcctctagttagcgacggcattcacactgtgaccaccaacgaatacgcacagcggcctatcaagctgggcgaatctgcctataaaacttttgccgcccctgttcttccctacttttccaagccctatggtattgtctctccctacgtccagagggccgactcctttggcgacaagaccctggaccgcattgacgagcgttttcccattgtcaagaagcccactggtgatctctacaacgagacccgtggtctgattctgttcccctaccagaagggactcgagggcaaggagcacgttttcaagatctatgcttccgagcttaagaagcttgagc

SEQ ID NO: 872 - DNA, 817 bp, Artificial
  Synthetic
gaatgaaaggggaaaaaaggccagcatggcacgctcgcacccaagaacaaaaaaaggccggagcactaataggcacggcatgggggcctcacgccatcgattgtgtaataggcgtacgacggttacgacaggaacgtgccacaaaaggaggggtgggaaaacggatgacgggaacaaggaggaaaactggctctttaagttccaactttgttgccaatagccagtcgctgctgtctgtgtttctagtttctacggagcatgaacctgtgagaacaagccacatcggggagacgggaagatggtgacacggatgcgtttgtggaggtgggtaagctttgcgcaacatgtgccagccttatcttgatattggacgcggcgacggcgagatggttggaagggtgtgtctatgtgtaccgacaaacgcatggctgatgagacggtgaataaaactgcaccaagaaagagatgcatgagagatgaatgaccagtacctaaggtctatgacatgtcgctttgcactcggtcggactcattcacatgtagtaaatactacataacacccacttgctccagtaatcatcacttataataatacggcgagaagacaagttgacacagggcgaaacagggcggaacaaggggcgaagcgaggtggaaaatggtaaacgcagagactctttctatgtactagccatcgatcaaaaggaaggacagctcagtcttcgctgcatgctaaagcagcggccgatgggatggggctccaaggcaaggtgtaataccgagtacatgcatatcaaaaaagaaaagacgaaacgtt

SEQ ID NO: 873 - DNA, 829 bp, Artificial
  Synthetic
gcacgtttgggcagcatctttatgatacaatgatgaacgtctccttctctaccggccgcgctgcgctgcgcctcagccgctcgtccttccgccacctgtgcgcatccagagtcgccggctttgcttaccactcctatccgctgccgtccaaaatccccgagcctcccacaagcgacaacctctccaagtcatcccttgcccagccagaggcccttcctcgcgtccacgagacacggccgcctcctcaacacgatgccgtacccaagccgatggccccaccgcaggttgaagctcagtcgccttctccaacaacctcctcagttcctccatctcccaaagccgccgagaccgatgcgcaaaagacacagcctgctcccgctgctcgacctcgttccaagcttcgcgcgcgcaaggccgcaatgaagctcacacccgccgccgtggagcagctgcgcgcactgctcaaccagcccgacccgaagctcatcaaggtcggtgtgcggaaccgaggctgcagtgggctcgcataccagctggaatacgtcgataagccgggcgctttcgatgaactggtggagcaagacggcgtcaaggtcttgattgacagcaaggcactcttcagcatcattggcagcgaaatggactgggcggaagataaactgagtcagaagtttgtgtttaagaaccctaatattaaggagcaatgcggctgcggagagtcatttatggtctaaggagcttgtgaagctacaaaggaacaagacaaaggccatggcacatgagaatactaccaaggccgatgtatggagagattgtacgatgacgacta

SEQ ID NO: 874 - DNA, 654 bp, Artificial
  Synthetic
aagatgctgcgctctatgggtctacgaggcaatgccttgacgcagaccacccgactggctgcatccagggccatgtcgagccaggcgctctccaacccgaccctgtccaacatcgagaaacgctgggagggaatgcctctccaggagcaggccgacctgtggatggccctgcgtgaccgcatgaagggcagctggaacgacctgaccctgcaggagaagaaggccggtaggtggtgcaccttgagtttttcttactggatcgccttcggccctcacggcccccgcaccgttgacgctcccggagccggtgcccgtgttgcctggggagttgccgttggccttgccgcctctctcgctctcttcgctgccatccgagttgccgccaagcctgcgccttacaccatgaacaaggagtaccaggaggccactaacgagcttctcaaggctcaaggtgctgatcccctcactggtatctcttctcccggctatactggcaagggtgttgttcagtctcctcccaaaaactaaaataaaacacgataatatcgcttcaagcttcgcacaattggggcgggcatgggagaagttttatcaaaacgacatttgtacatgtatagctttagtcctagagagtatgcaagacagggttctcgc

SEQ ID NO: 875 - DNA, 100 bp, Artificial
  Synthetic
cccacgcgtccggggaattaaatcccctcgctgcactaccgcaaccaccgtcaacctcgctgctacctctcaattgaactcgactcgagctccgtcaatc

SEQ ID NO: 876 - DNA, 581 bp, Artificial
  Synthetic
aagtaacttaaatacccattctcaccactaaacatggttgtgcagaagatggaggataaaaatgctagaagaaacaaatataaagtaacacaactcaaaaactagcaaaattacagcctgaacaaggctcaagccaacatagaaagttccttgttgcattgaacttaaattttgttgaaggcaacaatatcacagctctgcacatattcattgataggctctactgttaatttttcctcaacgagagtgtccacagagacaaggtcatccacgatggtaagcatgatctgcaatttcttaatcccgtagccaactgggaccaatttggatgctccccaagtaagcccttcttgctgaacactgcgaacagcctcctccagcagcttcatatcagtctcatcatcccaaggcttaacgtccaaaagaatggatgactttccactctctttcttcttggtagatgctttagtagcctcccttgcttctgctgccttcttttcctcctctgtctcttctccgaagagatcaatatcatcatcgtcatcatcatctgcagccttggcagcttccttagctggagc

SEQ ID NO: 877 - DNA, 325 bp, Artificial
  Synthetic
gcagaggagagggatgctgctaagaaggacaccaagaagcctaaagagagtggaaagtcttctgtgctcatggatgttaagccatgggatgatgaaaccgacatgaagaaactggaagaggctgttcgtggtgttgagatgcctggtcttttctggggagcctcaaaacttgtaccagttggttatgggatcaagaaactcacaattatgttcacgattgttgatgacctcgtgtccccggacaacctcattgaagacttcctcacctcagagcctaacaacgagtacatccagagttgtgacattgtcgctttcaacaagattt

SEQ ID NO: 878 - DNA, 577 bp, Artificial
  Synthetic
actgaattgtcacttttcattaaatatcaaaatggaggagagatggcaggccataacagagtcaaaacaacagtctacaaaaacttgggaaactgaatatagaagaagaagaagaaccagaccacatgaacacagacattccttgaagctttctccatcctcatatcttgttgaaggcaacaatgtcacagctctggacatattcattgatcggttcaacagtgagttgctcttcgatcatggtgtcaatagagacaaggtcgtcaacaatggtgcacaaaatctgcaacttcttgataccataaccaactgggacaagctttgatgctccccaaaacaaaccttccatctgaatggacttcacagcttcctcaagcttcttcatgtcagtctcatcatcccacggtttgatatcaatcaaaactgaggactttccagattccttcttctttgtagatgccttgacagaagctgctctctcttcagcagctttcttttcctcttcggtctcctctccgaaaaggtcaacatcatcatcatcttcttcatcagccgcagcatccttagaatcagctgc

SEQ ID NO: 879 - DNA, 764 bp, Artificial
  Synthetic
gtcttctgtcatcgccagatcgtgaaagacttgtattattatcaagcaatggctgttgcattccagaacctcaactctgattctggtctcaaaaagcttgatgagtacctcttgacctgcagttacatctccgggtaccaagcctcgaaggatgatatcactgtgtattcatatctagcaaaagccccatcagctgaatatgtgaatgcatctaggtggtataagcacattgatgcacttttgagaatctgtggtgtatctggggaaggtgcccgtgtcaccgtagagggatctgcaccaatcaccgaggaggcagtggcaactcctcctgctggtgacactaaggcctcagctgctgaagaagatgatgatgacgttgacctatttggtgaggaaactgaagaggaaaagaaggctgctgaagaacgtgcagcagcagttaaggcttcagggaagaagaaagagtctggcaagtcctcagttctcttggatgtcaagccatgggatgatgagactgatatgaagaagcttgaagaagctattcgaagtgttcagatggaaggattgacttatggagcatctaaacttgttcctgttggatatggtattaagaagctgcaaatcatgcttaccattgtggatgacttggtctctgtggatgatctcgttgagaattattttatggctgaacctatcaatgagtatgttcagagctgtgatattgttgctttcaacaaaatatgaattctattactctctgaagt

SEQ ID NO: 880 - DNA, 407 bp, Artificial
  Synthetic
gccgagatatccggctctttgggcgatttgggcaccctgcttcccctgatgatcgccctcgcggccaaggggtacatcgacctgggctcgacgctcgtcttttccggcgtcttcaacgtcctcaccggagttgtctttggcatccccttgcccgtgcagccaatgaaggtatgtcatgtccaagtactactgctattactacagtagcttgctgtactcgtacgaatatgtatgctgtgtggagcactctttaccccctggatttagacctcggtactcgatacgatactccgtatacatgcctacatacaactacacacatacatgactgtcttcttatctgcccaaggagccttacttttttgctaatcctcttcccgcctcatgtgggtacttaggccatcgcc

SEQ ID NO: 881 - DNA, 631 bp, Artificial
  Synthetic
  misc_feature (548)..(548): The residue at this position can be any nucleotide.
acagagccgatcaaataccgccaaaatgcccaaggaagtcgctgacatcaagaagttcatcgagatctgccgtcggaaggacgcttcctccgcgcggatcaagaagaacaagaaggcccacaacatcaagttcaaggtccgatgccagaagaacctctacactctggtgctgaaggacaatgacaaggccgagaagctcaagcagagcctgcctcccaacctgcaaatcgcagaggtccccaagaagaactaaggaaatgaattggtggtaaaataggggtggctttgggcgtgggaagggtttacatgcacaactgggcgtctcgggataccttgcatttcatgtgctcagaacgcacgctcgcaatagagctcaaaaaataacgatttgagacacaaaaagcaacaatcgcacaccaaaatctggtgagcccgatgtctttcttgtgccggctatgctacctgaagaaagggagcccccccggttactcggtgatgcctatttacacgacgtgcctgaagcggcgatgatctttcttgagggcgangctcgccaatccttccagtcgtttcttcggaacatcgccagtccagaatacaatcaaatcttccttgtcttcctcaaaaaaaa

SEQ ID NO: 882 - DNA, 627 bp, Artificial
  Synthetic
gacctgcaagatgttaccgccagatcaagaacaagccttacccaaaatcacggttttgccgtggtgtccccgatccaaagatcaggatctatgatgtgggcatgaagaaaaagggtgttgatgagtttcctttctgtgtacatttggtcagttgggagaaggagaatgtctctagcgaggcacttgaagctgcccgtattgcttgcaataagtacatgaccaagtctgctgggaaggatgccttccaccttagggtcagggttcatccgtttcatgttttgcgtattaacaagatgttgtcatgtgctggagctgataggctccaaactggcatgaggggagcttttggtaagccacagggtgtttgtgctcgtgttgcaattggtcaggttcttctctctgttcgttgcaaagatggaaacagtaaccatgcacaagaggctctgcgccgtgcaaagtttaagttccctggccgacaaaagatcatcgtcagcagaaagtgggggttcactaagtttagccgtaccgattatctgaaatacaagtcagagaaccgtattgtcccagatggtgtcaatgcaaagcttcttggctgccatggtagacttgctgcacgtcaacctggaa

SEQ ID NO: 883 - DNA, 695 bp, Artificial
  Synthetic
cagccgcacatccccgcctcttcccgccgccgtccgccgcgcgcacgccgccgccgccatggggaggagacctgcaaggtgctatcgccagatcaagaacaagccgtaccccaagtcaaggtactgccgtggtgtccctgaccccaagatcaggatctacgatgtcgggatgaagaagaagggtgtggatgagttctcccactgtgtgcatctcgtctcttgggagaaggagaatgtcaccagtgaggctcttgaggctgcgcgtatcgcgtgcaacaagtacatgaccaagtctgcaggaaaggatgccttccacctcagggttcgggttcacccgttccatgtgctccgtatcaacaagatgctttcgtgtgccggggcagataggctccagactggaatgaggggtgcttttgggaagccacagggaacctgtgctagggtggatattggccaggtcctcctttctgtgcggtgcaagcccaacaatgctgtccatgccagcgaagccctccgtcgtgccaagttcaagttccctggtcgccaaaagatcattgagagtagaaagtggggtttcaccaagttcagccgcgatgaatacgtcaggcttaagagcgagggtagaatcatgcctgatggtgtcaatgctaagctacttggttgccatggtcgcctctctgctcgtgcccccggga

SEQ ID NO: 884 - DNA, 739 bp, Artificial
  Synthetic
cccacgcgtccgcgcaggtcttaaacggggacgaaaccatggggagaagacctgcaagatgttaccgtcagattaagaacaagccatacccaaagtcacggttttgccgtggtgtcccagatccaaaaatcaggatctatgatgtaggcatgaagaagaaaggagtcgatgagtttccattctgtgttcacttggtcagttgggagaaggagaatgtctccagtgaggcgcttgaagctgcccgtattgcttgcaacaagtacatgaccaagtctgctgggaaagatgctttccacttgagggttagagttcaccccttccacgttttgcgtattaataagatgttgtcgtgtgctggagctgataggctccaaactggaatgaggggagcttttggaaagccccagggtgtttgtgctcgtgttgctattggtcaggttcttctctcagttcgctgcaaagatggcaacagcaaccacgcccaagaggctctgcgccgtgctaagttcaagttccctggtcgacaaaagatcattgtcagcaggaagtgggggttcaccaagttcagccgtactgattatctgaaatacaagtcagaaaaccgtatcatcccagatggtgtgaatgctaagcttcttgggtgccatggtcgacttgctgcacgacaacctggaagggcttttcttgaagcagtttaggaattggagcatatttacttttctgcatgcgactgaatgaa

SEQ ID NO: 885 - DNA, 602 bp, Artificial
  Synthetic
atcaaaaatggctcgacgacccgctaagtgttaccgataccagaagaacaagcccttccccaagtctcgatacaaccgagccgtgcccgaccccaagatccgaatctacgatcttggtcgaaagcgagcccacgtcgacgacttccctctgtgtatccatctcgtttccaacgagcgagagcagctgtcttccgaggctcttgaggctgcccgaatctgtgccaacaagtacatcaccaaggtgtccggacgagaggccttccacatgcgaatccgagcccaccccttccacgttctgcgaatcaacaaggtgctttcttgcgctggtgccgatcgacttgctcagggtatgcgaggagcctggggtaagcccgccggtcttgctgcccgagttgacattggccaggttctgatttccatccgaaccaaggacaacaacaaggccaccgttatcgagggtctgcgacgatgccgatacaagttccccggtcagcagaagatcatcatctccaagaagtggggtttcaccaacctcgaccgagaggagtacatgacccgacgacagaacggagagatcaaggaggacggtgcctacgtcaagt

SEQ ID NO: 886 - DNA, 569 bp, Artificial
  Synthetic
atcatctccccttctattcaccatgggtcgccgtccagctcgctgctatcgttactgcaagaacaagccttacccaaagtctcgttacaaccgtggtgtcccagaccccaagattcgtatctttgacttgggccgcaagagggccaacgttgacgaattcccattctgtgcccacttagtctccgatgagtatgaacaactctcgtcagaagctctcgaagccgcccgtatttgcgccaacaagtacgtcaccaagacatcgggcaaggattctttccatttgcgtgtccgtgcccaccccttccatgtcatccgtatcaacaagatgttgagttgcgctggtgccgatcgtctgcaaactggcatgcgtggtgcatggggtaagccctacggcaccgttgcccgtgtcaacattggtcaagtcattctctccatccgtaccaaagatgcaaacgcacccgttgtcattgaggctctccgtcgcgctcgttataagttccctggccgccaaaagattatcatttctaagaagtggggtttcactaatgtcgccaaggaggagtacttga

SEQ ID NO: 887 - DNA, 880 bp, Artificial
  Synthetic
gaagtggcgccgggactccttgagttggaattatcttcccccaaacatcatcaaacaaacctcaagtacagtcaacgaaacaccgacaaaatggctcgccgtcctgctcgttgctaccgatactgcaagaacaagccgtatcccaagtctcggttcaaccgtggtgtccccgaccccaagatccgcatcttcgatctgggccgaaagcgcgccaacgtcgacgacttccctctctgcatccacctcgtctccaacgagtatgagcagctgagctccgaggccctcgaggccgcccgtatttgcgccaacaagtacctcgtcaagcacaccggtaaggagggtttccacctccgtgtccgcgcccaccccttccacgtcgtccgtatcaacaagatgttgtcttgcgctggtgccgatagactgcagactggtatgcgtggtgcctggggcaagcccaacggcactgttgcccgtgtcaacattggtcagatcatcatgagcgtccgcactcgtgactctaaccgtgctctggctcttgaggctctccgacgatcccagtacaagttccccggccgacagaagatcatcatctccaagaactggggtttcactcctctccgccgcgaggactatctcgagcgcaaggctgccggccgtgtcaaggtcgacggtgcttacgttcagttcctcagcaaccacggttccattgagcagaacattcgtcgtttccccgacgctttctcgtccgaggcgtaaatagttctccttaatgtggcttctgggttttaggttggcgtaattatggcatgtcagataagagatttctcgatttgagaatcatcagttaggcaaatcaaaccattgtgcgttcagcactaga

SEQ ID NO: 888 - DNA, 343 bp, Artificial
  Synthetic
ataaagagagacgccatgggaagaagacctgcgaggtgttaccgtcagatcaagggtaagccatacccaaagtctcgctactgtcgtggtgtgccagatccaaaaatcaggatctacgatgttggtatgaagaggaagggtgttgatgagtttccattctgtgtccatttggtgtcatgggagaaggagaatgtgtcaagtgaagcacttgaagctgcccgtattgcttgcaacaagtacatggtgaagtctgctggaaaagatgcttttcatttgaggattagggttcatcctttccatgttctcaggattaacaagatgctttcgtgtgctggagctgata

SEQ ID NO: 889 - DNA, 721 bp, Artificial
  Synthetic
ccgcagactaatcgcagagagaattagccatggggagaaggcctgcaagatgttatcgccagattaagaacaagccttatccaaagtcacggttttgccgtggtgtgccagatccaaagatcaggatctatgatgtgggtatgaagaaaaagggagttgatgaatttcctttctgtgtgcacttggtcagttgggagaaggagaatgtttcaagtgaggcacttgaagctgctcgtattgcgtgcaacaagtacatgaccaagtccgctggaaaggatgctttccacctcagggttagggtccatcccttccatgttttgcgaattaacaagatgttgtcatgtgctggggctgataggctccaaactggtatgaggggagcttttggtaagccacagggagtctgtgctcgtgttgctattggtcaggttcttctctctgttcgctgcaaagatggtaatgctaaccatgctcaagaggcactgcgccgtgctaagtttaagttccccggccgacaaaagatcatcgtcagcaggaagtgggggttcactaagttcagccgtactgattatctgaaatacaagtcagagaatcgtattgttccagatggtgtcaatgccaagcttctcggttgtcatggccgacttgctgcacgtcaacctggaagagcttttttggaagcagtggggaattgaagttgcgaacttaccaaactgaacct

SEQ ID NO: 890 - DNA, 741 bp, Artificial
  Synthetic
ttcgcattaattaagcatggggagaaggcctgctaggtgctaccgccagatcaagaacaagccgtaccccaagtcaaggtactgccgtggtgtccctgaccccaagatcaggatctatgatgttggcatgaagaagaagggcgtggatgagttcccctactgtgtgcacttggtgagttgggagaaggagaatgtctccagtgaagctcttgaggctgcccgcattgcttgcaacaagtacatgaccaagaatgcaggaaaggatgccttccacctaagggtcagggtccacccgttccatgtccttcgtatcaacaagatgctctcgtgtgctggggctgataggctccaaactggaatgaggggtgcttttgggaagcctcagggtacctgtgctcgcgtggacattggtcaggttcttctttctgttcgttgcaaggagagcaatgctaaacatgctgaagaggcactccgccgtgccaagttcaagttccctggccggcaaaagatcatccacagcaggaagtggggcttcaccaagttcacccgtgaggagtacgtcaagttgaaggctgagggcagaattatgtctgatggtgtcaatgctcagctgcttggttctcatggtcgtcttgcgaagcgtgcccctgggaaggcgtttctggctgagaccattcaacgttccgccgcggccgcttatccgtatgatgttccggattatgccgagctctacaaacagct

SEQ ID NO: 891 - DNA, 647 bp, Artificial
  Synthetic
ggccggcgagatgctaccgccagatcaagaacaagccgtacccgaaatctcgcttctgccgcggtgttccagaccctaagatcaggatctacgatgtgggcatgaagaagaagggcgtggacgagttcccctactgcgtccatctggtgagctgggagaaggagaatgtctcgagcgaagcccttgaggcggctcgaatcgcctgcaacaagtacatggcaaagtacgccggcaaggacgcgttccatctccgagttcgtgtgcaccccttccatgtcctgcggatcaacaagatgctttcgtgcgctggcgctgatcggctccaaactggaatgaggggagctttcggcaagccgcagggaacttgcgcccgtgttgacatcggccaggtgctgctctcggtccggtgcaaggacaacaacggagttcacgcgcaggaagcgttgaggagggcgaagttcaagttccccggcaggcagaagatcatcgtcagccggaagtggggatttacgaagttctctcgcaccgacttcctcaagttcaaggcggagagcaggatcgtgaacgatggcgtgaacgcgaagctcctgacttgccacggaccactctcgtctcgatccgcggaaaccgctatacttccggatgat

SEQ ID NO: 892 - DNA, 577 bp, Artificial
  Synthetic
tccgtgatgctcagatcctcttaagtatcgcctcatcatccccttggtcaatacccccaaagcagttctaacctctccttcccaacatggccgtcggcaagaacaagaggatttccaagggaaagaagggaggaaagaagaaggcggcggatccgtatgccaagaaggactggtatgacattaaggcaccatcagtttttgatataaaaaacgttggcaaaacccttgttactaggactcagggaactaagattgcttcagagggacttaagcatagagtttttgaagtgagtctggctgatcttcaaaaggatgaggatcaggctttcaggaagatcaggttgagagcagaggatgtgcaaggaaagaatgtcctcacaaacttctggggaatggattttacaactgacaagttgaggtcactggttcgcaaatggcagactttgattgaggcccatgtggatgtcaaaactaccgacagctatactctgaggatgttctgcattgcttttacaaagaagcgtccaaaccagcagaagcgtacctgttatgctcagagcagccagatccgtcagat

SEQ ID NO: 893 - DNA, 995 bp, Artificial
  Synthetic
gttttgcagcattatagcctcagcttccccttctcccaaaccccccactcctcgtccaaagcagctgcaacatctccttcccaacatggctgtcggtaagaacaagaggatttcaaagggaaagaaaggaggaaaaaagaaggcggcggatccgtacgcaaagaaggactggtatgacataaaggcaccatcagtatttgatatcaaaaacgttggcaagaccctggtcactaggactcagggtactaagattgcttcggaaggactaaagcacagagtatttgaagtcagtttggctgatcttcagaaggatgaggatcaatctttcaggaagatccgcttgagggcagaagatgtgcaagggaaaaatgtcctcacaaacttctggggaatggatttcacaacagacaagttgaggtctctggtgaagaagtggcagacattgattgaggctcatgtggatgtcaagacaacagatagctacactctccggatgttctgcattgcttttacaaagaaacgtcccaaccagcagaagcggacatgctatgctcagagcagccagatccgtcagatccgtcggaaaatggttgagatcatgagaaaccaagcaagttcctgtgacctgaaggagttggtcgcaaaatttatccccgagtcaattggcagagagattgagaaagcgacttcaagcatcttcccactgcaaaatgtttatatccgcaaagtgaaaatccttaaggccccaaaatttgatattggcaagctgatggaggttcatggtgactattcagaagatgttggcgtgaagttggatcgaccagctgatgagaatgttgctgaggcagaacccgaaattcctggagcttagacttgtttgatttggattctatctgaatatggtgcttgtcttctaaatttatgaatttcttttagttgaggtgttaaggcgcgacctatcaaaatattggatatctttctttggcattcatcag

SEQ ID NO: 894 - DNA, 786 bp, Artificial
  Synthetic
gattcccatctccccatacgctggtaaggaatcatggctgttggaaagtgagtatctacgctgcgaatctttggaaatgaacgtcggccaacaaaaagaacaggaacaagagactctccaagggcaagaagggccttaagaagaagaccgtggaccctttcacccgaaaggactggtactctatcaaggctcctaaccctttcaacatccgagagtgagtcgcattgcaacaggttcataacgaaaaaatgtcgagaatttggactgacggattcttgcagtgttggcaagactcttgtgaaccgaacaaccggtctcaagaacgcgaacgatgctctgaagggccgcatcgtcgaggtctccctggctgacctccagaaggatgaggaccactcattccgcaaagttcgtctccgcgtcgacgaggtccagggcaagagctgcctgaccaacttccacggacttgacttcacatccgacaagctccgatccctcgtccgcaagtggcagactctcatcgaggccaacatcaccgtcaagaccaccgatgactacctcatccgcctcttcgccattgccttcaccaagcgacgccccaaccagatcaagaagaccacctacgctgcttcttcccagatccgcgccattcgacgcaagatgaccgacatcatccagcgcgaggcttccagctgcaccctcacccagctggtttccaagctgatccccgaagttatcggccgcgaaatcgagaagtccacccagggcatctaccccctgcagaacgtc

SEQ ID NO: 895 - DNA, 672 bp, Artificial
  Synthetic
agggcgtcgtcgtcggagctcagttgcgatggccgtcgggaagaataagcgcatttccaagggaaagaagggtggcaagaagaaagtggttgatcctttttcaaagaaagattggtatgatatcaaggctccatcagtcttcactattaggacggtcggtaagacccttgttactcggacacagggtacaaagattgcagctgatggcctgaaggggcgtgtttttgaggtctctcttgcggacctccaaaaggatgaagatcaggctgctaggaagatcaagcttagggccgaagatgtgcaaggaaggaatgttctcaccaatttctgggggatgaacttcactaccgataaactccgctctcttgtaaggaaatggcagactcttattgaggcccatgttgatgtgaagacgacagataactacactttgagaatgttctgcatcgccttcaccaagaagcgcccgaatcagatcaagaaaacttgctacgcacagtcaagccagatccgacagatccggaagaaaatgacagagatcatggtgaaagaagccgcgtcatgtgacttgaaagagcttgttgcaaagttcatcccggaagtaattgggaaggaaatagagaaagcaactgctggaatctaccccctgcagaacacttttatcaggaaggt

SEQ ID NO: 896 - DNA, 640 bp, Artificial
  Synthetic
aagccctagccgcttctaggtttttagggttcttctcagccggctgtgcgccatggcggtcgggaagaacaagcggatgtccaaggggaagaagggaggcaagaagaagatcgtcgatcccttctcgaagaaggactggtacgatgtgaaggcgccgtccaccttcaacgttcgccaggtcgggaagacactggtgacgagaacacaggggactaagattgcctctgatggtcttaaaggccgtgttttcgaagtgtcatcgggtgatctgcaaaacaacgacgaggaccatgccttccgcaagatcaagctcagggccgaggatgtccagggacgcaacgtccttaccaacttctggggaatggacttcacgacggacaagctccggtccctcgtccgcaagtggcagtcgctcatcgaagctcacgtcgatgtgaagacgactgacaactacaccttgaggctcttctgcattgggttcaccaagcgcaggcccaaccaggtgaagcggacgtgctatgcgcagtcgagccagatccgccagatccggaagaagatgagggagatcatggtccgcgaagctcagtcgtgcgacctcaaggacctggtggcgaaattcatcccggaggtgatcgggaag

SEQ ID NO: 897 - DNA, 668 bp, Artificial
  Synthetic
attaagacgtgattaaacaccatggctcagggaaagaacaagcgactctctaagggaaagaagggtatcaagaagcgagttgtcgaccccttcaccaagaaggactggtacaacatcaaggctccctccacctttgagaaccgagacgtcggcaagaccctcgtgaaccgatccaccggtctgcgactcgccaacgactacctcaagggccgagtgctcgaggtgtcccttgctgatctgcagggccaggaggaccactccttcaagaaggtcaagctgcgagttgacgaggtccagggcaagaacctgctcaccaacttccacggctttgacttcacttccgacaagctgcgatctctcgtccgaaagtggcagactctgattgaggctaacgtcaccgtcaagacctccgacgactacttcctccgactcttcgtcatcggtttcaccaagcgacaggccaaccaggtcaagaagaccacctacgcccagacctctcagatcaaccagatccgaaagaagatgaccgacattgttgtccgagaggcttccaacgtgactcttgctcagctcaccgccaagctcatccccgaggttattggccgagagattgagaaggccactcagaacatctaccctctgcagaacgtctacatccgaaaggtcaa

SEQ ID NO: 898 - DNA, 658 bp, Artificial
  Synthetic
gtagggcatgagtttcacgaccgacaagctgagatcattggtcaagaaatggcagacgctaatagaggctcatgtggatgtaaagaccactgataactacatgctgcgtctcttctgcattggcttcaccaagaggaggccaaatcaagtcaaacggacatgctatgctcaagcaagccagattcgacagatccgtcgcaagatggtggagatcatggtgaaccaggcatcatcctgtgatctcaaggagctggtgtcaaaattcattcctgaggtgattgggaaggaaatcgagaaggccacatcaagcatcttcccgcttcagaatgtgtttgtgcgcaaagtcaagatcctcaaggccccaaaatttgacctgggcaagcttatggaggttcatggagattacaaggaggacgttgggacgaagctcgagaggcctgcagaagatgaggtcgtggtaggacaggaggtcactgccgagtagattttcacttattttactgctattttattcagacaatatatatatgtatcgcctatcaaggttttgatcacgagcagcaggctcggtttttgtggctaatttcctgaatactttcttgagattactagccagcatcgtttttgttttctggatggaagtttatttgtctaaagt

SEQ ID NO: 899 - DNA, 593 bp, Artificial
  Synthetic
gccgcttccacctctctcgcgccgccgccggcgccgagcgcctggagcagcgtcagccatggccgtaggtaagaacaagcgcatctccaaggggaagaagggatccaagaagaagaccgtcgatccctttgctaagaaggactggtatgatatcaaggccccgtcggtgttcaatgtgcggaacatcggcaagaccctcgtgtccaggacacagggtacaaagattgcttctgagggcctaaagcatagagtgtttgaggtctccttagctgatctccagaacgatgaggatcaggcgtacaggaagatcagacttcgtgctgaggatgtgcaagggaagaacgtgctcaccaacttttggggcatgtcgtttactaccgataagctcagatcacttgttaagaagtggcagacactgattgaggctcatgtggatgtcaaaaccacagacggctacatgctgcgtctgttctgtatcggcttcaccaagcggcggcctaaccaggtgaagaggacttgctatgctcaagcgagtcagatcagacagattcgtcgcaagatggttgaaatcatggccaaccaggcttcaagct

SEQ ID NO: 900 - DNA, 699 bp, Artificial
  Synthetic
cccgacctcttctcccacctgcgccgccgccactcactcccaaaccctaaccccggaggagagggaggagcagccatggccgtgggcaagaacaagaggatctccaagggcaggaagggcagcaagaagaagaccgtcgatcccttttccaagaaggattggtacgacatcaaggcgccgaccgtgttctccgtccgcaacatcggcaagaccctcgtctccaggacccaggggaccaagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctggggcatgagttttaccacggacaaacttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcagatccgccggaagatggttgagatcatggccaaccaggcatcaacatgtgacttgaaagaactggtttcaaaattcatccctgaagtcattggaaaggagatcgagaagtcaacttcaagtatattccctctccaa

SEQ ID NO: 901 - DNA, 1523 bp, Artificial
  Synthetic
tcatcgccttcaaatttctctctcaaggtttgagaaaatttcctcaatttctcgctttaggagttcttttttattgaatcaccgatttgggtgtgtcaagccctaattttgaagttcattttttcaattgtttgttgttgattttatgttataacagatgcagatcttcgtaaaaaccctaaccggtaagaccatcactctcgaggttgagagttccgacacaatcgacaacgtaaaagccaaaatccaggataaggaaggaattcccccagatcagcaaaggcttatcttcgccggcaagcagcttgaggacggccgtactctcgccgattacaacatccagaaggaatctactcttcacttggtcctccgtctgcgtggtgggatgcagattttcgtcaaaaccctcaccggcaaaacaatcacccttgaggtggaaagttctgacaccatcgacaatgtcaaggctaaaattcaggataaggagggaattccaccagaccagcagaggttgatcttcgctggcaagcagcttgaggatggtcgtacccttgccgattacaacatccagaaggagtctacccttcaccttgtcctccgtctccgtggtggtatgcagatctttgtcaaaacgctcaccggcaaaaccatcacccttgaggtcgagagttccgacaccatcgacaatgtcaaggccaaaattcaggacaaggagggcattcccccagaccagcagaggttgattttcgctggcaagcagctcgaggatggccgtacactagctgattataacatccagaaggaatccacccttcaccttgtcctccgtctccgtggtggtatgcagatcttcgtcaaaacactcaccggcaagaccatcaccctggaggttgaaagctctgacaccattgacaatgttaaggccaagatccaggacaaagaggggattcccccagatcagcagaggttgatcttcgcaggaaagcagttggaagatggtcgcacccttgcggactacaacattcagaaggagtctactctgcacttggtgctaaggctgaggggaggaatgcagatcttcgtgaagacattgaccgggaagaccatcaccttggaggtggaaagctctgacaccatcgacaatgtcaaagctaagatccaggacaaggagggtatcccaccggaccagcagaggttgatctttgctggtaagcagcttgaggatggaaggaccctggccgactacaatatccagaaagagtcaacccttcaccttgtcctccgtctccgtggtggtttctaggttgcctgttgttgatgttgttgtgtcgtgttgattggctgtgtcttgttgtggtcatgatgtgttttgtctactaaggtcccaaagatgttcaattctgtttctgttcgccgtttctttcatattttctgttgtgaataaagacaccagattctgtcctagtgcttaggttttgtgctctctgttggcagtacatgaactttcctttgttttatccatt

SEQ ID NO: 902 - DNA, 682 bp, Artificial
  Synthetic
gaattcagagctcagacacaattgacaacgttggggctaagattcaagacaaggaaggaattcctccagaccaacaacgtttgatcttcgccggaaagcagttggaagatggaagaactttagctgactacaacatccagaaggaatcaactctccatcttgtccttcgtcttagaggtggtatgcaaatctttgtcaaaaccttgactggtaagaccatcactttggaagtcgagagctctgacaccattgataacgttaaggctaagattcaagataaggaaggaattcctccagaccagcaacgtttgatcttcgccggaaagcagttggaagatggtcgtactcttgccgactacaacatccagaaggagtctactctccatttggttcttcgtctcagaggtggtatgcagattttcgtcaagacccttactggaaagaccatcaccttggaggttgagagttccgacaccatcgataatgtcaaggctaagattcaagataaggagggtatccccccagaccagcaacgtttgatcttcgccggaaagcagctggaagatggtcgcactcttgccgactacaacattcagaaggagtctaccctccatttggtgcttcgtcttagaggtggtatgcaaatcttcgtgaagaccttgaccggaaagaccatcactct

SEQ ID NO: 903 - DNA, 586 bp, Artificial
  Synthetic
agcgggtaaactgaagagtgcgccgcaaaatgcagatcttcgtgaaaaccctaaccgggaagacaatcacgctcgaggttgaatcgagcgacaccattgataatgtcaaggctaagattcaagacaaagaaggtattccaccggaccagcagcggttgatattcgccggaaagcagctcgaagatggacgtactcttgctgattataacatccagaaagagtcaactttgcatttggttttgaggcttcgtggagggattattgagccttctctgatggctttggctaggaagtacaaccaggataagatgatttgtcgcaagtgctatgctcgcctgcatcctcgtgctgttaactgcaggaagaaaaaatgtgggcacagcaaccagctgaggccaaagaagaagatcaagtagacgtgatgtcttttctaagcttagatcaattttgcgcgttgcagctatatattgccagtccgttgtttttacagttttcagtcctgcttcaatttgatgtcatggataacaaacatgtcttaaacatctaattattggataagatatctttgtgcactcaatatatgtct

SEQ ID NO: 904 - DNA, 659 bp, Artificial
  Synthetic
ttctgcttttccttctctaagaagcgtttgattcccaaaaaccgtttcaaagatgcaaatctttgtaaagaccctcactggcaaaaccatcactctcgaggttgagagttcagacactatcgacaatgttaaggcaaagatccaagataaggaaggaattcctccagatcagcaaaggttgatctttgctggaaagcagttagaggatggccgaactcttgctgactacaatatccaaaaggagtctaccctccaccttgtccttcgtctgcgtggtggtatgcagatctttgtaaaaactttaacagggaagactatcactctcgaggttgagagctcggacacaattgataatgttaaggcaaagattcaggacaaggaaggcattcctccggatcagcaaaggttgatctttgctggaaaacaacttgaggatggtcgtacccttgctgactacaacatccaaaaggagtccaccctccaccttgttctccgtttgcgtggtggtatgcagatctttgtaaaaactttgacaggaaagactattacccttgaggttgagagttccgatacaattgacaatgtcaaagctaaaatccaggataaagaaggcattcctccagatcagcagaggttgatcttcgctggaaagcaacttg

SEQ ID NO: 905 - DNA, 865 bp, Artificial
  Synthetic
attctcattatctcctcaacttttctctctttattcaaacgcctctcaagatgcagatcttcgtcaaaaccctaactggaaagacgataacccttgaggttgaaagctccgacacaattgacaacgttaaggcgaagattcaggacaaggaaggaattccaccggatcagcagaggctgatcttcgccggaaagcagctcgaagacggcagaaccctagccgactacaacatccagaaggaatcgactcttcacttggtgctccgtcttcgtggcggtatgcaaatcttcgtcaaaaccctaacagggaaaacaatcacccttgaagttgaaagctccgacactattgataacgttaaggcgaaaatccaggataaagagggaatcccaccagatcagcagaggttgatctttgctggcaaacagttggaagatggaagaactctagctgactacaacatccagaaagaatccactctccatctcgtcctccgtctcagaggtggtatgcaaatatttgtgaaaaccctcactggcaagaccattactttggaagtggagagttctgataccatcgacaatgtcaaggccaagatccaagataaggaaggtattcctccagaccagcagaggttgatttttgctgggaagcagttggaagatgggcgtacccttgctgactacaacatccagaaggaatccacccttcacctggttctacgactaagaggtggtattgcagatctttgtgaaaacgcttactggaaagaccatcaccttagaagttgagagttcagataccattgacaatgtaaaagccaaaattcaggacaaggaaggtattcctccagaccagcaacgtttga

SEQ ID NO: 906 - DNA, 1591 bp, Artificial
  Synthetic
acttttctctttacttcaaacgcctctcaagagcagatcttcgtcaaaacccttaccggaaagacgataacccttgaggttgaaagctccgacacaattgacaacgttaaggctaagattcaggacaaagaaggaatcccaccggaccagcaaaggttgatcttcgccggaaagcagctcgaagacggcagaaccctagctgattacaacatccaaaaggaatccacccttcacttggtgctccgtcttcgtggcggtatgcaaatctttgttaaaaccctaaccgggaaaacaataacccttgaagtcgaaagctctgacacaattgacaatgtcaaggcgaagattcaggacaaggagggaatccctccagaccagcaaaggttgatttttgccggaaagcaactcgaagacggcagaaccctagctgattacaacatccagaaggaatcgacccttcacttggtccttcgtcttcgtggtgggatgcagatcttcgtcaaaaccttaactgggaaaacaatcacccttgaagtcgaaagctccgacaccattgacaatgtcaagggtaaaatccaggataaggagggaatcccaccagaccagcaaaggttgatttttgctggtaagcaattggaagatggccgtaccctagctgattacaacattcaaaaggagtcgactttgcaccttgtgctccgtcttcgtggtgggatgcagattttcgtgaagacattgaccgggaaaaccatcactcttgaggtggaaagctctgacactattgacaacgttaaggccaaaatccaggataaggagggaatcccaccagaccagcagagattgatttttgctggtaagcagctggaggatggccgaaccctcgctgattacaacattcagaaggagtctacccttcacttggttctccgtctccgcggtgggatgcagatcttcgtcaaaacactcactgggaagacaatcaccctcgaagttgaaagctccgatactatcgacaatgttaaggctaagattcaggacaaggaaggtattccaccggaccagcagagattgatttttgctggtaagcagttggaagatgggagaactttagctgattataatatccagaaggaatccacactgcatttggtgctccgtcttcgtggtgggatgcagatttttgtgaagacgttgaccgggaaaaccatcactttggaggtagagagttctgatacgatcgacaatgtgaaggctaagattcaggacaaggagggtatcccgccagatcagcagaggctgatttttgctgggaagcagttggaagatggaaggactctggctgattataatattcagaaggagtcgactctgcaccttgtcctccgtctccgtggtggtttctaaagtgtccgtcaatagtggtggtaatgtctgtgtcttgggtcttgggtctgttcggtgtttgtttgattcatgatttagtagtttgtgtagtttttgttagttgtcatcatgttatgccttcaaaagaaggaaggagacttgtcctctttgtctctgtttgcgaataataaagttcgaattatggttt

SEQ ID NO: 907 - DNA, 731 bp, Artificial
  Synthetic
ccccgagccaagaggggaaaaaaaaagggaagaaatttttttcttttttttttgttcgcctccgcttcttcctcacgcagctctcgcctcgcctcgccgcccgccactagagaggagagggagaaggagaaggaggcgaatcccagcaaaagaagatgcagatcttcgtgaagaccctgactgggaagaccatcaccctcgaggtggagagcagcgacaccatcgacaatgtcaaggctaagatccaggacaaggagggaatcccgccggaccagcagcggctgatcttcgccgggaagcagctggaggacggacgcaccctggctgactacaacatccagaaggagtccaccctccacctcgtcctcaggctccgtggcggtatcatcgagccgtcgcttcaggcgcttgcccgcaagtacaaccaggacaagatgatctgccgcaaatgctatgcgcgcctgcaccctagggctgtcaactgccgcaagaagaagtgtggtcacagcaaccagctgaggcccaagaagaagatcaagaactagagcgtcactcgccgggttcatggactggttaaatcaatcgtcatattagacttttatgcttccgttgttatctccctggatgttgttgaaccgtgttttactgtgctggatgcttcagcttcttgttttgacggtcgtggtatatggtaattggcagcaaactatattggtcatgtcgaaattgtc

SEQ ID NO: 908 - DNA, 1630 bp, Artificial
  Synthetic
cgaaaaatttctccccaatctcgcgaggctctcgtcgtcgaatcgaatcctctcgcgtcctcaagatgcagatctttgtgaagacattgaccggcaagactatcaccctcgaggtggagtcctctgacaccatcgataatgtcaaggctaagatccaagataaggagggcatccccccggaccagcagcgtctcatcttcgctggcaagcagctggaggatggcaggacccttgctgactacaacatccagaaggagtcgacccttcaccttgtcctccgcctccgtggtggcatgcagatctttgtcaagactctgaccggcaagactatcacccttgaggtggagtcttctgacaccatcgacaacgtcaaggccaagatccaggacaaagagggcatccccccagaccagcagcgtctcatcttcgccggcaagcagctggaggatggcaggacccttgctgactacaacatccagaaggagtccaccctccaccttgtcctccgcctccgtggtggcatgcagatctttgtcaagacactgaccggcaagaccatcaccctcgaggtggaatcttctgacaccatcgacaacgtcaagtccaagatccaggacaaggagggcattcccccggaccagcagcgtctcatctttgccggcaagcagcttgaggacggcaggacccttgctgactacaacatccagaaggagtcaacgcttcaccttgtcctccgtctcaggggaggcatgcaaatcttcgtgaagactctgaccggcaagaccatcaccctcgaggtggagtcttctgataccatcgacaatgtcaaggccaagatccaggacaaggagggcattcccccggaccagcagcgcctcatctttgctggcaagcagctggaggatggcaggacccttgctgactacaacatccagaaggagtccaccctccaccttgtgctccgccttcgtggtggtatgcagatctttgtcaagaccctcacaggcaagaccatcaccctggaggttgagagctcggacaccatcgacaacgtcaaggccaagatccaggacaaggagggcatccccccagaccagcagcgtctcatcttcgccggcaagcagctcgaggatggccgcaccctcgccgactacaacatccagaaggagtctaccctccacctggtgcttcgtctccgtggtggtatgcagatcttcgtgaagaccttgactgggaagaccatcactttggaggttgagagctccgacaccattgataatgtgaaggccaagatccaggacaaggaggggattcccccagaccagcagcgtctgatcttcgctggcaagcagctggaggatggacgcaccctcgccgactacaacatccagaaggagtccaccctccacctggtgctccgcctccgtggtggtcagtaatcagccagtttggtggagctgccgatgtgcctggtcgtcccgagcctctgttcgtcaagtatttgtggtgctgatgtctacttgtgtctggtttaatggaccatcgagtccgtatgatatgttagttttatgaaacagtttcctgtgggacagcagtatgctttatgaataagttggatttgaacctaaat

SEQ ID NO: 909 - DNA, 1442 bp, Artificial
  Synthetic
attattactcgaccacgcgtcgaaaaatctcccctcgaagcgaagcgtcgaatcgccttctcaagatgcagatctttgtgaagaccctcaccggcaagaccatcaccctcgaggttgagtcctcggacaccattgacaatgtcaaggccaagatccaggacaaggagggcatccccccggaccagcagcgtctcatcttcgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagctggaggatggccgcacccttgctgactacaacatccagaaggagtccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatcttcgctggcaagcagctggaggatggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaacgtgaaggccaagatccaggacaaggagggtatccccccggaccagcagcgtctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctattgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtcc

SEQ ID NO: 910 - DNA, 676 bp, Artificial
  Synthetic
cccacgcgtgcgcggacgcgtgggctctcctcaccttgcaattcttggtgcacatagttggcaaggatgcagatattcgtgaagaccctgacagggaagactattaccttagaggtagagtcatccgacaccattgacaatgttaaggctaagattcaggacaaggaaggcattccaccagaccagcagcggttgattttcgcaggtaagcagcttgaggatggccgaacactagccgactacaacatccagaaggagtccaccctccaccttgtccttcgcctccgtggtggtgccaagaagcgtaagaagaagacttacactaagccaaagaagattaagcacaagaagaagaaggttaagctcgccgtcctccagttttacaaggttgatgattctggtaaggttcagaggctccgcaaggagtgtcccaacgccgagtgtggtgccgggactttcatggctaaccactttgacaggcactattgtggtaaatgtgggcttacctatgtttaccagaaggctggtggtgattagatgagtgttactttgcttattacttttccccacatttcttgccttaaactctcctaatgtcttgtttgtgacaagatgtaatgaatttgaattatggtattgtgttaacagcttatgaaattaaggatttttgtcagtt

SEQ ID NO: 911 - DNA, 715 bp, Artificial
  Synthetic
agaaaccctagcgccgcagtggtcatcgagttctctcctccaaagcgaagatgcagatcttcgtgaaaaccctaacaggtaaaacaatcacccttgaggttgaatcttccgacacaatcgacaatgtgaaagccaagatccaagataaggaagggattcccccagatcagcagcgtctgattttcgccggaaaacagcttgaagacggccgtaccctagctgattacaacatccagaaggagtcgactcttcatctcgtgctccgcctccgtggtggtgctaagaagaggaagaagaagacttacaccaagcctaagaagattaagcacaagaagaagaaggttaagctcgctgtgcttcagttctacaaggtggatgattctggtaaagtccagaggctgcgtaaggagtgtcctaatgctgagtgtggtgctggaacttttatggctaaccactttgaccgtcattactgtggtaagtgtgggctcacctatgtttacaacaaggccggcgccgattgaggcttatgcttagctctgttttaatgctgtcgtcaattttatccttttgtcgaacggtaatttagtatggattttcctttttaaatggtgtggtaactatgggaattttgagttatttttaaagtttttgcttattattcttaaagttttaggttattatctcaaattttatatccttaattatctactttata

SEQ ID NO: 912 - DNA, 313 bp, Artificial
  Synthetic
aaaaccctcaccggaaaaaccataaccctagaggtcgaaagcagcgacaccatcgacaatgtcaaagccaaaattcaggacaaagagggaataccacctgatcaacagaggttgatatttgctggtaagcagcttgaagatggtagaacattagcggattacaacattcagaaagaatcgactcttcacttggtattgaggcttaggggtgggactatgattaaggtgaagactctcacagggaaggaaattgagattgatatcgaaccaaccgatactattgatcggattaaggaacgtgttgaggagaaag

SEQ ID NO: 913 - DNA, 575 bp, Artificial
  Synthetic
acaccattgacaacgtgaagggccaagatccaggataaggaaggaatccctccggaccagcagaggttgatctttgccggaaaacaattggaggatggtcgtactttggcggattacaacatccagaaggagacgacccttcacttggtgttgcgtctgcgtggaggtatgcagatcttcgtcaagactttgaccggaaagaccatcacccttgaagtggaaagctccgacaccattgacaacgtcaaggccaagatccaggacaaggaaggtattcctccggaccagcagcgtctcatattcgctggaaagcagcttgaggatggacgtactttggccgaatacaacatccagaaggagtctactcttcacttggtcctgcgtcttcgtggtggtttctaaatctcgtctctgttatgcttaagaagttcaatgtttcgtttcatgtaaaactttggtggtttgtgttttggggccttgtataatccctgatgaataagtgttctactatgtttccgttcctgttatctccctctttctaatgacaagtcgaacttcttcttacaaaaaaaaag

SEQ ID NO: 914 - DNA, 876 bp, Artificial
  Synthetic
cccacgcgtccgctcaaaatcttaaaaactttctctcaattctctctaccgtgatcaagatgcagatctttgttaagactctcaccggaaagacaatcaccctcgaggtggaaagctccgacaccatcgacaacgttaaggccaagatccaggataaggagggcattcctccggatcagcagaggcttattttcgccggcaagcagctagaggatggccgtacgttggctgattacaatatccagaaggaatccaccctccacttggtcctcaggctccgtggtggtatgcagattttcgttaaaaccctaacgggaaagacgattactcttgaggtggagagctctgacaccattgacatcgtcaaggccaagatccaagataaggagggtattcctccggaccagcagaggttgatcttcgccggaaagcaacttgaggacggcagaactttggcggattacaacatccagaaggagtctacgcttcatttggtcttgcgtctgcgtggaggtatgcagatcttcgtaaagactttgaccggaaagaccatcactcttgaagttgagagctccgacaccattgataacgtgaaggctaagatccaggacaaggaaggcattcctccggaccagcagcgtctcatcttcgctggaaagcagcttgaggatggacgtactttggccgactacaacatccagaaggagtctactcttcacttggtcctccgtctccgtggtggtttctaaaccttgtctctctctcttatggttactgaaccaagttcatgtatcgtttcatctagtactttggtggtttatgttttggggccatgtacagcctctgataaataattgatcgactatgtttccgtta

SEQ ID NO: 915 - DNA, 418 bp, Artificial
  Synthetic
gtattctctagcagccacgatgcagatcttcgtcaagaccctgaccggcaagaccatcaccctcgaggtggagagctccgacacgattgacaacgttaagacgaagatccaggacaaggaagggatccctcctgaccagcagcgcctcatcttcgccggcaagcagctcgaggatggacgaactctcgccgactacaacatccagaaggaatccacccttcacctggtgctgcgtctccgcggaggcatgcaaatcttcgtcaagaccctgaccggcaagaccatcactctggaggtggagagctcggataccatcgacaacgtgaagacgaacatccatgacaaggaacggatcccccctgaccagcagaggctcatcttcgccgggaagcaactcgaggatggcaggactctggct

SEQ ID NO: 916 - DNA, 1040 bp, Artificial
  Synthetic
tcatcaattaggtttcttcgatagcaagtagcgatgcagatcttcgtcaagactctcaccggcaagactatcaccttggaggtggagagctccgacaccatcgacaacgtcaagaccaagatccaggacaaggaagggatccctccggatcagcagcggttgatctttgccggcaagcagcttgaggacgggcgtaccctcgccgactacaacatccagaaggagtctacgctgcatcttgttcttcggctgcgaggaggtatgcaaatattcgtcaagaccctaacgggtaagacgatcactctggaggtcgagagctccgacaccatcgacaacgtcaagaccaagatccaggacaaggaagggatcccgccggatcagcagcgtctgatcttcgctggcaagcagctcgaggatggccgtaccctggccgactacaacatccagaaggagtcgacccttcatcttgtgctgcgtctgcgaggaggcatgcagatcttcgttaagaccctcactggtaagacgatcaccctggaagtcgagagctcggacaccatcgacaacgttaagactaagatccaggacaaggaagggatcccgccggatcagcagcgtctgatcttcgctggcaagcagctcgaggatggccgtaccctggccgactacaacattcagaaggagtctacactccatttggtgctgcgtctgcgaggaggcatgcagatcttcgtcaagaccctcactggtaagacgatcaccctggaagtcgagagctcggacacgatcgacaacgtgaagaccaagatccaggacaaggagggaattcctccggaccagcagcggttgatcttcgcgggtaagcagctcgaggatgggcgcactcttgccgactacaacattcagaaggagtctacactccatttggtgctgcgtcttcgcggaggcatgcagatcttcgtcaagaccctcacgggtaagacgatcaccctggaagtcgagagctcagacaccatcgacaacgtgaagaccaagatccagga

SEQ ID NO: 917 - DNA, 594 bp, Artificial
  Synthetic
gttggtcgaggcgaggagagcggcggcgaagaaggacaagtctggagccatgcagatcttcgtcaagacattgactgggaagacaatcaccctcgaggttgagtcgtcggacacgatcgacaatgtgaagaccaagatccaggacaaggaagggatccctcccgaccagcagcggctgatcttcgcgggcaagcagctggaagatggccggacgctggcggactacaacatccagaaggagtcgaccctccaccttgttcttcgcctccggggtggcggcaagaagaggaagaagaagacgtacaccaagcccaagaagatcaagcacaagaagaagaaggtgaagctggcggtgctccagtactacaaggtggacgattcgggcaaggtgaacaggctgcgcaaagagtgcccgaatccagagtgcggtgccgggacgttcatggcgaaccactttgatcggcactactgcggcaagtgtggactcacctacgtctaccagagagctgaagcttagagaggatgacgagctttgctctcttgtgtttctatccaattttctttgaacgaaagtataatcttttcttttgtttc

SEQ ID NO: 918 - DNA, 590 bp, Artificial
  Synthetic
gggagaatcaacgtttcttggtaagtcatagctatggcgcttatagaattttggggcttcttgtaattcttggataatgacatgggtatgactgtttgtagatgattttccgctagatgttctatattagggtgtcgttgtccttatgttgattcctttgtctatcctagcagcaacgatgcagatcttcgtcaagaccctgaccggtaagaccatcactctggaggtcgacagctctgatactatcgacaatgtaaagaccaagatccatgacaaggaagggatccccccggaccagcacaggctcatctttgccggtaagcagctcgaggatggcaggactctggccgactacaacatccagaaggagtcgactctccatctcgtcctacgtcttcgcggaggtatgcagatcttcgtcaagaccctcaccggcaagaccatcacgctcgaggtggagagctccgacacgatcgacaacgtaaagaccaacatccacgacaaggaaggtatccccccggaccagcatcgactcatctttgccgggaagcagttcgaggatggacgaacgctcgccgactacaacatcc

SEQ ID NO: 919 - DNA, 658 bp, Artificial
  Synthetic
aatcgaccgaaggggagggggagcgaagctttgcgttctctaatcgcctcgtcaagatgcagatattcgttaagaccctcactggcaagaccatcaccttggaggttgagtcctccgatacgattgacaatgtgaaggctaagattcaggacaaggagggcatccctccggaccagcaacgccttatcttcgctggcaagcagcttgaggatgggcgtactctcgcggattataacatccagaaggagtccaccttgcaccttgtcctccgccttcgtggaggcatgcaaatattcgtgaagaccctcaccggcaagaccattaccctggaggtcgagtcctccgacacgatcgataatgtgaaggccaagatccaggacaaggagggaatcccaccagaccagcagcgtctcatctttgctgggaagcagctcgaggatggccgcacccttgcagactacaacatccaaaaggaatccaccctgcaccttgtcctgcgcctccggggcggtatgcagatctttgtgaagacccttactggcaagacgatcaccttggaggttgagtcctctgacacgatcgacaatgtgaaggccaagatccaggacaaggagggtattccaccagaccagcagcgcctcatcttcgctggcaagca

SEQ ID NO: 920 - DNA, 629 bp, Artificial
  Synthetic
ggcatactactggtgatttctaaacatgcagatctttgtgaagaccttgaccggcaagactatcaccctcgaggtggagagctcggataccatcgacaacgttaagaccaagatccaggacaaggaagggatcccacctgaccagcaacgattgatcttcgccgggaagcagcttgaggacggacggacccttgcggactacaacatccagaaggaatccacgcttcacctggttcttcgtctccgcggtggcatgcagatatttgtgaagaccttgaccggcaagaccatcaccctcgaggtggagagctcggataccatcgacaatgtcaagaccaagatccaggataaggaggggattcctccggaccagcagcgacttatcttcgccgggaagcaactcgaggacggacggacccttgccgactataacatccagaaggagtcgactctccacttggttcttcgtctccgcggtggcatgcagatatttgtgaagacactgaccggcaagaccatcaccctcgaggtggagagctcggataccatcgacaatgtcaagaccaagatccaggataaggaggggatcctccggaccagcagcgtttgatcttcgctgggaagcagct

SEQ ID NO: 921 - DNA, 655 bp, Artificial
  Synthetic
ctcgccgccgcagccgcggaggcgacccctcccccgccgccgccaagatgcagatcttcgtgaagaccctgacggggaagaccatcacgctggaggtggagtcctcggacaccatcgacaacgtgaaggccaagatccaggacaaggaaggcatccctccggaccagcagcgcctcatcttcgccggcaagcagctggaggatggccgcaccctggccgactacaacatccagaaggagtccacgctccacctcgtcctccgcctccgcggtggcatcatcgagccctccctccaggccctcgcccgcaagtacaatcaggacaagatgatctgccgcaagtgctatgctcggctgcaccccagggctgtcaactgccgcaagaagaagtgcggccacagcaaccagctgaggcccaagaagaagatcaagaactagagtttgagatatcatttccgcggatcattgaaatcaacaggaagatcagagtttaagtttttttgtagtgtaatgcctcatgttgtatgccgaactttctgtttatcctgttgtatgttaaccttggttacgctggagagtactccagcttattttgatgacataattgactacaaagtcaaggttatatggtccggccttaatttttgtccccttcg

SEQ ID NO: 922 - DNA, 571 bp, Artificial
  Synthetic
atcaaccactctcaagcaacaataacaacctttacccaacttcaaagactttcagtctctcaactcaacaccttcaagatgtctccctggtgagtcttctgaggaccattggtccatcacttgctcgggagttcctctttgctttaccttcagcgttccactacctgatctatgataccttctttcccaccaccgagcaaagcactcattagacatgtcactaacgattttctttcaatagcgcatgcaactcctgtggatgcaaggacaactgctccagctgctcctgcaccagctgcagcgtaagtcctgcttctctcccctgctttgggcattgagaaacttttccaccagaaagctaacagatgggaacatatagcactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacacacatataatttgcttgtgaag

SEQ ID NO: 923 - DNA, 793 bp, Artificial
  Synthetic
gggacaagcagcccgagtctttcttctccgagagcgctgtttcttgaatctttgtttccgccacatcctccgtgaagcccgagaaaaaaacatctctagcatcagaagatcctataaaagataaaaaagacttatacaaaaaatccttcctcgcaagggaagcgccggagcaacaacatgcccatagcactgtcccctcccttccggccaagaaatggcttgaccaagttcaccaactgccgcctcctgcgcggcgataagctggtcgaggaggatctctgggtcagctcgctgtctggcaaggttgtcaacagccaggctgcctttttcgatgacctcgttctccctgaccagaccatcgacctcgacggccgcatcatctcgccgggcatgattgatgtgcagctcaacggcgcgttcggcttcaacttctcgacgctgctcgatgacatgtcacagtacggcaaaaaggtcaaggaggtgcagaagttgctggtgcagacgggcgtcacatcgtacaatcccaccatcaccagccagaggccagaactataccagaagcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacac

SEQ ID NO: 924 - DNA, 568 bp, Artificial
  Synthetic
gttttccaaggatttactccagcttgcaggggccaagatgtcactgcatgggggtttcgttaatgaagctgttcagggcatgatatggtgcatgaggatgcacgagtggatactaacatatgacagttgatgctctttttatagagcatccgtttggatataaaagcatcgagtgtcgccaacattttgatcttgttccatccatcaatcgcatcaaccactctcaagcaacaataacaacctttacccaacttcaaagactttcagtctctcaactcaacaccttcaagatgtctccctgcgcatgcaactcctgtggatgcaaggacaactgctccagctgctcctgcaccagctgcagccactaaatcatcgtgctctttttccttcgctggatctatactctctcggaatgacagcttgagggctcggatgtgcttaagacgccatgggaagggcaaggcatttgggcgaatagacctccatcatgtgggatatagcagaataggaatttgaagattttgccctaacacacatataatttgcttgtgagaaaaaaaaaaaacaa

SEQ ID NO: 925 - DNA, 663 bp, Artificial
  Synthetic
gtgcagctgataaattccatcgattggtttctttgggagcattaatcgacctttctcattcttcataccatcggcgtcgttggcatttatacggcatctcgtcttgtttccttcgtactcgaggtacggtaccctgaccgcgtcgtcatacgaatttgcagcatcggcgaattgacagtataaggcagacatcatggctgggtggcagtcctggaaccccttcagtaagagggagacgcacagcaatggctccatcgtcgcatacaagattttaaccttgctctcatggcttttgtccgtcgtcgtcactgtctactatgccgttgacgagcctcacgatggcttccacatccgccggcgcatatgggatcagaactatctgtatcccagcgcctttaccatgaaccacatcctcgctgatatctactggattgttctcttcatcctccagtttggatacgtcacatcgctcttctccagcagtgccgacgtcgttgccgcagctgctggtgtcggcagccacttcatcctcaacaacttgcttcactctgcattcgtcatgctctttgtgaactcgcacttccacatcgccgaggtcatactgattctcaacttcttcaacctcagctcactgtatttccgccacaacacggtcccgcgctt

SEQ ID NO: 926 - DNA, 478 bp, Artificial
  Synthetic
cccccccccatctcaaatcaaattctattttcttttcagttcaattactttaccaacaaaatgtcaggccgtggaaagggaggcaagggtttgggaaagggcggagcaaaacgacaccgaaaggttctccgtgataatattcagggaatcactaagccagctattcgtcgattggctcgtaggggtggagtgaagagaatcagcgggctgatttatgaagaaacaagaggagttctgaagatttttttggagaatgtgattcgtgatgctgtgacttacactgagcacgccagaagaaagactgtcactgcaatggatgttgtttactctttgaagagacaaggcaggactctttatggatttggtggttaaagtttgggaaattgttgttaacttctgtgttactatttggtgttattgttaatgtagttgactagattttcgtattaatgaaatgaaatccgttggttttattctc

SEQ ID NO: 927 - DNA, 532 bp, Artificial
  Synthetic
gattcagaagaggattgagcaactctttcgccaatttctatttcttgaatatgtaacgggagaattacattaccgggctgaaaaaactaagaaatccaaatccacaatagggaaaaaacgatctacaatcattacccacaaaaccctaatttcacaaacctaacccccaaatccgtagagagtcctgccctgcctcttgagtgcataaacaacatccatagcggtgacagtctttcttctagcgtgttcggtgtaggtcacagcgtcacgaatcacgttctccaaaaatatcttcaacactccacgagtctcctcgtaaatcaaaccagatatacgctttactccacccctacgagccaaacgccgaattgcaggctttgtaatcccctgaatgttgtcccttaatactttcctgtgcctctttgctcctcctttgcccaatccttttcctcccttgccccttcctgacattgttctgagaaattgatgaaaaaactgaaggagattatagaaattgatataaagagaaatg

SEQ ID NO: 928 - DNA, 471 bp, Artificial
  Synthetic
aaattcattcatggttaaacggaaaaattacaaatttgaaatccctaaatgctgaaattgaaaagtttacaaaatccgaatttgcaatccgaacgatttacccgccgaatccatacaaagttcgtccttgttttttgaaagcgaaaacaacgtccttcgccgaaacagttttccggggagcgtgctccgggtaagtaacggggtcacaaatcacgttttcaaaaaaaattttgaaaaccccgggagttttttaataaataaaaccattgatacgtttaacgcctccttttttggggagacaacaaatcgcaggttgggaaatccctgggaggtggtctttgagtactttccgaggtctttgggctcctccttttcctaatccttttcctccttttcctgggccggacatttttttttggggaaattaatttcgaactaaaaaaaaaattttttgatcggacccgggggtca

SEQ ID NO: 929 - DNA, 560 bp, Artificial
  Synthetic
gccattacggccggggatcgccctaatcattatctctcgcacaatttttcagcttcagggtctttaatttgcagagaaactaaaggttgattgaaaatgtctggacgtggaaagggaggaaaaggattaggaaagggaggagcaaaacgacaccgtaaagtcctccgcgataacatccaaggtatcacaaagccagcaatcaggcgtttagctcgtagaggaggagtgaagcgtatcagtggactcatctatgaagagacacgtggcgtgcttaagatctttttggagaatgtcattcgtgatgctgtaacttacactgagcacgctaggagaaagactgtgactgctatggatgttgtgtacgcgctcaagagacaaggaaggactttgtatggttttggaggttaatgtgaaacttttattttttctgcaagagtcttgctgtcaagaaaacaacaagaacggttaccatatggtatatgaggtttgttttgcttttgattagggatctgattcggtgtaattagtttggttacctattggtgataggtttctttttt

SEQ ID NO: 930 - DNA, 564 bp, Artificial
  Synthetic
tcgttcctctcttttaaattcaaaacccttgaattcactttcaattatctctttctcaagcttttgaaaaatgtctggacgtggcaagggaggcaagggattggggaaaggaggagcaaagagacacaggaaagtgctgagagataacatccagggaattacaaagccagctattcgcaggcttgctcgtaggggtggtgtgaagcgtatttctgggttgatttacgaggagactcgtggagttcttaagatctttttggagaatgtgattcgcgatgctgtgacctacactgagcacgctaggaggaagactgttactgccatggatgttgtttacgctctcaagaggcagggaaggaccttgtacggatttggaggttaaatattggcggttagggtttattgtattttgttgttagtgattgtagattttatgtttgtgctttctgtttgtgttagtggtcagtttaagctagggtattttaatttccgttgttaaggtctggacattgtaatacctcgttatacaattaagtaaaacagaccatttcctaaaaaaaaaag

SEQ ID NO: 931 - DNA, 473 bp, Artificial
  Synthetic
ctcagtttaattactctacctacaaaatgtcaagccgtggaaagggaggcaagggtttgggaaaaggaggagctaaacgacaccgtaaggtgctccgtgataacattcagggaatcacaaagccagctattaggagattagcgagaagaggtggagtgaagagaatcagcgggctgatttatgaagagacaagaggagtgttgaagatatttttggagaatgtgattcgtgatgctgtgacttacacagagcatgctaggagaaagactgtgactgcaatggatgttgtttattctctcaagagacaaggcaggaccctttatggatttggtggttaatttatgtatttttatttgttttaggggagatggagtttagttggtgtttaattagtgtttgttgatgaatgttatgaggttgctgtaattgagttctttgtgttaatgaaatggatctcattactatttccgaac

SEQ ID NO: 932 - DNA, 320 bp, Artificial
  Synthetic
gcagcatgtcaggccgaggaaagggaggaaaaggattaggaaagggaggagccaagagacatcggaaagtactcagagacaacatccaagggattaccaaacctgcgattcgtcgtctcgcgagaagaggaggcgtgaagcgtatcagtggtttgatctatgaagagactcgcggcgttctcaagatctttctcgagaacgtgattcgtgacgccgttacttacacggagcacgctcgccggaaaactgttacggcgatggacgtcgtttacgctctcaagagacaaggacgaactttgtatggattcggcggctaataa

SEQ ID NO: 933 - DNA, 519 bp, Artificial
  Synthetic
acgcgtcgagggtgctagagcaacagcagctaggaaatctctcgtcgtcgcggcaatgtctggaagaggcaagggaggtaagggattgggcaagggcggcgccaagcgccaccgcaagcatctccgcgataacatccagggcatcaccaagccggcgatccggcgccttgcccggcgtggcggcgtcaagcgtatcagcggcttgatctacgaggagacccgaggcgtcctcaagatcttcctggagaacgtcatcagggatgcggtcacctacaccgagcacgccagaaggaagaccgtcaccgccatggacgtcgtctatgcgctcaagaggcaaggcaggacgctctacggatttggcggctagaagaagaaaattagaagctctccatctccttggaaaatttctagttttcctcgatttctaactggtagacaaggaagaaatattttcctttgcattccatccaccactttgtaatattcgaatctaatgtagaatcttaaatcggaaaaaaa

SEQ ID NO: 934 - DNA, 504 bp, Artificial
  Synthetic
gtcgatagcactagcagcgccttctctcctctcctctccaagtaagtagctcttcttcgatcggctagaggcaatgtctgggcgcggcaagggcggcaagggattgggcaagggcggggccaagcgccaccgcaagcatctccgcgataacatccagggcatcaccaagcccgcgatccggcgccttgcccggcgtggcggcgtgaagcgcatcagcggcttgatctacgaggagacccggggcgtgctcaagatcttcctggagaacgtcatccgcgacgccgtcacctacacagagcatgcccgccgcaagaccgtcaccgccatggacgtggtatatgcgctcaagaggcagggccggaccttgtacggatttggcggctagaaaaattcttcttttggatagggaagaaactgccatagctcttcctggcattggaatttgtaaattttgttctctttgactatctttctggaaatttaaagtatgatcttgtactgttc

SEQ ID NO: 935 - DNA, 387 bp, Artificial
  Synthetic
gggcccacgcgtccgcccacgcgtccgaaacaatgtctggccgaggaaaaggtggtaaaggacttggaaagggtggcgctaagcgacaccgaaagattcttcgagataacattcagggtatcactaagcccgccatccgacgtcttgcgcgacgaggtggtgtgaagcgaatttccgcccagatctacgaggagacccgaaacgttctcaagtctttccttgagtctgttattcgagacgccgtcacctacactgagcacgccaagcgaaagactgtcacttctcttgatgttgtctacgctctcaagcgacagggccgaaccctttacggtttcggtggttaattatttatattatatatgatattggaatggatttattatactg

SEQ ID NO: 936 - DNA, 588 bp, Artificial
  Synthetic
tggtgcgaaaaacgtcattttgcaaagtgacgcgtttataacggatttctatatcttccgactttttcacattttaatacattcatcatgactggccgtggaaagggtggcaagggcctgggcaagggcggtgccaagcgtcaccgaaagattcttcgtgacaacattcagggcatcaccaagcctgctatccgacgtctcgctcgtcgtggtggtgtcaagcgtatctctgccatgatctacgaggagacccgcggtgttctcaagtccttcctcgagggcgtcatccgcgatgccgtcacctacactgagcacgccaagcgcaagaccgtcacctcgctggacgttgtctacgctctcaagcgacagggccgcaccctctacggtttcggtggttagagcgttggacgcgttgttttctgctgtctgcgcggtggcgatgtggagctggggttatctgtgcaaataacatggactcttctgtactttgatcgattggcgttgggggaatgggcttacgaggaggcgtcatggtagacgaccttataaatgagaataccacatgaatacaaatacgataatcatttg

SEQ ID NO: 937 - DNA, 602 bp, Artificial
  Synthetic
ggtttaccatctgcatctctttttgatatctcaaaactccccaaacaacccacatcaatcatcatgactggacgcggcaaaggtggcaagggcctcggcaagggtggtgccaagcgtcaccgcaagattcttcgtgacaacatccagggtattaccaagcccgctatccgacgtctcgctcgtcgtggtggtgtcaagcgtatctctgccatgatctacgaggagacccgtggtgtcctcaagtccttcctcgagggtgtcatccgtgatgccgtcacatacactgagcacgccaagcgcaagaccgtcacatcactagacgttgtctatgctctgaaacgacagggccgcaccctgtacggtttcggtggttaagcgatctgccactaggtcgggtcgacataatgtgttattcgcgtgtttgttacgattgggcttttcactatgggcgcgggtcattgctttttgagattttgtactgtacaacgtactgggaaatgggtgacccccgaaagggggtaattgagacttattcagtggtgaccttgaaataaagcatcacatatactctacaagtaaaatctttctgcctgattgtgaat

SEQ ID NO: 938 - DNA, 532 bp, Artificial
  Synthetic
aattcaaatctaaaaccctagaagcttcttttatcttcaaatttctgtgtgaaaatgtctggtcgtggaaagggaggaaagggattgggcaagggaggagctaagaggcacaggaaggtgctgagggataacatccaaggaattacgaagcccgcaattcgtcggttggctcgtaggggaggtgtgaagcgtatatctggtctgatctacgaagagacacgtggagtgctgaagatctttctagagaacgtgattcgtgatgctgttacctacaccgagcacgccaggagaaagactgttactgctatggatgtcgtttatgcactcaagaggcagggcaggactctctatggatttggtggttaggttgtttaggtgtgattttaggtaactgtatttgtagtaattgtagattttctggaatttctgttgtctctttgttggtttctccgcagctttgttctagttgttgttcttaaggtcttgataatgtaatttctcattacagattcaaggaacaaagttcattttc

SEQ ID NO: 939 - DNA, 595 bp, Artificial
  Synthetic
aacacatttttcctcatttcaaattcaaaaatccccaaaaatctagtttcacaatgtcaggaagaggaaagggtggaaaaggattgggcaaaggaggagctaaacgacaccgtaaggtgcttcgtgataacatccagggaatcacgaaacctgcaattcggcgtttggctcgtagaggaggagtgaaacgtatttctggtttgatttacgaggagacacgaggtgtattgaagatatttttggagaatgtgattcgtgatgctgtgacttacaccgaacatgccaggagaaagactgttactgctatggatgttgtttatgccctcaagaggcagggaaggactctctacggatttgggggttagatttgtctaattagagtttttgtggggtaatgattgtagatttgttctttactatctgatgtattagggttggttagtttttgttgagattttataatgtaattctctattacatactcaggaatagtaattgcccaaaaaaaatctaacaagcttctagtagtatatataacaagctcgcattcttaaaatcataaatcttggaacaaggttttttcttttctttctag

SEQ ID NO: 940 - DNA, 646 bp, Artificial
  Synthetic
cccgactccaatcaccaccacctcttctccaattccactcgcttttctctctctctcgtgcgtcgagccaccggaatcgtcgtcgtcggcggccatgtcggggcgcggcaagggaggcaaggggctcggcaagggcggcgccaagcgtcaccggaaggtgctccgcgacaacatccagggcatcaccaagccggcgatccggaggctggcgaggaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtaaagagacccggatgtgccacgggtgggtttttagtagtaggattagtagtatcccaactcctggttgtgatttgctcatttccatagatgtaatgacattacgatttcaatcgtagcaaaattatttg

SEQ ID NO: 941 - DNA, 430 bp, Artificial
  Synthetic
ggtcgaaacctgtgcttcctcctccctccggtatttcacgtgggccttgcccttattctcagagtccagctgagaaaacaaaaagaatttctttttgttttggaaatagggagacgctcatcgttcaattcgtcctccaacacagaccggagcaatggacgaaaagcacagcggctcgggtcgcaactcgaccgatgtccgtgacaccgaaatgccattcgctggcgaccaggttgtttggccgccgcacacaactgagcggcgcctgatgggaaagatcgacatgcgagtcgtgccgtttctctggatcatgtacctggttggattcctggatcgtgtcaatattgccaacgcaaagctatttggtctcgctggtggtctggatctcggcactggcgacaagtacaacacggccctggtcatcttcttc

SEQ ID NO: 942 - DNA, 657 bp, Artificial
  Synthetic
gctgcattttggggtcgcaaatctacagcaaaaatggcctcgacaacgaccaagcagaccccggcgtcctttgtcgggaccagcaaggtcgtcgagactgactatccgctcatcgacaacgaccctcactttaagcgggttatcggatatgcgagaacgtcagactacgtagctggtgcaacctctgcggcctttgcaccgactgctctctatgccctcgagaggctcgccccgtcgcatgttggccggggaggctttgccaaagccatgcggttagccggattcattggcttggccggcggtttcctctacttttaccagcgatcagcccttcgattctacggcgccactgagaactcaagggaagtcgagatggatatgcgagagatggtttccaaggtcaaggcgggacagcctctgtatggcgagagcaagctgagccctcacctgcagggagttgcggcccgacagagcagatactctgcgctctttttcagcacagtaccgtggttcaactttgtcaaccacaaccagcacggcgtggacacggccaagtactatcagcaggccgagagggaactggaagcagagcgggcggcgggcaagagctagacgggaccaaatgtgtatatttagcgggactaccgcttcttgcgg

SEQ ID NO: 943 - DNA, 667 bp, Artificial
  Synthetic
gggggctaagctctcagcaaccatgggtatctcacgagattctatgcacaagaggcgtgccactggtggcaagaagaaagcttggaggaagaagcgaaagtatgaacttggccgccagcctgctaatactaagatctcggctaacaagacagtccgacgaattcgtgtgcgtggtggcaatgtgaagtggagggcactgagattggataccggaaattactcatggggtagtgaggcagtcacacgcaagactcgtatccttgatgtggtttacaatgcctcaaacaatgaacttgttcgcacacaaactctggtcaagagtgctattgttcaagttgatgctgcgccatttaaacaatggtacctccagcattatggtgttgacattggtaggaagaagaagggccctgctaagaaggaaactactgaggaaggagaaggtgctgctgccgctgcagaggaaactaagaagagcaaccatgttctccggaagattgagacacgtcagaaggatcgtaaacttgatcctcatatcgaagagcaatttggtggtggtaggctgttggcctgtatctcttctcgccctggtcaatgtggcagagcagatgggtacattttggagggaaaagagcttgagttctacatgaagaaactacagaagaagaaa

SEQ ID NO: 944 - DNA, 694 bp, Artificial
  Synthetic
cgctctcctcccccccgctagttcccaaccagcagctgcggcggcgcgagcacacgaagaggaggcggagcagccggagccacctccgccgccgccgccaccatgggtatctcgcgtgactccatgcacaagcgccgggccaccggtgggaagcagaaagcgtggaggaagaagcgaaagtatgagcttggtcgccagccggcaaacaccaagttgtcgagcaacaagacagtgaggagggtccgtgttcgtggaggaaatctgaagtggagggctcttcgcctggatactggtaactattcttggggaagtgaggctgtcactcgcaagacccgtatccttgatgtggtctacaatgcgtcaaacaatgagcttgtgaggacccagacccttgtgaagagtgccattgtgcaagttgatgctgccccattcaagcagtggtatctcactcactatggtgtcgatatcggtaggaagaagaaagctcctgctgctaagaaggatgctgctgagggacaagagggtgaggctgccacggaggaagcaaaaaagagcaaccatgttgtgaggaagcttgaaaagcgtcagcaaactcgcactctggactcgcacattgaagagcaatttggcagcggaaggctcttggcctgcatctcctcccggcctgggcaatgtggcagagctgatgggtaca

SEQ ID NO: 945 - DNA, 878 bp, Artificial
  Synthetic
gccgacaagtcgattgccctggtgagcaccattatcatcagaaaccgcaatcatgggtatctctcgtgactctcgccacaagcgctccgcctccggtgccaagcgcgcctactaccggaagaagcgcgctttcgaggctggccgccagggtgccaacaccaagattggcgccaagcgaatccacaccgtccgcactcgtggtggtaaccacaagtaccgtgccctgcgtctcgactccggcaacttcgcctgggcctccgagggctgcacccgcaagacccgtgtcattgccgtcgcctaccacccttccaacaacgagctggtccgaaccaacaccctgacccgtagcgccatcgtccagatcgacgctgctcctttccgacagtggtacgagtcccactacggccagcccatcggccgtagacgccagaaggcccaggccgccaaggagggcaaggaggtcgaggaggtcaagaagagcaagtccgtcgagaagaagcaggctgctcgctacgccgccaacggcaaggtcgagtccgctgttgagaagcagttcgaggccggtcgtctgtacgccgttgtcaccagccgtcccggccagtccggccgctgtgacggttacgttctggagggtgaggagctggctttctaccagaagaagctgcacaaataaactcacaatggcgtgagttggatggtgttcaaggattttttcgttatcttgggcattttcagggcatgaagagctttctaacacacaaagcatcggaacgggtccatagggaaatgaaaagcttttctgcaatcatgttacttttttcacgttgtttcattcaagtatgataatgatacaagaaacaaaacaattcaacacacct

SEQ ID NO: 946 - DNA, 672 bp, Artificial
  Synthetic
ggaggaggcgccgcatcgtcgcggatcgatcagtcatgggtatctcccgcgattcgctccacaagaggagggctaccggtggtaagaagaagcaatggaggaagaagagaaaatacgagctggggaggcagccggcgatgaccaaactggcggccaagacggtgcggcgcattcgtgtccgtggtggcaaccataagctccgcgctctgaggctggacgctgggaactactcgtggggaaccgaagccgtggcccggaagacgaggatcttggaggttgtctacaacgcctccaacaacgagctcgtccggacccagacgttggtgaagagcgccatcgttcaggtggacgcgactcccttccgcgcgtggtacaaccagcactacggcatcgacctctcccgcaagaagaagactgccgccaagaaggacaaggaaggcgaggaagctacgaccgaggcagcgaccgaagaggagaagccgaggagccagaacgcgctccgaaagcttgcgaggagggccgacggccacaagatcgacccgcacattgaggagcaaatggcgagcgggaggctccttgcgagcattgcgtctcgccccgggcagtgcgggcgtgcggacgggtacattctggaaggtaaggagctggagttctacatgaagaagatcagaa

SEQ ID NO: 947 - DNA, 622 bp, Artificial
  Synthetic
gcgagactcccgacacaagcgatcccacaccggcgccaagcgtgtctccatccacaagaagcgaaagttcgagtgcggtcgacagggtgccgtcacccgaatcggccccaagcgaatccacaccgtccgaacccgtggtggtaacaagaagttccgagccatccgaatcgagaccggcaacttctcctggggctctgagggaaccacccgaaagacccgagtcctcggtgtctctttccacccctccaacaacgagcttatccgaaccaacactctgaccaagtctgccattgtccagattgatgccactcctttccgacagtggtacgagtcctactacggcaagtctctcggcaagaagaaggctggccaggaggagcccgtcattgctgaggctgaccaggctgccgttgctgcccgacaggctgatgccaagctcgaccctgccgtcgaggctcagttcggtgctggccgactctacgcctgcgtttcttctcgacccggtcagtccggccgagttgacggttacgttctcgagggagaggagcttgctttctacctcaagaagattgtctccaagaagtagacacaaaactaaaatgtattattgcacgtgaaaaaa

SEQ ID NO: 948 - DNA, 612 bp, Artificial
  Synthetic
gacccacgcgtcgggactgccacgccatgggtatctcacgagattcagtgcacaagaggagggccactggagggaagaagaaggcatggaggaagaagagaaagtacgagatgggccgtcagccagcgatgacaaagctgtcaagcaacaagacagtgcggaggatccgagtgcgtggtggtaacttcaagttcagggctttgcgtcttgacactttaaactactcctgggggtcagaggccaccacccgcaagtcgaggatcctggatgtggtctacaatgcctccaacaatgagcttgtcagaacccagactctggtcaaaagtgccattgtccaagttgatgcgacccctttcagacagtggtacagtcaacattatggcctggatattggccgcaaaaagaaatccagcagcgctgccaagaaggagactgaggagggtgatgctggagatgaggaaaacaagaaaagcaagcatgttctgcgaaagctaacaaagaggcaggaaggtcagaagcttgactctcatctagaggatcagcttgcaagtggtcgtctcttggcatgcatttcgtcccgcccgggacagtgtggccgagctgatgggtaca

SEQ ID NO: 949 - DNA, 357 bp, Artificial
  Synthetic
gtcggcagccctaggatacttacgtggccggcaacaatgggtctctctcgggattcgatgcacaagagacgtgccaccggaggcaagaagaaggcgtggaggaagaagagaaagtacgagcttggaagacaggctgcaaatacatattttgtgcctaattctaagactgttacgaggataatggtccgaggaggcactgtgaagtggcgtgctttgaggttggacactggaaacttgtagtggggcattgaggctgttactaggaagactcgattattggatgtggtgtacaacgtctaaaacaatgatctggttaggacacacactctaatgaacagtgcaattgttcaatttgat

SEQ ID NO: 950 - DNA, 337 bp, Artificial
  Synthetic
cccctccacccacgcgtgcgcttttggagaaaccctaatcggcgacaatgggtatttctcgtgactctatccacaagaggcgtgccactggaggcaagcagaagcaatggaggaagaagcgaaagtatgagatgggaaggcagccagccaacaccaagctctcaagcaacaagacggtcagaagaataagagttcgtggtggaaatgttaagtggcgtgcgttgaggctcgatactggtaactactcgtggggaagtgaagcaactacccgcaagaccagagtccttgatgtggtctacaatgcctccaacaatgagcttgtacgtactaagacact

SEQ ID NO: 951 - DNA, 597 bp, Artificial
  Synthetic
cccccgagcgaggcacagctaccggcggcgcagccacacagcagcagcaggtgaggaggagaggagacccgccgccgccgccgccatgggtatctcgcgtgattccatgcacaagcgccgcgccacgggcggcaagcagaaggcatggcgcaaaaagcgaaagtatgagctcggaaggcagcctgccaacaccaagctgtcaagcaacaagacagtgaggagggtgcgtgtccgtggaggtaatgtgaaatggagggccctccgtttggatactggcaactactcatggggaagtgaggccgtgacccgcaagacccgtatccttgatgtggtctacaatgcatccaacaatgagcttgtcaggactcagacccttgtaaagagtgctattgtgcaagttgatgctgcccccttcaagcagtggtacctcactcactatggagtggatattggtagaaagaagaaggctcctgcagccaagaaggatgctgaggggcaggatgctgaagctaccacagaggaagcgaagaaaagcaaccatgttgtcaggaagcttgagaagcgccaacagggacgcacacttgacgcccacatcga

SEQ ID NO: 952 - DNA, 621 bp, Artificial
  Synthetic
aattcgtgatcgcggaagggacgactccagataccctcaacgccccgacaacccccaagtcacagcagccatgaggtacattcactctcaggagatcctggaaattccagagggcgtcaaggtcaacatcaagacccgtatcgtcaccgttgagggtccccgaggcaagctcaccaagaacctcggtcacttggctgtcaacttcggtcaccccaagaagaacaccatctccatcgagatccaccacggcaaccgtaagaatgtcgccactctccgtaccgtccgctccatcatcgagaacttgatcaccggtgtcaccaagggcttcaagtacaagatgcgatacgtctacgcccattttcccatcaacgtcaacctggacaagaacaaggagaccggtctgttcgaggtggagatccgaaacttcatcggcgagaagatcgtccgacgggttaccatgcacgagggtgtcgatgttgagatctccaaggcccagaaggatgagctcatcctgaccggcaactcactcgagaacgtttcccagagcgccgcagatatccagcagatctgccgggtgcgcaacaaggatatccgaaagttcttggacggtctgtacgtttc

SEQ ID NO: 953 - DNA, 711 bp, Artificial
  Synthetic
gccggtaggcagtagtgagcgcagaagcagggagagacacaaaaaatgaagactatactctcatcagaaacgatggatatccccgatggggtgaaaatcaaggtaaaagcaaagcaaatagaagtggagggaccaagaggaaagctaacccgcaacttcaagcacttgaatcttgattttcagctcataaaagatgaagaaactggaaagaaaaagctcaagattgatgcttggtttggatctcgtaaaaccacagctgctattcgcactgctcttagtcacgttgataatctcataactggtgtcacaaaagggtaccgttacaagatgcgttttgtttatgcccattttcctatcaatgcttctatcactggtgggaacaaggctattgagatcaggaactttctgggcgagaaaagggtgaggaaagtcgatatgcttgatggggttactgttgtgaggtctgagaaagttaaggatgaattggtattggatggaaatgacattgagcttgtttctcggtctgctgccctcatcaatcagaaatgccatgtgaagaacaaagatattcgtaagttcctggatggtatctatgtgagtgagaagggaagaatagccgaagaagagtaagttttagcagattggttgggggttgtttggggatcatctgctgatttcatacgaactcatatttgaagttaattcaacaat

SEQ ID NO: 954 - DNA, 619 bp, Artificial
  Synthetic
ttttagcgatcgccattttcacacacacagaaggagagcggaagagagaaactaagacaagatgaagaccattctgtcatcagaaaccatggatatccccgacggcgtgagcatcaaggtgaaggcaaagcaaatcgaagtagagggaccaaggggcaaacttgtccgaaacttcaagcatctcaacctcgattttcagctgatcaaggatgaggaaactggcaagaagaagctgaagatcgacgcttggtttggttctcgtaagactaccgctgctatccgtactgctcttagccatgttgagaatctcatcactggtgttaccaaaggttaccgctacaagatgcgtttcgtgtatgctcactttcccatcaatgcctccatcaccggtggtaacaagtccattgagatccgtaacttccttggcgagaagagagttaggaaagtggacatgcttgatggggttacagttgttcgatctgagaaggtgaaggatgagcttgtattggatggaaatgacattgagctcgtttctcgctctgctgccctcatcaatcaaaaatgccatgtgaagaacaagggatatccgaaagtttcttgatggtatctatgtcagtga

SEQ ID NO: 955 - DNA, 554 bp, Artificial
  Synthetic
caacacaatgaaattcatccagggcgacgttctgctcgatatccccgagggtgtcaccgttgacatcaaggaccgacaaatcatcgtcaccggcccccgaggtaccctcaagaagaacctgtctcacatcaacgtagccttcgctaaaggtctccgatgaccatatcaagatcaccatctacgatggtgaccgaaggcatgtcgctgctctgcgaaccgtcaagaccctcatcaacaacatgatcaccggtgtcacccgatgttacaagtacaagatgcgatacgtctacgcccatttccccatcaacgtcaagctcattaaggacggttccgtcgttgagatccgaaacttcctcggtgagaagcgattcctctaattccccatccacgagggctgcagcgctgagatctctaccaaccagaaggatgagatctgcatcatcggtaactccatcgagaacgtctctcagacctgtgctgacatccagcagatctggcgagtccgacacaaggatatccgaaagttccttgatggtatctacgtttccgagaat

SEQ ID NO: 956 - DNA, 651 bp, Artificial
  Synthetic
ggcaggccgtcttcgttgggcattgttgcgaggaggaggaggcgggcgcgatgaagacgatcttgtcggcccagacgatggacatccccgagggggtgaaggtagagatccgggcgaagcagatccgggtgacggggccgcggggggtgctgcacaggaacttcaagcacctcaacctcgacttccagctgctggagaatgggcgcaagctcaaggtggaggcgtggtttggttcgcgcaagaccatcgccgccatccgcaccgccgtgagccacgtgaagaacctcatcaccggcgtcaccaagggcttccagtacaagatgaggtttgtctacgctcacttccccatcaacgccaacatctccgccaccaagcagaacatcgagatccggaacttcctcggcgagaagagcgtgagaactgtcgacatgcttccgggtgtgactgtgaccaggacggagaaggtcaaggacgagctcgttctcgaggggaatgacatcgagcttgtgtcgagatcggccgctctgatcaaccagaaatgccatgtcaagaacaaggatatcaggaagttcttggatggtatctacgtgagcgagaagggaacgatcgctgtggaggagtagaccccttgcctgttctgagtataatttt

SEQ ID NO: 957 - DNA, 718 bp, Artificial
  Synthetic
ggattaatcgcaactccgagatcctgctgaatcacaatgagacctactcaggttcgtctgggcggcggcgcccctcaacccaagactggccactggctcggtgactggggctcctttggtgagtgtgctctacttgacgaacgattgcatcagaccacccgcgaaagagactttgaggacgcaaggaaccggatggtggagggaagatgaggacgattcaatgggccgatatcttgattcagctggagcaattgaggcggaagacattgaacacgctacggagcaacaattggatcaggaattgcgtcgaaggacccgtcgggacgaactacaaagattgaaggagtcactcgcatgctaacatatgatgctataggtggtgccaagcagaagggcattatcgactacggcctgtctgccaaccgtcagaacccctttgccggtgctgcccacgatgccatcttcaacaccttccgccgcaccaagtcccagatcttctactggctccctcctatgctggctggctactacctgctgagctgggccaccgagcgaaaccactacctcaactccaaggctggccgtgctgagtttgccgactcggagtaaaatggtgcacgaatatgttgaattatgggtgtccaggggacacagtgtatatcagcgtctagattaggagaaaacaatagaaacgtttgactctaaaaaaaaaacaaaa

SEQ ID NO: 958 - DNA, 796 bp, Artificial
  Synthetic
gggagaccatggcctctgtccgatcggctgtgagagcattgccccgcaaaacggcagcaggataccagtccagctattacccctccatccccagacccagatctctgtcttcattttcatctttgtctttgtcttcatctttgcatcgttcgggccctccgtccttttctccgagtcacgcacagagacaccagctagccacgatgtctacgcaagccgcgcacccggccctgctcatcccagggcccattgagtttgacgatgctgtgctccagtccatgagccacttcagcgagtctcatgttggccctggcttcgtggccacctttggcgagactctgagcatgctccgccagctcttccagaccaccgatcctgcctctcagcccttcatcctcagcggttccggcaccttgggttgggatttggtgtctgctaacttgattgagcccggcgaggacgctttggttctaagcaccggctactttggcgacagcttcgccgactgcctggctacctacggagccaagcccaccaagcttgagggaccaattggcggacgaccccagttcccggagatcgaaaaggcattgtcggagaagaagtacaagctcgtcaccgtcacccatgtcgacacctctactggcgttgtgagcgacctgaagggccttgtccaggctgtcaagaaggtctctcccgaaacattggtcgtcgccgatggcgtctgcagtgtagcttgcgaggagattgctttcgacgactggggcttggacggtgtcatcactgcaagccaaaa

SEQ ID NO: 959 - DNA, 692 bp, Artificial
  Synthetic
atttggcaattcctcaagctcacccatttgttgactctggcagtgtagcacacagtctgctcaacaaaccacatcaccatgtccgccgaagagaagaccacggtggcgaccgacgtcgcaaatccccccagtcgcgagcatgaagttgtccacggcgacgagagcaatgtcgacgtgcctctagatttgcccgcaggatggaagtacaggcagattagccttttcggctacaagatgccttggtacgcgtcgccccgtgtccagctcctcatggttgcttttgtctgcttcatgtgtcctggcatgttcaacgcgcttggtggtttgggaggtggtggtcgtgccagcgcgaccttggctgacaacatgaacaccgccctctacagcgcatttgctgtcttcggattctttggtggcaccatcgttaacaaactcggtgttaaatggacactcgctttcggcggcatcggctatggtatttacgccatcagcctgctggtttccctccataagaccgaacagggtttcagcattttcgctggtaccttccttggtatctgtgccggtcttctatggactgctcagggcaccatcatgatctcctacccaaccgagaaagagaagggccgatactttgcctggttctgggctatcttcaacatgggcgctgtcgtgggcagtcttattcctct

SEQ ID NO: 960 - DNA, 99 bp, Artificial
  Synthetic
aattctggatctgcttgagccttctttcttcactgtccgctcccaattgtcgcctcggttccacggcttcggattggaacacgcgcccacagacagaac

SEQ ID NO: 961 - DNA, 429 bp, Artificial
  Synthetic
atcgtcccttcggttgcacggtttcagatgggaactcgcgcccacagatacaaatcgccgtatcccatcgaacgtcaaactctactgagcttatatcaattagtactatgccgtcttcgaatatttccagaaaaagacatctgcctttctataaaatcaattaggaaagaatagccagttcttcaccatggatgatgatgacaatcatgtagcatggcctgtcattacagacgtctcccccgtccagtcctatgcggctgcccacaaggagtttcataagcggcttcccggatggatttacaagggccaccacatctttggttgggagatgtactatgcctcatccatagtgcaattcatgatggttgatctcgtgtgtatcctctgccgcgggatgtacaatttcttgactggtctgggatgtggtgg

SEQ ID NO: 962 - DNA, 562 bp, Artificial
  Synthetic
ggcgctatggcgctatggccttccccgcctacggaccccactagggcaggtcatgctcatcggcgccgtctgcttctgctgcccgggtatgttctccgcactcaccggcatgggcggcggcggccaggtcgacccccacgccgccgatcgcgccctcaccgccctctacgccgcattcgcggtcttcggcctcctcggcggcgggttcaacaacatcctgggcccgcgcatcacggtccttgccggcagcgtcttctacgccctctacgtcgcgtcgttcctccgctacaaccacagccgcgacgaaggcctcgtcgtcctcgccgggggatttctagggtttggggcagggcttctgtgggcggggcagggttcgatactcatgtcctaccccccagagcgagataaaggtttgtatatatccatcttttggagtgtgttcaatatggggggtgtggttggcggacttatacctttcttcctcaactttagctgcgatagaagctcgtctcactcggtgaacgacaccacctacatcgtcttcgtggtggtgatgctgtgt

SEQ ID NO: 963 - DNA, 604 bp, Artificial
  Synthetic
cgagtactagtcacaccacacgcttggcttgacgccgcacgcctccgctccgctccgccgccgcggccgatctctctagggcttccaacctcgccggcgacgcgacgccacgccatggccgccccggtcgtggacgccgagtacctccgccaggtcgacagggcgcgccgccacctccgcgccctcatctcctccaagggatgcgcgcccatcatgctccgcctcgcatggcatgacgcgggcacttatgacgtgaacacaaaaactggtggtgcaaatggttcaattagatacgaggaagagtacactcacggttcaaatgctggtctaaagattgctattgatcttctcgagcctattaaagccaagagccctaagatcacatatgctgacctttatcagcttgctggagttgttgcagttgaagttactgggggtccaactgttgagttcattcctggaagacgtgattcgtcagtttgcccccgtgaagggcgtcttcctgatgctaagaaaggtgcactgcacttgagggacatcttttaccggatgggcttatcagacaaagatatagtagctttatctgggggtcacactctgggaa

SEQ ID NO: 964 - DNA, 648 bp, Artificial
  Synthetic
cttatcctcattcacctttcctccagcaatggcgaagccaatcgtcgacacggagtacctcaaagaaattgagaaagctcgtcgcgacctccgcgctctcatctccagcaaaaactgtgctcctatcatgcttcgcttagcatggcacgatgcaggaacgtacgatgctaagtctaagaccggtggaccgaatggttccatcagaaatgaggaagagttcagtcacggtgctaataatggattaaaaatcgctcttgacttttgcgaagcagtgaagtctaaacatcaaatgataacgtatgcagatttgtaccagcttgcaggagttgttgcagttgaagtcactggtggtccgaccattgattttgtccctggtaggaaggattccagtgtttctccaaaggaaggacggctgccagatgctaaacaaggtgtgccacatctgaaagatgtattttataggatgggtttgtctgacaaagatatagtggcactatctggtggtcacacactgggaagggcacatccagatagatcaggctttgatggtccatggacaaaggagccactgaaatttgacaattcatattttgtggagctgcttaagggggaaactgagggcctgctgaaacttgctacagacatagc

SEQ ID NO: 965 - DNA, 879 bp, Artificial
  Synthetic
cccggcccaagcctttcgagtcgtcttctccccttcttctcctcctcctcctcgattcggagctccacccgcagccatggctaagaactaccccgtcgtgagcgccgagtaccaggaggccgtcgagaaggccaggcagaagctgcgcgccctcatcgccgagaagagctgcgcccctctcatgctccgcctcgcgtggcactcggcggggacgttcgacgtgtcgtcgaagaccgggggcccgttcgggacgatgaagaccccggcggagctgtcgcacgccgccaacgcggggctggacatcgcggtgcggatgctcgagcccatcaaggaggagatacccaccatctcctacgccgatttctaccagcttgccggagttgtggccgtcgaggtgtccggtggacctgccgtccccttccacccaggaagggaggacaaacctgcacccccacctgagggccgtcttcctgatgctaccaagggttctgaccacctaaggcaggtcttcggtgcgcagatgggcttgagtgatcaggacattgttgccctctctggcggtcacaccctgggaaggtgccacaaggaaagatctggttttgagggaccttggacaagaaaccctctgcagtttgacaactcttacttcacggagcttctgagtggtgacaaggagggccttcttcagcttcctagtgacaaagccctgctgagtgaccctgccttccgcccactcgtcgagaaatatgctgcagatgagaaggctttctttgaagactacaaggaggcccacctcaagctctccgaactggggttcgctgatgctgcgccgcttatccgtatgatgttccggattatgccgagcatctacaaacagct

SEQ ID NO: 966 - DNA, 737 bp, Artificial
  Synthetic
gaggagagggagagaatgccggtgccggtggtggacaatgcgtacctcaaggtgatcgagtcggcgaggcgcgatctccgcgcgttcattgcggagaagaattccgcgccactgatgcttcgattggcatggcacgatgccgggacgtatgatgctgtgtccaagactggaggaccgaatggatcgatccggagcgagcgcgagtatacccacgctgccaacaatgggatcaaaatcgccatagacttttgtgagcctatcaaacagaaatatcccattatcacgtatgctgatctctaccagcttgctggcgttgttgctgtggaagtcactggaggtcctacaataaattttgttcctggccgcaaggaatcggtcgctactacacccgaaggacggcttcccgatgctcatctcggggcaaagcatatccgcgatgtcttctacagaatgggtctatctgacaaggatatcgtcgctctctctggtggtcacacactgggtagaggacacaaggaaaggtctgggtttgagggaccctggacatcacagccattgaagttcgacaactcatacttcacggagcttttgagaggagaatcggaaggcctgttgcagttgccgacagacaagtgcttgcttgaggatccatcgttccgtccatacgtggagctgtatgcaaaggacgaagacgcattcttcaaagattacgccgagtcgcacaagaagctatccga

SEQ ID NO: 967 - DNA, 795 bp, Artificial
  Synthetic
cccacgcgtccgccagattttattatccttcctcgaaacgagatccacgattcgttgctgcgatcggcgttattatcgtcagctctctcgtttctgttctgtggttcgatattgctgagtttctaggctaatcttacgaatctgtgaaagtttttgagagatttggcttctgtagctcactcctgcttgatttagagcttagctaagatgacgaagaactacccaaccgtgagcgaagattacaagaaggctgttgagaagtgcaggaggaagctcagaggtttgatcgctgagaagaactgtgcacccatcatggtccgactcgcatggcactctgctggaactttcgattgtcaatcaaggactggaggtccattcggaacaatgaggtttgacgctgagcaagctcatggagccaacagtggtatccacattgctcttaggttgttggaccccatcagggagcaattccctaccatctcttttgctgatttccatcagcttgctggtgttgtggccgttgaagttactggtggccctgacattcctttccaccctggaagagaggacaagccccaaccacctccagagggtcgtcttcctgatgctaccaagggttgtgaccatttgagagatgtctttgctaagcagatgggcttatctgacaaagacattgtcgctttatctggtgcccacactctgggacgatgccacaaggataggtctggcttcgaaggtgcatggacatcaaaccctctaatcttcgacaactcttacttcaaggaactcttgagc

SEQ ID NO: 968 - DNA, 707 bp, Artificial
  Synthetic
gcggacgcgtgggagaggagacgagaggcgagaggcgaggacgcattcttggatctagatcgacaatcagaatgggcaaatcttatcctgcagtgagcgacgagtacctggccgccgtcgacaaggccaagagaaagcttcgcggcttcatcgcagagaagaactgtgccccattgatgcttcgtcttgcatggcattcggccgggactttcgactgtgcgtccaagacgggtggtccctttggaaccatgaagcacgccgaagaactcggccacggcgcgaatgccggcctcgacatcgctatcaagcttctccagccgattaaagaccagtttccggtcctgagctatggcgacttctaccagcttgctggggtcgtcgcagtggagatcactggaggcccggatattccattccatccggggagagtggacagggagacatgccccgtagagggccggcttccagacgcgaccaagggagccgatcatctccgtgacgtttttgtgaagcaaatggggctctctgacaaggacattgtggctctttctggcggtcacactttgggaagagcacacaaggaaaggtcgggttttgagggcccatggacgcacaaccctctccagtttgacaactcctacttcacacttctgctgagcggcgagcaagaaggcatcctgacgctcaagacggacaaggttctggtg

SEQ ID NO: 969 - DNA, 791 bp, Artificial
  Synthetic
tggtatcaacgcagagtggccattacggccggggctcttgagatatgtactagtgtccattctcaccaagaaaccctagccccctaccgtgctcgagctgcttcgttgctaggttgccaattctatctccacaaccatggcggatgttgaagccgatgtgacggcagggcagccaaagaagaggacgttcaagaagtttagttacagaggcgtcgatctcgatgctttacttgacatgtccactgacgagcttgttaagctctttaatgctcgtcctcgcagaaggttccagagaggtttgaagaggaagccaatggccttgatcaagaagctgcgcaaggcgaaacgtgaggcaccaccaggggagaagccagagcctgtcaagactcatctgaggaacatgattattgttcctgagatgattggaagtgtcattggcatctacaatggaaagacgttcaatcagattgaggtcaaacctgagatgattggtcactatctggctgagttctcaatctcatacaagcctgtcaagcacgggaggcctggtattggtgctactcactcatccaggttcattcctctgaagtaatatgggatgtcaggttatttagtgccttcttttactagaattttgatgaaggccacagattatgaaagagttgagtcttaaattgcagtggtcagctgataaatatctatttttagttgtttgttatgaggttcgtttcttagacttttcttttcaaatgctcaatttaggagagggcttgatgctcacaagccatatg

SEQ ID NO: 970 - DNA, 559 bp, Artificial
  Synthetic
ccgcgaaggtcgctgatttccatctccacaaccatgacggacgttgaagccgatgtgacgagtggacagccaaagaagagaacgtttaagaagtttagctacagaggcgttgatctcgatgctcttctcgatatgtccactgatgagctcgtgaagctcttcaatgctcgtcctcgtagaaggtttcagagaggtttgaagaggaagccgatggcactgatcaagaagctgcggaaggctaaacgcgaggctccaccaggtgaaaagccagagcctgtcaagactcacctgaggaacatgattatcgttcctgaaatgattggaagtgttattggaatttataatggaaagacattcaatcagattgaagtcaagcctgagatgattggccactatttggctgagttctccatctcatataagcccgtcaagcacggtagacctggtattggtgctactcactcgtcaaggtttataccactcaagtgatctggtcgagttctctatctcataagcctgtcaagctcggtagagctggtattggtgctactcccccatc

SEQ ID NO: 971 - DNA, 726 bp, Artificial
  Synthetic
gctccaacgaagctttctcccgtcgatcgaatcctcgctcttccgcagctatggcagatgttgaactggagcccggaacagtgcaacccaagaagaggacgtttaagaagttcacattccgcggtgttgatcttgatgccttgctggacatgtcatctgacgagcttgttgagctcttcaacgccagaatccggagaaggttccagcgtgggttgaaaaggaagtcagtggctctcataaagaagctgagaaaggcgaaactggatgcaccagcaggtgataaacctgaaccagtcagaactcatttgcgtaacatggtaattgtacctgagatgattgggagtgttattggtgtctacaatgggaaaacatttaatcaagttgaaatcaagcctgagatgattggtcattatttggctgagttttctatctcctacaagccagtgaagcacggccgtcctggtataggagctactcattcctctcggttcattcctctcaagtaatttggagctagtgatcgtctgccattggatctgcaattcttcattatgctgcagaaggagcagagaagtaggctggctaatatatatttaatgtttttctgagacaacctgacaattttgaaatgtagctgttcctccttattgcatcaagtagtgtgatgaattgtggtaggtagctggtaatgtgctagtatagcatgctcccttaactgtttttttt

SEQ ID NO: 972 - DNA, 625 bp, Artificial
  Synthetic
  misc_feature (587)..(587): The residue at this position can be any nucleotide.
ggaggcgcagaacaaggaggaggaggaggaggagcagccatggcggacaccgaggatgcgggcgctggatccctccagccgaagaagcgtacgttcaagaagttctctttccgtggcgtcgatctggatgcgctgctcgacatgtccaatgattcgcttgtcgagctcttccacgcccgggccaggagaaggttccagaggggtctcaagaggaagcccatggctctcatcaagaagctacgcaaggcgaaacgtgaggccccggcgggagagaagcccgagccggtgcgaactcacctccgcaacatgatcatcgtcccggagatgattggaagcatcatcggcgtctacaacggcaagacgttcaaccaagtggagatcaagcccgagatgatcggccactacctgggagagttttccatctcgtacaagccggtgaagcacggacgccctggtatcggtgctacgcactcgtccaggtttattcctctcaagtaaaaggcgaggttttgtaacgctggtttttgaaacttctttctcgaatgctgaagtttacattgcaagcttagattcttttctctcgtttngccggtgatataagagtaacgtaaaggaatttgcaatc

SEQ ID NO: 973 - DNA, 487 bp, Artificial
  Synthetic
gcgcttctgctgaatcccgaaaggctcgaaccttcaagaagttctcctaccgaggcgttgacctcaaggatctgctcgagatctccaccgacgagttcaaggagctcgtttccgcccgagcccgaagacggttcaaccgaggcctcaacaagaagcctaccattctcatcaacaagctgcgaaaggccaagctcgccgccggccccaacgagaagcccgccgtggtcaaagaccacctgcgaaacatgctcatcttccccgagatgattggctctgttgttggtgtctacaaacggaaagtccttcaccaccgtttgagatcaaagcccgagatgatcggcatgtacctcggtgagttctccatcaactaaaaccccaaccgaacacgggcgacccggtgtctccaactccaagttcattcctctgcgataagggattgcatggtaataaaaatatgtattgtatgattgcacaccaaacaacacaa

SEQ ID NO: 974 - DNA, 603 bp, Artificial
  Synthetic
gcgctcgtcgataccctgcgcgtcgataggcgaatccttggaatcaacacacaaccgcgatcatggctgacgaatacaacgccgaggaggccgctgagatcaagaagagaagaaccttccgcaagttctcttaccgaggaatcgaccttgacaacctcctcgacctctcctctgaccagctccgagatgtcgtccacgcccgtgcccgcagaaggatcaaccgcggcctgaagcgccgccccatgggcctcatcaagaagctccgaaaggccaagcaggaggccaagcccaacgagaagcccgacctcgtcaagacccacctccgagacatgattgtcgtccccgagatgattggaagcgtcattggtatctactccggcaaggagttcaaccaggtcgagatcaagcctgaaatggttggccactacctgggtgaattctctatctcatacaagcctgtcaagcacggtcgacctggtatcggtgccactcactcttctcgtttcattcccctcaaataagaaggttgtggtcttgggtggtttctgcattcacggacatttttgggcgaaaaggactggttttagtagacggaggaaagcc

SEQ ID NO: 975 - DNA, 713 bp, Artificial
  Synthetic
cgaaccgccgccgccgccgtctcctcctcgtcatccaagcagctcgcgcctccgacccctcgcctcgagctccagctctccccaaccccttcaacaatggcggatgtcgaggtcgaggcggaggtggccgcggccggagcgccgaagaagaggacgttccgcaagtacagctaccgcggcgtggacctggacgcgctcctcgacatgtccaccgacgacctcgtccagctcttccccgcgcgcgcccgcagaaggttccagaggggcctgaagaggaagcccatggcgctcatcaagaagctccgcaaggcgaaaaaggatgcacctgctggtgagaagccagagcctgtgaggacccacctcaggaacatgatcattgtgcctgagatgatcggaagcatcgtcggtgtctacaacggcaagaccttcaaccaggttgagatcaagcctgagatgattggccactacctcgcagagttctccatctcgtacaagccagtcaagcacggtaggcctggtattggtgctacccactcctcacggtttatccctctcaagtgagagatcatctgcagctgtttgcgcttccagtatgtagcttgagctgtcgaacaaaactccaaagtactttattaattgcgtgtccaccgagcagccactttttgaaccttggttaatctgatgttatttccccagatattttgaagttatat

SEQ ID NO: 976 - DNA, 619 bp, Artificial
  Synthetic
gtgcttacttcgctgttagtgcaattccaaaccatggcggacgttgaaggtgctgatgttgcggccggacagccaaagaagaggacgtttaagaagtttagctacagaggagtagatctggatgctctgcttgacatgtctacagatgagctcgttaagctcttccctgctcgccctcgcagaaggttccagaggggcttgaagaggaagccaatggctttgatcaagaagctgcgtaaggcgaaacgtgaggctccaccaggtgagaagccagaggttgtcagaacacatttgaggaacatgattattgtacctgagatgattggaagcgttattggaatctacaatgggaaaacattcaatcaaattgaggtcaagcctgaaatgattagccactatttagctgagttctcaatctcatacaagcctgtcaagcacggtaggcccggtattggtgctactcactcttcaaggttcattccattgaagtagtctaaaaaaggttcattccattgaattgattcaggcagaggttttcgttatggtttctagtaatactagtactttattttactgcaattttgatgagaacaatggatgttgatctgtgattagtctt

SEQ ID NO: 977 - DNA, 306 bp, Artificial
  Synthetic
cccacgcgtccgtgtggaaccagaggttgcagcagcaggagttccaaagaagagaacgttcaagaaattcgccttcaaaggagtcgatctcgatgctcttctcgacatgtctaccgatgatcttgtcaagctcttctcttcccgtattcgcagaaggttctctagaggattgacgagaaagcctatggctttgattaagaaactccgcaaggcgaaaagagaggcaccagctggtgagaagccagaaccagtgagaacccacttgaggaacatgatcattgtgcctgaaatgattggaagcatcat

SEQ ID NO: 978 - DNA, 855 bp, Artificial
  Synthetic
ccccccccatctcattacccaacaactcttccagctactgctgctgttacatcttcctgcggtagcgccatggcttcagagaagaaattgagcaaccccatgagagaaattaaggtccagaagctcgttctcaatatctccgtcggtgagagcggagatcgtctcaccagagcagctaaggtcttggagcagcttagcggccaatcccctgttttctccaaggctaggtatactgtgcggtcttttggaatcaggcgtaatgaaaagatagcttgctatgtaactgtcagaggggagaaagctatgcagctacttgagagtggattgaaagttaaggaatacgagttgttgagaaggaacttcagtgagaccggctgctttgggtttggtattcaggagcacattgatcttggaattaaatatgatccgtcaactggtatttatggcatggacttctatgttgtattggagcgtcctggataccgtgttgcccgtcggcgcaggtgtaagtctcgagttgggattcagcacagagtcacaaaggaggatgcgatgaagtggttccaggtcaaatatgaaggtgttatccttaacaagtcctcaaacattcagtgataagcttagaaagccaacttctggatcagtctgtctcctcgcaagtttatgtttatgtattttgttgacctgcatctatatcactcgtagagggaagttttggagagtttctagtagtggcgtatgaggatgttttagttctcattttggctatcagatcaattcaatctttttttggtcattttcttttgttccaattaaatcagattcattgaactccacaatctagtacaatagatg

SEQ ID NO: 979 - DNA, 670 bp, Artificial
  Synthetic
aacccctaatcttgagatggcatcggagaagaagctctcgaaccctatgagggatattaaggtccagaagctagttcttaacatctctgttggtgagagtggtgatcgtctcactcgtgcctccaaggtgttggaacagctcagtggtcagactcctgtcttctctaaggcgaggtacactgtgaggtctttcggtatcaggcgtaatgaaaagattgcgtgctatgtcaccgtgagaggtgagaaggcaatgcagcttcttgagagtggcttgaaagtgaaggaatacgagctgttgaggaggaacttcagtgacactggctgcttcggattcggtatccaggagcacattgatcttggaatcaagtatgatccttctaccggtatctacggtatggatttctacgttgttcttgaacgtccaggataccgtgtggcccgtcgccgtagatgcaagactcgcgttggtattcaacatagagttaccaaggatgatgccatgaagtggttccaagttaagtatgaaggagttatcctcaacaagtctcagaacatcactggttgaagagcttttttttgtcattttgttttgtttcaagttcttatatttaagattctggatagtaaggatttcgtgttgtggtaacctttttgcggccgcaagctcgag

SEQ ID NO: 980 - DNA, 627 bp, Artificial
  Synthetic
gggcgccgcggcatggcggaaaagcagaaccccatgcgggacatcaaggtccagaagctcgtcctcaacatctccgtcggcgagagcggcgatcgtctcaccagggccgccaaggtcctggagcagctcagcgggcagcaacctgtcttctccaaggcccggttcacggtccggtcttttggcatccggcgtaacgagaagatcgcttgctacgtgaccgttcggggcgacaaggcgatgcagctactcgagagcgggctcaaggtcaaggaatacgagctgctgcgccgcaacttcagtgacactggatgctttggcttcggcatccaggagcacatcgacctgggcatcaagtacgatccatcgacgggcatttacgggatggatttctacgtagtgctggagcggcctggctaccgcgttgcgaggaggcggcggtgcaagtccaaggttgggatcaagcaccgggtgaccaaggaggacgccatgaagtggttccagctcaagtacgagggcgtcatcctcaacaagtcccaggccttctgacctgcttgacacataaaaaccaaagccggatgtaacctctcttgtggtgtgttttatatcagcttttttccaaaaaaaaaa

SEQ ID NO: 981 - DNA, 696 bp, Artificial
  Synthetic
cgacccacgcgtccgaacttcatcaccaggtcgactaataacagcagccatggcttccgagaaggcaaacaaccccatgcgggagcttaagattcagaagctcgttctgaacatctccgtcggagagtctggtgacagacttacccgagccgccaaggtccttgagcagctttctggtcaaacccccgtctacagcaaggcccgttacaccgtccgaactttcggtattcgacgtaacgaaaagatctctgtccacgtcaccgtccgaggccccaaggctgaggagattctcgagcgtggcctcaaggtcaaggagtacgagctccgcaagcgcaacttctccgagaccggcaacttcggtttcggtatcagcgagcacatcgatctcggtatcaagtacgacccctccattggtatctacggcatggacttctactgctgcatgacccgacctggtgagcgtgtcacccgccgtcgccgaacaaagaccaagatcggtgcctctcaccgcatcaagcgtgaggagagcatcaagtggttcaagtctcgcttcgatggtatcgtccgataaacggttgaaaacaaaatgggtatttgaatttgcggattgggtcacggcgaaaataaggggaaaactcacatggggcatgtattttctgttgccattgctgcatcagctcgactcttttagtcgag

SEQ ID NO: 982 - DNA, 591 bp, Artificial
  Synthetic
ccccccccccgttttggatcttcttcgcgccatcagtaccctacaactctccctgcagctgcaacatcttccagcagaattgcgatggcttcagaaaagaaactgagcaatcccatgagggaaatcaaggttcagaagcttgtccttaacatctccgttggtgagagtggagatcgacttactagagctgcaaaggtgttggagcaacttagtggtcaatcacctgttttttctaaggcaaggtacactgtgaggtccttcggaatcaggcgtaatgaaaagatagcttgctatgtgactgtcagaggggagaaagccacgcagctacttgagagtgtattgaaagtcaaggaatatgagttgttgagaaggaacttcagtgaaaccggctgttttgggtttggtattcaggagcacattgatcttgggatcaaatatgacccttcaactggtatttatggtatggatttctatgttgtattggagcgccctggataccgtgttgctcgtcgtcgtaggtgcaagtctcgagttgggatccagcacagggtcacgaaggaggatgcaatgaagtggttccaggtcaaatat

SEQ ID NO: 983 - DNA, 754 bp, Artificial
  Synthetic
gacgcagcagcagaccacgtcgcaaaacaaccgcagcaatggccgccgaaaagtccagcaaccccatgcgggagcttaagattcagaagctcgttctgaacatctccgtcggtgaatctggtgacagactcactcgtgccgccaaggtgcttgagcagctgtctggtcaaacccccgtctacagcaaggcccgttacaccgtccgtacctttggtatccgccgtaacgaaaagattgctgtccacgtcaccgtccgcggccccaaggctgaggagattctcgagcgtggcctcaaggtcaaggagtacgagcttcgcaagcgcaacttctccgagactggcaacttcggcttcggtatcagcgagcacatcgatcttggtatcaagtacgacccttccatcggtatctacggcatggacttctactgctgcatgacccgccccggtgagcgtgtcacccgccgccgccgcatgaagagcagaatcggtgcttctcaccgcatcaagcgcgatgagaccgtcaagtggttcaagggccgcttcgatggcattgtccgataaacggtttaaaatccaaaccgaataaaatactttttttttcttgtcttgaaggaaatgggcatggcgaacatttgggggtacaaaggatcatatggtccatgtattcttccgcttgatttttacatcagctcgtaccaaaatttttgagtcgagcaacggcctgagagaccgaccggcgctatgccggcttcaca

SEQ ID NO: 984 - DNA, 660 bp, Artificial
  Synthetic
gatgcgggagatcaaggtgcagaagctcgtgctcaacatctccgtcggcgagagcggcgacaggctcacccgcgcctccaaggtgttggagcagctgagtgggcagagcccagttttctccaaggcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtacgacccctcaacaggtatctatggaatggacttctatgttgtgcttgagcgtgctggctaccgtgttgcccgtcgtcggaggtgcaagtctcgcgttgggatccagcaccgggtgaccaaggaggatgccatgaagtggttccaggtcaagtatgaaggagtcatcctcaacaaggcccaggcgaatacctcttaaaacattttcacctgtaggctcagctgttagaaaagcttttcccttgttgggcagaagttcaccttccaagttttatgttacttgatgaattttccggccagatgtttttgtcaattacctgaaagctaagagcatgatct

SEQ ID NO: 985 - DNA, 572 bp, Artificial
  Synthetic
aaaaatgactgactcctctgccaaccccatgcgagagctgcgaatcgagaagctcaccctcaacatttgtgttggtgagtccggtgatcgacttacccgagccgccaaggtgctcgagcagctttccggtcagacccccgtctacaccaaggcccgatacaccatccgatctttctctatccgacgaaacgaaaagattgccgtccacgtgaccgtccgaggccccaaggctgaggagattctcgagcgaggcctcaaggtcaaggagtacgagctcaaggccaagaacttctctgagactggtaacttcggtttcggtatcaacgagcacatcgaccttggtatcaagtacgaccccaacatcggtatctacggtatggacttcttcgtcatcattggtcgacccggttaccgagttgcccgacgaaagcgatgccgagcttccgttggtatcaaccaccgagtcaccaaggaggacaccatcaagtggttcaagcagaagtacgacgcttccgtcctctaagcgggtcatttttgtatcatatcctcacccatcatgcaaaaataatcca

(The sequence listing continues in the following parts.)

What is claimed is:

1. An isolated nucleic acid consisting of SEQ ID NO: 111 and nucleic acid sequences that hybridize thereto under conditions of high stringency, wherein expression of said isolated nucleic acid in a plant results in a disease resistance phenotype.

2. A vector comprising the isolated nucleic acid of claim 1.

3. The vector of claim 2 wherein said nucleic acid is operably linked to a plant promoter.

4. A vector according to either one of claims 2 or 3 wherein said nucleic acid is in the sense orientation.

5. A vector according to either one of claims 2 or 3 wherein said nucleic acid is in the antisense orientation.

6. A plant transfected with the isolated nucleic acid of claim 1 or the vector of either one of claims 2 or 3.

7. A plant transfected with the vector of claim 4.

8. A plant transfected with the vector of claim 5.

9. A method for providing disease resistance in a plant comprising:
   a) providing a vector according to either one of claims 2 or 3 and a plant
   b) and transfecting said plant with said vector under conditions such that a disease resistance phenotype is conferred by expression of said isolated nucleic acid from said vector.

10. A method for providing disease resistance in a plant comprising:
    a) providing a vector according to claim 4 and a plant
    b) and transfecting said plant with said vector under conditions such that a disease resistance phenotype is conferred by expression of said isolated nucleic acid from said vector.

11. A method for providing disease resistance in a plant comprising:
    a) providing a vector according to claim 5 and a plant
    b) and transfecting said plant with said vector under conditions such that a disease resistance phenotype is conferred by expression of said isolated nucleic acid from said vector.

12. A plant transfected with an isolated nucleic acid according to claim 1.

* * * * *